United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 29

SEQ ID NO: 164489 - protein, 557 aa, Glycine max
  Coding DNA Sequence Number=SeqID_72804
  Gene Ontology: Mol. function=aspartic-type endopeptidase activity; Cellular component=extracellular region; Biological process =proteolysis
  Homolog annotation: Hit_ID=Q9LYS8; Match level="QueryCoverage=95%, HitCoverage=94%, E-value=1e-176, Identity=59%"; Hit description =Putative uncharacterized protein F17J16_130
  Pfam annotation: Domain name=Asp; Domain location=190-552; Score= -84.3; E_value=1.3e-08; Accession=PF00026.14; Description=Eukaryotic aspartyl protease
MVLRVSLILVLLVLHCSCTVESIWGHHNDLNKNGSSLAAVKFPDHAHFNAVSSSTETGCSFSKSEKFEPSVATMASNEDTDGKEGEAFVAAKQHKQSVKLNLRHHSVSKDSEPKKSVVDSTGRDLKRIQTLHRRVIEKKNQNTISRLEKAQEHSKKSYKPPTVAAAAPPEYLSGQLMATLESGVSLGSGEYFMDVFVGTPPKHFSLILDTGSDLNWIQCVPCYACFEQNGPYYDPKDSSSFKNITCRDPRCQLVSSPDPPQPCKGETQSCPYFYWYGDSSNTTGDFALETFTVNLTTPEGKPELKIVENVMFGCGHWNRGLFHGAAGLLGLGRGPLSFATQLQSLYGHSFSYCLVDRNSNSSVSSKLIFGEDKELLSHPNLNFTSFVGGKENPVDTFYYVQIKSIMVGGEVLKIPEETWHLSAQGGGGGTIIDSGTTLTYFAEPAYEIIKEAFMRKIKGFPLVETFPPLKPCYNVSGVEKMELPEFAILFADGAVWNFPVENYFIQIEPEDVVCLAVLGTPMSALSIIGNYQQQNFHILYDVKKSRIGYAPMNCADV

SEQ ID NO: 164490 - protein, 66 aa, Glycine max
  Coding DNA Sequence Number=SeqID_72805
  Gene Ontology: Mol. function=structural constituent of ribosome; Cellular component=ribonucleoprotein complex; Biological process =translation
  Homolog annotation: Hit_ID=P51418; Match level="QueryCoverage=74%, HitCoverage=24%, E-value=1e-10, Identity=69%"; Hit description=60S ribosomal protein L18a-2
MRGGCSSDNGKGKREFHQYQVVGRALPTETDVHPKIYRMKLWATNEVLLEKAKEGKEKQWANVSHQ

SEQ ID NO: 164491 - protein, 99 aa, Glycine max
  Coding DNA Sequence Number=SeqID_72806
MWTTTGEKLAAQLAQASSVRPGEQGCFLQKQQPSGGIFWRAQFFEGVTETYGLRKNTSFRLPPHYGISRIAQACFLLISETSRDFIYLCNKGRQVPQSG

SEQ ID NO: 164492 - protein, 82 aa, Glycine max
  Coding DNA Sequence Number=SeqID_72807
MRVHITKPPSGEGVSLRVPCSTNYQTYQGNPCGVYPDLSSFTGSGVYPDLSSFTGSGVYPDLSSFIGSGVIQTFVTCIKRSA

SEQ ID NO: 164493 - protein, 103 aa, Glycine max
  Coding DNA Sequence Number=SeqID_72808
  Homolog annotation: Hit_ID=A5AK77; Match level="QueryCoverage=57%, HitCoverage=7%, E-value=6e-07, Identity=44%"; Hit description =Putative uncharacterized protein
MAQPPPRERTLREMAAPDFTYESLCIQYPDEDVPYVLKTGLIHLLPKFHGLASEDPHKHMKEFHIVCSIMKPPDVLEDHIFLKGLSSFFRGSGQGLAILPLLQ

SEQ ID NO: 164494 - protein, 116 aa, Glycine max
  Coding DNA Sequence Number=SeqID_72809
MGPLQMQAFRKAYGKILDLTIAEISIEAIASLTQYYDQPLRCFTFGDFELGFNERIGPRKANSKWHSGPTTEVLRRQGEGYGKSRGVSSIYGCISIANLWGSPLSKRGWVGGPSRN

SEQ ID NO: 164495 - protein, 191 aa, Glycine max
  Coding DNA Sequence Number=SeqID_72810
HSGITPNKVANAAELSNDVPKQDPLRELIKTLVDIYDKPVEFVWDLTEFGIPNVNSSLFLTYIDVSEITSGDKWLNIAILQLWTMYMNEWSNGLGYQSVYGFLEPQSIHNAKDRRGQCEEYIEKWLKESQRQLYIGAYLNDAHWQMVVLCPKDNVVVWFCSVRRRPDCIQEINTTADGKVPKTGPQWLELK

SEQ ID NO: 164496 - protein, 122 aa, Glycine max
  Coding DNA Sequence Number=SeqID_72811
  Subcellular localization annotation: CTP_CleavageSite=34; ConfidenceScore=5.46e-01
MTSFSQMQSHFRSQMQSQGLALPLDPLVGPSGPRVSTKESCVVPSGNNPTTGDSDRCGLYIEAKEIVSPEKPPQNPDPKVDDLLYHMTLTIPELFLRPYLGTLADGGHPAQGIPSCLVLFIA

SEQ ID NO: 164497 - protein, 53 aa, Glycine max
  Coding DNA Sequence Number=SeqID_72812
MSPISHNILYFNDQDDDQSHKVVDADYVADFFFPLKNFDLVLQTNMVHRTVVK

SEQ ID NO: 164498 - protein, 143 aa, Glycine max
  Coding DNA Sequence Number=SeqID_72813
MSCSRALSSRWTSVNEELEQLLANVPKHGEWKELTNTMQDVVTPSEAFFHTISAKDQVIEVGKVYVVKWKDVLDRWTALRDFYPLIGDHLVSLHHYGSVTFKVYLIEQKVSCSSLDVSSSMYYFLKDKGWTHLHLEDVAECRL

SEQ ID NO: 164499 - protein, 63 aa, Glycine max
  Coding DNA Sequence Number=SeqID_72814
MHSKIILMMPKNQDSNKFQESRSRFKIQPPRALDRRLQEDWAKDAREGPRVLMSLRADFRAMG

SEQ ID NO: 164500 - protein, 79 aa, Glycine max
  Coding DNA Sequence Number=SeqID_72815
MMFMDCHHQKGGDCGSNDFQDYFDDAKESRVKQVPKIQESSFKNQESRFKIQDSRIKFQESGFKTPDSRIKRRLNQDKY

SEQ ID NO: 164501 - protein, 98 aa, Glycine max
  Coding DNA Sequence Number=SeqID_72816
MYKDNWTQPWPMGSEIYPKVHENPRAFFSSSSPIFLEHLAHCSCDWSLPREDCIMHGDMRCYLMVTPTFGQPVANKPVDAQRLGSSAAPFVVLTREVR

SEQ ID NO: 164502 - protein, 116 aa, Glycine max
  Coding DNA Sequence Number=SeqID_72817
  Subcellular localization annotation: CTP_CleavageSite=56; ConfidenceScore=5.16e-01
MAAVRGAGLDDEGMSSVLALFLDAICKKGIQTTAKRTGSFSSKNSAMNCTWPMEARLSARLSTQNLTKLPGLSESSSLSHRFFIKRMNIHPQKINSLSAISSLNEFFRKTQIFNEY

SEQ ID NO: 164503 - protein, 212 aa, Glycine max
  Coding DNA Sequence Number=SeqID_72818
  Homolog annotation: Hit_ID=Q9AVH2; Match level="QueryCoverage=22%, HitCoverage=16%, E-value=9e-20, Identity=97%"; Hit description =Putative senescence-associated protein
MCPVVGFGPWLGLGKPLVEILPPGQLRGFCPLLAWLGSAVLGYGPVLSFGLVGPLLPPVISFVARILPTLACAPLAKSVPRWVCCDLEGGTIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 164504 - protein, 353 aa, Glycine max
  Coding DNA Sequence Number=SeqID_72819
  Gene Ontology: Mol. function=phosphate acetyltransferase activity; Cellular component=cytoplasm; Biological process=metabolic process
  Homolog annotation: Hit_ID=A8GH25; Match level="QueryCoverage=99%, HitCoverage=48%, E-value=1e-171, Identity=88%"; Hit description =Phosphate acetyltransferase
  Pfam annotation: Domain name=PTA_PTB; Domain location=29-345; Score =637.2; E_value=1.4e-188; Accession=PF01515.10; Description=Phosphate acetylbutaryl transferase
EYVAGFINADWVESLTATSERSRRLSPPAFRYQLTELARKAGKRIVLPEGDEPRTVKAAAICAERGIATCVLLGNPDEIQRVAAAQGVELGKGIEIVDPQVVRDNYVPRLVELRKSKGMTEVVAQEQLEDNVVLGTMMLESGEVDGLVSGAVHTTANTIRPPLQLIKTAPNSSLVSSVFFMLLPEQVLVYGDCAINPDPNPEQLAEIAIQSADSAKAFGIDPRVAMISYSTGNSGAGSDVEKVREATRIAQEKRPDLVIDGPLQYDAAIMEDVAKSKAPNSAVAGRATVFIFPDLNTGNTTYKAVQRSADLISIGPMLQGMRKPVNDLSRGALVDDIVYTIALTAIQSQQAEG

SEQ ID NO: 164505 - protein, 74 aa, Glycine max
  Coding DNA Sequence Number=SeqID_72820
MSFRTVGKLGLCKGGKSVTKVKARVISRKMLMHGWLWKGLYIFGSGRFLADPNGQNLGEIDGDPVLRGMRIKAT

SEQ ID NO: 164506 - protein, 154 aa, Glycine max
  Coding DNA Sequence Number=SeqID_72821
MKMNMNLGSLIPGQISLIAQSNSSWLGFPALIIALCKARGVTSDSLTYESLGPAINLAYIKKNYWNLDDLSVTFPRTQKSRARRSEAPSPLAAPAPPTSAPSTSTLPSPPAAPVLPEPTPGPAPDYAELAGCGLAAGSYEPGGVCSEGGVASPK

SEQ ID NO: 164507 - protein, 266 aa, Glycine max
  Coding DNA Sequence Number=SeqID_72822
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=39%, E-value=1e-135, Identity=79%"; Hit description =Photosystem I P700 chlorophyll a apoprotein A1
  Pfam annotation: Domain name=PsaA_PsaB; Domain location=15-266; Score= -57.6; E_value=1.5e-05; Accession=PF00223.10; Description=Photosystem I psaApsaB protein
PIKTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNW

SEQ ID NO: 164508 - protein, 140 aa, Glycine max
  Coding DNA Sequence Number=SeqID_72823
MGLSQVPRLKKRFYQVKIKSLGVASLKELGQLMGQLQRQTFRKAYGKIWDLTIVEVSTEAIASLAQYHDQPLSQNLDTKIGPGKVSQKWGGWSTKEMFGSKGENLGKSRRMGPVHGHPGAPDLRSGPLSKCRWVGGPGSD

SEQ ID NO: 164509 - protein, 123 aa, Glycine max
  Coding DNA Sequence Number=SeqID_72824
MELLRLNQHEENDKKKKGIALKASSSIQEESDKEDLIDLNEDDDLSLFVKRVDCPIFKKRKEKSEKKNFSEKKMKKAYITWDDNDMESSEDSENEEINLCLMAKSYESDEERINQTCKVSFIF

SEQ ID NO: 164510 - protein, 146 aa, Glycine max
  Coding DNA Sequence Number=SeqID_72825
MMIWKQHAKLVMATARWALKHPIYGIVILRLGVYTNRPNHFISKRPYRGNTGSNRDRRKSLKVYQSHTVRGEKVASAQDFVGNQRERTTLGRGQGSTFSPWVKVYDKLGFWLKACGTAGHDICQGLASGSGIKGMSYIISMIHMQL

SEQ ID NO: 164511 - protein, 46 aa, Glycine max
  Coding DNA Sequence Number=SeqID_72826
MATISNHVITENVRKLIMFKNQFVPRQQDAVDCNCYSQTTKFSLNT

SEQ ID NO: 164512 - protein, 166 aa, Glycine max
  Coding DNA Sequence Number=SeqID_72827
  Subcellular localization annotation: CTP_CleavageSite=48; ConfidenceScore=5.03e-01
IAPTRHPVDPKKSSRALGFPALVTGLFQSYRVPIPPARSCHRDIGITPTKTLSGPGEVQQGPGGLRLQDTQWTRRSPTGSWSCQALITGLCQFYGVLVTSGKGIRPPTNRAFIKKYCVPKQAQGETPHQPGDGRQRATDAPPSPLEFTSAHPQKRLERCLRPMADQ

SEQ ID NO: 164513 - protein, 196 aa, Glycine max
  Coding DNA Sequence Number=SeqID_72828
  Gene Ontology: Mol. function=helicase activity; Biological process =viral genome replication
  Homolog annotation: Hit_ID=Q2R1R7; Match level="QueryCoverage=86%, HitCoverage=10%, E-value=2e-38, Identity=49%"; Hit description=AT hook motif-containing protein, putative
MWYDERISKDRNTTSPKFSLCCGDEKVELPLLQSPPKYLERLLFDGKESDSKNYQCNIRTYNMMFAFTSAGIKLDKSINESRGPPTIRIQGQPCHRIGSLLPMPGKQPKFSQLYIFDTQNEVENRINTMSQHVRIQPEIVSTLSQMLDEYNVHAKSFRMARDKLANTQVDNTQEGILLLKLKMENYKESMNYTLAI

SEQ ID NO: 164514 - protein, 27 aa, Glycine max
  Coding DNA Sequence Number=SeqID_72829
MLAAVKISQTSFLDSDTDHPSLTPQGD

SEQ ID NO: 164515 - protein, 1084 aa, Glycine max
  Coding DNA Sequence Number=SeqID_72830
  Gene Ontology: Mol. function=transmembrane receptor activity; Cellular component=intrinsic to membrane; Biological process=innate immune response
  Homolog annotation: Hit_ID=A7QH65; Match level="QueryCoverage=90%, HitCoverage=90%, E-value=0.0, Identity=38%"; Hit description =Chromosome chr18 scaffold_96, whole genome shotgun sequence
  Pfam annotation: Domain name=LRR_1; Domain location=605-626; Score =3.9; E_value=59; Accession=PF00560.24; Description=Leucine Rich Repeat
  Pfam annotation: Domain name=LRR_1; Domain location=628-649; Score =6.9; E_value=16; Accession=PF00560.24; Description=Leucine Rich Repeat
  Pfam annotation: Domain name=LRR_1; Domain location=651-673; Score =9.8; E_value=4.7; Accession=PF00560.24; Description=Leucine Rich Repeat
  Pfam annotation: Domain name=LRR_1; Domain location=675-697; Score =8.5; E_value=8.2; Accession=PF00560.24; Description=Leucine Rich Repeat
  Pfam annotation: Domain name=LRR_1; Domain location=699-720; Score =1.0; E_value=2e+02; Accession=PF00560.24; Description=Leucine Rich Repeat
  Pfam annotation: Domain name=LRR_1; Domain location=779-800; Score =8.8; E_value=7.2; Accession=PF00560.24; Description=Leucine Rich Repeat
  Pfam annotation: Domain name=LRR_1; Domain location=802-823; Score =14.6; E_value=0.37; Accession=PF00560.24; Description=Leucine Rich Repeat
  Pfam annotation: Domain name=LRR_1; Domain location=825-846; Score =6.2; E_value=21; Accession=PF00560.24; Description=Leucine Rich Repeat
  Pfam annotation: Domain name=LRR_3; Domain location=605-624; Score =29.2; E_value=1.6e-05; Accession=PF07725.3; Description=Leucine Rich Repeat
  Pfam annotation: Domain name=NACHT; Domain location=218-369; Score= -33.3; E_value=0.024; Accession=PF05729.3; Description=NACHT domain
  Pfam annotation: Domain name=NB-ARC; Domain location=176-472; Score =115.2; E_value=2e-31; Accession=PF00931.13; Description=NB-ARC domain
  Pfam annotation: Domain name=TIR; Domain location=24-155; Score =176.3; E_value=8e-50; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_3::NACHT::NB-ARC::TIR; Domain location=605-626::628-649::651-673::675-697::699-720::779-800::802 -823::825-846::...
  Pfam module annotation: Domain location=605-624::218-369::176-472::24- 155
  Subcellular localization annotation: CTP_CleavageSite=43; ConfidenceScore=5.12e-01
MASNNNSSSSSIIVQHCNYSSYDVFVSFRGKDTRNNFTDHLFGAFHRKKIRTFRDDTRLKKGERILSNLMQAIEGSQIFVIVFSKNYAFSSWCLKELAKILDCVRVSGKHVLPIFYDVDPSEVRNQTGDYEKAFAKHEDREKMEEVKRWREALTQVANLAGWDMRNKSQYAEIEKIVQEIISKLGHNFSSLPNDLVGMESPVEELEKLLLLDLTDDVRIVGICGMGGIGKTTLATVLYDRISHQFDAHCFIDNVSKTYRHCGQIGVLKQLLHQTLNEDLQICNLYHAANLMQSRLRYVKSIIVLDNVNEVEQLEKLVLNREWLGAGSRIIIISRDKHVLKKCGVTVVYKVQLLNGANSLKLFCKKAFDSVDITGDYEELKYEVLKYANDLPLAIKVLGSVLSGRSVSYWRSYLDRLKENPNKDILDVLRISYDELQDLEKEIFLDIACFFCGNEELYVKKVLDCCGFHSEIGIRALVDKSLIDNSSGFIEMHNLLKVLGRTIVKGNAPKEPGKWSRVWLHEDFYNMSKATETTNNEAIVLDREMEILMADAEALSKMSNLRLLIFRDVKFMGILNSVNCLSNKLQFLEWYNYPFSYLPSSFQPNLLVELILQHSNIKQLWKGIKHLPNLRALDLSYSKNLIEAPDFGGVLNLEWIILEGCTNLARIHPSVGLLRKLAFLNLKNCISLVSLPSNILSLSSLGYLNISGCPKVFSNQLLEKPIHEEHSKMPDIRQTAMQFQSTSSSIFKRLINLTFRSSYYSRGYRNSAGCLLPSLPTFFCMRDLDLSFCNLSQIPDAIGSMHSLETLNLGGNNFVSLPYSINQLSKLVHLNLEHCKQLRYFPEMPSPTSLPVIRETYNFAHYPRGLFIFNCPKIVDIARCWGMTFAWMIQILQVSQESDTRIGWIDIVVPGNQIPKWFNNQSVGTSISLDPSPIMHGNHWIGIACCVVFVAFDDATDLHPNLRSSIRIGFKTESYSSSLDIPILINKDLVTVGLHHLWLLYLSREEFFSYFKIEKMLDLHGIKMQSTVWHSQGLNLEVHGCGYQWVFKEDLDTLNLTIMRRGYNETHVDDDFVKGVSILSLEDGN

SEQ ID NO: 164516 - protein, 64 aa, Glycine max
  Coding DNA Sequence Number=SeqID_72831
MTGDATMSFIVDPSKGKARQRCGDTKVLRWWPEVLMPTKVTRDEWAMAKRKKIYRSRGGSFWRW

SEQ ID NO: 164517 - protein, 115 aa, Glycine max
  Coding DNA Sequence Number=SeqID_72832
  Homolog annotation: Hit_ID=Q9ZVK3; Match level="QueryCoverage=67%, HitCoverage=8%, E-value=1e-07, Identity=37%"; Hit description =Putative retroelement pol polyprotein
MLKLHQGPLPSQPAHLPPTNTNNHLDIEPLSLLDWKWDTSASPPTKLVLVQWSGLALEDITWEAWDALPDSYNLEDKVNFPEGGDVSDISPATSSANASRPKRCSRRPTHLNDYI

SEQ ID NO: 164518 - protein, 50 aa, Glycine max
  Coding DNA Sequence Number=SeqID_72833
MPRHSPLVRYKHAPQKPGFGCMASEPMVGGDDEAREKQRFGERKVYTRGK

SEQ ID NO: 164519 - protein, 121 aa, Glycine max
  Coding DNA Sequence Number=SeqID_72834
  Homolog annotation: Hit_ID=A7P3Y4; Match level="QueryCoverage=25%, HitCoverage=3%, E-value=5e-09, Identity=90%"; Hit description =Chromosome chr1 scaffold_5, whole genome shotgun sequence
MLLGLYASRAASNFASCWDKEGTKENTHLLEEIEKILCYVCDEVCICLLHSYGLLHSYHHRVVAVKCLKNVTSGDVEFWAEVTIIARMHHLQYGTEFELGIRIFFMIMSAIFIYSEQESIP

SEQ ID NO: 164520 - protein, 89 aa, Glycine max
  Coding DNA Sequence Number=SeqID_72835
MKPRGYIEFNNVQDDVPYQVEEMSHVNEVIEVESISGLQDLRGGVEVDHANMLTNEEESNNLNEESNSIEQDNEEELEDDFKAYNFEED

SEQ ID NO: 164521 - protein, 63 aa, Glycine max
  Coding DNA Sequence Number=SeqID_72836
MVVASDKPVIIDKKLAETLGEIRWNYKSLTMEFEHAGKTVKLVGEQQCRQHQGASTTMNCILP

SEQ ID NO: 164522 - protein, 81 aa, Glycine max
  Coding DNA Sequence Number=SeqID_72837
MKINPQTRMKNVMEKGLEQGECMPPAGMTSPPRMVHVAVDSPAPVAISCQLVSPIKLASWSQSHQTQWRHSHALVQMGRAQ

SEQ ID NO: 164523 - protein, 156 aa, Glycine max
  Coding DNA Sequence Number=SeqID_72838
DVSNNGYDKNTNGDRDDSGGGGDNDNIVVVAVLVVAANRNNVGFGGGDRGDISGSVVVVVVVAIGGGDNNNGSDADIMVVVVVAMLVMMMMSVMVVAPSGGCIVVVVARMTLVVVVVTMMKVVIVITAVAMATTLMVVAMMKVVLVVVAVTMVIMV

SEQ ID NO: 164524 - protein, 229 aa, Glycine max
  Coding DNA Sequence Number=SeqID_72839
MASSNFSELDFEAMRARREHQIVRNAFINSGLRGPDLPKQRRKLSPNGNEKIFLKWQTRSRHRSLDVQLINFGYPAQLLCSNEVSEVCWYLLLPFGVQGSDGSVVVEVAAIVGHAMFQKIVVEGKRRRILDAGGVVAGPTALDWAAVGAAGPAGPVQRGLQRRVLRVVLRHAPQLLRRSATAAVAGTEAQKEEERKNEAFWGKKEKWVVLGWELGFMLLCVNEDEDEDA

SEQ ID NO: 164525 - protein, 813 aa, Glycine max
  Coding DNA Sequence Number=SeqID_72840
  Gene Ontology: Mol. function=binding; Cellular component=nucleus; Biological process=protein amino acid phosphorylation
  Homolog annotation: Hit_ID=A7PJE2; Match level="QueryCoverage=83%, HitCoverage=92%, E-value=0.0, Identity=51%"; Hit description =Chromosome chr12 scaffold_18, whole genome shotgun sequence
  Pfam annotation: Domain name=PPR; Domain location=141-175; Score =33.3; E_value=8.8e-07; Accession=PF01535.11; Description=PPR repeat
  Pfam annotation: Domain name=PPR; Domain location=243-277; Score =36.4; E_value=1.1e-07; Accession=PF01535.11; Description=PPR repeat
  Pfam annotation: Domain name=PPR; Domain location=278-312; Score=8.7; E_value=0.73; Accession=PF01535.11; Description=PPR repeat
  Pfam annotation: Domain name=PPR; Domain location=344-377; Score =13.0; E_value=0.22; Accession=PF01535.11; Description=PPR repeat
  Pfam annotation: Domain name=PPR; Domain location=409-443; Score=4.9; E_value=2.1; Accession=PF01535.11; Description=PPR repeat
  Pfam annotation: Domain name=PPR; Domain location=41-75; Score=45.6; E_value=1.8e-10; Accession=PF01535.11; Description=PPR repeat
  Pfam annotation: Domain name=PPR; Domain location=472-506; Score =39.8; E_value=9.7e-09; Accession=PF01535.11; Description=PPR repeat
  Pfam annotation: Domain name=PPR; Domain location=574-608; Score =27.7; E_value=4.4e-05; Accession=PF01535.11; Description=PPR repeat
  Pfam annotation: Domain name=PPR; Domain location=609-643; Score=5.6; E_value=1.7; Accession=PF01535.11; Description=PPR repeat
  Pfam annotation: Domain name=PPR; Domain location=645-678; Score=2.2; E_value=4.3; Accession=PF01535.11; Description=PPR repeat
  Pfam module annotation: Pfam domain module=PPR::PPR::PPR::PPR::PPR::PP R::PPR::PPR::PPR::PPR; Domain location=141-175::243-277::278-312::344- 377::409-443::41-75::472-506::574-608::609-643::645-678
MGHIPKQSIFIHNNIISSYIALGEVLNARKLFDALPHRTVVSYNTLITAYCRRGNVDDAWNLLCHMRGSGFAPTQYTLTGLLSCELLNHSRGVQLQALSIRNGLLDADAFVGTALLGLFGRLGCWDELFLAFEDMPQKSLVTWNSMVSLLARNGFVEECKILFRDLVGTGISLSEGSVVAVLSGLVDSEEDLEYGEQIHGLMVKCGFGCEITAANSLISVYVRCKAMFAVERLFEQVPVENVVSWNTVIDALVKSERPMMALDLFLNMARRGLMPSQATFVAVIHSCTSLRNSVCGESVHAKIIRSGFESDVIVGTALVDFYSKCDKFISAHKCFDQIEEKNVVSWNALITGYSNICSSTSILLLQKMLQLGYSPNEFSFSAVLKSSSMSNLHQLHGLIIRSGYESNEYVLSSLVMAYTRNGLINEALSFVEEFNNPLPVVPSNIIAGIYNRTSLYHETIKLLSLLEKPDAVSWNIVISACARSNSYDEVFALFKHMHSACIHPDSYTFMSIISVCTKLCLLNLGSSLHGLIIKTNLSNYDTFLGNVLIDMYGKCGSIDSSVKVFEEIMYKNIITWTALITALGLNGFAHEAVMRFQNLELMGLKPDALALRAVLSSCRYGGLVNEGMEIFRQMGTRYGVPPEHDHYHCVVDLLAKNGQIKEAEKIIACMPFPPNANIWRSFLEAHVNQMAKRKNPIKLTMVGRIEWDIHLPPTTSISAFAFSGIGSGSSKCKVNGAPTKEDGVSSIICLLCRLVIVTFGLGLSEPEGEPIWIGQSGSQKRMQEAIFGCRKQQPEVHGVASFNWARACHLIGP

SEQ ID NO: 164526 - protein, 379 aa, Glycine max
  Coding DNA Sequence Number=SeqID_72841
  Gene Ontology: Mol. function=oxidoreductase activity; Cellular component=extracellular region; Biological process=lignin catabolic process
  Homolog annotation: Hit_ID=A7NYK7; Match level="QueryCoverage=92%, HitCoverage=73%, E-value=1e-115, Identity=52%"; Hit description =Chromosome chr6 scaffold_3, whole genome shotgun sequence
  Pfam annotation: Domain name=Cu-oxidase; Domain location=72-262; Score=177.3; E_value=4e-50; Accession=PF00394.13; Description =Multicopper oxidase
  Pfam annotation: Domain name=Cu-oxidase_2; Domain location=264-379; Score=-4.5; E_value=0.0028; Accession=PF07731.5; Description =Multicopper oxidase
  Pfam annotation: Domain name=Cu-oxidase_3; Domain location=1-62; Score=-18.3; E_value=0.00011; Accession=PF07732.6; Description =Multicopper oxidase
  Pfam module annotation: Pfam domain module=Cu-oxidase::Cu-oxidase _2::Cu-oxidase_3; Domain location=72-262::264-379::1-62
MAEFGIRIMLLLAACLLPLSGEAMVRYYKFNVGQRGTLWWHAHILWLRATVHGALVILPKLGVPYPFPKPNREQVIILSEWWKSDTEAVINEALKSGLAPNVSDAHTINGHPGPIQGCVLHKAKSKNQNLTFDVIRPSQCDSNSNKFSTVAKAKEKMEKKKSGGFKLDVQPGNTYLLRIINAALNEELFFKIAGHELTVVEVDAVYTKPFKTDTILIAPGQTTNVLLTTKHETGKYLVAASPFINATPLATTFTDSLRSLNSEKYPARVPLRIDHNLLFTVSLSVNPCATCVNNSRVVADINNVTFVMPKISLLQAHFLKIKGVFTDDFPGNPPVVTREFQPAKDAKKFNLGDPVEKNTVGVPAGGWTAIRFRADNPGI

SEQ ID NO: 164527 - protein, 154 aa, Glycine max
  Coding DNA Sequence Number=SeqID_72842
MGIWDILDSHHRIVCSLMRCRRRPPCHRSGRAKVLVALGGAFDGLTSMAPTVVANCEAQGHLLGGVPHFQYCIGTWTERGTTLISWVRMGKTGTTMAGILGLNASYYLKIGVNMASNDSNVGSRSDNFGSDVVASRSGSGYLSFLIPNENAAPL

SEQ ID NO: 164528 - protein, 241 aa, Glycine max
  Coding DNA Sequence Number=SeqID_72843
  Gene Ontology: Mol. function=phosphoprotein phosphatase activity
  Homolog annotation: Hit_ID=A7UQU7; Match level="QueryCoverage=65%, HitCoverage=27%, E-value=9e-20, Identity=36%"; Hit description=IMP dehydrogenase/GMP reductase, putative
  Pfam annotation: Domain name=DUF1723; Domain location=175-224; Score =67.3; E_value=5.2e-17; Accession=PF08330.1; Description=Protein of unknown function (DUF1723)
MAQMALYLNLFILLGRGLGASRGRGISEDTHEADVPLRRRPTTSARRQQVRLREDVAERPEDVPQLHEDVPHVSDVTPEMTSAADAVQTERVATDGSLGSPAADEGFPGGPHDPSILTDFAEHVAHNIWSGQERPDLKLVSHDRKVDKIGRPAPEIEGLIAGTGLSPLIRCSVITTDPILISAFVERWHRETSTFHLPVGELTITLDDVASLLHLPITGALHTFEPLVTSDAICLLTELLE

SEQ ID NO: 164529 - protein, 160 aa, Glycine max
  Coding DNA Sequence Number=SeqID_72844
MHEYPRGTCALTCKHSFQNSYGCSCFVGKREMAPKKLSTKRSRRDVTTEGSSATPDFDSHRFWSAEHQQRFEAIKGWSFHRERRVQLREDEYTDFQEEIARRRWTSLVTPMAKFDPEIVLEFYANAWPIEEGVRDMRSWVRGQWIPFGVDALSCWTLWPQ

SEQ ID NO: 164530 - protein, 157 aa, Glycine max
  Coding DNA Sequence Number=SeqID_72845
  Homolog annotation: Hit_ID=Q2QVF2; Match level="QueryCoverage=47%, HitCoverage=8%, E-value=3e-10, Identity=40%"; Hit description =Transposon protein, putative, CACTA, En/Spm sub-class
  Subcellular localization annotation: CTP_CleavageSite=27; ConfidenceScore=5.64e-01
MASPPASPPPAPSDALASPFAVKRTRKASRLRSLSTRPPGAERPVVHVDPATSKADGPHRKKLRTYLGIVVRDKVDVTYENWKEVPTAHKDLIWEDIQAEFEILEASDSRMKRKLLQTVGERWRQFKSDLTRKWVLAVDKDSVEDTVYEKYGISKEK

SEQ ID NO: 164531 - protein, 116 aa, Glycine max
  Coding DNA Sequence Number=SeqID_72846
MVKVGTSYVPINVSFSPKVGPGLPRYQQGHQDLFILRSDLPSQWLLFLSAVPPVQLLTGWPRNGKSTAGHQRWQAAQLLGRAIGAGLFAITPAGERGMCCKAIKLGNARVFPVTTL

SEQ ID NO: 164532 - protein, 204 aa, Glycine max
  Coding DNA Sequence Number=SeqID_72847
MASPWLSETKCRQAQFIAARIEGHGAERFPEELAECAYRTKRVYFLRMNTHPPGTDLLRQAKFFAASAELSGPFSVAKRNLFLAKRKSMRLTLGLAGSLQAKPTLQTLYTDNVLGRHILAERKVEIYHTELDEFKAELERCNFHKRLTNLADNSIDLALVKEFYTNLYSPKGPSPKQVRIRGHLIRIDADSLNVFLETPVVLAD

SEQ ID NO: 164533 - protein, 43 aa, Glycine max
  Coding DNA Sequence Number=SeqID_72848
MVDEHDQRTTLEDYSSSSERPRGGSTHSKVSVLKPGKKLWKSS

SEQ ID NO: 164534 - protein, 284 aa, Glycine max
  Coding DNA Sequence Number=SeqID_72849
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=A8GDC1; Match level="QueryCoverage=30%, HitCoverage=16%, E-value=1e-39, Identity=89%"; Hit description=PTS system, glucose-like IIB subunint
MGIFLGLILGVTIAWVHNRLCNVELNGVFSVYGGAKLVLIAMTPIIMLYAVAFSYLWPAISQGLIALTGFMKSSGSLGVFVYGFFEKCPHPHRAAPLYLVAVPAHQHRRFDRAGRPDRLRLAGDFPGLYARPEHLAADERSAALLAARDGDHLRPVGRGIGFLSHRQTGKENAGQGDSDPGHHHLDPGRHHRADRVHLPVYLSAAVGDPRRVDRAVAGGLQPVPGAPLGRQRAGRVPGLQPAAAGLPHPLAAVCGHRPGAVCGVLPGVQNAGAEAQSEDAGPRR

SEQ ID NO: 164535 - protein, 338 aa, Glycine max
  Coding DNA Sequence Number=SeqID_72850
LSSIEGMIQRLAAAWEKKTPETNVHVVDKSGEDEGMVAHDSNRWRNLELPIFDRQAGGGNGRDGWGSSGLVPMVGILESKSFLGWVQDCCHPKVSGFKLGKSFSSAAGTATRIDRLEEPFLVEVFLTGLKEEISIEVRLHEPKNMMEAMVKAQRVEDKNRILGKLLVGNGKWSNLQKNVHLGQKWVSDWQPANNKVTDLQNAARTGTSGWIGRRTFHNLSPAERRKEILRASNRRIRKKRWGSFTNYPCIVLKALPPENLLNYKIGGNPYRPIFYRSRRWTQGMEWLAGLGAIEANLEKLTLTVPVQNRKVILRVEPELIKAAISMKMIRGTMLESDQ

SEQ ID NO: 164536 - protein, 117 aa, Glycine max
  Coding DNA Sequence Number=SeqID_72851
MVWRLLSTLLLHSTSIKIQEAKDSIDEEDPRPTSSNGATSTLPMKGLFVTKLEINEVLLSPIALKVVGPLLLDSNSSRDGTNPPFQFPIWQLTNKETKRQAITKDQKYEIKAKLIDF

SEQ ID NO: 164537 - protein, 221 aa, Glycine max
  Coding DNA Sequence Number=SeqID_72852
  Gene Ontology: Mol. function=4 iron, 4 sulfur cluster binding; Cellular component=periplasmic space; Biological process=cellular respiration
  Homolog annotation: Hit_ID=P24183; Match level="QueryCoverage=99%, HitCoverage=21%, E-value=1e-102, Identity=80%"; Hit description =Formate dehydrogenase, nitrate-inducible, major subunit
MRDETLTHPRCVWNLLKQHVSRYTPDVVENICGTPKADFLKVCDVLASTSAADRTTTFLYALGWTQHTVGAQNIRTMAMIQLLLGNMGMAGGGVNALRGHSNIQGLTDLGLLSTSLPGYLTLPSEKQLDLQTYLAANTPKATLPDQVNYWSNYPKFYVSLMKSFYGDAAQKENDWGFEWLPKWDQAYDVIKYFNMMDKGDVTGYICQGFNPVASFPDKNKV

SEQ ID NO: 164538 - protein, 84 aa, Glycine max
  Coding DNA Sequence Number=SeqID_72853
  Homolog annotation: Hit_ID=A5BDQ4; Match level="QueryCoverage=90%, HitCoverage=13%, E-value=8e-13, Identity=39%"; Hit description =Putative uncharacterized protein
MELSLVTSTRRLHPYFQSHLIKVKTNHPIRQVLQKPELDGRMLPSKSSSSDRGDWWMLYVVGASNPNGSGIGITLEGPGDISLK

SEQ ID NO: 164539 - protein, 79 aa, Glycine max
  Coding DNA Sequence Number=SeqID_72854
  Homolog annotation: Hit_ID=A7NTA8; Match level="QueryCoverage=73%, HitCoverage=42%, E-value=1e-09, Identity=50%"; Hit description =Chromosome chr18 scaffold_1, whole genome shotgun sequence
MDSGQARKFEDLENSHKSSTVTLASIKESLGMDVDQKSLEQLIKKNGWWTKSSWAFLNEPPVIEPASNKYGSQFQKIRG

SEQ ID NO: 164540 - protein, 107 aa, Glycine max
  Coding DNA Sequence Number=SeqID_72855
CFESSLVVGTTSGVSSLIALCTTSVPGNWAASKVGQYADERLAIPNMRVAVSYGLSSRCGWALYRLATELRPPRLLAAMHWVYSIYAHYQLLLATRYRCCAASADSS

SEQ ID NO: 164541 - protein, 78 aa, Glycine max
  Coding DNA Sequence Number=SeqID_72856
MTQKLGIPIRYNAPRKSMKMHYLFEEKIHHMTTIFHLVTWNELCHLGKPINNHKNRIFAPLGPWKTKHKIHGNVGPRG

SEQ ID NO: 164542 - protein, 63 aa, Glycine max
  Coding DNA Sequence Number=SeqID_72857
MVFRRLPLNKLELTVNWFKDVRFPRLEGMESEDMFSGCVVPRTMTTMAIFNGCDVTSAGKTKS

SEQ ID NO: 164543 - protein, 236 aa, Glycine max
  Coding DNA Sequence Number=SeqID_72858
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIHGQGAHVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 164544 - protein, 153 aa, Glycine max
  Coding DNA Sequence Number=SeqID_72859
MGKKYFRSAPRTFYTSSSMAPEELEQLTQQIKDQLEELIIEKVTRRMMSSFSQMQSQFQSQMQSQGLALPPEPEGTIQTRVTHTNTGYTSKKILHAWFPLGRVYEGSTTVHNIPLLHDQVKVGVEEVKDADAPVSVPTNEVNLVGELWDQQNL

SEQ ID NO: 164545 - protein, 142 aa, Glycine max
  Coding DNA Sequence Number=SeqID_72860
  Gene Ontology: Mol. function=iron ion transmembrane transporter activity; Cellular component=outer membrane-bounded periplasmic space; Biological process=entry of virus into host cell
  Homolog annotation: Hit_ID=A4WB76; Match level="QueryCoverage=49%, HitCoverage=26%, E-value=6e-29, Identity=87%"; Hit description=TonB family protein
  Pfam annotation: Domain name=TonB; Domain location=35-69; Score=71.1; E_value=3.6e-18; Accession=PF03544.5; Description=Gram-negative bacterial tonB protein
  Subcellular localization annotation: CTP_CleavageSite=29; ConfidenceScore=5.60e-01
GRKCSPFTSGDNNTATTTKPTVAAPAGPRAVSRSQPQYPPRAQMLRIEGRVRVKFDVTADGRVDNVEILSAQPSNMFERDVKAAMRKWRYEPGKPGSGPAEAGETSMLMEIEVIAAFYAARVAAHHITHRHRAQEGHAVYSH

SEQ ID NO: 164546 - protein, 68 aa, Glycine max
  Coding DNA Sequence Number=SeqID_72861
MESDDMRGYRMVICTFHQPGANEPVDAQRLTSSSAPFVIPTHGVRFYSPRPETFKPDDARGSAGRDID

SEQ ID NO: 164547 - protein, 138 aa, Glycine max
  Coding DNA Sequence Number=SeqID_72862
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=65%, HitCoverage=55%, E-value=5e-25, Identity=65%"; Hit description=LacZ -alpha
MDQLSPLGTCLRMRKRNLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 164548 - protein, 87 aa, Glycine max
  Coding DNA Sequence Number=SeqID_72863
  Subcellular localization annotation: CTP_CleavageSite=62; ConfidenceScore=5.39e-01
MGANLSNMEKSFSRSLWAATGSILLNNGVQGIWGFRNASVKLPKTLENSNRGSSVTLPRRFREQIREDFSSFFTVLRSFFGLQLISV

SEQ ID NO: 164549 - protein, 396 aa, Glycine max
  Coding DNA Sequence Number=SeqID_72864
MARVAKALADQREWASFIDIFALLIFGVVLFPNMERLVNLAVIDAFLAYHHSKESSVIAILTDVYDTPTCPLQGHHLCVEKGKENWEQLLANVAWGAVQRKDTKLRGSTNGIIGDYQKWLQVRTQELDWLPKLKAARKDEAGTLEESEEVKTLKEELERAKVVKEKFKSMAIKVRKDNELKLRRAERDQSQVEGMILEDELKACQRSKRSLSEQLSKTEENIWAIINQYKEKLSLVATHEQRLEDEYAKVSVLQAEREARERLPRLLAKAKAKAMADLYLAPEEHAFMFSSLSHYSPHFVPLGSNTITERALRHPYRTRSKTRVMGDVDEVQEQMKADMVALKDQMTSMMEVMLSMKRLIESNVATTIAASVAAEADPTLPSAMNQAHQPAPNMRG

SEQ ID NO: 164550 - protein, 63 aa, Glycine max
  Coding DNA Sequence Number=SeqID_72865
  Subcellular localization annotation: CTP_CleavageSite=38; ConfidenceScore=5.08e-01
MVKVGTSYVPINVSFSPKVGPGLPAVPPVQLLTGWCVTAKAPPDISAGKCSGPPARNHHTRRA

SEQ ID NO: 164551 - protein, 272 aa, Glycine max
  Coding DNA Sequence Number=SeqID_72866
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=A7PML1; Match level="QueryCoverage=97%, HitCoverage=60%, E-value=5e-95, Identity=67%"; Hit description =Chromosome chr14 scaffold_21, whole genome shotgun sequence
  Pfam annotation: Domain name=Branch; Domain location=89-272; Score =254.1; E_value=3e-73; Accession=PF02485.12; Description=Core-2I -Branching enzyme
MKKLKNYYMHLRHHHHHHHAAAERKWVFPLAIGSLLSLFLLFLATLTSPEGTPILPFYRSITAASYSVFVESKLRPLPVVSSLPPPPRLAYLVSGSKGDGAAVTRVLLALYHPNNRYVVHLDLESSPEERSDLVRFVEGHALFKRFGNVRVIKKANLVTYRGPTMVANTLHAAAILLRELGDWDWFINLSASDYPLVTQDDLLHTFSYLPRDLNFIDHTSDIGWKDHQRARPIIVDPGLYMNKKQDVFWITQRRSRPTAFKLFTGEDPFLVC

SEQ ID NO: 164552 - protein, 166 aa, Glycine max
  Coding DNA Sequence Number=SeqID_72867
MPNKTNKDLEEAILALVVEMENLQAHHENRHEQLQSTMDARNDALHGVLASIMDKLAIISSAPAQVFSPAIFATTSPTFHMAFDGTIHITTSPFGGHILSSSTLLHQHNFSPHHTPNFSTNPFIQRRVVEHHWTCDFSVSSMSFTLDEALILLQGDNMHTKEVSYQ

SEQ ID NO: 164553 - protein, 627 aa, Glycine max
  Coding DNA Sequence Number=SeqID_72868
  Gene Ontology: Mol. function=transition metal ion binding; Cellular component=cytoplasm; Biological process=inositol metabolic process
  Homolog annotation: Hit_ID=A2Q2R2; Match level="QueryCoverage=99%, HitCoverage=56%, E-value=0.0, Identity=75%"; Hit description =Histidine acid phosphatase
  Pfam annotation: Domain name=Acid_phosphat_A; Domain location=62-624; Score=210.3; E_value=4.5e-60; Accession=PF00328.13; Description =Histidine acid phosphatase
MKRYYDDSACVLRKMLLDAKAPHLSSAIPPTLPWKVNELVQPSEPLTRQGSGINGTFEGSEELRCVIAVIRHGDRTPKQKVKLKVTEEKLLNLMLKYNGGRPRSETKLKSAVQLQDLLDATRMLVPRTSSTHEICNLKQEVSGYMTKGCKLKPLLMGLAQQFKQHIGHVLDHDRESDSEAEDVEHAEKLHQVKAVLEEGGHFSGIYRKVQLKPLKWIKMTNDNGEVEEQPVEALMVLKYGGVLTHAGRKQAEELGRYFRNKMYPGEGTGLLRLHSTYRHDLKIYSSDEGRVQMSAAAFAKGLLDLEGQLTPILVSLVSKDYSMLDGLENASSEMKEAKAWLNEIITSNANTVDSNGSPEFPWMVDGAGLPPNASELLANLVKLTKKVTEQVRLLAQDENEKLTERSLYDVIPPYDQATVLGKTNIDVDRIAAGLPCGSEGFLLMYARWKKLETDLYNERKERFDITQIPDVYDSCKYDLLHNAHLNLEGLDELFKVAQMLADGVIPNEYGINPKQKLKIGSKIARRLLGKLLIDLRNTREEAITVAELKNNHDHSLSINIEKEDAEAKSKLFHKNDEMDQDDDDDKETKYRLDPKYANVKTPERHVRTRLYFTSVSVVSANIYTSCQ

SEQ ID NO: 164554 - protein, 166 aa, Glycine max
  Coding DNA Sequence Number=SeqID_72869
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=Q9FLD7; Match level="QueryCoverage=86%, HitCoverage=31%, E-value=7e-72, Identity=82%"; Hit description =Glycosylation enzyme-like protein
MALSKSFIDYCIWGWDNLPRTVLMYYSNFISSPEGYFHTVICNAQEFRNTTVNSDLHFISWDNPPKQHPHYLTVDDMKGMVGSNAPFARKFHREDPVLDKIDAELLSRGPGMTVPGGWCIGKRENGTDPCSEVGDTNVLRPGPVDSVVPGHLFLPLTNLSKISDQH

SEQ ID NO: 164555 - protein, 101 aa, Glycine max
  Coding DNA Sequence Number=SeqID_72870
MNNQNNQNNVENIIKNTVKSNQNTVENNQNKQIYDLIVEKSFERKTYHESKTCMHKPCKPPLAMASLLRNGCVARKPPAWLATLPNEDLATSTTRQHKPLV

SEQ ID NO: 164556 - protein, 956 aa, Glycine max
  Coding DNA Sequence Number=SeqID_72871
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=A7PMM1; Match level="QueryCoverage=100%, HitCoverage=100%, E-value=0.0, Identity=79%"; Hit description =Chromosome chr14 scaffold_21, whole genome shotgun sequence
  Pfam annotation: Domain name=Cation_ATPase_N; Domain location=10-90; Score=109.2; E_value=1.2e-29; Accession=PF00690.17; Description =Cation transporterATPase, N-terminus
  Pfam annotation: Domain name=E1-E2_ATPase; Domain location=102-323; Score=301.4; E_value=1.7e-87; Accession=PF00122.11; Description=E1 -E2 ATPase
  Pfam annotation: Domain name=Hydrolase; Domain location=327-613; Score=73.0; E_value=1e-18; Accession=PF00702.17; Description =haloacid dehalogenase-like hydrolase
  Pfam module annotation: Pfam domain module=Cation_ATPase_N::E1-E2 _ATPase::Hydrolase; Domain location=10-90::102-323::327-613
MAEKEEAMRVVLKEAVDLENVPLEEVFQTLRCDSNGLTTESAEERLAIFGHNKLEEKKESKVLKFLGFMWNPLSWVMEAAAIMAIALANGGGKPPDWQDFVGIITLLIINSTISFIEENNAGNAAAALMARLAPKAKFLRDGKWVEEDASILVPGDIISVKLGDIIPADARLLEGDPLKIDQSALTGESLPVTKGHGDSVYSGSTCKQGEINAVVIATGVHTFFGKAAHLVDSTNQVGHFQKVLTAIGNFCICSIAVGMIVEIIVMYPIQHREYRPGIDNLLVLLIGGIPIAMPTVLSVTMAIGSHRLAQQGAITKRMTAIEEMAGMDVLCSDKTGTLTLNKLTVDKNLIEIFAKGVDVDTVVLMAARAARLENQDAIDASIVGMLGDPKEARAGIQEVHFLPFNPTDKRTAITYIDSESKMHRVSKGAPEQILNLARNKSEIERRVHSVIDKFADRGLRSLAVAYQEVPDGKKESQGGPWQFIGLLPLFDPPRHDSAQTIRRALNLGVNVKMITGDQLAIGKETGRRLGMGTNMYPSSALLGQNKDESIATLPVDELIEKADGFAGVFPEHKYEIVKRLQARKHICGMTGDGVNDAPALKKADIGIAVADATDAARSASDIVLTEPGLSVIISAVLTSRAIFQRMKNYTIYAVSITIRIVLGFMLLALIWQFDFPPFMVLIIAILNDGTIMTISKDRVKPSPYPDSWKLAEIFTTGIILGGYLAMMTVIFFWAAYKTDFFPQTFGVSSLQKKDRDDFRKLASAIYLQVSTVSQALIFVTRARSWSFVERPGLLLVAAFVIAQLIATLIAVYANWSFAAIEGIGWGWAGVVWLYNLVFYIPLDFIKFIIRYALSGRAWDLVIEQRIAFTRKKDFGKEERELKWAHAHRTLHGLHPPETKMFNERTSYTELNQMAEEARRRANIARLRELHTLTGHVESVFRLKGLDIDTIQQAYTI

SEQ ID NO: 164557 - protein, 249 aa, Glycine max
  Coding DNA Sequence Number=SeqID_72872
  Homolog annotation: Hit_ID=A7Q4C7; Match level="QueryCoverage=42%, HitCoverage=18%, E-value=2e-21, Identity=49%"; Hit description =Chromosome chr9 scaffold_49, whole genome shotgun sequence
MDTRLRVIGDPMNEVQRGHNSLFEDSPSECGGGAATVRYGLISKGHSRNKIQAQGREWEVQEACRAVSSYLGELGVSLEDSVWMASKSPEYVKMLVEGVRDLEQWHEWDAGLSFRDKILHIAPQKGDKGKVAYLETLGFSLSSSMNIARYFSADTLTLPSLMHKMDLADKDYAKLLLKYPWLLSTSIQDNSAKFNISYAPQSKCIKKTRMQKRVDACGGYDVWRDQHYRRRGYPLLPRCLSSGPVAPAY

SEQ ID NO: 164558 - protein, 59 aa, Glycine max
  Coding DNA Sequence Number=SeqID_72873
MEACDAIAERLERHLSLRVVTPGTLTHEVIKKCLKIVRSVTQDRIVYVRSLRRRCMDQP

SEQ ID NO: 164559 - protein, 223 aa, Glycine max
  Coding DNA Sequence Number=SeqID_72874
  Subcellular localization annotation: CTP_CleavageSite=34; ConfidenceScore=5.29e-01
MTFLVETSSQTVVNSTLGFIFPNGSIVYNDSSVSFQASTPVLIRVPNRCDFQTLKTRIHNTLKLTDKQFLDEIYYRQPFTYTATMTPTHDALLYYNERWNMSRQNEFVGYSFTGKNPKNFDIPTGCTMDELKDLIKQVASRGIPPYGIDETQMVKRLFFRKPSHHEYSEKVIKFEIIELKTNDDVMKVLIESNYWKKIGPIEILVVFSKPVLQMEDELSLPQN

SEQ ID NO: 164560 - protein, 97 aa, Glycine max
  Coding DNA Sequence Number=SeqID_72875
  Homolog annotation: Hit_ID=A7Q2R8; Match level="QueryCoverage=70%, HitCoverage=13%, E-value=1e-07, Identity=47%"; Hit description =Chromosome chr1 scaffold_46, whole genome shotgun sequence
MGFGSNAVQAGSLDVDKSNERKKKVEGAGKERKWWFRFSFFGSCIPSGSKVDSTISGTKAHNAFQNQSHVLFSVTFGPRHVLLYALDARQRAEKNIL

SEQ ID NO: 164561 - protein, 24 aa, Glycine max
  Coding DNA Sequence Number=SeqID_72876
GSFLFGGFFRLVVYFFGVSNVLFA

SEQ ID NO: 164562 - protein, 169 aa, Glycine max
  Coding DNA Sequence Number=SeqID_72877
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=85%, HitCoverage=13%, E-value=6e-69, Identity=89%"; Hit description=DNA -directed RNA polymerase subunit beta
  Pfam annotation: Domain name=RNA_pol_Rpb2_7; Domain location=61-138; Score=142.4; E_value=1.2e-39; Accession=PF04560.11; Description=RNA polymerase Rpb2, domain 7
YPGKSKIFDGRTGNSFKQPAIMGKPYILKLIHQVDDKIHGRSSGHYALVTQQPLRGRAKQGGQRVGEMEVWALEGFGVAHILQEMLTYKSDHIKTRQEVLGTTIIGGTIPKPTDAPESFRLLVRELRSLAMELNHFLYKHQQLRIGSVSPQQISAWAKKILPNGEIVGE

SEQ ID NO: 164563 - protein, 48 aa, Glycine max
  Coding DNA Sequence Number=SeqID_72878
MVKYYAKSKTEMNRGAQGWVRVDARPVISRSSSRVRLRTIKKHYWEAA

SEQ ID NO: 164564 - protein, 132 aa, Glycine max
  Coding DNA Sequence Number=SeqID_72879
NKRGYISCGSVLVEGTSTRLFKENKGGYIPCGSLLVKEFTRLKRNLKDCRLLEGWMPLDPTLLGLHLLVTAKSMMALGFDGLQTYVGERFDALELQVDMRFDVMDSRISKVEGDVTYIRTCFDLPPPPPSSS

SEQ ID NO: 164565 - protein, 218 aa, Glycine max
  Coding DNA Sequence Number=SeqID_72880
MDLKEGCTYVMHNFRVNIIGVVDEVVFRHISPRSKRVVFKLMNLRLSELDIEIRSVLTRRSQWSSQPSGSAQLSSRETFISKSEAKSISEMNNLCEEFVCVTVGTITRIVMDNHSWCYASCIQCHKKIDVYTEPFVCPCGKHNDRVVLRYRVEVMVNYKDESTKFLQWYRECTELIEQLADEVNTLKIEDGDLDLNASPKALDKLLGHLLAFKVKIQP

SEQ ID NO: 164566 - protein, 489 aa, Glycine max
  Coding DNA Sequence Number=SeqID_72881
  Gene Ontology: Mol. function=transporter activity; Cellular component= integral to membrane; Biological process=transport
  Homolog annotation: Hit_ID=P0AEX3; Match level="QueryCoverage=82%, HitCoverage=93%, E-value=0.0, Identity=79%"; Hit description=Alpha -ketoglutarate permease
  Pfam annotation: Domain name=MFS_1; Domain location=26-388; Score =62.0; E_value=2e-15; Accession=PF07690.7; Description=Major Facilitator Superfamily
  Pfam annotation: Domain name=Sugar_tr; Domain location=21-422; Score =89.2; E_value=1.3e-23; Accession=PF00083.15; Description=Sugar (and other) transporter
  Pfam annotation: Domain name=Voltage_CLC; Domain location=65-386; Score=-185.4; E_value=0.1; Accession=PF00654.11; Description=Voltage gated chloride channel
  Pfam module annotation: Pfam domain module=MFS_1::Sugar_tr::Voltage _CLC; Domain location=26-388::21-422::65-386
MTESITSNGTLANSDTRRRVWAIVSASSGNLVEWFDFYVYSFCSLYFAHIFFPSGNTTTQLLQTAGVFAAGFLMRPIGGWLFGRIADRQGRKASMLISVCMMCFGSLVIACLPGYESIGTWAPALLLLARLFQGLSVGGEYGTSATYMSEIALEGRKGFYASFQYVTLIGGQLLAILVVVILQQILTDEQLHTWGWRIPFAMGAALAIVALWLRRQLDETSQKEVRTLKEAGTFKGLWRNRKAFLMVLGFTAGGSLSFYTFTTYMQKYLVNTTGMHANVASVVMTVALFVFMLIQPIIGALSDKIGRRTSMLIFGGLSALCTVPVLTALQHVSSPYAAFALVMLALVIVSFYTSISGILKAEMFPAQVRALGVGLSYAVANALFGGSAEYVALSFKSWGSETTFFCHSVRSRSATEEYASTGSIKKPCDGRAWILQNTADKSVDTDSTQAANKLANFHRIIGNTLQFAVVIHHGCMRANQFQLTFTLCG

SEQ ID NO: 164567 - protein, 547 aa, Glycine max
  Coding DNA Sequence Number=SeqID_72882
  Homolog annotation: Hit_ID=UPI00005F89C5; Match level="QueryCoverage =48%, HitCoverage=33%, E-value=4e-84, Identity=61%"; Hit description =COG5283: Phage-related tail protein
  Pfam annotation: Domain name=Phage_E; Domain location=162-231; Score =58.3; E_value=2.7e-14; Accession=PF06158.2; Description=Phage tail protein E
  Pfam annotation: Domain name=Phage_P2_GpE; Domain location=245-283; Score=80.8; E_value=4.4e-21; Accession=PF06528.3; Description=Phage P2 GpE
  Pfam annotation: Domain name=Phage_tube; Domain location=2-166; Score= 342.3; E_value=8.4e-100; Accession=PF04985.5; Description=Phage tail tube protein FII
  Pfam module annotation: Pfam domain module=Phage_E::Phage_P2 _GpE::Phage_tube; Domain location=162-231::245-283::2-166
MALPKKLKYLNLFNDGYSYMGVVSSLTLPKLTRKLEKYRGGGMNGAASIDMGLDDDALAVEWSMGGIDELVLKQWGAVDAVPLRFAGSFQRDDTGEVSAVEVVMRGRHKEIDFGEYKQGEDTETKVSTECTYFKLTVDGKELIEVDTVNMVEKNTMKDAKENTVTLDTPIQRGETTITEVQVIKPNAGALRGVGLAAIANADVDALLVVLPPAGFGGAGRESGRFFVAELGGVIPDARLGVDDLMADIAVIFHWPPSEMAGMTLTELLNWRHLALQRSGAVDQATRPLKSIQQASKQLAGDIKTTQQTLKALDAQSARIEGFRKAQGQLAVTGKALKKAKEEAAALAVQFKATEKPTAQQARLLEASRRAAAELQTKYNGLRQSVQRQRDALNADGIATRNLSAEQRRLKASASEATTALGRQRGELDRLSKKQDQVNRVGARYRAGQSATAAVRNTSAAGLGIATAGLVAEGAFIAPGVQFDRQMSDTQATLGLAKNDQQLAAIRQQARDIGATTAFSPTDVARTQSVLAKSGFNGDAILKSTEST

SEQ ID NO: 164568 - protein, 237 aa, Glycine max
  Coding DNA Sequence Number=SeqID_72883
  Homolog annotation: Hit_ID=Q8FJG7; Match level="QueryCoverage=56%, HitCoverage=66%, E-value=6e-19, Identity=42%"; Hit description =Putative uncharacterized protein
RLIDSQPVECRAVFLVDEFCLRRIGRRQRAVPVADGHRDDFQLRAARAGGGNLGRPGGGNNRFVFVHDFLLSGVNGNNIAINGGRAGVNPAGDVLQNVEADQVAAQGLGVGDKALHFLIHFLGDAGFQHANIQPEGAGRIGAVGMEPLDNVNQVAERLHHTAHCADGALMPVNVERSGHHTPLDVLRPRLIPAIDRERPRQIGQQMHRAGFRVPQITQGNRHALQLSTRGGGSNFQR

SEQ ID NO: 164569 - protein, 107 aa, Glycine max
  Coding DNA Sequence Number=SeqID_72884
MRRVVTCFTKDEDIYSVIKRLLGLPTIQHFNDVCRCLTKINEQELVAHEQAATIEAEALLKLWTTTLCGRSLLCVDDEVRLHSKAGSKVRRRTVFRSAKVNYIVGSF

SEQ ID NO: 164570 - protein, 47 aa, Glycine max
  Coding DNA Sequence Number=SeqID_72885
MMLTSVSVELCWRRQSGLTGSRGNIQINELQLAMVIFNFKMIISARS

SEQ ID NO: 164571 - protein, 113 aa, Glycine max
  Coding DNA Sequence Number=SeqID_72886
MFNSGRSSSGSTSSGIEHGNFQEELIPEIQHSHSGTTSFSSKKKREKKSDKCGRPTKYEQQRPKQLQTRNNCFTGPPNRLLQNFYFTGPPQRLFTEKDNNSKKTEMKVRAQHI

SEQ ID NO: 164572 - protein, 312 aa, Glycine max
  Coding DNA Sequence Number=SeqID_72887
  Gene Ontology: Mol. function=helicase activity; Biological process =viral genome replication
  Homolog annotation: Hit_ID=Q2A9E0; Match level="QueryCoverage=95%, HitCoverage=22%, E-value=2e-56, Identity=38%"; Hit description =Putative uncharacterized protein
SDSNFLTAYEDCQSPTNQPVINTEGYSDLGDQLMQCRYCNAQMWYDKRISKDKNCGSPRFSLCCGDGKVELSLLQNPPQYLQQLLFDDNTIDSKNYQHNLRAYNMMFAFTCAGIKLEKTINDSRGPTTIRIQGQPCHRIGSLLPMLGKNPNLHNYISLTQKMKCKGHIVSSLSHMLDEHYSHAKSFRMTRDRLADDEVDNIKLQLIAARGKDGRVYNMPNVPEIAALIVGDFHPGSKRDIIVETQNGELQRIHELHPSYLPLQYPILFPYGEDGYRAYILHRSTSSSKKRKQNRLTMREWFAYRLQSKSNKA

SEQ ID NO: 164573 - protein, 71 aa, Glycine max
  Coding DNA Sequence Number=SeqID_72888
MERYLQHLGQGFTPFACPTPEQFGAEVAWPGDWPEAQAGEEPVGSIDEAEEARMDEEMTDLLGFLGGSGAT

SEQ ID NO: 164574 - protein, 146 aa, Glycine max
  Coding DNA Sequence Number=SeqID_72889
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALSSQLPRFKECSSETSKTACKRFFVSEQRYAQTKRSQKIIYNQIKYF

SEQ ID NO: 164575 - protein, 52 aa, Glycine max
  Coding DNA Sequence Number=SeqID_72890
NFCLNQIRIFHPETINFCLSGNWFFRGIPSSAQASSQNRIWSPLLDKWPQIS

SEQ ID NO: 164576 - protein, 172 aa, Glycine max
  Coding DNA Sequence Number=SeqID_72891
  Homolog annotation: Hit_ID=A0LT24; Match level="QueryCoverage=44%, HitCoverage=48%, E-value=1e-09, Identity=38%"; Hit description =Putative uncharacterized protein
MTGQNIHTTIVSSTYGLLTETNSALLRLCDQASSLVIIVNSTEQAIESSQHSEEITLLELSEELCEHLLPLSRGDRSRKAPDILAKMLNCIASEVVWIDRIQILFEPSLELDPLRQLQELARIKPIVAIWPGQLTEQFLTFSVPGRADYQSYTANELANLPIIHFIEQREYK

SEQ ID NO: 164577 - protein, 165 aa, Glycine max
  Coding DNA Sequence Number=SeqID_72892
MTLLLSNILPSDRNANLPLQKYQLVCVVPTWGSHPQRHPVDLKKSNRALGFPALVTGLCRPYRAPVPPSKFMSSWHRDCARKTPSGPKEGQQGLGVASSKYGSLSVLGSVCRPQQGHQAPYQSSFHQEVLRPQAGAGRTHINIGMADSRPIDTLPPPLEFTSAHP

SEQ ID NO: 164578 - protein, 105 aa, Glycine max
  Coding DNA Sequence Number=SeqID_72893
  Homolog annotation: Hit_ID=A7Q8B9; Match level="QueryCoverage=74%, HitCoverage=15%, E-value=7e-11, Identity=47%"; Hit description =Chromosome chr14 scaffold_63, whole genome shotgun sequence
MVGAGLKKDLRVSRVVPGGSLNAFLFLLIGVISQRLAMLVELRSCNWVVAITGWMSNCPGGNDSIFEPVAHFFALSNGKEDRNISMKTLLETKTGFETKNLSSRR

SEQ ID NO: 164579 - protein, 218 aa, Glycine max
  Coding DNA Sequence Number=SeqID_72894
  Homolog annotation: Hit_ID=UPI00016621D1; Match level="QueryCoverage =88%, HitCoverage=44%, E-value=9e-13, Identity=32%"; Hit description =UPI00016621D1 related cluster
MTDPLNESISCFLIRVDPWVLELVAFGGLDFLAFRGLDFLTFRGLHVLAFRGLHVLAFVGQHALTFRGLHVLTFRGLHILHFRELHVLAFRGLHVLAFRGLHSLAFRGLHVLVFRGLHVLIFRGLHVLAFRGLHVLTFRGLHVLAFRGLRTLAFSGIHIRSLREFKAINCASTTREGGYHAATMHIGQDFTRAAAKRQVVDHARQHDHSYTDMDDVAT

SEQ ID NO: 164580 - protein, 48 aa, Glycine max
  Coding DNA Sequence Number=SeqID_72895
MLQDEQVYYSCTRLTKSVEGSTACYGEVVSAIGAGVSSGDFSGVAATS

SEQ ID NO: 164581 - protein, 129 aa, Glycine max
  Coding DNA Sequence Number=SeqID_72896
KIGEELATQLAQASQVASSRSNRLLEEESGRPKLWNLTGHVITPFLAFGKLRKLTDYEQYFLLISNMLRNFTDCVTMLPFDFRHVTEFHGLRNKGCQVSRSGQPKVACHQTKATEIWMTPLPVKEDKSG

SEQ ID NO: 164582 - protein, 150 aa, Glycine max
  Coding DNA Sequence Number=SeqID_72897
MLMCNDQFSCVGPIELLCIVGRTPDEEINLLERTTTPTHGALLYYNGRWNMPPQNKFVGCAFTGKNPKKFEIPSGCTLDELKDLIKQVAPKGIPPHGIHESQALKTNDEVLKVLVQSNYWKKYGPIEILAVFTKYGLEFEDDVDATSLNN

SEQ ID NO: 164583 - protein, 200 aa, Glycine max
  Coding DNA Sequence Number=SeqID_72898
  Gene Ontology: Mol. function=ribonuclease P activity; Biological process=tRNA 5'-leader removal
  Homolog annotation: Hit_ID=A7PJ62; Match level="QueryCoverage=80%, HitCoverage=19%, E-value=1e-27, Identity=45%"; Hit description =Chromosome chr12 scaffold_18, whole genome shotgun sequence
MEKRVISINCFSLEGQLAKLELIGLGTFQLLQKVLHAVGRELLAIEETCARNSSILRNEDYFSSCAMLSLNVKDPRELPWKKTVVPVESISTKTPTDAQEKKYKELAELGGILEENRDLSSLSRGLRPPVEDSFLSKEKHHERMVNFCLDDIHSGEANSSTKPPGFLSSVMGVGGGGFRIAGCGVFWGSGLGVAGFFGVG

SEQ ID NO: 164584 - protein, 30 aa, Glycine max
  Coding DNA Sequence Number=SeqID_72899
MKVGMEWEASREMRGVVFHTVRFKKGVDLK

SEQ ID NO: 164585 - protein, 168 aa, Glycine max
  Coding DNA Sequence Number=SeqID_72900
  Gene Ontology: Mol. function=6-phosphofructokinase activity; Cellular component=6-phosphofructokinase complex; Biological process=glycolysis
  Homolog annotation: Hit_ID=Q9STQ7; Match level="QueryCoverage=28%, HitCoverage=9%, E-value=2e-14, Identity=83%"; Hit description =Pyrophosphate-dependent phosphofructo-1-kinase
MDEDRPETHDGRPKRKRRFPCPRNEGPLSSACIRKPSELKPNVSLSSVKVVTDLVVVFDDVEPCLIGSVLFLGTKFVDSDSDVLVIDKSFGFDTAVEEAQGAINFAHVEAESTENGIDIVKLMGRYSVQYKFILFGDGDKNPSYCDLVNMITSDVFDAAVGDIAIVSV

SEQ ID NO: 164586 - protein, 215 aa, Glycine max
  Coding DNA Sequence Number=SeqID_72901
  Gene Ontology: Mol. function=nucleic acid binding; Cellular component= intracellular; Biological process=transport
  Homolog annotation: Hit_ID=A7QCI5; Match level="QueryCoverage=99%, HitCoverage=20%, E-value=8e-75, Identity=64%"; Hit description =Chromosome chr12 scaffold_78, whole genome shotgun sequence
MIRSATVDSSLFSRYFNNCPVVTAEGRTHPVTTYFLEDIYDQIEYRLASDSPASLTDGTFPKGQRDVVTNSRGKKNLVLSAWGDESLLSEEHFNPYFVPSYYQLCSEQTQQNMKRLNEDVIDYDLLEDLICFIDETCDEGAILVFLPGMSEINYLHDKLVASSQFGGPSSEWVIPLHSAVASSEQKRVFLRPPGNIRKLYKETLVDIPDMVYLAP

SEQ ID NO: 164587 - protein, 214 aa, Glycine max
  Coding DNA Sequence Number=SeqID_72902
  Gene Ontology: Mol. function=nucleic acid binding
  Homolog annotation: Hit_ID=A7QCI4; Match level="QueryCoverage=46%, HitCoverage=26%, E-value=1e-29, Identity=65%"; Hit description =Chromosome chr12 scaffold_78, whole genome shotgun sequence
MGLIAEPITNICPALLMSTTSKTMMLYGAMFGCLSPILSVAAFLSYKSPFVYPKDERQNVERAKLTLLNDKLDGPGNTNDIDRQSDHLLMMTAYKRWERILTELVGVLISHPSAYLGQSLLHAPLRSAFCGSFNQNMRLKLPFRSPLIILLVQICSQALLGSFFRNLVFGLCPKMSYEPNSTLQNRLVREMRVQFGTLLADIGLITLPKDYQDK

SEQ ID NO: 164588 - protein, 292 aa, Glycine max
  Coding DNA Sequence Number=SeqID_72903
  Homolog annotation: Hit_ID=A5AXP6; Match level="QueryCoverage=93%, HitCoverage=40%, E-value=1e-75, Identity=55%"; Hit description =Putative uncharacterized protein
MIVRTPPPPKRPRADGDDGQLVIYEDPPESSPPSEQMLCTYQCRQMVKSDFIDALSKAENQARHYQSKFETLEPHFRKVESERKKFQDQFLYAQQELAAAKGREQALQDQLLKEATQSQERLRKQIQLNTQLQVKLQNETDLRQKADSHAASTEEKAASLEGKLGHLSESIEREKKRLHDEHSQLKSDSNLSISRISANLEQMECRANNAEKEAELLKEQLKHLKDQLDECLHQKIEVEKKLSTLMSQEVASTESNVLVKHLQQELRNYCKDTYIDYLMYDSGLILVVMHLA

SEQ ID NO: 164589 - protein, 394 aa, Glycine max
  Coding DNA Sequence Number=SeqID_72904
  Gene Ontology: Mol. function=nucleotide binding; Cellular component =microtubule
  Homolog annotation: Hit_ID=A7Q7W9; Match level="QueryCoverage=91%, HitCoverage=41%, E-value=1e-130, Identity=66%"; Hit description =Chromosome chr18 scaffold_61, whole genome shotgun sequence
  Pfam annotation: Domain name=GED; Domain location=207-300; Score =20.9; E_value=4.5e-05; Accession=PF02212.9; Description=Dynamin GTPase effector domain
  Pfam annotation: Domain name=PH; Domain location=70-175; Score=25.7; E_value=0.00017; Accession=PF00169.20; Description=PH domain
  Pfam module annotation: Pfam domain module=GED::PH; Domain location =207-300::70-175
MERQRREEELKNRSSKKTLDAEQSILNRATSPQTSQQSGGNLKSMKDKSSQQDRDTQEGSGLKTAGPEGEITAGYLLKKSGKGSGWSRRWFVLNEKTGKECNIDEIPDDDEASTKNSKDKKSNGPDSGKASNLIFKITSKVPYKTVMKSESAVLLKAESMADKVEWINKLRSVAQAKGGQAIGEPSFPMRQSLSDGSLDTMARKPADPEEELRWMSQEVRGYVEAVLNSLAANVPKAVVLCQVEKAKEDMLNQLYSSVSAQSSAKIEELLQEDHNVKNKRERVQKQSALLSKLTRQLGVHDNRAAAASSWSDRGSAAESSPRSSGPSSGDDWRSAFDSAANGPSNLTSRYGSGGHSRRYSDPSQNGDVSSGSNSNSRRTPTRLPPAPPQSGSRY

SEQ ID NO: 164590 - protein, 227 aa, Glycine max
  Coding DNA Sequence Number=SeqID_72905
MSSAKSMHLGAISWICSVRTSKIKGGREHTRLVEQGRRETYQAQKHTATPGLVRGSFADVVARREPRIQQRRTSAVQNAKTNTSRSEVHLDRPMTAPKWLQDAWVGRLKNLALLDRVEENMLWDWGLDVVPKYIGDDMVLLPGLTEDKAKQMMEEGNAGREVMFYSVERWNKKMRAGSRLTWVQCWGVPLVAWDPTHLREIVTAIGEVVEVDEEMEDLRKMDRQGSL

SEQ ID NO: 164591 - protein, 61 aa, Glycine max
  Coding DNA Sequence Number=SeqID_72906
MVVTTMTIMMVVVIVIMVVVVMTMKVMRTEVVIDDDSDDNNNYGGDYNGDSDNHDINLSEI

SEQ ID NO: 164592 - protein, 293 aa, Glycine max
  Coding DNA Sequence Number=SeqID_72907
  Homolog annotation: Hit_ID=A7QCD0; Match level="QueryCoverage=88%, HitCoverage=36%, E-value=6e-97, Identity=71%"; Hit description =Chromosome undetermined scaffold_77, whole genome shotgun sequence
MTGYSSYLLLAVVTEERNKLRNFANLKNDETLDASKNANSVQEPESSLMKKDDCVKDLESTLHEQRLVNNCQLEEIKLLNEKLHSEARRVKSLERESDRLRSEISLLEAKLGHGDFSAANTKVLRMVNTLTVDNEAKQTIEALQTELQKTKEKLKALEELKSQSGEAGKLVDSYISDKMLQLKEQIATLEKREERYKTVFADRISVFRRACCELFGYKIVMDEHQRSNGIPVTRFTLQSIYAQSDDEKLEFEYESGNTNILANHYTSQPEVSRQDLILYFFDHDHQYDCEGFV

SEQ ID NO: 164593 - protein, 290 aa, Glycine max
  Coding DNA Sequence Number=SeqID_72908
  Gene Ontology: Mol. function=nucleotide binding; Cellular component =intracellular; Biological process=small GTPase mediated signal transduction
  Homolog annotation: Hit_ID=A7QGU3; Match level="QueryCoverage=97%, HitCoverage=50%, E-value=5e-79, Identity=53%"; Hit description =Chromosome chr16 scaffold_94, whole genome shotgun sequence
  Pfam annotation: Domain name=Dynamin_N; Domain location=11-161; Score= -48.6; E_value=0.1; Accession=PF00350.14; Description=Dynamin family
  Pfam annotation: Domain name=GTP_EFTU; Domain location=6-219; Score= -75.5; E_value=0.015; Accession=PF00009.18; Description=Elongation factor Tu GTP binding domain
  Pfam annotation: Domain name=MMR_HSR1; Domain location=9-162; Score =67.6; E_value=4e-17; Accession=PF01926.14; Description=GTPase of unknown function
  Pfam module annotation: Pfam domain module=Dynamin_N::GTP_EFTU::MMR _HSR1; Domain location=11-161::6-219::9-162
MLLSGSVLQSLAILGRPNVGKSTLLNALLQEDHVLVGPEAGLTRDSIRTQFEFQGRTIYLVLNRHADYTFASRVDTAGWLQMQSTPGIMQSRKSLLQAHIIALVLDAEEACQALPNGLATHGHHSIGKIINARRSMKHAEVIIARWAVEEGRGLVVIVNKMNLPRGKHQSSSYEKVMEIVPQEIQTIIPQVKGIPVVFISALEGRGRTTVLNQVMSRHSWKGQAAQPKVKYFTQSLKENFDLGGIPIRLMQRFVTKKDASGSETRTSKNSHSVGRVIERTVSDKRSVLVE

SEQ ID NO: 164594 - protein, 159 aa, Glycine max
  Coding DNA Sequence Number=SeqID_72909
  Homolog annotation: Hit_ID=A2Q4L4; Match level="QueryCoverage=40%, HitCoverage=6%, E-value=9e-07, Identity=40%"; Hit description=RNA -directed DNA polymerase
MSWINLKGALPLSIKHLFMQYSFLQDASSRNRRWQYWWLAITWSTWQLRNKILFSGATFDGIKLVEDATFLMWTWLHNLEKDFTLHFNQWSSDFNSIRRPSERVGSNERQQDERSIKEFNEWIAELEVEDVPCVGRKYTWYRPNGTVKSSLDRILVSAK

SEQ ID NO: 164595 - protein, 176 aa, Glycine max
  Coding DNA Sequence Number=SeqID_72910
MVLNHSRQKQNTIFECLTTIKAEATQQCLTMHEVLDQIEHQEQQLLQGQRQGRSCWTTGSTNDLKLNPGDRDIKLQTTQQMNRRTGDNGAAQQRAAGRGALTTYKNIPNLATAFEEGLQTKAMGTLWLGNNITVCNTRESCPAEKENAGLAEAIFDQKDEALMENKKGMQQLDSKG

SEQ ID NO: 164596 - protein, 255 aa, Glycine max
  Coding DNA Sequence Number=SeqID_72911
  Gene Ontology: Mol. function=thiopurine S-methyltransferase activity; Cellular component=cytoplasm; Biological process=metabolic process
  Homolog annotation: Hit_ID=A5AQ16; Match level="QueryCoverage=56%, HitCoverage=70%, E-value=7e-61, Identity=82%"; Hit description =Putative uncharacterized protein
MDWIGFVKNIKKRKKAEQRGRWKKKKEEGMSATVTLTLNLCRSSIVASCPHYSHKPNPNFNAFFSFSLSLSLSHHRRIVIYKKPFPSRRTWLYGYMNRDRDYELENGLALFGSDEELATQIPTQAQSLVEGSGSIRIAEFKPVPDVDYLQELLAIQQQGPRAIGFFGTRNMGFMHQELIEILSYAMVITKNHIYTSGASGTNAAVIRGALRAEKPELLTVILPQSLSKQPPESQELLSKVFVINNYICIFPEKQF

SEQ ID NO: 164597 - protein, 359 aa, Glycine max
  Coding DNA Sequence Number=SeqID_72912
  Gene Ontology: Mol. function=nucleic acid binding
  Homolog annotation: Hit_ID=A7QCI5; Match level="QueryCoverage=83%, HitCoverage=26%, E-value=4e-51, Identity=44%"; Hit description =Chromosome chr12 scaffold_78, whole genome shotgun sequence
MAPKKNKQKAKAQSGPKLQISAENENRLRRLLLNSARPTTATAADDTLTKAQKAKKLKAVYEKLSCEGFGNHQIELSLSALREAATFESALDWLCLNLPGNELPLKFSTGISHYDQGGSVGVISNQPAVDAASITIEEEAPESPVLIRRQWKNDDTLDSRLTSQADWIRQYVEQQEEDESESWEDDIFFDGRSAKHKPCEPRSYDVIAKEYLAARLEATKAKEKRDKNRQEQAGHIIRKLKQELSALGLSDDSLALEHEHEISYTFKSERASTGPEAVDCFKEKTPCDTEGLASGKTEVAESDVESHSMVEHLVKSGSLVVHVEKDSAQGEVGDIELGGLFLEDASPSEILPPDILKVQ

SEQ ID NO: 164598 - protein, 103 aa, Glycine max
  Coding DNA Sequence Number=SeqID_72913
  Homolog annotation: Hit_ID=Q8LAQ8; Match level="QueryCoverage=76%, HitCoverage=28%, E-value=5e-09, Identity=36%"; Hit description =Putative uncharacterized protein
MEEAQIWAQKVELPTFMGTYPIGWIARAEKFFEVLEIPSFHKLQYAFMSMEGAATHWFYIWSQNNPDSDWESFSTVLIKRFRDRHGTVITEPGRNHKKRKVQE

SEQ ID NO: 164599 - protein, 141 aa, Glycine max
  Coding DNA Sequence Number=SeqID_72914
MNYRNHVISTVYLINRLPSSSIHQKGYKCMTADGRIYISKDMIFDELSFPFPRFFGDTASATTSATTASDTSASQAAALVQQSPVSSTSVDVDPVSDFPDSQQHQEPLPTDVAYSQATALVRPENIHPMCTGAKAGVDKPR

SEQ ID NO: 164600 - protein, 129 aa, Glycine max
  Coding DNA Sequence Number=SeqID_72915
  Subcellular localization annotation: CTP_CleavageSite=42; ConfidenceScore=5.13e-01
MITGLCQSFGVPVTPSKVIRPPITGPSLRSIARLDRRRHLVRQQAANHRGQVQTHECLYQLSLSLQSQGFAPFACPTPNQFRAEAAWPGDWPEAQAGEAPAKAPGDPEDTCMDEEMTDLLDFLGGSGAT

SEQ ID NO: 164601 - protein, 102 aa, Glycine max
  Coding DNA Sequence Number=SeqID_72916
  Gene Ontology: Mol. function=oxidoreductase activity
  Homolog annotation: Hit_ID=A5B7X5; Match level="QueryCoverage=52%, HitCoverage=16%, E-value=1e-11, Identity=61%"; Hit description =Putative uncharacterized protein
  Subcellular localization annotation: CTP_CleavageSite=35; ConfidenceScore=5.58e-01
KPVYTPLAPNTQPPLPRVGRFINAAGTTGFPTGKRAVSATQLMFRDKEFRSGLFSCPSEEAVIESHIKPATYRKFTSREYRQQTEKDVKQTGDKVGLSRFLL

SEQ ID NO: 164602 - protein, 172 aa, Glycine max
  Coding DNA Sequence Number=SeqID_72917
MFFKKLEFDLYSKQVKPSRALNKPSHRPLTSGSAHFHPYLPYGLPPNYTPPSVAHAPDENVDNSGPIPFESQQPQSGHANVSQPMGETPEVPQNHTLANFKPHLGYVTEGQAFGSTPLLNTLGGPQYRPQPQPLHFAVGRVPPTMVEREKFDHIEERLKAIEEGEDYAFADM

SEQ ID NO: 164603 - protein, 150 aa, Glycine max
  Coding DNA Sequence Number=SeqID_72918
MGYIQTVPPPPVRDSLTDHVVSTGELCVVPGQVAPDYMQWFFQISHPFVTPTEDTGEPRPAPPPPTHDDDFVEPPVAEVPVASDPPTHYVVDCTACIRIGRIAEHLERVINLRMVTARTDLYDIMNLCLRIVRDVDPNDSPRPRQRPRID

SEQ ID NO: 164604 - protein, 157 aa, Glycine max
  Coding DNA Sequence Number=SeqID_72919
MQLLCISGQDFTRAAAKRRVRIMRTNMTTLTQIWMTFLLSNIPPGDRNADLPLRKYQLVCAVSTWVRVVPTRHPVDPKEPNMALGFPVLVTGLCQSYRAPVPPANSCHRDIGKDRARKTPSGPGEGQQGLGVASSNYRPLLVLRSACRPQQGHQAPY

SEQ ID NO: 164605 - protein, 547 aa, Glycine max
  Coding DNA Sequence Number=SeqID_72920
  Gene Ontology: Mol. function=4 iron, 4 sulfur cluster binding; Cellular component=membrane; Biological process=generation of precursor metabolites and energy
  Homolog annotation: Hit_ID=A6T8Q6; Match level="QueryCoverage=99%, HitCoverage=99%, E-value=0.0, Identity=89%"; Hit description =Fumarase B (Fumarate hydratase class I), anaerobic isozyme
  Pfam annotation: Domain name=Fumerase; Domain location=47-328; Score =475.9; E_value=5.3e-140; Accession=PF05681.5; Description=Fumarate hydratase (Fumerase)
  Pfam annotation: Domain name=Fumerase_C; Domain location=332-541; Score=395.4; E_value=8.6e-116; Accession=PF05683.3; Description =Fumarase C-terminus
  Pfam module annotation: Pfam domain module=Fumerase::Fumerase_C; Domain location=47-328::332-541
MSNKPFYYQNPFPLAKDDTEYYLLSRDHVSVANFDGEEVLKVDPKALTLLAQQAFHDASFMLRASHQQQVASILADDEASQNDKYVALQFLRNSEIAAKGVLPTCQDTGTAIIMGKKGQRVWTGGGDEAALSQGVYNTFIEDNLRYSQNAPLDMYKEVNTGTNLPAQIDLYSVDGDEYKFLCIAKGGGSANKTYLYQETKALITPAKLKNYLIDKMMSLGTAACPPYHIAFVIGGTSAESTLKTVKLASTHYYDSLPTEGNEHGQAFRDVQLEQELLEASQKLGLGAQFGGKYFAHDIRVVRLPRHGASCPVGMGVSCSADRNIKAKINREGIWIEKLEDNPGRYIPEALRQQGEGEVVSVDLNRPMSEILAQLSAYPVATRLSLNGTIIVARDIAHAKLKERIDNGEGLPQYIKDHPVYYAGPAKTPEGYASGSLGPTTAGRMDSYVDLLQANGGSMVMLAKGNRSQQVTDACHKHGGFYLGSIGGPAAVLAQQSIKSLECVEYAELGMEAIWKIEVENFPAFILVDDKGNDFFQQIHNQCAACVK

SEQ ID NO: 164606 - protein, 404 aa, Glycine max
  Coding DNA Sequence Number=SeqID_72921
  Gene Ontology: Mol. function=phosphatidyl-N-methylethanolamine N -methyltransferase activity; Biological process=metabolic process
  Homolog annotation: Hit_ID=A1JNV6; Match level="QueryCoverage=26%, HitCoverage=57%, E-value=3e-19, Identity=44%"; Hit description =Putative methyltransferase
MKSGTCAICAVNMKQTREQENKMLASALMVMRAKANFVQQFIRNPRKMGSITPSSAALCRAMCETVNWEHSLRIAELGAGDGVLTRHLLAHMAPQAQLDVFEISPELVKGLRRWNDARMQVRACSAEYLSGETGAARRVCPVSVHLADPAQPVTLLHLAAPAGAEKYATRVGLSLHAALRALSLRLRARLLPETLQQLARPVFARQLRAIIADAGRQTGAPAANSAGSGNHPALNAPAPVPAAAVPAPTGGATTTPGRPPATVPATDRAVRVIAHFTAQRIGHQLMAIANAEQRQLRVDGRTNPGGGALAPVGVIGHHRPRTAENRAADARESRQLFPEMRPHNDIIIRLARVGIAGASATVSDLDALCGGGYRAGAVLPHHARPATVAADAGVYLWLHALFTA

SEQ ID NO: 164607 - protein, 134 aa, Glycine max
  Coding DNA Sequence Number=SeqID_72922
  Subcellular localization annotation: CTP_CleavageSite=65; ConfidenceScore=5.76e-01
MSMPVRPPDVAATPSPPPTEARPFSSHVDAPGPSTVPAFTPSPSSVDARGPSPVPTSTPSPSTVVANMPIDEDATNLVMEDPSINDCLMVTLINLAFHPSKVATKAITLSIRQQFGQPWPTQGAIPKDHRELFF

SEQ ID NO: 164608 - protein, 55 aa, Glycine max
  Coding DNA Sequence Number=SeqID_72923
MHLRDQDLHTTKSLKLSEIWTSLSRTKDMQELLKKNGQTPLLNLISGNSDPLSAH

SEQ ID NO: 164609 - protein, 105 aa, Glycine max
  Coding DNA Sequence Number=SeqID_72924
MLAIESGMSPLVLVAYRQLFATVSIAPFAYRLEWQNTSTTVLMKTRLYSLIYQQRRVLQPPSLKPQTTMTVYTPPTLTYYQTTSVVSPPPMLTGNKTTTGLVNPT

SEQ ID NO: 164610 - protein, 134 aa, Glycine max
  Coding DNA Sequence Number=SeqID_72925
  Homolog annotation: Hit_ID=O52175; Match level="QueryCoverage=61%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELV

SEQ ID NO: 164611 - protein, 312 aa, Glycine max
  Coding DNA Sequence Number=SeqID_72926
  Subcellular localization annotation: CTP_CleavageSite=41; ConfidenceScore=5.26e-01
DCIKAQSQNSDKLPSQTVQNPKNVSAITLRSSNQIQVPPPVAAPAPELVKLHSTPEKEDETVAQKRKLPNKIFHAGGPSSSNFDLQQPPIPLPFPPRAIPNKKMEEELCTHKRMLKGNERISMGRNVSALIGKSVPHIPEKCKDLARTKIDVYAGTLSMEFGDIVVHFNILDAMKHPSKDHSIFRAEIIDQIVDDYMFDFDYVLHGRKHPFLSDLHTSHSLCIEFESEFEFDPVSDFYAKHEFEFESGVVPLDVDFLESECTNHVAGSTYTSDLLYEVYAEEPSSSPTLDEEKFLVIISASLVVEQEEKLLL

SEQ ID NO: 164612 - protein, 311 aa, Glycine max
  Coding DNA Sequence Number=SeqID_72927
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=99%, HitCoverage=31%, E-value=1e-129, Identity=100%"; Hit description=DNA- directed RNA polymerase subunit beta
  Pfam annotation: Domain name=RNA_pol_Rpb2_3; Domain location=45-101; Score=6.8; E_value=0.0033; Accession=PF04565.7; Description=RNA polymerase Rpb2, domain 3
MTSYGSERITNKIPHLEAHLLRNLDKNGIVILGSWVETGDILVGKLTPQMAKESSYSPEDRLLRAILVPAGRLRYPRCPIDTSEGINVGLIGSLAIHARIGSWGSIESPFYEISERSKRIRMLYLSPSRDEYYMVATGNSLALNRDIQEEQTVPARYRQEFLTIAWEQVHLRSIFPFQYFSIGASLIPFIEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKTS

SEQ ID NO: 164613 - protein, 57 aa, Glycine max
  Coding DNA Sequence Number=SeqID_72928
PNHKAMSRYMEKKMKNKELNLLALALLHQWSPLLLEDQCQQNGKGGKVIGDTTSRRR

SEQ ID NO: 164614 - protein, 206 aa, Glycine max
  Coding DNA Sequence Number=SeqID_72929
MVKRKVIHTRRPNQLALLCLLGSFYYLTNTEHAYTNPLKNLRIARHGKFGENSARSSVLAWVYRPTKPRPNDFGRKPIELVQPSRPNSIQARLIPLVQPNSVSSTEFGSVISAEGSSANTAEFSACRTFLDGSANMIQVRPTPIQLCYAQASQALQVQPNFTQHVPYSHSWPNQVHPPLPINCLLESLFGGLRARTLFTVTGCLGF

SEQ ID NO: 164615 - protein, 183 aa, Glycine max
  Coding DNA Sequence Number=SeqID_72930
MASMMEAMLGMEQLMENNVATAAAVSSAVEADPTLPATAHHPLPNAVGRERSTLGHSSNPHLGYNWVAYPYGLPRNYTPPVMRDDTGHVPSPGDSSNSAPVQPRAPAPIQRETPSSGSNPDSPGRQRPLWRWFQRDEELSPKANSRIHPDLNDVRRPLAVPHRQPNGFDISWEDLPTSFLKVV

SEQ ID NO: 164616 - protein, 32 aa, Glycine max
  Coding DNA Sequence Number=SeqID_72931
MANIYARRQGADAAAIQMIFLRSFWSARNLLL

SEQ ID NO: 164617 - protein, 235 aa, Glycine max
  Coding DNA Sequence Number=SeqID_72932
  Homolog annotation: Hit_ID=Q6UUU1; Match level="QueryCoverage=25%, HitCoverage=40%, E-value=3e-18, Identity=78%"; Hit description =Putative uncharacterized protein
  Subcellular localization annotation: CTP_CleavageSite=42; ConfidenceScore=5.16e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTFNCIPHETEYEAQLPAIRLQSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGDT

SEQ ID NO: 164618 - protein, 55 aa, Glycine max
  Coding DNA Sequence Number=SeqID_72933
MPEDPTTSVLAMDTSPLATPVLHLTDEEDVQTQDTQDQFVSFGAEKLYNSTKVLV

SEQ ID NO: 164619 - protein, 170 aa, Glycine max
  Coding DNA Sequence Number=SeqID_72934
GLAQPPEPEIGPSVTRVNTKESFVDPSGNDPNTGDLDKYELYIKENPPRLVALGRVYKGSTTAHNIPLLHDQIKVGVEEVRDADAPILVPTEYVMLVGEALNTFLAWPTHLVKHLSEQGDVGPAKPADRPDHDVNDPLYMMTLKIPQVFLKPLQVMWDATVFGMFNEDFP

SEQ ID NO: 164620 - protein, 56 aa, Glycine max
  Coding DNA Sequence Number=SeqID_72935
MTENKRGYISCGSVLVEGTSTRVSKRTREEACVESTSTNKKESSSDATTNPRGSSR

SEQ ID NO: 164621 - protein, 160 aa, Glycine max
  Coding DNA Sequence Number=SeqID_72936
  Gene Ontology: Mol. function=oxidoreductase activity, acting on single donors with incorporation of molecular oxygen, incorporation of two atoms of oxygen; Cellular component=extracellular region; Biological process=...
  Gene Ontology: Biological process=fatty acid biosynthetic process
  Homolog annotation: Hit_ID=Q93YA9; Match level="QueryCoverage=53%, HitCoverage=9%, E-value=3e-22, Identity=60%"; Hit description =Lipoxygenase
MAPSGSKELMRLRNGAKFPMAAISEDLIKTTMTVHAEKPVQFKVKVVVIMRNKIKEDFKETILKHLDVINDRIGTRNIVLELFSTKIDSNDLFHNCCTIALRPLRIRLGGSLQDQVLYDVGSLKSPCHPLQKVKGGLFGFSKGCLHMKRWDELNQFFYET

SEQ ID NO: 164622 - protein, 168 aa, Glycine max
  Coding DNA Sequence Number=SeqID_72937
  Homolog annotation: Hit_ID=A7PI75; Match level="QueryCoverage=72%, HitCoverage=6%, E-value=1e-09, Identity=36%"; Hit description =Chromosome chr13 scaffold_17, whole genome shotgun sequence
MVCSAAVNQRTRSGRLHFWRISDESEEKAAFLQAVSSFGKDLRIILQHVGTKSKDRCKKFFIKGQKSHRLDLMRHRLENIGSLLNEIDIGMSTYTNDAHIVEGDSAADNDKLDTKTNDDQPSSAANSSHDKSKPMEARNLSTNFKESVMAMISQAPKQTMSSLHLART

SEQ ID NO: 164623 - protein, 66 aa, Glycine max
  Coding DNA Sequence Number=SeqID_72938
MNQATLLQTSGKSETLVELQGLPQTSKGISAQPAPTWAIGMPIMRHVATDFENTIMGSKIATIFNV

SEQ ID NO: 164624 - protein, 232 aa, Glycine max
  Coding DNA Sequence Number=SeqID_72939
  Gene Ontology: Biological process=embryonic development ending in seed dormancy
  Homolog annotation: Hit_ID=A5BGH4; Match level="QueryCoverage=56%, HitCoverage=66%, E-value=8e-28, Identity=52%"; Hit description =Putative uncharacterized protein
  Pfam annotation: Domain name=LRR_1; Domain location=16-38; Score =19.5; E_value=0.012; Accession=PF00560.24; Description=Leucine Rich Repeat
MLEGPIPDGFGKVMNSLEVLDLSGNKLQGEIPSFFGNIELVVSEIGPKRPIKPNRSEPDAVFQYPVAAASVNNIPELHKFQSLQSPSHAIISSAGFVDAQDEFVETQYYKELASIDKQHHTTVSGFIKAAREGGEGEYEIQLPNNHVNAAETQPRSYKSNPATNDWVPNSDEHQAQELKGTVPTGVGAKGHSTRGLRAAPMRSTKLTQRTNKEKVLAAGEDEDIVGNKAFYV

SEQ ID NO: 164625 - protein, 37 aa, Glycine max
  Coding DNA Sequence Number=SeqID_72940
MDKSLKVGKDEWREREIRAMVQPTNPRSSPRFSAKCT

SEQ ID NO: 164626 - protein, 209 aa, Glycine max
  Coding DNA Sequence Number=SeqID_72941
  Homolog annotation: Hit_ID=A7PI75; Match level="QueryCoverage=83%, HitCoverage=9%, E-value=1e-14, Identity=33%"; Hit description =Chromosome chr13 scaffold_17, whole genome shotgun sequence
  Pfam annotation: Domain name=Myb_DNA-binding; Domain location=22-67; Score=31.8; E_value=2.6e-06; Accession=PF00249.22; Description=Myb -like DNA-binding domain
MVCGAAVNKERVQEDSIFGGNTMKWTDEEKAAFLQAVSSFGKDLRMILRHVGTKSKDWCKKFFIKGQKSHRLDLMRHRLENIGSLLNEIDIGMSTYTNDAHIVEGDSAADNDKLDTKTNDDQPSSAANSSRDKSKPMEARNLSTNFKESVIGNDKSGTKTNDEQSSSGTNLSHDKSKPVEARNRSADLNESREINREFDHQDKTIISNT

SEQ ID NO: 164627 - protein, 72 aa, Glycine max
  Coding DNA Sequence Number=SeqID_72942
MVASLVLSRAPPLIALLGFLCGLVTLGERRLALGEAVDGLLEFVSGGLTGVVVRHGGEGRPDQFDTNQEWKR

SEQ ID NO: 164628 - protein, 119 aa, Glycine max
  Coding DNA Sequence Number=SeqID_72943
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=ATP synthesis coupled proton transport
  Homolog annotation: Hit_ID=P92549; Match level="QueryCoverage=56%, HitCoverage=13%, E-value=5e-21, Identity=79%"; Hit description=ATP synthase subunit alpha, mitochondrial
ARKGFRLSFIETQARDILAYIPTDVISITAGQICLKTELFYRGIRLAINVGLSVSRVGSATLLKATEQVCGSIIDGHVDIYIEEASSNESTQAQARSRLGLDGNPFAYAEGVLNDDSLN

SEQ ID NO: 164629 - protein, 133 aa, Glycine max
  Coding DNA Sequence Number=SeqID_72944
  Gene Ontology: Mol. function=DNA binding; Cellular component=nucleus
  Homolog annotation: Hit_ID=A7PI75; Match level="QueryCoverage=55%, HitCoverage=4%, E-value=1e-23, Identity=71%"; Hit description =Chromosome chr13 scaffold_17, whole genome shotgun sequence
  Pfam annotation: Domain name=Myb_DNA-binding; Domain location=25-71; Score=24.6; E_value=0.00038; Accession=PF00249.22; Description=Myb -like DNA-binding domain
MFSMFNSSNELVEDPLAVEREGAMINRWTLEERNIFSEKLAAFEKDFKKIASFLDHKTTADCVELYYKDHKTNCLEKDKKKKKKKMGCKSQKSKTSTTTVKGLVNQRTRSGRLHLWRKSDESERVAVDALIEM

SEQ ID NO: 164630 - protein, 40 aa, Glycine max
  Coding DNA Sequence Number=SeqID_72945
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=ATP synthesis coupled proton transport
  Homolog annotation: Hit_ID=Q6E2W4; Match level="QueryCoverage=97%, HitCoverage=9%, E-value=1e-11, Identity=92%"; Hit description=ATP synthase subunit alpha
VAFAQFDSDLDAATQALLNSGARLTEVLKQPQYASLPIEK

SEQ ID NO: 164631 - protein, 114 aa, Glycine max
  Coding DNA Sequence Number=SeqID_72946
MVCGAAVNQRTRSGRLHLWRKSDESERVAVDAFIDMCDSLSPKATKRCLANNISTNTNYAHVWEADLVIDNDESGTKTNDDQPSSVVNSSRDKSKPMEAMNLSAYFKESVIGND

SEQ ID NO: 164632 - protein, 117 aa, Glycine max
  Coding DNA Sequence Number=SeqID_72947
MTLCLIDCSTRWHNLVDADLLLIVLIKYGAAHHDPFHCKEAKKETEHGPCKRTYGFFLICSASYNVFLHNKHGTFWVNTILLPSDNTRVVRMRKGAKFPMTEQETLCCNLSAPRLIQ

SEQ ID NO: 164633 - protein, 398 aa, Glycine max
  Coding DNA Sequence Number=SeqID_72948
  Subcellular localization annotation: CTP_CleavageSite=28; ConfidenceScore=5.33e-01
MILKSYLFPIESLTPQDNFKSRPTFFLFAKSRPTFFLNAIEAGFNLKLHQSPRRRQLGRLHEPFQLDQRKTLRLVRGSHRSHEQTREQRQRRCRSGWGSEKSQGSYSAFDLRRGRGKIRGETCFCQCFLQRQCLYNQQRPQVDSHNNELVSVSNVAAPNLTYSNESKLNSDEDEDGWEFKSTEWETGTKSQDVKAKTPKHDNGALDVDKAGRWHVEFEFSPHSASQGHINPQPSPESESNDIGTGFAMFSQYFGEFSSGSGPNQNLIIKECPLTQSDCGFVDFVSPYFHQFHIHSLHLGAKIHSHNFPYANLFQCVSEKFEERKESQLIYILINKLEIDDGGYYSTTTSLSGSIGQVMRPKSPLSGLVDFHGKQKQMVKIQVLEREIGLLQHIKASKS

SEQ ID NO: 164634 - protein, 167 aa, Glycine max
  Coding DNA Sequence Number=SeqID_72949
  Subcellular localization annotation: CTP_CleavageSite=19; ConfidenceScore=5.44e-01
MATPPVSPPPPPPSHASVSPSTVKWTCKATRLRLWATRPPGAERLVVNVDPDTGKANGPHKKKLRTYLGIVARDKVNVTYETWKEVPAAQKDLIWEDIQAEFEIPEASDADHDSVADIVCEKYGISKDKWTQFCETCRDPSWEDVRKKPSGNKTLPPTCCLVGVKNI

SEQ ID NO: 164635 - protein, 90 aa, Glycine max
  Coding DNA Sequence Number=SeqID_72950
MVFVGSGSGVGRSIQPLSAVPLNDDMQSFLTTKVVIELEIPREVENMETANKDITQREDCLNQASFLETQMELPQLAKKVDKRNKGICEI

SEQ ID NO: 164636 - protein, 58 aa, Glycine max
  Coding DNA Sequence Number=SeqID_72951
MGVQIATRPTWALQKIPPEGCCFWRKQPCSPGRAGNFAKVSTVLRHSSSVLHHSSIFT

SEQ ID NO: 164637 - protein, 314 aa, Glycine max
  Coding DNA Sequence Number=SeqID_72952
  Gene Ontology: Mol. function=DNA binding; Cellular component=nucleus
  Homolog annotation: Hit_ID=A5AZS6; Match level="QueryCoverage=59%, HitCoverage=9%, E-value=2e-22, Identity=39%"; Hit description =Putative uncharacterized protein
MSYTPNCEAELKEKEMRKNTQNYVVHLEKGYIHGRENKKLFYYCCSHSPTHRDLKPENFLFDTVEEGAKMPRERAWSWVLVEVGILMMSLSFPWRRSSPMQSLGSGANAEDHAGLDILDDLVGGKEEGVGDTFCVKDETTDSDVCDLGGSPGPVPPKNHQLKFPLSSQRKDVISLNRLRSSIVELLHFDKPGSVDSNSEGFTAMTKLQIWKNVISQALEQTETEICSLENELEPLQFESGDGMPCYNTKSCDKEIGDYHKVTHHPELSQIGPSNDDNNTEKMMPLSANLHGMHDTTKENDIDNPGTTTPKFVEA

SEQ ID NO: 164638 - protein, 252 aa, Glycine max
  Coding DNA Sequence Number=SeqID_72953
  Gene Ontology: Mol. function=DNA binding; Cellular component=nucleus; Biological process=regulation of transcription
  Homolog annotation: Hit_ID=A7PI75; Match level="QueryCoverage=94%, HitCoverage=17%, E-value=2e-44, Identity=39%"; Hit description =Chromosome chr13 scaffold_17, whole genome shotgun sequence
  Pfam annotation: Domain name=Myb_DNA-binding; Domain location=79-124; Score=25.3; E_value=0.00022; Accession=PF00249.22; Description=Myb -like DNA-binding domain
MSLVPSVFAAGDQLSLVPTSEMINYTSQLLSKPQYEVNRKILKMPALILDQKDKMFSMFNSSNELVEDPLAVERERAMINCWTSEERKTFTEKFAAFGKYFRRIASFIDHKTTVDCVEFYYKDHKPNCLEKDKNKKNKKKGCKSQKSKTSKTIVKGLGKKGNCKANVDSQKKLIEAPAMAKFDESERVEVDALISMCDSLSTETTRLPCQQPVTPDITRRDIDDGTCEWTDEENASFLQAVSSFDEDFRMIA

SEQ ID NO: 164639 - protein, 152 aa, Glycine max
  Coding DNA Sequence Number=SeqID_72954
  Homolog annotation: Hit_ID=A7P9F6; Match level="QueryCoverage=50%, HitCoverage=21%, E-value=4e-17, Identity=54%"; Hit description =Chromosome chr3 scaffold_8, whole genome shotgun sequence
MTPHISAVVSSTTTSPPCDVMWDKVVSVHDHHVPPYVIGIGASLYCPLCLHYFLPIGMETLAQNLFNGMLVNGRSIVVEAIALLKGRWKILQDLNTKIQFSLLCLKEANHIYSRHRVFIAGKREFYWVEACAWHGVLPYHNPNNECPKLFIF

SEQ ID NO: 164640 - protein, 231 aa, Glycine max
  Coding DNA Sequence Number=SeqID_72955
  Homolog annotation: Hit_ID=A7PEN3; Match level="QueryCoverage=81%, HitCoverage=32%, E-value=8e-20, Identity=30%"; Hit description =Chromosome chr11 scaffold_13, whole genome shotgun sequence
MALAQWDLAASDSWIEGGQIFGFGDNERAQLGHDTSPNIEWDSVMYRSFLRCDDPKGVVECGIIRKYKTRSHKVKDKTKILKTGENLETSLSLMNKRYKEENKVPKGCDGNLIDPSSYRDIMFDEKSEDIAEDRIDAKMIGRMQANPFGEQSKPKGFQRPQPSVGGCLSNCQEELKKVIKESLVMQNMFPKTSKRLNTAIAPKMERPPSLIFKLMGLEEAPSKSFPAVKQK

SEQ ID NO: 164641 - protein, 105 aa, Glycine max
  Coding DNA Sequence Number=SeqID_72956
MVGAFSQNIVTLTGLPMILLSESDLTNPLCGVSCYVLLSAPGWFFTDMHTSFSPDGKLVVTGGFSNRKVWHVLFVYIIGSWLYISLSTLLNGMGVGAGCAKCEKL

SEQ ID NO: 164642 - protein, 60 aa, Glycine max
  Coding DNA Sequence Number=SeqID_72957
MSAALMADRSGVTFHEDISNAAIPLGVILAILDPMLIAVSKNGHAVIAGKSIVLNFPTQL

SEQ ID NO: 164643 - protein, 112 aa, Glycine max
  Coding DNA Sequence Number=SeqID_72958
MVHNIPLLHDQVKVGVEEVIDAEALIPVPTDKAAVSPAKPPKSLDHEVDDPLYLMTLTIPQLFLKPLQVMWDASLFGLFNSDFPLYIKHEDLSEIPHGGQCLSISVIQLWIL

SEQ ID NO: 164644 - protein, 61 aa, Glycine max
  Coding DNA Sequence Number=SeqID_72959
MSESLKKGPLVRKVNQTGWSYLRSKEKDQREAVLSCRTIDYGSSKHFFLCETMPQAELEMR

SEQ ID NO: 164645 - protein, 20 aa, Glycine max
  Coding DNA Sequence Number=SeqID_72960
MGEVVAAQLAQMGPNARYTP

SEQ ID NO: 164646 - protein, 308 aa, Glycine max
  Coding DNA Sequence Number=SeqID_72961
  Gene Ontology: Mol. function=aminopeptidase activity; Cellular component=integral to membrane
  Homolog annotation: Hit_ID=Q6J5N4; Match level="QueryCoverage=40%, HitCoverage=98%, E-value=2e-48, Identity=68%"; Hit description =Protein crcB homolog
  Pfam annotation: Domain name=CRCB; Domain location=180-296; Score =154.5; E_value=2.9e-43; Accession=PF02537.6; Description=CrcB-like protein
  Subcellular localization annotation: CTP_CleavageSite=41; ConfidenceScore=5.03e-01
MAQAILVSGPIATRVIACGCARTLSMMNCTALSATSLYGVAGAEGASASGREQPRYTGALMFIFAQNSRAFFTAWPTATLPNTVVMPSSRCVRAAYASAKASSTPISVSKIRVRIGISLLMMSATVNIVTSAAPAYYRASEVMACHLTQPPSGYRRLMTPDNLLIPARETAELQTMLKSLFAVMIGGAIGCTLRWLISLRFNTLFPNLPPGTLIVNLVGGFIIGAAMAWFVRNPHIDPVWKLLIVTGLCGGLTTFSTFSAEIVVLLQSGKYLWAMSSVMVHVIGSLLMTFAGFAVVNLLGYTTRLNHP

SEQ ID NO: 164647 - protein, 108 aa, Glycine max
  Coding DNA Sequence Number=SeqID_72962
MGSKQSDYIPIDLEINTICRRRNQERIRKFLQDLEAAAIPKEEPQSSEASSSFPIAEHSHLDPSEDYIMVEEPRRVTLEDYSSSNVPQFFISIAQPEVKHKPLLIHHH

SEQ ID NO: 164648 - protein, 218 aa, Glycine max
  Coding DNA Sequence Number=SeqID_72963
  Homolog annotation: Hit_ID=A4WE01; Match level="QueryCoverage=70%, HitCoverage=82%, E-value=1e-54, Identity=67%"; Hit description =Putative uncharacterized protein
  Pfam annotation: Domain name=N_methyl; Domain location=6-29; Score =20.4; E_value=0.0068; Accession=PF07963.3; Description=Prokaryotic N- terminal methylation motif
MSMRQRGFSLTEVLIATAVSSLLLISASRFLPGLQRAVLLQSGQREREEEVWQHLFAIGKQLQRAGYCAGNCQGQGLLIGRQGSCVIVRWDANSNGKWDSTASENDSTGFRLESGALETLRGATSCEGKGWEKLTDPESLAITHFKVSKADRAGGTLAGAVHGYGVQPVRRQRGISSLALVLLLLVLGTLILTGLNQQLVTFSALVAGESRSLQQQAS

SEQ ID NO: 164649 - protein, 138 aa, Glycine max
  Coding DNA Sequence Number=SeqID_72964
MGWMVEGCLRPKAMIPLVHRDLVAYNRNDSRYIAAPIYLFTASGVSTSLARGWDSFTCIPASTTKSSGLNAPTTAVQPFLGFVESGFPFTHNGGPHLTRQAATGHNALFAQQIHFEVDLSARPIVGMCTIYHKGPISQ

SEQ ID NO: 164650 - protein, 155 aa, Glycine max
  Coding DNA Sequence Number=SeqID_72965
  Gene Ontology: Biological process=transposition, DNA-mediated
  Homolog annotation: Hit_ID=Q1J7G7; Match level="QueryCoverage=21%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLWLRRGNQHIGNDDVKVFRRKFDIMKRHE

SEQ ID NO: 164651 - protein, 22 aa, Glycine max
  Coding DNA Sequence Number=SeqID_72966
MSPMESPIVATYPSAGGRRETD

SEQ ID NO: 164652 - protein, 140 aa, Glycine max
  Coding DNA Sequence Number=SeqID_72967
  Subcellular localization annotation: CTP_CleavageSite=62; ConfidenceScore=5.55e-01
MKDCRNTSSGDVSSTSRTSQSLTNASQSLRMALVSADLHTTKSPKLSGTWTFLSLELSKHAEASRKGQTPLKNLISGINRWSSRLFSLSGWTEVVRLAGWPFAQRTSIAHPSSRFFLALSRGILHSADGSLSQSAGLARR

SEQ ID NO: 164653 - protein, 183 aa, Glycine max
  Coding DNA Sequence Number=SeqID_72968
MSCLVIITPTFLCRSVSWCMEPTRHSLVPDKSNRALGFLALITGLCKSFGVPVTLCKVIRPPITQAFIEKYCTPRQAQGDAPQAADAPPPPHQADPAGSLGMERYLQHLVHQQVPNHRGQGQGFAPFTCPTPDQFRAEVAWPGDWLEAQVGEAPAVAPGDAEEARMDEEMTDLLGFLGGSGAT

SEQ ID NO: 164654 - protein, 256 aa, Glycine max
  Coding DNA Sequence Number=SeqID_72969
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGSSLFTSGKCTVMQSYPARALDRKHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 164655 - protein, 106 aa, Glycine max
  Coding DNA Sequence Number=SeqID_72970
MKLASTVFPKEIPPGLPPLRGIEHQTDLGEGQGPRELKSLCYACVVGAQDVSYPLSANIVFCTLCQSRPTSPLTRRDLHRLPCSQSLSVLTREVRGQAEIPKWLSV

SEQ ID NO: 164656 - protein, 128 aa, Glycine max
  Coding DNA Sequence Number=SeqID_72971
  Gene Ontology: Biological process=transposition, DNA-mediated
  Homolog annotation: Hit_ID=Q1J7G7; Match level="QueryCoverage=28%, HitCoverage=65%, E-value=3e-10, Identity=71%"; Hit description =Transposase
MVKVGTSYVPINVSFSPKVGPGLPGINRDTRIYLFCEVIFRHRCSWLLFLSAVPPVQLLTGWCVTAKAPPDISAGKCSGRVPFAIQAAQLLGRAIGAGLFAITPAGERGMCCKAIKLGNARVFPVTTL

SEQ ID NO: 164657 - protein, 137 aa, Glycine max
  Coding DNA Sequence Number=SeqID_72972
  Subcellular localization annotation: CTP_CleavageSite=42; ConfidenceScore=5.39e-01
MHTQGFTIPQFLRIGITHKKVPSGVANCRNMPFCGRAKARLSGALSKGGKMRGVATNVYLWETSEKPKETGQDEILSSGVVFTLKEGDHFKALDLKNDPFYLQNRGGACHPARPGEQGCFLQKQQPSGGRIWKVQVG

SEQ ID NO: 164658 - protein, 146 aa, Glycine max
  Coding DNA Sequence Number=SeqID_72973
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=72%, E-value=3e-24, Identity=69%"; Hit description=LacZ protein
MYSPIQIFHRIIDKWIPFVLSLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 164659 - protein, 150 aa, Glycine max
  Coding DNA Sequence Number=SeqID_72974
  Homolog annotation: Hit_ID=Q2HW90; Match level="QueryCoverage=61%, HitCoverage=18%, E-value=5e-09, Identity=34%"; Hit description =Putative uncharacterized protein
MGTNQNGKRFYQFKIKGLDVTSLKELGRLMGPLQRQAFRKVYEKILDLTAAEVFTEAVVSLAQYYDQLLRCSTFGDFQIVPTVEEFEEILGCPLGGRKPYIFSGCGRRFGERVGSNEANSKRCSGPTAEILGRQGKGYASQKSGFPFAVY

SEQ ID NO: 164660 - protein, 160 aa, Glycine max
  Coding DNA Sequence Number=SeqID_72975
  Homolog annotation: Hit_ID=Q6UUU1; Match level="QueryCoverage=37%, HitCoverage=40%, E-value=1e-18, Identity=78%"; Hit description =Putative uncharacterized protein
MDVIGGREYRLAKYARANLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 164661 - protein, 75 aa, Glycine max
  Coding DNA Sequence Number=SeqID_72976
MMHYLTIHYMQLLGHGMLAALLANMQLELQLLSMNYLSTSSPVLSMGNGTWVRSDLVATPLELLMLMFDATTPNS

SEQ ID NO: 164662 - protein, 70 aa, Glycine max
  Coding DNA Sequence Number=SeqID_72977
MASYGVASPLSLPFFIPLPFIFQEAKESIDEEDPRPTSSNGACIRMEAEDTQEAAATPERSLEATSELPA

SEQ ID NO: 164663 - protein, 223 aa, Glycine max
  Coding DNA Sequence Number=SeqID_72978
  Homolog annotation: Hit_ID=Q84VH5; Match level="QueryCoverage=84%, HitCoverage=31%, E-value=2e-95, Identity=83%"; Hit description =Envelope-like protein
MDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAGGNHQSQHREENGAGTPDQKTLRKWR

SEQ ID NO: 164664 - protein, 352 aa, Glycine max
  Coding DNA Sequence Number=SeqID_72979
  Gene Ontology: Mol. function=motor activity; Cellular component=cell projection
  Homolog annotation: Hit_ID=P15305; Match level="QueryCoverage=84%, HitCoverage=93%, E-value=9e-13, Identity=23%"; Hit description =Dynein heavy chain
MPSASEDYMSSPSESYTSSPSDDYTLTPSEDYTGLHVLAFRELNVLPFRGLHVLVVTGLQVLAFRGLHVLAFRGLDVLACRGLHVLAIRGLHVLLFRGLHVLALRGLHVLAFRGIHILLFRGLHVLAFRGLHVHAFRGLHILPYRGLHVLAVRGLHVLAFRGLHVLNFRGQHVLAFRGLHVHPISGLHILSFRGLHILGIRGLHILAFRGLHVIAFRGLHVLPDRGLHALAFIGLHTPTLRATRPRLQLQTLRGLHVLLLRGLHPFAFRGLHVLTLRGLHVLAIKGLQVLNFGGLHALTFRGLHVLAFRGLHVLAFRGLQVLAFRGLHALTLRGLQALAVRGLQLQTLRGPH

SEQ ID NO: 164665 - protein, 86 aa, Glycine max
  Coding DNA Sequence Number=SeqID_72980
MRGTVHEPQANLGADNKGDKPWDFNGLIKCQMAPLPSLQNGQVSKSNRTYTLREFPKRFAKDRIRLHELSPLSKIKSKSQNRERMS

SEQ ID NO: 164666 - protein, 322 aa, Glycine max
  Coding DNA Sequence Number=SeqID_72981
MKAVMLALKDQMASMMEAMLGMKRLIESNAATATAASTAAEADLVLSSIANLAHQPSLDMVGRGKDTLGNTNSPHLGYNRSAYPYTLPPNFMPPTMHENLDRTTGGAREDRREHAQGDVNSYPLFTTEGPAPNVLPQPNIVGVSQPCPMQPLLFSVGGSPLAVEGSEKLDLIEERLRSVKGFGDYPFVSDYPFASCPCRHLDTYLVEASASLTWYSSIHSTPPEFSSLCRKLFQLSSCPTKDVCTIVKGPYSYFGSSATSSRQQCQFWHDFQWGKKPSGKETSGVCPNPNVIWGPIVVTKQGRAIGRAWGNSGAFDRAMHGS

SEQ ID NO: 164667 - protein, 159 aa, Glycine max
  Coding DNA Sequence Number=SeqID_72982
  Gene Ontology: Mol. function=Type I site-specific deoxyribonuclease activity; Biological process=DNA restriction-modification system
  Homolog annotation: Hit_ID=P08956; Match level="QueryCoverage=69%, HitCoverage=9%, E-value=2e-54, Identity=91%"; Hit description=Type I restriction enzyme EcoKI R protein
MSGKRQIAVRRLRHAAGFPRSLRCAGAARPERPARAAGGDQSPARPHPAWKATRNQDIAARLIGHIRRAAVGDALKPFDERVDHALARIKGENDWSDEQLSWLDRLAQALKEKVVLDDDVFKTGNFHRRGGKPMLQRTFDDNLDSVLDKFSDYIWDELA

SEQ ID NO: 164668 - protein, 84 aa, Glycine max
  Coding DNA Sequence Number=SeqID_72983
MYIKYGPKYIMKHSQRNMLSNKPPTLIPKTIPKLQNSLRLVMSFKTKKGKHRLKGLSKGLIQGSINKNQAKAIMQAINGAKHTK

SEQ ID NO: 164669 - protein, 412 aa, Glycine max
  Coding DNA Sequence Number=SeqID_72984
  Gene Ontology: Mol. function=siderophore-iron transmembrane transporter activity; Cellular component=cell outer membrane; Biological process=siderophore transport
  Homolog annotation: Hit_ID=Q0K283; Match level="QueryCoverage=99%, HitCoverage=56%, E-value=1e-149, Identity=61%"; Hit description =Outer membrane receptor, TonB dependent precursor
  Pfam annotation: Domain name=TonB_dep_Rec; Domain location=180-412; Score=64.3; E_value=4.2e-16; Accession=PF00593.15; Description=TonB dependent receptor
RQRAAGYQFEHAFNDRLAVRQNLRYTQSAVDYRSIYTAGFTGASHGWVPGSDTLLRRKLYQEQKALRQGVVDTQAQLSLRAGPVRHTVLAGIDYQRAILDSRLGLGGTAAPIDVHHPVYGNYVAPTSYAWSTYRAHQTGLYLQDQLEWERWLLMLGLRHDHSRTSVDNDPKGGADDSALTRRFGLMYRSVAGLNPYISYAESFEGQTGLNKANEPFKPLRGKQWEAGAKYQPAGRNLTLTAAIFAMIENNRKVPGVVNGRADTVQVGQARTRGLELEALASQGNLDLVASYTYLDARVARGKPAEEGRQLSGIARHMASFWANYRFRAFGVSGLVAGAGARYNGTHDDGTGHNGMAAVTLYDAVLAYDAGPMRMALNVTNLFDKRYVDVCLARGDCFFGTRRSVVGSVTYRF

SEQ ID NO: 164670 - protein, 165 aa, Glycine max
  Coding DNA Sequence Number=SeqID_72985
MEVNLSDLMVPSRRIVPQWAIGIIDSSSPKSSDRQEVEIRHDIGAGRGWVLSPQSLTPTVEHVLIPIPDTRRVRVRGQGGCSNPIPVAVPDFWLSGKTRTCSRTRSTWVLPIKVGTDSDGYPRPTLVETVEARFMMMNQAILMMPKAQVIDSRLQDQASRIQSKI

SEQ ID NO: 164671 - protein, 74 aa, Glycine max
  Coding DNA Sequence Number=SeqID_72986
MACDPVVRFRKWIEKNGWWNDMAESELINNLRQQVRYTSLNPLIDTGFHTNISCSVTNSYSKVKQLSILTASAS

SEQ ID NO: 164672 - protein, 38 aa, Glycine max
  Coding DNA Sequence Number=SeqID_72987
MREHAELLSSIKDDITDFKTYLLLADIRKYVTKDAVTT

SEQ ID NO: 164673 - protein, 142 aa, Glycine max
  Coding DNA Sequence Number=SeqID_72988
MVYNDHADMTGRLLARSFTFECRIMHYILCRVLLPRSTNLAQASEEDLILLWALQTGHQIDWAHLHFNVPLDDEPFVKVKRSFSIGAGAVTSFGYWKDMDGQWVRKQDLPPPIPDECTSSPPPQRDTSSSLLNDVFTKLRDL

SEQ ID NO: 164674 - protein, 96 aa, Glycine max
  Coding DNA Sequence Number=SeqID_72989
  Subcellular localization annotation: CTP_CleavageSite=41; ConfidenceScore=5.23e-01
MSPILTTINISCNKCWALGKISEKVSFLSSLFSLPLSLSLSLSEVLDLESSRLTSLTFHMPWKLCMVSGMGCGSGGWYGSHGRQPWTLNESTNVRL

SEQ ID NO: 164675 - protein, 282 aa, Glycine max
  Coding DNA Sequence Number=SeqID_72990
  Gene Ontology: Mol. function=nucleic acid binding
  Homolog annotation: Hit_ID=Q2AA09; Match level="QueryCoverage=40%, HitCoverage=41%, E-value=1e-08, Identity=28%"; Hit description =Retrotransposon gag protein
  Pfam annotation: Domain name=Retrotrans_gag; Domain location=33-122; Score=9.1; E_value=0.007; Accession=PF03732.8; Description =Retrotransposon gag protein
MTEVKQTMIKFATGQGADMSQPVRPPNIGDNQINFPLWVHNSLNHYQFVGASTEEVKDKFLNHFFLEFGVEAIMEHIVNFKQTPTEMLFDAWKRYKSLLRSCPFDGNNQFMQISMLMKGITNDYRRMINASFEGNYLNKTTTQVKTIIKDLPASEKTIKTNGSNPQKGEEEEVEERTMLEEEMKAQVNPLTQGMKSSLNPPLFDFSKQSIHKQGDDEMMAKFEKYMEMLQGKKEEPPIEKLTWDVLNEKIGRLNLKATNMTIQLIDGSKKKALWKAVNVTIK

SEQ ID NO: 164676 - protein, 109 aa, Glycine max
  Coding DNA Sequence Number=SeqID_72991
MGDVLSEKIVYSLGSYLARGGFERGRMMFFKGEKRTCRLHGIENLSNTWNCWEGVHDREEEVHGEDAGGDGREEGELGHNGGGIRDCLFDGGGMAWSTVVVVFVGEGEK

SEQ ID NO: 164677 - protein, 165 aa, Glycine max
  Coding DNA Sequence Number=SeqID_72992
MYPPLFSLNLVDVPSTRTDPQEMYPLLFSVKPKEWEESKEFSDCVVLNSLTREKGDTEEFRRLVLCSFGKGRRETQKEFRRLVLGEFFLAKGEENEKMNSTSFQGLEKPENFRKLLVQRRRKSSKRFKACKGLYENKCSRYLTCKTKPCFYRLFMSGQENHSEEL

SEQ ID NO: 164678 - protein, 25 aa, Glycine max
  Coding DNA Sequence Number=SeqID_72993
MAGAFSTIKIECLHIRMELFKTIDG

SEQ ID NO: 164679 - protein, 179 aa, Glycine max
  Coding DNA Sequence Number=SeqID_72994
  Subcellular localization annotation: CTP_CleavageSite=3; ConfidenceScore=5.24e-01
MQMANRGRGGCRRTFNRGTRRGTHSLRAPITTNPSPSSIHISTSKSMIHVVAQTPNTLPTTEDQPNPTFVRESILTTPVRDASPSAPDDSVTPEYPTDPNCEHIVDERPFIRAYKGEFQPTYGCSNIISNIIREKFDEPAPSWLKVSVDLRDRWFGEFKKEYRWHPQEEQAIRAVFETK

SEQ ID NO: 164680 - protein, 126 aa, Glycine max
  Coding DNA Sequence Number=SeqID_72995
  Subcellular localization annotation: CTP_CleavageSite=18; ConfidenceScore=5.11e-01
MHNGNTNPCLPPVPKRPAVFTSKDPQGMYPPLFSLNLVDVPSTRTDPQEMYPLLFSVKPKEWKESKELSDYVVLNSLTREKGDTKEFRRLVLPSFGKGRTETQKEFRRLVLGEFFLAKGEENEKDE

SEQ ID NO: 164681 - protein, 77 aa, Glycine max
  Coding DNA Sequence Number=SeqID_72996
  Gene Ontology: Mol. function=nucleic acid binding; Cellular component= nucleus; Biological process=DNA replication
  Homolog annotation: Hit_ID=A7QQ41; Match level="QueryCoverage=64%, HitCoverage=7%, E-value=2e-10, Identity=58%"; Hit description =Chromosome chr2 scaffold_140, whole genome shotgun sequence
MAGRSVELTLWGWLQTICHAGEFPVLATKVVRSNDFNGKSVGTIATSKVYKGTMTKNLNVAMKHIINDDGSRTLLSD

SEQ ID NO: 164682 - protein, 271 aa, Glycine max
  Coding DNA Sequence Number=SeqID_72997
  Gene Ontology: Mol. function=4 iron, 4 sulfur cluster binding; Cellular component=cytoplasm; Biological process=metabolic process
  Homolog annotation: Hit_ID=Q6YNR9; Match level="QueryCoverage=23%, HitCoverage=6%, E-value=2e-20, Identity=80%"; Hit description =Putative aconitase
  Subcellular localization annotation: CTP_CleavageSite=45; ConfidenceScore=5.67e-01
MLVESPSKGSQEQQSQDGSSQSHSWYLPSVVSSPTSSRPVTPTASSSSLSQRPSSHVPPSKAVAVIAILKDKSVDELQKFLSDKDAYQQFLHSLDQVNIQTNVTIHFLIPKPQGFVVPKESQNKVAKFPILWTPAHLRHSDVVIAAITSCINTSNPSVMLGAALVAKKACELGLQAIQFGAVKDELNRPAIKVKNSLIFNAFVLCQLTTFLERYLLRRSLANHRLIRQHTFLRQFFMKLSSKVLTFNDISFKDGSKPSLYIVFHCRRLSFL

SEQ ID NO: 164683 - protein, 139 aa, Glycine max
  Coding DNA Sequence Number=SeqID_72998
MAQTKKTGQMTSEAAKEITDKIANSLEEQASQGSFVTHGRQDGLALPPEPEIGPSAAHASTKESCIDPSGHDLDMGVPEKYGLYVDKNPPCLVALGFRRLYEGRPPFTTSLWEMIKLRSVFRKFETLMLIFLYPLKRFN

SEQ ID NO: 164684 - protein, 307 aa, Glycine max
  Coding DNA Sequence Number=SeqID_72999
MIVHIISVRLLLQGISSNHCTTSLYAHEHWVLINSSNYFGLIKVEVSDVEYKCEVKSHIGPPYVVARGPQVYPSNLPNNWYQSRWFKLMTGSDEYARQVPQVAMAILVDDKSFRLRGRLRCGRDSHLRGRCVEYKCESVVSGLLMWWLVVQRCTPRISPTSEPYESCPKYWAMVTPILVAQTQQGYYGHLMFPLLNDPNKACIYVIKGRSNRGFSFPYQEAFFTKKEKNKMKDCKNTSGEDVSFTSRISQSLTNSSQAFKPIPASSSGGLVRARALSALMDCLAHISEFRLSACLSCLADELKRCAL

SEQ ID NO: 164685 - protein, 103 aa, Glycine max
  Coding DNA Sequence Number=SeqID_73000
MVHVNPFIGKALDPLKEKFDTYLGIVAEIRGNLIFQKCPMPRRRSFQWWVQDGDNLSPISALNLYTQKRKRVSAKRNTHGLSTRKTLQEDELYRFAKRTASSH

SEQ ID NO: 164686 - protein, 199 aa, Glycine max
  Coding DNA Sequence Number=SeqID_73001
MDKSLEVGEEEWREKERGSMKFVPQKGVLLTLFHSSFFPKFVITLFMRKWFTGKCTGSSNYLKALGLPTEQVDAIKDVSLIKDVPVFYVEGSSTKPRCLKSPTEGFSLPWQGSSFYNKERESREMAWLHMRGMSPPPLSTSQSLKSSLISLKVENLAPCSASSFSAVHTQRIYVVSLQKLLQFCANQGLKRTQKPRHHV

SEQ ID NO: 164687 - protein, 119 aa, Glycine max
  Coding DNA Sequence Number=SeqID_73002
MAEPSKKRKGSSSRSQRHSEAKDIPIPSSISSSSLFSSEEQCIRYKNLFSSCSIIDPKFIDMDFFSDESFECIQAFQNSNPIPFMSLKLPVYSELVKAFYSNLEIQESTLISEDYGIKM

SEQ ID NO: 164688 - protein, 149 aa, Glycine max
  Coding DNA Sequence Number=SeqID_73003
MHAFLGSFNSGNWSDSDDLDRTGLSCRTITRSPVGNLVPLNLEIEATLKRNRAERRRKLLQDRTVASILEEETHFSYSLSPDSPSSRESATQLRETASMEDEQHQKITLEDYSSSSVPQFFTSIAHPEVQAHNIKYPHSLIHLIQGNLF

SEQ ID NO: 164689 - protein, 78 aa, Glycine max
  Coding DNA Sequence Number=SeqID_73004
MDIEEDFEIPFILGWPLMLTASCVVDMGKKKLELGIDNQKISFDLFDEEKHLSDQNVCLQVKEFDEKVLKERTKIDPG

SEQ ID NO: 164690 - protein, 109 aa, Glycine max
  Coding DNA Sequence Number=SeqID_73005
MAFLGETNTQTIVNSGLGFIFPNGLIIHNDSRVYFQTPTLLLCTVGRTPHGIINLLERTMTPTHDVLLYYNGRLNMSRQNNIVIMSIQTKIKFEIIEQKTNDDVLKVLV

SEQ ID NO: 164691 - protein, 61 aa, Glycine max
  Coding DNA Sequence Number=SeqID_73006
MPANTPTELQKCTKMVTGRKAGAEEIFRKKIDLIQHKKLQPRYAHCYINTKAARVLYQVRG

SEQ ID NO: 164692 - protein, 195 aa, Glycine max
  Coding DNA Sequence Number=SeqID_73007
  Gene Ontology: Mol. function=nucleic acid binding
  Homolog annotation: Hit_ID=A5BPE6; Match level="QueryCoverage=33%, HitCoverage=6%, E-value=2e-08, Identity=46%"; Hit description =Putative uncharacterized protein
MKNWMQNSKWDVYLGAYLNGAHWQVAIILPKETLVVWFCSLHNRPDNYLKGIINSALKGLDDTPQSKSRAGARWIVVKTTGTRDIEGTLHPVGKDIDDKMEDEDLTMILLASLPPSYENFVSSLSVGKDSITLEEVKSSLYSRELQLKESGNGDEASMPKLSVNDFSSWKKNNKGKGRKKSKANPKGIFIITTKN

SEQ ID NO: 164693 - protein, 138 aa, Glycine max
  Coding DNA Sequence Number=SeqID_73008
VVVPLGSIPLVEQFSELVAWPGTQPFLHREDEGPTAQVPQDVGDESSEATIPEPFVIGEEAEETQVRQVAAAMPERSLEATSEPSAQGEDIPSPQPTADPSTPLLEMPEDSTRPALALDTSPPATPVLHLTDEEDVQT

SEQ ID NO: 164694 - protein, 71 aa, Glycine max
  Coding DNA Sequence Number=SeqID_73009
MKLASTVSVDSQLALSLRKKRVVIIKKGEIVEASFMMMNQVDSSSFDDDKDDDKKLKRMISRLSQQVQDQD

SEQ ID NO: 164695 - protein, 85 aa, Glycine max
  Coding DNA Sequence Number=SeqID_73010
MWTTTGEELATQLAQASKVAFSRSNNLLEEGSGRPKWARLLFVPPFLLNAPPSIFLLSKKLRKLTDYAKTPLFDFRHITEFHGLR

SEQ ID NO: 164696 - protein, 83 aa, Glycine max
  Coding DNA Sequence Number=SeqID_73011
MSQNFTDYLMMGVKYLEAVRMPPNNGPWTKLGYDSLALVFIEFNIHLGSTFQPAIQSPKLKFTIDTIIRKPKSSRKGSQSKIL

SEQ ID NO: 164697 - protein, 113 aa, Glycine max
  Coding DNA Sequence Number=SeqID_73012
MLDLVFKGHALFGGVAWGFPMVCVGGVKVMPLWERRLVDFSGRYHNHLVGDEGWQEVFLHHWDRGECCPRGKVPYRVRTDAKVGIASRASRGWSRSLRGLPLDGCRHPSLYGC

SEQ ID NO: 164698 - protein, 94 aa, Glycine max
  Coding DNA Sequence Number=SeqID_73013
  Homolog annotation: Hit_ID=UPI0000ECBAF8; Match level="QueryCoverage =45%, HitCoverage=50%, E-value=1e-17, Identity=100%"; Hit description= UPI0000ECBAF8 related cluster
MCLHLKGECCESFSIEFLQPGGSTSSRAAATAGGAPIRPIVSRITIHWPSFYNVVTGKTLALPNLIALQHIPLSPAGVIAKRPAPIALPNSCAA

SEQ ID NO: 164699 - protein, 320 aa, Glycine max
  Coding DNA Sequence Number=SeqID_73014
  Homolog annotation: Hit_ID=Q2HW90; Match level="QueryCoverage=69%, HitCoverage=42%, E-value=8e-20, Identity=31%"; Hit description =Putative uncharacterized protein
MANQEEWVPFMDVLALLIFGVVLFPNVDDLVDLAAIDAFLAYHHSKESPVVAVLANLFDTFDRRCEKSSARIICCLPVLYVWLVSHLFQQNIRHPCPLRSHRSCVKKRRVDWDQHLAGIGGRTINWFPRWKEGKEGVLFSCGDYPNIPLMGTRGCINYNLALAVRQLGYPMRGAPAEGSLSPFLVRDFGAQSFKIIQRVHKAWESPLRKDKELRGIRNGIIGGYHEWLKVRTQGLDWLSKLKIINEENFEAPEEDEEVRALKSELGKAILAKEKFKLVATDVRKECVELREENAATARALEQETKRACKEEHGRDKFRGA

SEQ ID NO: 164700 - protein, 177 aa, Glycine max
  Coding DNA Sequence Number=SeqID_73015
  Gene Ontology: Mol. function=glycine hydroxymethyltransferase activity; Cellular component=nucleus; Biological process=regulation of transcription, DNA-dependent
  Homolog annotation: Hit_ID=Q0GPG8; Match level="QueryCoverage=87%, HitCoverage=63%, E-value=7e-39, Identity=64%"; Hit description=BZIP transcription factor bZIP94
  Pfam annotation: Domain name=bZIP_1; Domain location=116-174; Score =16.5; E_value=0.0059; Accession=PF00170.12; Description=bZIP transcription factor
  Pfam annotation: Domain name=bZIP_2; Domain location=116-173; Score =15.6; E_value=0.01; Accession=PF07716.6; Description=Basic region leucine zipper
  Pfam module annotation: Pfam domain module=bZIP_1::bZIP_2; Domain location=116-174::116-173
MEFGNNADERAREAQTQVLDLERDLLFMGNELNKYKNQHQLWNREYEKMQNQPVPLWTGIVPILNGFLLFLVEPWKQLMFILPAFLNLERWINLLDFALKIPIPERCESSGSKDKSNQKVTLRRLAQNCEAARKSRLRKKAYQQQLESSRFKLTQLEQELQRARQQGSLLDTMTFGS

SEQ ID NO: 164701 - protein, 53 aa, Glycine max
  Coding DNA Sequence Number=SeqID_73016
MGAKYLEVVKQRLHAIKQWSPDEIRYVISVCFCLITQMHAFVGSFNSGNWSDS

SEQ ID NO: 164702 - protein, 136 aa, Glycine max
  Coding DNA Sequence Number=SeqID_73017
MVVSFFLTHLLLEVASLFILLLLHSAAIKPQEAKDSIDKEDPRPTSSNGATSTSLGTDTTIVRSTLATDPDAKTMGSCASLLQSWAWYRMPFIAARVNWKPSYLLVTSGGGLSFTSKPHGDVIGYRMRLDHMTAEQ

SEQ ID NO: 164703 - protein, 27 aa, Glycine max
  Coding DNA Sequence Number=SeqID_73018
MEEEKKKEKMVEDDKQLRKKKKRRMNR

SEQ ID NO: 164704 - protein, 120 aa, Glycine max
  Coding DNA Sequence Number=SeqID_73019
MVPKKLSTKRSRRDAAAEGSSATREFDSHRFRSAEHQQRFEAIKGWSFHRERRVQLREDEYTDFQEEIACRRWTSLVTPMAKFDPKIVLEFYANAWPTEEGINEALGLNPTLGLDLKRAD

SEQ ID NO: 164705 - protein, 65 aa, Glycine max
  Coding DNA Sequence Number=SeqID_73020
MALIWDTLGVPMNPKRIKVIPEWPTPPSVEEKSPEFQEPQDLRSNPFQGPRMMQSYPARALDRIL

SEQ ID NO: 164706 - protein, 240 aa, Glycine max
  Coding DNA Sequence Number=SeqID_73021
MASRKRKAPASVSQARRETERRNWHKELTKFFEGSIDVALVKEFYANLYDLEDKSPKQAKLIYELVMQMNMNLGSLISGQISLIAQHDSSRLGFPALIIALCKARGVTSDSLTFESLSPAINLAYIKKNCWNLDDPSVTFWETRKSRARGSEAPFTSAPSTSPLPPALATPVAWPGVQPSPLGREAAEPTLLEPFTLEFDPADPAISPQPKPSAPVPDLPLSQDPSSAPSLDLNEHAQDH

SEQ ID NO: 164707 - protein, 85 aa, Glycine max
  Coding DNA Sequence Number=SeqID_73022
  Gene Ontology: Mol. function=aspartic-type endopeptidase activity; Biological process=RNA-dependent DNA replication
  Homolog annotation: Hit_ID=Q9FZN9; Match level="QueryCoverage=43%, HitCoverage=1%, E-value=1e-08, Identity=70%"; Hit description =Retroelement pol polyprotein-like
MGPFPSSTGNEYILVVVDYVPKWVKAVATPRNDAKAMASREHRKIQLLELEEMRLTTYESSKLYKGRVKATTINVVEERLQPGQQ

SEQ ID NO: 164708 - protein, 218 aa, Glycine max
  Coding DNA Sequence Number=SeqID_73023
  Gene Ontology: Mol. function=integrase activity; Cellular component =mitochondrion; Biological process=DNA integration
  Homolog annotation: Hit_ID=A2RQ28; Match level="QueryCoverage=96%, HitCoverage=87%, E-value=9e-87, Identity=72%"; Hit description =Conserved Hypothetical
  Pfam annotation: Domain name=DUF28; Domain location=5-218; Score =408.2; E_value=1.2e-119; Accession=PF01709.11; Description=Domain of unknown function DUF28
MAGHSKWANIQHRKGRQDAKRGKIFTKLIKEITVSARMGGGDTAMNPRLRAAVAAAKEENMPSDNITRAIKKGTGELEGVNYEEIRYEGYGINGAAIIIDCLTDNRQRAVMDVRHALTKHGGNLGTDGSVAFMFKHCGQLVFEPGVSEDAVMEVALEAGAEDVITDEDGSIEVITAPGDFVTVKEALEAAGLKAVMAQVTMKSLNEVVFTGCVHFSRD

SEQ ID NO: 164709 - protein, 98 aa, Glycine max
  Coding DNA Sequence Number=SeqID_73024
MTCEDKLSSSAHLFAIQRRSSPMARKDKLWSFYAFFNLEAASPMTGGDKLWSSAHLFVNQRQGQRVGWWVEIPYGHPRLSSTERNEFGNMKMMLVVRC

SEQ ID NO: 164710 - protein, 159 aa, Glycine max
  Coding DNA Sequence Number=SeqID_73025
MYVRNAPRKLASKRSRKDKAVEGTSSAPEYDSHRFRSAEHQQCFEAIKGWSFLRERRVQLRDDEYTDFQEEIVRRRWASLVTPMAKFDPDVVLEFYANAWPTEEGVRDMRSGVRGQWIPFDADALSQFLGYPLVLEEGQECEYGQRGTKADGFDEEASP

SEQ ID NO: 164711 - protein, 122 aa, Glycine max
  Coding DNA Sequence Number=SeqID_73026
  Homolog annotation: Hit_ID=A7Q8B9; Match level="QueryCoverage=34%, HitCoverage=13%, E-value=4e-13, Identity=73%"; Hit description =Chromosome chr14 scaffold_63, whole genome shotgun sequence
KTDLTPSCMLHSARGDIAQLVELRSCNWVVAITEDRNMPLKDSTETKTGCQERRGGFLIWDPGEEDQAGPCEQLDALSPFNPLSEMWQKEKESMDRPHRLHPVGTTRSPQGRLRHPGVADRP

SEQ ID NO: 164712 - protein, 121 aa, Glycine max
  Coding DNA Sequence Number=SeqID_73027
MLNGMPRGSSMISTHCVRFVSSEKWRLRKPSRGYGYHCSIKWCLALVVWKVGFVVDLGMAFVDNWVETWLYRNGSHSMGFSLILTLFICPSFLIHQSRMIKFASFQTHFDPFACEDQICKT

SEQ ID NO: 164713 - protein, 87 aa, Glycine max
  Coding DNA Sequence Number=SeqID_73028
MSWMNIKGVFPFSPKQHFLQHISIKIEGIRAKRWRNRILVANAKFDANRLFEDAIFVVWTWLRHFEKDFTIHFNQWSSNIRQGFLLM

SEQ ID NO: 164714 - protein, 232 aa, Glycine max
  Coding DNA Sequence Number=SeqID_73029
  Pfam annotation: Domain name=TolA; Domain location=1-232; Score= -106.1; E_value=0.00078; Accession=PF06519.2; Description=TolA protein
KGGATGEELQQKQAEQQQRLKELEKERLAAQEKAAQDAKAQAEQQQKAAEQQKQAAEQQKAAEAAAAKAKEQQKVAEAAAAKAKAEADKIAKAQADAQKKAEAEAKKEAAAAAAAKKQAEEAKKAAAAAAEQKAAEAAEKKAAAEAEKKAAAEAEKKAAAEKAAAAKKAAADAKKKAAAEAAKQSEEVNDLFGGLADGKNAPKGGGAKSKGDGKPAGQGNAKTAGASGADIS

SEQ ID NO: 164715 - protein, 112 aa, Glycine max
  Coding DNA Sequence Number=SeqID_73030
MAPKKLSTKRSRRDATGEGSSAALEFASHRFRSAEHQQRCEAIRGWSFHKERRVQLREDEYTDFQEEIARRRWTPLVTPMAKFDPEIVLEFYANAWPTKEGVRDMCSWVRGQ

SEQ ID NO: 164716 - protein, 61 aa, Glycine max
  Coding DNA Sequence Number=SeqID_73031
  Gene Ontology: Cellular component=extracellular region; Biological process=sexual reproduction
  Homolog annotation: Hit_ID=Q39802; Match level="QueryCoverage=93%, HitCoverage=20%, E-value=2e-25, Identity=85%"; Hit description =Cytokinin induced message
WSPAVATWYGPAQGDGSEGGACGYGSAVGEPPFSSLMSAGSPLLFESGEGCGSCYEVLMIF

SEQ ID NO: 164717 - protein, 458 aa, Glycine max
  Coding DNA Sequence Number=SeqID_73032
  Gene Ontology: Mol. function=protein binding; Cellular component =integral to membrane; Biological process=phagocytosis, engulfment
  Homolog annotation: Hit_ID=Q9FHT4; Match level="QueryCoverage=85%, HitCoverage=59%, E-value=1e-156, Identity=70%"; Hit description =Endosomal protein-like
  Pfam annotation: Domain name=EMP70; Domain location=49-449; Score =234.9; E_value=1.8e-67; Accession=PF02990.7; Description =Endomembrane protein 70
MKNLSFFLITTLFAAFSAVRSDPSDHRYKEGDSVPLYANKVGPFHNPSETYRYFDLPFCEPGDLKEKKEALGEVLNGDRLVSAPYKLEFQRDKESISVCNRKLSKQDVARFRSAVRKDYYFQMYYDDLPIWGFIGKVDKEGKDPSDYRYFLYKHIHFDVFYNKDRVIEINVRTDPNALVDLTKDSEVDAEFLYTVKWKETNTPFEKRMDRYSQSSSLPHHLEIHWFSIINSCVTVLLLTGFLATILMRVLKNDFVKQGQLQLLFVTILDIREIVNKCGHNCSHSFIATLDIAGNCRYMYAHDEESAEDQEETGWKYIHGDVFRFPKFKSLFAAALGSGTQLFTLTVFIFILALVGVFYPYNRGALFTALVVIYALTSGIAGYTATSFYCQLEGTNWESAVDWMPFLWTSVSDFLLSKHCCNCLQSYCCPPIWDDCGYSSHMDTCYVSFACIGRDCWEE

SEQ ID NO: 164718 - protein, 219 aa, Glycine max
  Coding DNA Sequence Number=SeqID_73033
  Gene Ontology: Cellular component=intracellular; Biological process =RNA processing
  Homolog annotation: Hit_ID=A7QW89; Match level="QueryCoverage=57%, HitCoverage=10%, E-value=2e-15, Identity=40%"; Hit description =Chromosome undetermined scaffold_200, whole genome shotgun sequence
  Subcellular localization annotation: CTP_CleavageSite=66; ConfidenceScore=5.68e-01
MEQNPPSPAEDSAAAAPSSGEAKPSLFPLFPLTASSSLQTTTTSSTPQWLSNTSFTTDISVINDAVASQLNREITQSPPQDDEDENRAQANPLPSSRYEILESSESDGGGRDRERKKRKKRKKRKCDSSVERGGFHGFGSRKSRVRAWADSEAKVAKDYYIDSHGDRDNLAFGCIYRMVVLTSVLLALLMNLLGVRIQMKCFSASSGSHYHPQVFHDDH

SEQ ID NO: 164719 - protein, 83 aa, Glycine max
  Coding DNA Sequence Number=SeqID_73034
MPLREELSLRERCFHDGCAIEGGGVVKGRKGAIEGGGVIMVSVPSKKEVSSREGRVSSWEMLLQGVLGLREGRREVFGLGDEK

SEQ ID NO: 164720 - protein, 25 aa, Glycine max
  Coding DNA Sequence Number=SeqID_73035
MFKGVNGGGQGNIRIWQVHLGCHAP

SEQ ID NO: 164721 - protein, 437 aa, Glycine max
  Coding DNA Sequence Number=SeqID_73036
  Gene Ontology: Mol. function=protein binding; Cellular component =nucleus; Biological process=embryonic development ending in birth or egg hatching
  Homolog annotation: Hit_ID=A7QJJ2; Match level="QueryCoverage=96%, HitCoverage=59%, E-value=1e-139, Identity=58%"; Hit description =Chromosome chr8 scaffold_106, whole genome shotgun sequence
  Pfam annotation: Domain name=NUC153; Domain location=249-278; Score =52.1; E_value=1.9e-12; Accession=PF08159.3; Description=NUC153 domain
MVLIYDLRSSNPVRIQDHMYGSSILDIKWHHTLNYEQPMLITSDNHVVRIWDPETGEGLTSIEPTTGTINDVCTFPGSGLILLALDCSQIPSYFIPSLGPAPKWCSSLENFTEELDMGGQTTIYDHYKFLTKEELERLNLTNLIGTNLLRAYMHGFFINHALYKKAKALVDPFEYEAYIEQQKREKMEAERASRITVRKKLPKVNRALAARLLETEEAENEKRDEDADDGETKKASKKKKGLSMQDLQDDRFKAIFTNEEFEIKDSSQEYLALHPMGSKKQTSLLKEHFEPVMSDDGQSLSDSDASTSSQDEPANGMKDKSRVPRMYEIKNEQHAEAFWSQKSLAGEDSLPMGDRVAALRDDQQSSRVPKGIKQGPGGSREITFATRSSAKYKEDEEDKEVPNRKKRGVQSLGLKPNRPVFRGQGRGKRGNGRRGRR

SEQ ID NO: 164722 - protein, 354 aa, Glycine max
  Coding DNA Sequence Number=SeqID_73037
  Homolog annotation: Hit_ID=Q9M005; Match level="QueryCoverage=22%, HitCoverage=15%, E-value=1e-20, Identity=60%"; Hit description =Putative uncharacterized protein F7A7_230
MGILGEASSIDFCLGTTLVLMVSPKAFGLGMLEVVSNPWRFTVGNWLCDSDLVSPTGIERVLTEKDLLADSYSDLEASILDENEFLLLKIISIFPELSCLICSMVGAGRGTDVIHVLIDIFESDFLIEEIVFGGDLLGLDLRRFMKTRFRSSLPLAVPRFTPSGFDFAIEEQEFGDLHGMLFINVEVHRDPREHVEVKGRGMGRIQPLQSSGRGEFDGEVEKIQGFDFANWLKKTVSKNDFVVMKMDVEGTEFDLIPRGVQSMRKHMIHACSSSNPLDKVEFLFISGSNCAQHDRNFKGNKKQHSMPNAHVRSELRYGSNSKGEADKANRVSYIKSKSTTGKRFGKNGKKRKGK

SEQ ID NO: 164723 - protein, 25 aa, Glycine max
  Coding DNA Sequence Number=SeqID_73038
MSNIDIKTGGVTSKKARKIEEKKKI

SEQ ID NO: 164724 - protein, 97 aa, Glycine max
  Coding DNA Sequence Number=SeqID_73039
EKYQHRRDEILQHSTEEGTSTQDSPNTATSVNDNEIYLNVVGGPNYKGNVYDLGTLSKRFSCSKSVSSTSIAPVEDQIEDHVNDAQVDRPHDMGNYH

SEQ ID NO: 164725 - protein, 113 aa, Glycine max
  Coding DNA Sequence Number=SeqID_73040
  Subcellular localization annotation: CTP_CleavageSite=38; ConfidenceScore=5.08e-01
MTSLTSVPFQLYADTFMTSMLDNINHQCSCQLLVFFLVANQSFSMLRLMQHIQSLPTRAIFLALSRPPIKKVRARRNKSRHKGNCIGLVSVMLELRSVELVNSCTVLTRDFNQ

SEQ ID NO: 164726 - protein, 275 aa, Glycine max
  Coding DNA Sequence Number=SeqID_73041
MKSLISGKVFLQWGKCWEVHIGPRRGSAKNTKFEKYGRGDIGRKTTGHQGREETQSKGQDVGKGKEVVYQNAGQKTGRHNNARSYARLVSTRVIPVGQTWRPKNGNKGRGETVLGRETVTPMQYGMAKQEDNIVLLTALEGGDLNGMLQESEAWMGESFESIEPWNSFFISGNKTCCIRIVGVLLNAWSNVDENTEKMASLEYARVMISTSSYDNICSTEWVKIHGNPYSFRVVEELKESGNLKMIWWSRYCHHREKFRRVFCKREKGLGGENRL

SEQ ID NO: 164727 - protein, 91 aa, Glycine max
  Coding DNA Sequence Number=SeqID_73042
  Gene Ontology: Mol. function=ion channel activity; Cellular component= integral to membrane; Biological process=ion transport
  Homolog annotation: Hit_ID=A7QJZ5; Match level="QueryCoverage=76%, HitCoverage=10%, E-value=6e-24, Identity=72%"; Hit description =Chromosome undetermined scaffold_109, whole genome shotgun sequence
MTTTLVLFRSINDLIYFFNILVQFRLAYVSPESRVVGAGDLVDHPKKIALNYLKGFFFIDLFVVLPLPQLNFQWLCIFDLLENKEVFDVAI

SEQ ID NO: 164728 - protein, 206 aa, Glycine max
  Coding DNA Sequence Number=SeqID_73043
  Gene Ontology: Mol. function=ion channel activity; Cellular component= integral to membrane; Biological process=response to nematode
  Homolog annotation: Hit_ID=A7QJZ1; Match level="QueryCoverage=93%, HitCoverage=68%, E-value=2e-67, Identity=60%"; Hit description =Chromosome undetermined scaffold_109, whole genome shotgun sequence
MPNSLSWYNSVKYLQIFILFVQPKHLGSSGANYAGLIFESPWASFFINLFTFMLSGHVVGSWWYLFGLQRVNQCLRDVCQKVIKEHNECAKFIDCGHGQAEENQNNPTLHNWRSNSEASSCFTEDGFPYGIYNKAVNLTADQNVITRYVYSSFWGFQQISTLAGNLTPSYYVWEVIFTMAIIGSGLLLFALLIGNIQNFLQALGRR

SEQ ID NO: 164729 - protein, 663 aa, Glycine max
  Coding DNA Sequence Number=SeqID_73044
  Gene Ontology: Mol. function=GTP binding; Cellular component =intracellular; Biological process=RNA-dependent DNA replication
  Homolog annotation: Hit_ID=A5C1X5; Match level="QueryCoverage=76%, HitCoverage=72%, E-value=0.0, Identity=68%"; Hit description =Putative uncharacterized protein
  Pfam annotation: Domain name=PPR; Domain location=271-304; Score =21.5; E_value=0.0032; Accession=PF01535.11; Description=PPR repeat
  Pfam annotation: Domain name=PPR; Domain location=305-339; Score =37.2; E_value=5.8e-08; Accession=PF01535.11; Description=PPR repeat
  Pfam annotation: Domain name=PPR; Domain location=340-374; Score =36.4; E_value=1e-07; Accession=PF01535.11; Description=PPR repeat
  Pfam annotation: Domain name=PPR; Domain location=378-412; Score =30.7; E_value=5.4e-06; Accession=PF01535.11; Description=PPR repeat
  Pfam annotation: Domain name=PPR; Domain location=413-447; Score =30.2; E_value=7.8e-06; Accession=PF01535.11; Description=PPR repeat
  Pfam annotation: Domain name=PPR; Domain location=448-482; Score =38.1; E_value=3.1e-08; Accession=PF01535.11; Description=PPR repeat
  Pfam annotation: Domain name=PPR; Domain location=483-517; Score =30.1; E_value=7.8e-06; Accession=PF01535.11; Description=PPR repeat
  Pfam annotation: Domain name=PPR; Domain location=518-552; Score =20.9; E_value=0.0049; Accession=PF01535.11; Description=PPR repeat
  Pfam module annotation: Pfam domain module=PPR::PPR::PPR::PPR::PPR::PP R::PPR::PPR; Domain location=271-304::305-339::340-374::378-412::413 -447::448-482::483-517::518-552
MVFLRPLFFVETKQQHPPQYIINSLKNPSFSSLTHHHCQVFRNKVLQQIETTLQHTRFSPFHHLAHCQRPSLSDNKSSCVHLIQYSLPLNYYYIACHVSNRHYCSETVSMNKDLSCSESGVVEGNGFESDVDKVYSIVMDNLAGFNNMENALGQLGIPLSTPLVTGGLHRLRYDEKIALRFFTWAGHQEDYSHEPCAYNDMMDILSSTRYKVKQFRIVCDVLEYMKRNNRTMVPAEVLLVILRKYTEKYLTHMQKFAKKKRIRVKTQLEINAFNLLLDALCKCCLVEDAESLYKKMRKTVKPNAETYNILVFGWCRVRNPTRGMKLLEEMIELGHRPDNFTYNTAIDTYCKTGMITEAVDLFEFMRTKGSTISSPTAKTYAIIIVALAQHDRMEDCFKLIGHMISSGCLPDVTTYKEIIEGMCMCGKIDEAYKFLEEMGNKSYRPDIVTYNCFLKVLCDNKKSEDALKLYGRMIELNCIPSVQTYNMLISMFFEMDDPDGAFETWQEIDNRGCRPDTDTYCVMIEGLFNCNKMEDACFLLEEVINEGVKLPYKKFDSFLMQLSVIGDLQAIHRLSEHMKKFYNHGMARRFALSQKQKFEGAELGGSYHDRSDKYFLEAWQPKGGKIHVYILWLHLRTEVAQICLMLGGLFVLLEIQLWKDGVS

SEQ ID NO: 164730 - protein, 92 aa, Glycine max
  Coding DNA Sequence Number=SeqID_73045
GGRYENCGVRTTRSSEHNVILSSSRALRSLRSQSKHLCENDMVKYKCEEDANDEAIRVGEVKDANDEAIGVGENPSSNKAVELLRNNPQKKS

SEQ ID NO: 164731 - protein, 107 aa, Glycine max
  Coding DNA Sequence Number=SeqID_73046
  Subcellular localization annotation: CTP_CleavageSite=60; ConfidenceScore=5.59e-01
MHTQSFTIAQFPKIGLTHKNSPQWSRQLSQPTLLRASEARLMGASSKGGKCTESPPTFISGKCRKNPRKLVMKNIPDSGVVFTFEEGRQKQGSCSYVPSIEEEIRPT

SEQ ID NO: 164732 - protein, 122 aa, Glycine max
  Coding DNA Sequence Number=SeqID_73047
MKIKKRTKERKEGFSIKDRKEVKRGKEATLDQRKEENRKSPKPDCHSESFLTGNIPPHMNKEEKTETPSFLSKNADLEKILLDKTLALAVHVFSTFESGAVFHDCLREDPQGNPPFSSFSGV

SEQ ID NO: 164733 - protein, 23 aa, Glycine max
  Coding DNA Sequence Number=SeqID_73048
MTVKKRLSHEVPKVTVELSSLVG

SEQ ID NO: 164734 - protein, 102 aa, Glycine max
  Coding DNA Sequence Number=SeqID_73049
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=17%, E-value=2e-33, Identity=61%"; Hit description =Photosystem I P700 chlorophyll a apoprotein A1
MQSDVWGSISDQGIVNHITGGNFAQSSITINGWLRDFLWAQASQFNVSIQRAGYARTYESIVWAHNKLKVAPATQPRALSIVQGRAVGVTPYYLLCHTYPFF

SEQ ID NO: 164735 - protein, 43 aa, Glycine max
  Coding DNA Sequence Number=SeqID_73050
MGSSCHTSTREDCATVWMHFSDYLALVDEICVVPGQCTSDYIN

SEQ ID NO: 164736 - protein, 96 aa, Glycine max
  Coding DNA Sequence Number=SeqID_73051
MTKGEKRLKIFAKSPTKMLRKCYGSASAWIFFTETIFLTDFKKIGEELATQLAQASQVASSRSNRLLEEYSGRPKWACFRNVTETHGLRNTSLQVM

SEQ ID NO: 164737 - protein, 124 aa, Glycine max
  Coding DNA Sequence Number=SeqID_73052
  Homolog annotation: Hit_ID=Q6WAY6; Match level="QueryCoverage=83%, HitCoverage=18%, E-value=3e-14, Identity=39%"; Hit description =Putative uncharacterized protein
MCAEKGKANWEQLLASMVGASVNWFLRWKEGRAGVLSSCEGFSNIPLMGTRGCINYNPVLAIRQLGYPMRGAPSEESITPFVTRGFSDPNARIFQGVRKAWSVVQRKDKELRGSSNAIIGGYHK

SEQ ID NO: 164738 - protein, 337 aa, Glycine max
  Coding DNA Sequence Number=SeqID_73053
  Gene Ontology: Mol. function=hydrolase activity, acting on carbon -nitrogen (but not peptide) bonds; Cellular component=chitosan layer of spore wall; Biological process=carbohydrate metabolic process
  Homolog annotation: Hit_ID=A6T9E7; Match level="QueryCoverage=80%, HitCoverage=87%, E-value=1e-130, Identity=80%"; Hit description =Putative polysaccharide deacetylase
  Pfam annotation: Domain name=Polysacc_deac_1; Domain location=48-169; Score=44.1; E_value=5e-10; Accession=PF01522.12; Description =Polysaccharide deacetylase
PPHAQWPGEARVAVQFVLNYEEGAENNVLHGDAGSEQFLSDIIGAASYADRHMSMDSLYEYGSRAGFWRIHQEFQQRGLPLTIFGVAMALARHPQIVEAIKAADYDVVSHGWRWIHYQGMDAKTERQHMQQAVDVLTELFGKAPTGWYTGRDSPNTRRLVVEQGGFSYDSDYYGDDLPFWTQVTCQDGTVKPHLIIPYTLECNDMRFATPQGFNTAEQFYTYLRDTFDVLYEEGATAPKMMSIGMHCRLLGRPGKFRALQRFLDHIQQHDKGTLAPASAHQTHLRCHDAPAARQPYPGLLLTADLLYALAGELGAAHRIVIAKGGDHRIAQRAIEPL

SEQ ID NO: 164739 - protein, 110 aa, Glycine max
  Coding DNA Sequence Number=SeqID_73054
MTDLVSAEDDVNLRVSTGLSAAIDEGRRMTIICLCVPSDTTVSEWQKKVCRMTIICLRMSSGPPPLDDKRVQNDHNLSLRAIGHDCVRMAKGVWNDHNLSLHVIGPAASG

SEQ ID NO: 164740 - protein, 326 aa, Glycine max
  Coding DNA Sequence Number=SeqID_73055
  Gene Ontology: Mol. function=transporter activity; Cellular component= integral to membrane; Biological process=transport
  Homolog annotation: Hit_ID=A6XFC1; Match level="QueryCoverage=100%, HitCoverage=31%, E-value=1e-171, Identity=94%"; Hit description=AcrB
  Pfam annotation: Domain name=SecD_SecF; Domain location=119-301; Score=-99.4; E_value=0.045; Accession=PF02355.7; Description=Protein export membrane protein
TPQFKIDIDQEKAQALGVSISDINTTLGAAWGGSYVNDFIDRGRVKKVYVMSEAQYRMLPNDINNWFVRGSNGQMVPFSAFSTSRWEYGSPRLERYNGLPSMEILGQAAPGRSTGEAMNLMEELASKLPSGIGYDWTGMSYQERLSGNQAPALYAISLIVVFLCLAALYESWSIPFSVMLVVPLGVIGALLAATFRGLTNDVYFQVGLLTTIGLSAKNAILIVEFAKDLMEKEGKGLIEATLEAVRMRLRPILMTSLAFILGVLPLVISSGAGSGAQNAVGTGVMGGMITATVLAIFFVPVFFVVVRRRFSRKNEDIEHSHSVEPH

SEQ ID NO: 164741 - protein, 94 aa, Glycine max
  Coding DNA Sequence Number=SeqID_73056
  Homolog annotation: Hit_ID=A7Q5A7; Match level="QueryCoverage=53%, HitCoverage=69%, E-value=8e-15, Identity=78%"; Hit description =Chromosome undetermined scaffold_52, whole genome shotgun sequence
  Subcellular localization annotation: CTP_CleavageSite=40; ConfidenceScore=5.52e-01
MNASKMHCYASTSTSNNSNVCLNSPGLWNKGVSRTYTEISESIKSPQVGFEPTTSQLTADRSTTELLRNNGKFELIEFNSRSQPMTNMSSKFPS

SEQ ID NO: 164742 - protein, 97 aa, Glycine max
  Coding DNA Sequence Number=SeqID_73057
  Homolog annotation: Hit_ID=Q6UUU1; Match level="QueryCoverage=82%, HitCoverage=54%, E-value=3e-28, Identity=78%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPGVIPLYGRVCLIPRLTLSS

SEQ ID NO: 164743 - protein, 283 aa, Glycine max
  Coding DNA Sequence Number=SeqID_73058
  Gene Ontology: Mol. function=oxidoreductase activity, acting on the CH-OH group of donors, NAD or NADP as acceptor; Cellular component =cytoplasm; Biological process=electron transport
  Homolog annotation: Hit_ID=A4WG24; Match level="QueryCoverage=99%, HitCoverage=66%, E-value=1e-149, Identity=93%"; Hit description=UDP -glucose/GDP-mannose dehydrogenase precursor
  Pfam annotation: Domain name=ApbA; Domain location=6-159; Score= -31.3; E_value=0.082; Accession=PF02558.7; Description=Ketopantoate reductase PanEApbA
  Pfam annotation: Domain name=NAD_binding_2; Domain location=3-179; Score=-83.7; E_value=0.031; Accession=PF03446.6; Description=NAD binding domain of 6-phosphogluconate dehydrogenase
  Pfam annotation: Domain name=UDPG_MGDP_dh; Domain location=205-283; Score=124.4; E_value=3.2e-34; Accession=PF00984.10; Description=UDP -glucoseGDP-mannose dehydrogenase family, central domain
  Pfam annotation: Domain name=UDPG_MGDP_dh_N; Domain location=4-197; Score=305.4; E_value=1.1e-88; Accession=PF03721.5; Description=UDP -glucoseGDP-mannose dehydrogenase family, NAD binding domain
  Pfam module annotation: Pfam domain module=ApbA::NAD_binding_2::UDPG _MGDP_dh::UDPG_MGDP_dh_N; Domain location=6-159::3-179::205-283::4-197
MSFTTISVIGLGYIGLPTAAAFASRQKQVVGVDINARAVETINRGEIHIVEPDLDRVVKEAVDGGFLRASTTPVEADAYLIAVPTPFKGEHEPDMVYVEAAAKSIAPVLKKGALVILESTSPVGATEQMAQWLADARPDLSFPQQAGEQADINIAYCPERVLPGQVMVELIKNDRVIGGMTPVCSERASTLYKIFLEGECVVTNSRTAEMCKLTENSFRDVNIAFANELSLICADQGINVWELIRLANRHPRVNILQPGPGVGGHCIAVDPWFIVAQNPAQRV

SEQ ID NO: 164744 - protein, 140 aa, Glycine max
  Coding DNA Sequence Number=SeqID_73059
MVGYTPSSFADLVFVGERVEADLKRGKFNHPAWMNEKTGANEEGESEGETHPATVISIQPSFPPTQQCHYSANNNPSPYPPPSYPQSKKPIEFTPILVSYANLLHYLLDTAMVAITPARALKHKVQGPIDAGWLKFEENR

SEQ ID NO: 164745 - protein, 61 aa, Glycine max
  Coding DNA Sequence Number=SeqID_73060
MAVESRRRKGDWRRHFMKKMSQEQVSMAVEWRRRKDDWRCHFKEKMSQEQAHHHRKPWMRA

SEQ ID NO: 164746 - protein, 89 aa, Glycine max
  Coding DNA Sequence Number=SeqID_73061
  Gene Ontology: Mol. function=aminomethyltransferase activity; Cellular component=cytoplasm; Biological process=glycine catabolic process
  Homolog annotation: Hit_ID=A8GIQ4; Match level="QueryCoverage=91%, HitCoverage=24%, E-value=5e-37, Identity=88%"; Hit description=tRNA -modifying protein ygfZ
MAHNIPFPPRQPSASTHLPLTLISLEDWALVTLNGPDTVKYLQGQVTADIDALAADQHVLCAHCDAKGKMWSNLRLFHRSEASPIWNAA

SEQ ID NO: 164747 - protein, 71 aa, Glycine max
  Coding DNA Sequence Number=SeqID_73062
MDKSLKDEKMSEGREGAKHFVPQKRYELKWYVAHEPEIYHNAHENPRAFSCISGQIFLESSIQFFNPIPLG

SEQ ID NO: 164748 - protein, 465 aa, Glycine max
  Coding DNA Sequence Number=SeqID_73063
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=A8GJK9; Match level="QueryCoverage=48%, HitCoverage=49%, E-value=1e-102, Identity=85%"; Hit description=PTS system, sucrose-specific IIBC subunit
  Pfam annotation: Domain name=PTS_EIIC; Domain location=1-192; Score =34.3; E_value=4.5e-07; Accession=PF02378.9; Description =Phosphotransferase system, EIIC
MNFFGLEIAMIGYQGTVFPVLLTVWFMSVLEKRLRKVIPNALDLILTPFLTVVISGFVALLFIGPAGRALGDGISFVLSTLIAHAGWFAGLLFGGLYSAIVITGIHHSFHAVEAGLLGNPNIGVNFLLPIWSMANIAQGGACLAVYFKTRDAKIKAIAVPSAFSAMLGITEAALFGINLRFVKPFLAALAGGALGGAWVVANHVGMNAVGLTAIPGMAIVQASSLLNQTGAAGGNERPATRAARSAPPGLASGAQRWPAERSQRLYPAQWRLSPVLSVEPAGLRSSQQVLGTLAIDRFIALGTSADRPGAGRLLRQPRLLLRLGGGGGRQNHADLHRQREIPRRLAHRLPMPGSGKRSGRIPQTRAGAAAAGGLQRPRTRSESVASSGCLDRGKVLLLRSCDLRDWQALGEIAGSGLNDLGEFGYMWECPDLFSLDGDDVLICCPQGLVPQPERYLNRYQAGYLL

SEQ ID NO: 164749 - protein, 90 aa, Glycine max
  Coding DNA Sequence Number=SeqID_73064
MASSTCFQQIPSQITIMKLKPSKTTHHTSQNPIPTKIKDALHDSENAFLSRFGAEMGTKGWSFNGVSMEDEEERKSNVREREKASEMWAE

SEQ ID NO: 164750 - protein, 329 aa, Glycine max
  Coding DNA Sequence Number=SeqID_73065
MWLVKPPSLDMCCPGYFCQVVRDGRVFGVSGKAIPHLRILIEVTLIESPPPWRGAQPSAATGEPVLVTVIPPFAFGGTRRANNSENVRSSPCIRPCVSAGSPSSTQAVAGYEWVKLANPEDSYKLTFQAYGSDDFLCLFEVLSVILPLNAFQCALLEHLNVAPSELYPKNWAMATCLTLPNKTVWQIGWLSLNSVFKKLFEFDSNVFHRFKDHFFKVLTTDVVANGMALMFNRDEEPRFLFYWQSDPSKIKSYDKDLLTLVASDPLVVLDGMIGDFARRPLVKQVGLVGGTVPLFVAAPFIGEGGQPIGEVCPVVVAIEVAPSAGCCGA

SEQ ID NO: 164751 - protein, 58 aa, Glycine max
  Coding DNA Sequence Number=SeqID_73066
MDVKNAFLNGFIEEEVYVKQPQEIHYKELMKKFKMEDYAGDKLNEKAQVVDAIILNPV

SEQ ID NO: 164752 - protein, 388 aa, Glycine max
  Coding DNA Sequence Number=SeqID_73067
  Homolog annotation: Hit_ID=A5BEY8; Match level="QueryCoverage=90%, HitCoverage=90%, E-value=1e-107, Identity=57%"; Hit description =Putative uncharacterized protein
  Pfam annotation: Domain name=F-box; Domain location=2-49; Score=32.3; E_value=1.8e-06; Accession=PF00646.24; Description=F-box domain
MTEITNLSTDLIELILSLLPIPILIRASTVCKLWHSIISSSSFSTLSNHLNQPWFFLHGIHNISSKNNQSFAFDPASNTWFLLPTPQHQHQHQHQYQSNTSFIGTNSFFFITAPNFLYTPILHPSWHPTPPLHFPRINPLLGVFHDAKDHTFSHPKFIVVGGVKFIGNLVDIEDRLDVEIYDPLLGSWDLGPPLPPDFRSGNSSSSLSSALFREKFYVFGIYSCFVSSFDLHKRVWSEVHTLRPHHGIVFSFLVACKEMLVLAGVCNFPHGSSSFVLWKVDERTMGFSQIAVMPHDLLCSLFDGDEDDKFASLKCVGLGDLIYVFNEDYHRMYPACVCEIDGESGRCVWRRVPQLPSLMNRFHKVVSFCSTVSLHSILGERQPCGLQY

SEQ ID NO: 164753 - protein, 70 aa, Glycine max
  Coding DNA Sequence Number=SeqID_73068
MKITIEKVPCSDSNPLVMSGEERVRNALVQTLMDYLTPQLDKNNNIQLLTLPKEVIFDFKHGFLQMIESN

SEQ ID NO: 164754 - protein, 87 aa, Glycine max
  Coding DNA Sequence Number=SeqID_73069
MPFNICICVEYITWKCLSKKCVYMEVGKWLQRSFQPRGPGKMPLEKVPVRPHRWTWSLMGTGSGVRNTSDDLRPLKAGRSSRRGESS

SEQ ID NO: 164755 - protein, 230 aa, Glycine max
  Coding DNA Sequence Number=SeqID_73070
MVASLRTTSRWERIPQETSFEWGPFVVERVPFAGWALDWRGFRHEPKSLVDVGHIGKCCAGFVGASAKPTSILSPINTKSAKLEVPPSLGILLKGLMLPLAHILQLGSVGSHVSIVLVLPNEGSNQVLPCADTRSLQIGIPDDCRPDQTFLEEMHQQFLIPRGGVEELPRYWVKAYSIKCWSLSGESEVWVEVTLSMLLRFFTGAPNRLGLLTLKGNGNGVISVLIGHVH

SEQ ID NO: 164756 - protein, 207 aa, Glycine max
  Coding DNA Sequence Number=SeqID_73071
  Gene Ontology: Mol. function=aspartic-type endopeptidase activity; Biological process=proteolysis
  Homolog annotation: Hit_ID=A5C9V7; Match level="QueryCoverage=89%, HitCoverage=11%, E-value=5e-30, Identity=38%"; Hit description =Putative uncharacterized protein
MGINATILMCLRDIRHNKFKDSLIGMVETNLGQGPVYFNCYPNKIMSLMDRNILDSLFLNIHFHGLDMKERKIPTALIYRIQYKVINTCASRVLLKPQRGETTLFITYMTKVNVSLPRTIKWDEVTLPEKWVMDKATPLVPRPAPTIEQIKQDNSGKRMNLKGDGFFNILRVQIENKSKTNFKNLSKESRSTSFSLIGFMPIPSEKT

SEQ ID NO: 164757 - protein, 402 aa, Glycine max
  Coding DNA Sequence Number=SeqID_73072
MVGEKVNLPKVIFYYWMQGFKDKFNPKMKKNLVPYEYAQKHIKRKVKKDPRLRRSLWSKPTKRPKLDETLERKQALELEEGVLTSVKALLAKEHKRKLTKDAKIANLEQFEQEMKKTKMNELERVQPLVEHATEIMSPDVAQRQAEKKTIIVPKDMDLVEKEALEEAILKYIIEASLRESKDDIVETNPRIAPVRPRPMSDVDEQLIDANQSNIIDVDKLRRLEEICKVPKSVSIETYNRVWKEKGEVGSHILHPEMQDVELDKLRKVYPPSATVYKCRKLNPLSCPSILPWIFKNSWVLFVPSMLFFLGITLRKKLLIEEDEDDPPTRYVKACPRRLFKHELEALKQKTKLESLDWSAIKRIYRLKAYCSETPFNVVYPRTREFFVVSESHILFCGVLAMK

SEQ ID NO: 164758 - protein, 52 aa, Glycine max
  Coding DNA Sequence Number=SeqID_73073
MKRYGEFQRGAWERWNGSREGSEFDEVEDVVMINMAKGGGAKVMVSNGGVHM

SEQ ID NO: 164759 - protein, 15 aa, Glycine max
  Coding DNA Sequence Number=SeqID_73074
MRWSWRQREKSTEKM

SEQ ID NO: 164760 - protein, 63 aa, Glycine max
  Coding DNA Sequence Number=SeqID_73075
  Subcellular localization annotation: CTP_CleavageSite=42; ConfidenceScore=5.09e-01
MRILLRLKCSSHCGGSATSNTSSWWPPMIMGDGRGGVRAWISLSELVSLSGSSLLALSVTFHA

SEQ ID NO: 164761 - protein, 240 aa, Glycine max
  Coding DNA Sequence Number=SeqID_73076
  Gene Ontology: Mol. function=protein binding; Cellular component =nucleolus; Biological process=RNA metabolic process
  Homolog annotation: Hit_ID=A7QRG8; Match level="QueryCoverage=88%, HitCoverage=24%, E-value=1e-59, Identity=56%"; Hit description =Chromosome chr8 scaffold_150, whole genome shotgun sequence
  Pfam annotation: Domain name=MA3; Domain location=170-239; Score= -0.5; E_value=0.012; Accession=PF02847.8; Description=MA3 domain
MDCGSASKRIMGAVGVPVVLGYHGRIDVMEFMLEIVCDIKNNKRKPNEDSHMTLGLRSGYKSLLGHLRNDVPVAEHPSCKCYLSLTVEILGLLKDSVEFHSYDAIDDILIRGFKWSKLLDPDKKGQWWLSGDVASSTGNVEEVANRIDKDVHETQRMLQLAAAQKMNTNARREIFCIIMSGEDYLDAFEKLLRLELPGKQDRDIMWVLVECCLQEKVFNKYYTVLASKLCEHDKNHKLTL

SEQ ID NO: 164762 - protein, 69 aa, Glycine max
  Coding DNA Sequence Number=SeqID_73077
MADNDGVRLWGLKITAQFRTYGGGNGGSRWLKEEGSHVSNVSGITRGDQEANPINCRAIIAEHAVFQNP

SEQ ID NO: 164763 - protein, 111 aa, Glycine max
  Coding DNA Sequence Number=SeqID_73078
  Gene Ontology: Cellular component=integral to membrane; Biological process=vesicle-mediated transport
  Homolog annotation: Hit_ID=O48850; Match level="QueryCoverage=84%, HitCoverage=32%, E-value=1e-33, Identity=73%"; Hit description =Vesicle-associated membrane protein 725
  Pfam annotation: Domain name=Synaptobrevin; Domain location=49-106; Score=-2.7; E_value=0.056; Accession=PF00957.12; Description =Synaptobrevin
MAYLERIMEDFSKRYGGGKATTATAKSLNKEFGSKLKEHMQYCVEHPEEVSKLAKVKAQVSEVQQVMRANIDQVLDRQVKIDVLVGQTEDLRNQVNIRSLCEGFCLPNTTD

SEQ ID NO: 164764 - protein, 98 aa, Glycine max
  Coding DNA Sequence Number=SeqID_73079
MGDQATSMHTISIDRSSEHEASFTLKMRNQEKLLAYKGVGMSPPPLGISQSLKNSLISLKDENLAPCSALRSLKFTLFKPLCGEQFSLGSLQFCANQA

SEQ ID NO: 164765 - protein, 238 aa, Glycine max
  Coding DNA Sequence Number=SeqID_73080
MKLSHEEYGSADFCECIFNNGLRLAGELNKQRFNNIDLGAKMSIKFSNHSLSWSPRVLIRKEWTLFESMKPFPSSYYCSSHRSFAVLVQVKDKPRVKRRNIMDEALIELVIPLLPQEAHMPIIESINLGGYKTRVFIHVFKIKENDVVLIELNVWLKRNRLLSSIPGEVHVPTIWKWAQGNIVLWAWMRHGFAMRRNLTFLLSEVQWRQPQSNSIWHELDGCGWSDVNVRRISWPLIS

SEQ ID NO: 164766 - protein, 61 aa, Glycine max
  Coding DNA Sequence Number=SeqID_73081
MGYLLENLEHKGEDPKLVGLGSSSSMNSFASWKMNGSGMEKEEREEMPLQGEDESRRSSPP

SEQ ID NO: 164767 - protein, 71 aa, Glycine max
  Coding DNA Sequence Number=SeqID_73082
MGRVFTLSSAEASKSKGLIQEDAQVYMTLSNLEVETKVSMGDLPVVRKFPEVFLEDISNLPLERDRVFHRP

SEQ ID NO: 164768 - protein, 80 aa, Glycine max
  Coding DNA Sequence Number=SeqID_73083
MGGTKEISSSLISNIVAVGTTSDKVSSKRKILDEASLSSSELKTQHDHKSTSTSYVSMDQGIGPNSSPCVQRCKCHVCIE

SEQ ID NO: 164769 - protein, 132 aa, Glycine max
  Coding DNA Sequence Number=SeqID_73084
  Homolog annotation: Hit_ID=O52175; Match level="QueryCoverage=62%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLES

SEQ ID NO: 164770 - protein, 149 aa, Glycine max
  Coding DNA Sequence Number=SeqID_73085
  Gene Ontology: Mol. function=pseudouridylate synthase activity; Cellular component=chromatin; Biological process=pseudouridine synthesis
  Homolog annotation: Hit_ID=A1JLM4; Match level="QueryCoverage=100%, HitCoverage=71%, E-value=2e-62, Identity=75%"; Hit description =Pseudouridine synthase
  Pfam annotation: Domain name=PseudoU_synth_2; Domain location=30-138; Score=0.4; E_value=4.8e-05; Accession=PF00849.13; Description=RNA pseudouridylate synthase
  Subcellular localization annotation: CTP_CleavageSite=22; ConfidenceScore=5.19e-01
MKKFSVRNHKVKRFSKPNTAKPAAPKGPRRIVLFNKPFDVLPQFTDEAGRATLKEYIPFPDVYAAGRLDRDSEGLLVLTNDGQLQAQLTQPGKRTGKIYYVQVEGAPQESDLAPLRSGVTLKDGPTLPAGVELVAEPQWLWPRNPPIRE

SEQ ID NO: 164771 - protein, 394 aa, Glycine max
  Coding DNA Sequence Number=SeqID_73086
  Gene Ontology: Mol. function=potassium ion transmembrane transporter activity; Cellular component=integral to membrane; Biological process=potassium ion transport
  Homolog annotation: Hit_ID=A4SLX1; Match level="QueryCoverage=60%, HitCoverage=39%, E-value=3e-89, Identity=69%"; Hit description =Probable potassium transport system protein kup
  Pfam annotation: Domain name=K_trans; Domain location=85-389; Score= -195.0; E_value=5.4e-14; Accession=PF02705.7; Description=K+ potassium transporter
  Subcellular localization annotation: CTP_CleavageSite=49; ConfidenceScore=5.43e-01
MTTNAADHATKSRLNPASNTPETRRRRRTAQNCADRRRKSPARRRELIVAAANKVRRLHLYCQREPSNKDLHMHVKNKQPLPAVTLAAIGVVYGDIGTSPLYTLRECLTAEEGITMTPASIYGFLSLIFWLLTLVVSIKYICFVMRADNDGEGGILTLMSLAIRRLDARWVPAAVLIGLVGGSFFYGDGVITPAISVLSAIEGLQIIAPELDSFIVPLSLLVLTALFAIQKRGTGSVGKLFAPAMVIWFLTLALLGIGGILQHPGVLRALNPYWTVNFFLEYKTVSFFALGMVVLSVTGAEALYADMGHFGGAAADQSGGDQQPVLPAGADLGADPAAGDRHAGDSDRLAGGNLRRILADAAGGAAGLPAADAHHLYLRSGVRADLHSGGELAA

SEQ ID NO: 164772 - protein, 157 aa, Glycine max
  Coding DNA Sequence Number=SeqID_73087
  Homolog annotation: Hit_ID=A5B939; Match level="QueryCoverage=22%, HitCoverage=22%, E-value=9e-07, Identity=74%"; Hit description =Putative uncharacterized protein
  Subcellular localization annotation: CTP_CleavageSite=60; ConfidenceScore=5.07e-01
ADGNVRESEDVAGPGKSYLFCLTACPPGNGSAGASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKRNHSQGNGLGGISGERRPC

SEQ ID NO: 164773 - protein, 167 aa, Glycine max
  Coding DNA Sequence Number=SeqID_73088
  Subcellular localization annotation: CTP_CleavageSite=55; ConfidenceScore=5.02e-01
MVTSPEWVKARTTATSLISAKGNHGKFGLGYKPTQAYIRKSVAGRKSGSPGSRLRQEEEGGPPCHISRSFISADLGHEGQVVAICEDDSPSGSDLVRPCPPGFRLGNWQVEERPNIYATSIISDDKSLEGTNTWDPTIDFEQETNQTEDEEDEDVGTSPRIGEDSRP

SEQ ID NO: 164774 - protein, 84 aa, Glycine max
  Coding DNA Sequence Number=SeqID_73089
MRIHKLLIAFLLAPTFGSFCAPWMPSHQSSKISEPNMPCVPFQPGMLLYDSHGIDLIPFEAEYYRSVTTITDHIRVPNREKLFF

SEQ ID NO: 164775 - protein, 87 aa, Glycine max
  Coding DNA Sequence Number=SeqID_73090
  Gene Ontology: Mol. function=oxidoreductase activity; Biological process=ethylene biosynthetic process
  Homolog annotation: Hit_ID=O04076; Match level="QueryCoverage=100%, HitCoverage=29%, E-value=5e-26, Identity=65%"; Hit description=ACC -oxidase
MEKRFREAVESKGLEAEVKDMDWESTFFLRHLPDSNISKIPDLSQEYQDAMEEFTQKLEKLVEEVLNLICENLALEKWYLKNAFYGS

SEQ ID NO: 164776 - protein, 148 aa, Glycine max
  Coding DNA Sequence Number=SeqID_73091
MDMNVRALIFGQITLMAQSNSSRLGFLALIISFCMAQGVTSDSLTFESLSPAINLAYIKKNCWKLDDPTVSFHQGQYLSLHSLAQHQPIMSMEEFSLQVAWLGVQPSSHGRGEASVAQEPQLDPKTTPAAQEDDLEATPQSHLYQKLI

SEQ ID NO: 164777 - protein, 187 aa, Glycine max
  Coding DNA Sequence Number=SeqID_73092
MARRDKNWSFCTLCHPEARGPMTCGDKIWSFRTPLPFRHSRVRWPQRQNLVILHPLSSRGGGPDDRETKVFTLSCAETKFGHSAPLCHSDTVVSDGAQRQKLVILHPLSSRGGGPDDMRRQNLVIPHPFAIQTQSCPMARRDKIWSFCTLCHPEAAGLMTCGDKIWSFCTPLPLRHSRVRWRAETKF

SEQ ID NO: 164778 - protein, 170 aa, Glycine max
  Coding DNA Sequence Number=SeqID_73093
  Homolog annotation: Hit_ID=Q6WAY6; Match level="QueryCoverage=58%, HitCoverage=17%, E-value=2e-09, Identity=36%"; Hit description =Putative uncharacterized protein
ILSSCEGCPNVLLMGTRGCINYNPVLAIRQLGYPMREVPSDESITPFIARGFSDHNVRVLQGVRKAWDAACRKDKELRGSSNRSIGDYHKWLRVRTQGLDWLPNLKTMRDDGVKASEESDEVQALKAELERARVVKEKFKAAIVSSSSEEVKGIITGQRHDLEGRAKGLP

SEQ ID NO: 164779 - protein, 97 aa, Glycine max
  Coding DNA Sequence Number=SeqID_73094
MMAHHLASGKISKEAKTKWKNQYTTTWPKKVGQQDTWENQQRKKWRGKKTKKSGKVPGVNISSMGGHRKTLHWPANCRSQIEAKATDRRSLKLVYFG

SEQ ID NO: 164780 - protein, 87 aa, Glycine max
  Coding DNA Sequence Number=SeqID_73095
MKTITSSFQGMSNQAAPWWVEPKSHVQTGAYECGYYVMHWMWCIMTGGLKDDWNKWFSDGSPLDVEAITTLRQKWATFFLSIRKSGC

SEQ ID NO: 164781 - protein, 212 aa, Glycine max
  Coding DNA Sequence Number=SeqID_73096
  Gene Ontology: Mol. function=transporter activity; Cellular component= integral to membrane; Biological process=transport
  Homolog annotation: Hit_ID=A8GHS1; Match level="QueryCoverage=94%, HitCoverage=46%, E-value=3e-67, Identity=63%"; Hit description=Major facilitator superfamily MFS_1
MMILRVLFGMAEGPICASANKAINGWFPKKQAATAMGLLSAGSPLGGAVAGPIVGYLALSFGWRPAFVVICLIGLVWMALWFFFAADNPARSKRVSAQERALVEKLKAEEPADIIDADGKAHGMGYYLRQPIILVTAFAFFCYNYILFFFLSWFPAYLGQAHGLDIKAMSITTMIPVDCRLRWPGAGRLGFPIKFFNITGKPAANHARLVLG

SEQ ID NO: 164782 - protein, 66 aa, Glycine max
  Coding DNA Sequence Number=SeqID_73097
MEKAPRIDPLYNPNSSSLGLFSRKKSVIEAYPFQPRDQPIKQTKSWFSSGMVLTLKVFRLRPAKSA

SEQ ID NO: 164783 - protein, 75 aa, Glycine max
  Coding DNA Sequence Number=SeqID_73098
MKLEMSLKIKEEVKKQFDASFLAVARYLEWVANFVPIPKNLFFPIFFHGWVFRVMSFGLKKCWGNIPAGHGGIVP

SEQ ID NO: 164784 - protein, 89 aa, Glycine max
  Coding DNA Sequence Number=SeqID_73099
MEKNEETTMEEKVKLEISGGPSMVIFHHGDAAEDKGEEVRGGAIYYDASSIGACRPRIFFINGFLCFLEDKWQRNGEGRERGDATSRRR

SEQ ID NO: 164785 - protein, 266 aa, Glycine max
  Coding DNA Sequence Number=SeqID_73100
  Gene Ontology: Mol. function=subtilase activity; Biological process =proteolysis
  Homolog annotation: Hit_ID=A7QXF8; Match level="QueryCoverage=51%, HitCoverage=8%, E-value=4e-19, Identity=43%"; Hit description =Chromosome undetermined scaffold_222, whole genome shotgun sequence
MGAIKYMTTDELKLLSIPSEMVKFFNHSIFPHKGHPTRKISMQQGQTYILIARFPDPNYGVKTVNFIINSPHLSIFQRKRKNIQWWFQSKKRCKDELNLTRNKRRITVTSKKTMKVRLGFILYRNHETSLEDFAPIEGFLSVWGFNGDLRRFLDVIRLSFFSQPDGPLMGYGSFKSSPLVQGIKDGIYLGPPPKEKLPKNSPQGSLLLGEISYGKLSFANQGENKTAEILMQPSFDCFEVLNTPRQAIREVPRHSGSQKEALLRNP

SEQ ID NO: 164786 - protein, 236 aa, Glycine max
  Coding DNA Sequence Number=SeqID_73101
SRLFRFFRRFPQINVGGDSARIPFVEHASRESRVALPPKAKRASLAKLRILSGIFEELVSLSAAFKELSAYPCGRGQLNGPCHAKRPMASRKHKSIGSRPTTQYDTRRFSSLDAWTRYTDNVLGRNILPERKVKIYHYELDEFKAELERHNFHKCLTNLADGSIDLALVKEFNANLYSSEDHPPKQSRVRGHLVKIDANSLNTFLETPAVLAEGETLSAYSRYCRLPTDYREIEAA

SEQ ID NO: 164787 - protein, 90 aa, Glycine max
  Coding DNA Sequence Number=SeqID_73102
MPWMLVSMGCVATYPSARGRRETHGMRVPRKEYARSRHQRLFEENVGKTGKDTIYELLSERFGSCIYARGRVFPFAPTYSSICDEEIRPT

SEQ ID NO: 164788 - protein, 260 aa, Glycine max
  Coding DNA Sequence Number=SeqID_73103
  Homolog annotation: Hit_ID=Q9LTU1; Match level="QueryCoverage=70%, HitCoverage=32%, E-value=6e-07, Identity=22%"; Hit description =Replication protein A1-like
MQFGTDDEGGVSQSQSTQNCQHKFLHNAQIVSFGEIKTLRQDCYCLTVGTVDEVMIDTPWSYDSCPYCTITFDPLKIGVACRSCQNHVTHTIPRYKLVVKMEQNGEKANFHFWDAVCIKIFGKNADECRQELIASGDEIKVFPACVDQLLGKTWVVRFKHRIQMHQSSVLDFSEQEHHIQSVIFTLGLQDEQCLSNKSAAVGAASSSQQDYHPTSSEYDPGNAAFVTPAKRTSDQQGSSQFDSDNFTAYELSTNKHIKAE

SEQ ID NO: 164789 - protein, 1077 aa, Glycine max
  Coding DNA Sequence Number=SeqID_73104
  Gene Ontology: Mol. function=binding; Cellular component=nuclear pore; Biological process=NLS-bearing substrate import into nucleus
  Homolog annotation: Hit_ID=A7P079; Match level="QueryCoverage=98%, HitCoverage=98%, E-value=0.0, Identity=78%"; Hit description =Chromosome chr6 scaffold_3, whole genome shotgun sequence
  Pfam annotation: Domain name=Adaptin_N; Domain location=103-673; Score=-175.5; E_value=0.053; Accession=PF01602.11; Description =Adaptin N terminal region
  Pfam annotation: Domain name=Arm; Domain location=445-488; Score =10.7; E_value=0.48; Accession=PF00514.14; Description=Armadillobeta -catenin-like repeat
  Pfam annotation: Domain name=Arm; Domain location=492-530; Score =13.0; E_value=0.25; Accession=PF00514.14; Description=Armadillobeta -catenin-like repeat
  Pfam annotation: Domain name=HEAT; Domain location=135-171; Score =18.1; E_value=0.034; Accession=PF02985.13; Description=HEAT repeat
  Pfam annotation: Domain name=HEAT; Domain location=176-214; Score =16.2; E_value=0.1; Accession=PF02985.13; Description=HEAT repeat
  Pfam annotation: Domain name=HEAT; Domain location=224-260; Score =2.9; E_value=9.8; Accession=PF02985.13; Description=HEAT repeat
  Pfam annotation: Domain name=HEAT; Domain location=370-406; Score =10.3; E_value=0.79; Accession=PF02985.13; Description=HEAT repeat
  Pfam annotation: Domain name=HEAT; Domain location=412-447; Score =19.3; E_value=0.015; Accession=PF02985.13; Description=HEAT repeat
  Pfam annotation: Domain name=HEAT; Domain location=453-490; Score =11.7; E_value=0.48; Accession=PF02985.13; Description=HEAT repeat
  Pfam annotation: Domain name=HEAT; Domain location=496-532; Score =15.1; E_value=0.15; Accession=PF02985.13; Description=HEAT repeat
  Pfam annotation: Domain name=HEAT; Domain location=705-742; Score =3.2; E_value=8.9; Accession=PF02985.13; Description=HEAT repeat
  Pfam annotation: Domain name=HEAT; Domain location=760-797; Score =6.6; E_value=2.8; Accession=PF02985.13; Description=HEAT repeat
  Pfam annotation: Domain name=HEAT; Domain location=885-921; Score =31.1; E_value=3.9e-06; Accession=PF02985.13; Description=HEAT repeat
  Pfam annotation: Domain name=HEAT; Domain location=931-968; Score =1.6; E_value=15; Accession=PF02985.13; Description=HEAT repeat
  Pfam annotation: Domain name=HEAT_PBS; Domain location=391-416; Score= 6.2; E_value=12; Accession=PF03130.7; Description=PBS lyase HEAT-like repeat
  Pfam annotation: Domain name=HEAT_PBS; Domain location=432-469; Score= 12.9; E_value=1.2; Accession=PF03130.7; Description=PBS lyase HEAT -like repeat
  Pfam annotation: Domain name=HEAT_PBS; Domain location=517-553; Score= 5.7; E_value=15; Accession=PF03130.7; Description=PBS lyase HEAT-like repeat
  Pfam annotation: Domain name=HEAT_PBS; Domain location=906-942; Score= 4.8; E_value=20; Accession=PF03130.7; Description=PBS lyase HEAT-like repeat
  Pfam annotation: Domain name=IBN_N; Domain location=39-111; Score =9.6; E_value=0.011; Accession=PF03810.10; Description=Importin-beta N-terminal domain
  Pfam module annotation: Pfam domain module=Adaptin_N::Arm::Arm::HEAT:: HEAT::HEAT::HEAT::HEAT::HEAT::HEAT::HEAT::HEAT::HEAT::HEAT::HEAT _PBS::HEAT_PBS::HEAT_PBS::HEAT_PBS::IBN_N; Domain location=103 -673::445-488::492-530::...
  Pfam module annotation: Domain location=135-171::176-214::224 -260::370-406::412-447::453-490::496-532::705-742::760-797::885 -921::931-968::391-416::432-469::517-553::906-942::39-111
MDPEVQQSQVAAILGADPSPFQTLISHLMSSSNEQRSHAETLFNLCKQTDPDNLSLKLAHLLHSSPHQEARAMSAILLRKQLTRDDSYLWPRLSPQTQSSLKSLLLSSIQSENIKSISKKLCDTISELASGILPDNAWPELLPFMFQCVSSDSPKLQESAFLIFAQLSQYIGDSLTPHIKHLHDIFLQCLTNATVNPDVRIAALNAVINFIQCLSGSADRDRFQDLLPAMMRTLTEALNSGQEATAQEALELLIELAGTEPRFLRRQLVDVVGAMLQIAEAESLEEGTRHLAIEFVITLAEARERAPGMMRKLPQFISRLFTILMKMLLDIEDDPAWHSAETEDEDAGETSNYSVGQECLDRLSISLGGNTIVPVASEQLPAYLAAPEWQKRHAALIALAQIAEGCSKVMIKNLEQVVAMVLTSFPDQHPRVRWAAINAIGQLSTDLGPDLQVKYHQGVLPALAGAMDDFQNPRVQAHAASAVLNFSENCTPDILTPYLDGIVSKLLVLLQNGKQMVQEGALTALASVADSSQEHFQKYYDAVMPYLKAILVNATDKSNRMLRAKSMECISLVGMAVGKEKFRADAKQVMEVLMSLQVSQMETDDPTTSYMLQAWARLCKCLGQDFLPYMEFVMPPLLQSAALKPDVTITSADSDNDIEDSDDESMETITLGDKRIGIKTSVLEEKATACNMLCCYADELKEGFFPWIDQVAGTLVPLLKFYFHEEVRKAAVSAMPELLRSAKLAIEKGQSQGRDVTYLKFLTDSIIPALVEALHKEPDTEICASMLDSLNECLQISGMLLDESQVRSIVDEIKQVITASSSRKRERAERTQAEDFDAEEGDLIKEENEQEEEVFDQGRDKTPEERRIAICIFDDVAEQCREAAIKYYDTYLPFLLEACNDETPDVRQAAVYGLGVCAEFGGSVFKPLVGEALLRLNAVIQHPNALHSDNVMAYDNAVSALGKICQFHRDSIDSAQVVPAWLNCLPIKGDLIEAKVVHDQLCSMAERSDSELLGPNNQYLPKIVSVFAEDLATEQTAGRMVNLLRQLQQTLPPSTLASTWSSLQPQQQLALQSILSS

SEQ ID NO: 164790 - protein, 531 aa, Glycine max
  Coding DNA Sequence Number=SeqID_73105
  Gene Ontology: Mol. function=protein binding
  Homolog annotation: Hit_ID=A7QDJ4; Match level="QueryCoverage=88%, HitCoverage=76%, E-value=1e-63, Identity=35%"; Hit description =Chromosome chr10 scaffold_81, whole genome shotgun sequence
  Pfam annotation: Domain name=DUF688; Domain location=2-520; Score =47.7; E_value=1.6e-14; Accession=PF05097.3; Description=Protein of unknown function (DUF688)
MMDERKLNIDAPLMSVRRSFGISPSLTEANKKILEKPQTLPHYKSDTALDQVTEPVAVPFNWEHIPGRPKDYDGSEPQPPTQASITPTAPTLPPGKSTNVAKQSLEKEPNVANNFRPSSISNSLREKIDCDKEHKDEKINKVEENDDYDDDSDIYSDALETLSPTEPMSMNCSLSGVSGLDNVDENRCGTSSTDKQAHDFMMSRFLNAAKAMTIQPPQYASFRKQQPVLAEQPREFIKLVPEQKKSFVNRHITDIVPYTGQCQEEEEEEEESDDETNDYANNSAKGCGLFPRLCVRNSLCLLNPVPGTKMGNQFPLYSAYEVVKPDKSSHIRSHRPAPAIKKAWDAINKSKLSSSSRAASPDKKDVRKKWTSESSRYNYSGELKQLGRLSPFRRSRAASAGVSPFRSKPQPPFPGAKLLGDSEQADNNHSGKLKFPNRGHASIQEVLSQGAKKSYSFGSLSVEKTLYIDTASTVKSSCSSSRSLGSTIVVGKDRNSLVDSFRDMKHLEALEENLDSQVLNSVDANSPTLSS

SEQ ID NO: 164791 - protein, 181 aa, Glycine max
  Coding DNA Sequence Number=SeqID_73106
  Homolog annotation: Hit_ID=A7QDH1; Match level="QueryCoverage=72%, HitCoverage=78%, E-value=1e-25, Identity=48%"; Hit description =Chromosome chr10 scaffold_81, whole genome shotgun sequence
MARIQDTSLHSPPINTLPELSTHKSQYISFTFTKEEDEAKRTSLAKSTVLRLYKLKLALETVKRQYENLLATRRECVRLLNHVKESKDVKIEKVGAGTFMVRVTCEKGGDNLVAILKAFDEMCLDVQQARVSCENGFFLEAIAVAEDQTLDVRDITEVLLKAIGKQSGEKDSQMFDKCCDS

SEQ ID NO: 164792 - protein, 352 aa, Glycine max
  Coding DNA Sequence Number=SeqID_73107
  Gene Ontology: Mol. function=protein domain specific binding; Cellular component=melanosome; Biological process=intracellular signaling cascade
  Homolog annotation: Hit_ID=A7P1Z4; Match level="QueryCoverage=69%, HitCoverage=93%, E-value=1e-117, Identity=85%"; Hit description =Chromosome chr19 scaffold_4, whole genome shotgun sequence
  Pfam annotation: Domain name=14-3-3; Domain location=7-242; Score =512.8; E_value=3.9e-151; Accession=PF00244.11; Description=14-3-3 protein
MASTKERENFVYTAKLAEQAERYEEMVEAMKNVAKLNVELTVEERNLLSVGYKNVVGARRASWRILSSIEQKEEAKGNDVSVKRIKEYRQKVESELSNICSDIMTVIDEHLIPSSSAGEPSVFFYKMKGDYYRYLAEFKSGDERKEAADHSMKAYQSASTTAEAELPPTHPIRLGLALNFSVFYYEILNSPERACHLAKQAFDEAISELDTLSEESYKDSTLIMQLLRDNLTLWTSDIPEEGEKTKRVSKIKIAKACIPCSTHSSIGHCYRLQWPEGHTTALVFLGSAEEQKVDSARAAGGATVRVECKEAVTRECKLGKSSKADCGDVDSEQLVSASCPHSCLLHEGVNLK

SEQ ID NO: 164793 - protein, 194 aa, Glycine max
  Coding DNA Sequence Number=SeqID_73108
  Gene Ontology: Mol. function=catalytic activity; Biological process =metabolic process
  Homolog annotation: Hit_ID=A7P054; Match level="QueryCoverage=100%, HitCoverage=32%, E-value=2e-66, Identity=57%"; Hit description =Chromosome chr6 scaffold_3, whole genome shotgun sequence
MWLSSKAYYSPIVELCGGTELASSYIAGSPLQPQAFGAFSTASMTTGFVIFDENGVPYPDDVACVGEVGLFPLSLGASDRLLNADHEKTSSVEIESVCDGADECILVTAAVGVATANGGPEQLVIFVVLKEGYNSSAETLKMKFTKAIQSNLNPLLKVSLAKIVPEFPGTSSNKIPRRVMRDQMKRELSVQSRL

SEQ ID NO: 164794 - protein, 51 aa, Glycine max
  Coding DNA Sequence Number=SeqID_73109
MGEKGAGKEVPLCVETEGSTMFDDMMQCNAMQCTLVVTDNRFFYGANQYPF

SEQ ID NO: 164795 - protein, 131 aa, Glycine max
  Coding DNA Sequence Number=SeqID_73110
MENETSKGAAWFDLSAGGGGVGLSGGGSGVVSNRGDGGVSGGGVGNGGGGDGVRDRGVDGPLKLCLASSSVGGGSGRWKLCMASGSHGRQPWKLHTVSGSHGSWYGIHGRKPWALNESTKCYEPSTGTGTT

SEQ ID NO: 164796 - protein, 287 aa, Glycine max
  Coding DNA Sequence Number=SeqID_73111
  Gene Ontology: Mol. function=phosphogluconate dehydrogenase (decarboxylating) activity; Cellular component=mitochondrion; Biological process=glyoxylate metabolic process
  Homolog annotation: Hit_ID=UPI00005FA7FA; Match level="QueryCoverage =100%, HitCoverage=97%, E-value=1e-135, Identity=83%"; Hit description=COG2084: 3-hydroxyisobutyrate dehydrogenase and related beta-hydroxyacid dehydrogenases
  Pfam annotation: Domain name=F420_oxidored; Domain location=1-208; Score=-33.9; E_value=0.0012; Accession=PF03807.8; Description=NADP oxidoreductase coenzyme F420-dependent
  Pfam annotation: Domain name=NAD_binding_2; Domain location=1-158; Score=232.3; E_value=1.1e-66; Accession=PF03446.6; Description=NAD binding domain of 6-phosphogluconate dehydrogenase
  Pfam annotation: Domain name=PDH; Domain location=2-247; Score= -121.8; E_value=0.066; Accession=PF02153.8; Description=Prephenate dehydrogenase
  Pfam module annotation: Pfam domain module=F420_oxidored::NAD_binding_ 2::PDH; Domain location=1-208::1-158::2-247
GIIGLGIMGAPMAEKLLAGGHTLYAHTRHQVPAALLQQGAIACGDPQQVADEADVIFIMVPDTPQVEEVLFGERGCAAGKLNGKVVVDMSSISPLETKRFAQRINQLGAQYLDAPVSGGEVGAKQGTLTIMVGGEEATFERVQPLLALMGKNITLIGGNGDGQTCKVANQIIVALTIEAVSEALVFASRAGADPARVREALMGGFASSRILEVHGERMIKRAFAPGFRISLHQKDLNLALQGAKALALSLPNTATCQELFNVCAANGDGELDHSALVRALEIMGNHR

SEQ ID NO: 164797 - protein, 269 aa, Glycine max
  Coding DNA Sequence Number=SeqID_73112
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=83%, HitCoverage=23%, E-value=1e-105, Identity=81%"; Hit description=DNA -directed RNA polymerase subunit beta
  Pfam annotation: Domain name=RNA_pol_Rpb2_6; Domain location=15-265; Score=-7.6; E_value=2.6e-13; Accession=PF00562.19; Description=RNA polymerase Rpb2, domain 6
MGTGHLRSIFPSNIFLWSFSDSFYEHNDANRALMSSNMQRQAVPLSQSEKCIVGTGLERQVALDSGVSAIAEHEGNIIYYQYCGYFYLVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQEIFRGTDCSSPIPSRISYDCMGTGSSSKYFSLPIFSIELL

SEQ ID NO: 164798 - protein, 214 aa, Glycine max
  Coding DNA Sequence Number=SeqID_73113
  Homolog annotation: Hit_ID=A4DID9; Match level="QueryCoverage=25%, HitCoverage=49%, E-value=4e-19, Identity=80%"; Hit description =Putative uncharacterized protein
EPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPDREGRTSGVPVIVPTVNAGASGSTAETAMGSLPQRGWSERSFENSRE

SEQ ID NO: 164799 - protein, 59 aa, Glycine max
  Coding DNA Sequence Number=SeqID_73114
MEKEGDGLESLTIHVSHEKKYLYLGACHSVWNFLETQVDHHGGGGEFPVHDRVTLTLAA

SEQ ID NO: 164800 - protein, 72 aa, Glycine max
  Coding DNA Sequence Number=SeqID_73115
  Subcellular localization annotation: CTP_CleavageSite=43; ConfidenceScore=5.27e-01
TYQGNPWGVYPDLSSFTGSGVYLTYLPSPKVASTLIYLSSPEVASSKTSTACIKRSAPTQVHITMRLNWTSE

SEQ ID NO: 164801 - protein, 143 aa, Glycine max
  Coding DNA Sequence Number=SeqID_73116
MASMLEAMLGMRQLMKKNVATIAVISSAAEADPTLLATVHHPPPNAVGRERNRLGHNSNPHLGYNWVAYPYGLPPNYTPPVMHDDAERPPPTAEERRKLDLLEERLKVVEGFGNYSFTDMTDLCLVPAVVIPPKFKVPDFDKY

SEQ ID NO: 164802 - protein, 147 aa, Glycine max
  Coding DNA Sequence Number=SeqID_73117
  Gene Ontology: Mol. function=helicase activity
  Homolog annotation: Hit_ID=A2Q378; Match level="QueryCoverage=53%, HitCoverage=4%, E-value=2e-17, Identity=50%"; Hit description =Putative uncharacterized protein
MVHDDNEIVLHANTPNDEIKEYLDCRYISPCESAWRIFGFPIHGRKPSVERLQFHLLGQHSVLYQDHDDIDDMLSNPSISESKFIAWMNTNQVFVEEDQSHLKISEQWMVLNILHIEKHVLLWVFYRMIENSLLQSRKQKTGAQDLI

SEQ ID NO: 164803 - protein, 156 aa, Glycine max
  Coding DNA Sequence Number=SeqID_73118
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=7e-25, Identity=56%"; Hit description =Putative uncharacterized protein
  Subcellular localization annotation: CTP_CleavageSite=50; ConfidenceScore=5.34e-01
MTMITPSSKLTLTKGNKSWYRAPPRGRRSDDRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 164804 - protein, 89 aa, Glycine max
  Coding DNA Sequence Number=SeqID_73119
MVGPRPWMRRRPWGDLVVYGVETMGEIVHQAVRKVSVHQVVSCLPVDSAAVRKVDLYRESPDLRLFCNSPKHFVAYYALPRLWVPRYPP

SEQ ID NO: 164805 - protein, 445 aa, Glycine max
  Coding DNA Sequence Number=SeqID_73120
SSVRDLKHERRRSPSSQKRVRKGKLAKEKFKLAATHVRKECAGLQEENAITARALEQETKRARKEEYGRNKFRGALWGSNNELKLRREERDQSRAHSMVLKEELIACSRSKRSLSQRLCETETNMLAIIAKYQEELGLAAAHEHRIADEYAQVYAEKEARGRVIDSLHQEATMWMDRFALTLNGSQELPRLLAKAKAMADTYSAPEEIHGLLGYWKNTITKRAARDPYRTRSKSRTMGDQEETQEQMKADMSALKEQMASMMEAMLGMKQLMEKNAATAAAVSSAAEADPTLLATTHHPPSNIVGRGRDTLGHDGSPHLGYNRAAYPYGLPPNYSPPILQEDAGHIASPVHEKEPPQQPDEVHKDPQDYARRDVEFYPPIPEGPAPGTLPQPNIAASPIVLSMEGPPPATEERRKLDLLEERLRAVEGFGDYPFADMTDLCLVPD

SEQ ID NO: 164806 - protein, 260 aa, Glycine max
  Coding DNA Sequence Number=SeqID_73121
MVIRTRFRHPETIESDGTQRQIMVILHLLSSRGGEPDDMRRQLMVIRTPFRHPETIESDGTQRQIMVILHHLSSRGGEPEDMWRQIMAIRTPFRHPETIESDGTQRQIMVIRTRFRHPETIESGGTQRQIMVIRPHFRHPDTIESNGTQTQIMVILHLLSSRGGEPDDMRRQLMVIRTPFCHPETIESGGTQREIMVILHLLSSRGGEADDLRRQIIVIRTPLCYPETIESGGTQRQIMVILQLLSSRGGEPDDMWRQIM

SEQ ID NO: 164807 - protein, 150 aa, Glycine max
  Coding DNA Sequence Number=SeqID_73122
  Homolog annotation: Hit_ID=Q6UUU1; Match level="QueryCoverage=40%, HitCoverage=40%, E-value=9e-19, Identity=78%"; Hit description =Putative uncharacterized protein
MDREMEGSTDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 164808 - protein, 152 aa, Glycine max
  Coding DNA Sequence Number=SeqID_73123
HPLLGCDPRLTTSRYLEPIVRQFVKFRDMSEVKEGIAAQSVKFCDMPEIKRKLTWAFQDVPPKVVASGGSNLARLGELGGKLLPYFPINRGRSEGEKCSAPSGISRSLEISEKNCFRKENPSRGASVTFPWVISRKIFKPFFDVLHRSSVFN

SEQ ID NO: 164809 - protein, 93 aa, Glycine max
  Coding DNA Sequence Number=SeqID_73124
MTTEESIHVTFDETNITSPRKEFLDDIADTLEDAQNEERNLKRKRDDEDKDDKDDIAQENDNLPKEGKTSRNHPLDNIIGDILKGKNLQIIQS

SEQ ID NO: 164810 - protein, 80 aa, Glycine max
  Coding DNA Sequence Number=SeqID_73125
RVPFAIQAAQLLGRAIGAGLFAITPAGERGMCCKAIKLGNARVFPVTTLNSIKLKENSLTHRFRTGHEAQKFQDNMFKEV

SEQ ID NO: 164811 - protein, 111 aa, Glycine max
  Coding DNA Sequence Number=SeqID_73126
MSIGKCSIGIIRRSFFIRPQGSVILTRIMKLAKYKLKAQVEKDEGPSGEGQSPRVEKDEGPSNPCGVYPDLSSFTGSGVYPDLSSFTESGVIQNLRSLYQTIRSYSRSHHL

SEQ ID NO: 164812 - protein, 135 aa, Glycine max
  Coding DNA Sequence Number=SeqID_73127
  Gene Ontology: Mol. function=structural molecule activity; Cellular component=flagellin-based flagellum filament; Biological process =ciliary or flagellar motility
  Homolog annotation: Hit_ID=Q56912; Match level="QueryCoverage=100%, HitCoverage=37%, E-value=2e-53, Identity=83%"; Hit description =Thermoregulated motility protein
  Pfam annotation: Domain name=Flagellin_N; Domain location=28-135; Score=167.3; E_value=4e-47; Accession=PF00669.11; Description =Bacterial flagellin N-terminus
  Subcellular localization annotation: CTP_CleavageSite=62; ConfidenceScore=5.23e-01
MAVINTNTLSLVTQNNLNKSQSSLGTAIERLSSGLRINSAKDDAAGQAIANRFTSNINGLTVAARNANDGISLAQTAEGALSEINNNLQRVRDLTVQAQNSSNSASDIDSIQAEVNQRMEEINRVTAQTDFNGIK

SEQ ID NO: 164813 - protein, 81 aa, Glycine max
  Coding DNA Sequence Number=SeqID_73128
MASMMDAMLGMRQLMENSAATAAAVSSATEADPTLPATAHHPIPSVVMSLPPSLKGSLLDSRTRFMRIVENMPKETSIPTP

SEQ ID NO: 164814 - protein, 90 aa, Glycine max
  Coding DNA Sequence Number=SeqID_73129
ARVTGSSSIRGKCAELPPTFICGKCRKNRRKPVMKNIPDLGVVFTFEESISTSQVDKSGALAPTYPPSKRKSDLRSSFKKANQAILFTWK

SEQ ID NO: 164815 - protein, 44 aa, Glycine max
  Coding DNA Sequence Number=SeqID_73130
ENEGGAFHAARPGELGCFLQKAPPSRGTSWKAQVGLVAICTPIY

SEQ ID NO: 164816 - protein, 271 aa, Glycine max
  Coding DNA Sequence Number=SeqID_73131
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSSSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSTIYDIKHAKTSFSDFGRPIPWGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 164817 - protein, 69 aa, Glycine max
  Coding DNA Sequence Number=SeqID_73132
MAPTDAEKREELEPKNGMQTEKKFQTAFSPSPSRCFSPSSSSTIVAQQSFNLWCPFPLQIGKGGHFPES

SEQ ID NO: 164818 - protein, 230 aa, Glycine max
  Coding DNA Sequence Number=SeqID_73133
MGEVEEIQEKMKADMEAIKEKIATMMEAMMSVKKIMEANAVAIAATSVVAKVNLMSPSDINQMNHPTLDMVGKDLGSTGSPHNVQIQNEHAFPPYGLPLNYTPPKVAYTPNKNVNNSTPIPIESQQPQTDHAHGKQLVVYPYKTLWRALGITHNCTSCIPQWLKTLMTMAGMGKLDHLEERLRAIEGGEDYAFANLEELFLIPKHGHSQVQGAGLWQVQGDYSLQEPSKD

SEQ ID NO: 164819 - protein, 159 aa, Glycine max
  Coding DNA Sequence Number=SeqID_73134
MVITVHLENLRWGPLTVIHRPKKVVRQFGYIQTIPPHLVVPSASVEEMDAKWMHQCSSDYMEWFYLISHPFMTPAQPGDPPTVPPQPVAAGAPNEVDVNVHRPGHVVDGYVAIVDKLERLLNLRIPTEGIKPCIVVEKCLSIARSYIGQPTIGQRSRHR

SEQ ID NO: 164820 - protein, 54 aa, Glycine max
  Coding DNA Sequence Number=SeqID_73135
MSVKNLVERLGVHDKTNHTLGDQSGSRYFARMLQPCGIDTCLKEHSNQVYLGIL

SEQ ID NO: 164821 - protein, 79 aa, Glycine max
  Coding DNA Sequence Number=SeqID_73136
MEWRRKKDDWRHNFMEKMSQEEAHHNKKPWIRASRHEKMSGGREREGARNFVPQISQLIQDHVQDSPLSVLRCHETCKE

SEQ ID NO: 164822 - protein, 138 aa, Glycine max
  Coding DNA Sequence Number=SeqID_73137
  Gene Ontology: Mol. function=binding
  Homolog annotation: Hit_ID=Q9FKW5; Match level="QueryCoverage=92%, HitCoverage=19%, E-value=4e-44, Identity=75%"; Hit description =Genomic DNA, chromosome 5, TAC clone:K2A18
MAKSIQLADQVAKAATEEASSFFKQECLELKSKTEKLAGLLWQVARVSSDLYEWPTRRIIVDTELVLDKALSLILKCRANDLMKRVFNMIPATAFRKMSSQLENSIVDVSWLLRVSAPADDRADIEYVTTTATASDPY

SEQ ID NO: 164823 - protein, 125 aa, Glycine max
  Coding DNA Sequence Number=SeqID_73138
  Gene Ontology: Mol. function=transferase activity, transferring glycosyl groups; Cellular component=chloroplast; Biological process =aromatic amino acid family biosynthetic process
  Homolog annotation: Hit_ID=A7PCX5; Match level="QueryCoverage=80%, HitCoverage=25%, E-value=4e-27, Identity=62%"; Hit description =Chromosome chr17 scaffold_12, whole genome shotgun sequence
  Pfam annotation: Domain name=Glycos_transf_3; Domain location=4-124; Score=-128.4; E_value=0.033; Accession=PF00591.12; Description =Glycosyl transferase family, ab domain
MECLTLNMSFYLVCGLKVFAYFFPKKVFKIPKELNRFGMKRALVVHSGGLDEMSPFGPCLMLEVTTNKVDKISFDPLEFGIPRCNIESLKCGGPEYNAEVPKCVLGVKKGPIAYALGLRGYDILV

SEQ ID NO: 164824 - protein, 87 aa, Glycine max
  Coding DNA Sequence Number=SeqID_73139
  Subcellular localization annotation: CTP_CleavageSite=60; ConfidenceScore=5.52e-01
MCSPSAQPARPAGSLSLLTLSVTSLAKPKFTYSRLASLRKLKGPRAFKTLKLAKIKHRVRDSAPEEAKKTERKQLREHMLEGVKSRV

SEQ ID NO: 164825 - protein, 189 aa, Glycine max
  Coding DNA Sequence Number=SeqID_73140
MEDETSSCCKLFKKPCSNNIEAVGRSVGFLIKQSLRKSLPSADNVSGIGGVLNPPLQQPRDQDQQAWLPAVSPPPLPACAVATTGMHRRRLDNRNSSTSTVIRGGGQQHAEVLHGRCPGAEDFADDGARDELLLHRLHHAPRPDLKSIRFNVVADINNVFEEVYNDVAFKDRPAPSLNADKDRCKTAFF

SEQ ID NO: 164826 - protein, 50 aa, Glycine max
  Coding DNA Sequence Number=SeqID_73141
MRTTKGKGRRCLPPSSPRRARLLPLEATAFWRNILEGPSGPGCYLNSNFY

SEQ ID NO: 164827 - protein, 35 aa, Glycine max
  Coding DNA Sequence Number=SeqID_73142
LASHLKEVSLAIREEVFSKKLLKEVFSRKLLKEAT

SEQ ID NO: 164828 - protein, 167 aa, Glycine max
  Coding DNA Sequence Number=SeqID_73143
QISSIAQSNSSRLGFPALIIALCRARGVTSDNGIQEEEGLDQLMFPLLLHRHLLLLLLALHQLSMIPGAFQDSLEAWNRYSGNHSQPKYLHGENMFIIEFDELQGGVGEAGGSQQAQSKSPIKIDADPAMPAPGLATTPPTTPVLRFSDEEEGQDYYSSRDSSVTFG

SEQ ID NO: 164829 - protein, 134 aa, Glycine max
  Coding DNA Sequence Number=SeqID_73144
MGLDRYPLVKVSLSLGFIVMPKKYLLTRPLEEGVEKELKGMNLVGRRISEEGGSLVQEGIIHLRKMIVFKVLVDHEGHKSRADFVHSERLCRVGFGCLRRFGISSNEKEKKECDDRSMSVARFRRGKGYRGRYF

SEQ ID NO: 164830 - protein, 46 aa, Glycine max
  Coding DNA Sequence Number=SeqID_73145
MTSAACMHGDLPYLLIYIERCAAPPIIKLSIGGGCDVEINIWAMMI

SEQ ID NO: 164831 - protein, 120 aa, Glycine max
  Coding DNA Sequence Number=SeqID_73146
MAYKESSHCNSPIEADTGKASKKDDVRGKLNFDASNMPESLDKSLANEVSTSELDKGVVISDIDFSNLDWSLQGTSFEDFFDPIGLTDSKDNASSSRSSNELQVSTNKNLNVQGLDSQHV

SEQ ID NO: 164832 - protein, 102 aa, Glycine max
  Coding DNA Sequence Number=SeqID_73147
  Homolog annotation: Hit_ID=A0ST23; Match level="QueryCoverage=24%, HitCoverage=51%, E-value=3e-07, Identity=100%"; Hit description =Putative reverse transcriptase
MQWNYLPFCDTIKLNRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 164833 - protein, 490 aa, Glycine max
  Coding DNA Sequence Number=SeqID_73148
  Gene Ontology: Mol. function=nucleotide binding; Cellular component =Golgi apparatus; Biological process=regulation of transcription, DNA- dependent
  Homolog annotation: Hit_ID=A7PNZ1; Match level="QueryCoverage=97%, HitCoverage=76%, E-value=0.0, Identity=78%"; Hit description =Chromosome chr8 scaffold_23, whole genome shotgun sequence
  Pfam annotation: Domain name=DUF246; Domain location=84-428; Score =711.2; E_value=7.7e-211; Accession=PF03138.5; Description=Plant protein family
MNGKSFKSIENGQLILQRFKEDWVSAQRVVSESRTRTETSMPKRVLERLTTPEIWMKPNSDKYYKCVSPPRNVIRPKQTNGYLLVHANGGLNQMRTGICDMVAVAKIMNATLVLPSLDHDSFWTDPSDFKDIFDWRHFVKVLKDDIEIVEYLPVQYASLKPLVKAPVSWSKASYYRGEILPLLKQHTVVQFTHTDSRLANNGLASSLQKLRCRANYHALKYTAEIEELGRVLVNRLRNNKEPYIALHLRYEKDMLSFTGCSHNLTAEEAEELRVMRYEVKHWKEKEIDSVDRRLQGGCPMSPREAAIFLKAMGYPSTTTIYIVAGPIYGGNSLEAFQSVFPKVFSHSTLATEEELEPFKPYQNRLAALDYIVALESDVFVYTYDGNMAKAVQGHRRFEGFQKTINPDRLNFVKLIDQLDEGAISWEAFASEVKNLHSNRLGAPYLRQVGESPRMEENFYANPFPGCVCNKSQEQITSQKLDHQFGIGAQR

SEQ ID NO: 164834 - protein, 227 aa, Glycine max
  Coding DNA Sequence Number=SeqID_73149
MHLTFMLGSQFLCLAHSGTKFQLAVDKPILIPKLNYIRIEDLISRDKQALRGYYRLGAHYFCLEPEEKPPLDKVHHKIGCCYQTINHNPFVVDSPSNRICQWKRDFVVVSERNFSFTIELPNSTFTFIHQVQSIIDEVNSNEEASIVADLATEVYNGPPSQEEVLVEALQDRAHAEREAKRWKILGESLFKKCVEIPLDSSCDDDFKDDFLRKIKEEDEASKQRGKK

SEQ ID NO: 164835 - protein, 229 aa, Glycine max
  Coding DNA Sequence Number=SeqID_73150
  Subcellular localization annotation: CTP_CleavageSite=30; ConfidenceScore=5.12e-01
MEHKLQGFVKIDRDDSSLPLVTSPIRHATQSFAKFSEKQMSNFHNRNLSTFAVQPSFLASHFGSRWDRNALSDLNGGQSGGSDFISSPLKSFIKFSEKQTSNFHKRNLSIFVVQASSLASDFGCRHELGRFEGLIRTDGISGNLRNVWQVTFSSASSPNESSGAGTEVSKPEQFWNTPLVECPRMHLSLLSTKDMKDFDTIQVMNVWFESFVLDVNSRAPLMTFQELKN

SEQ ID NO: 164836 - protein, 166 aa, Glycine max
  Coding DNA Sequence Number=SeqID_73151
  Homolog annotation: Hit_ID=A2Q4N3; Match level="QueryCoverage=43%, HitCoverage=35%, E-value=3e-08, Identity=36%"; Hit description =Polynucleotidyl transferase, Ribonuclease H fold
MVQCNSTVNVYQHLPALLSTNQQHIWTPPPTGFGKCNLDAKIFNNSLPFGIDICIRGEHGHFIQVKMSSFNGIPTLAQAEAWALYHALQWTSHLGYQNPLTVLAIKLDPPLALALQDVTWTVPPFPLARRGDVDGTAIATGDTGHGHRFAVFRATALQCLGQQHAD

SEQ ID NO: 164837 - protein, 252 aa, Glycine max
  Coding DNA Sequence Number=SeqID_73152
  Homolog annotation: Hit_ID=Q3E8M5; Match level="QueryCoverage=23%, HitCoverage=9%, E-value=5e-08, Identity=48%"; Hit description =Uncharacterized protein At5g36905.1
VINGALEFTSRTNDSNQTFMTWIVSKSFISLVESKDKCILGHSTNGVFQNCSGFDTSVPAPEDSFGLEAEENVTCHTFLKFPEIPSVLMSPSNLPSSCLHPKSLAREEAWTTKMLKFLLWKLDVCFSLNLMKLFNDCPLIWLEENLKKSQHEDVDSWSRHFTVMLDKLGSDGALMVILRLMEEITSYPNGIRWSPPPEGLFKLNYDGAVNCNSLKVSAGGVVRDSHGNFVIGFTTTPDSCTINIAELWASTD

SEQ ID NO: 164838 - protein, 180 aa, Glycine max
  Coding DNA Sequence Number=SeqID_73153
MLAFPFEMLRNFTDYATMLILRVSKGTNKGSKDKTLILFKLNLTRPINCPTSGTSQSNRIENASGAPRRVLHVVGLECLWMTKATIYCLRASSDLSSLDDEGAGNHEVSPHAIGPSSHDSRIETFSRSRPKDADISGKGTDNHKVRSHATGPLGHDSEIEIFSQSQPKDADISGKGADDD

SEQ ID NO: 164839 - protein, 116 aa, Glycine max
  Coding DNA Sequence Number=SeqID_73154
MESPTVATYPSAGGRRGAHGCVFQERKMRGVATKVYLRKTSEKSERCGLRTLSVKGSGVIFTHGKGHLRRWTIKRSFDFEKRTLRRWTINDLLGWSTKAGFVLLRILNCDEELKPT

SEQ ID NO: 164840 - protein, 50 aa, Glycine max
  Coding DNA Sequence Number=SeqID_73155
MVTSHDTCKGLRKSHGMVFAIRNANISCRSKVSKIILMMPKIIKDPFKQD

SEQ ID NO: 164841 - protein, 93 aa, Glycine max; identical to SEQ ID NO: 141213
  Coding DNA Sequence Number=SeqID_73156
  Homolog annotation: Hit_ID=A5C6R1; Match level="QueryCoverage=61%, HitCoverage=5%, E-value=4e-10, Identity=54%"; Hit description =Putative uncharacterized protein
  Subcellular localization annotation: CTP_CleavageSite=62; ConfidenceScore=5.20e-01

SEQ ID NO: 164842 - protein, 90 aa, Glycine max
  Coding DNA Sequence Number=SeqID_73157
  Subcellular localization annotation: CTP_CleavageSite=77; ConfidenceScore=5.12e-01
MLMKKDMVEKINLFFKRFWIGSMVFKPLLVKVCPSEFSPAPSNSLIQVCTSCSSSLLAVDMKGRPKIIGMSGSSSISITTKSAGNTSCLT

SEQ ID NO: 164843 - protein, 64 aa, Glycine max
  Coding DNA Sequence Number=SeqID_73158
MGLHHFGIRAPVQGFFKSAWVEISCFQKFLKVVVNINWMGHKDSYWMLSMLKCKTIEKQQRGVV

SEQ ID NO: 164844 - protein, 80 aa, Glycine max
  Coding DNA Sequence Number=SeqID_73159
MGVQIATRPTWALQKAVASGGSNPARLGELGGKLLPQFSINRGRSEKIQAEALRKRFREEFCEAFDRFSTFFIHSSIFNG

SEQ ID NO: 164845 - protein, 202 aa, Glycine max
  Coding DNA Sequence Number=SeqID_73160
  Gene Ontology: Mol. function=chloramphenicol O-acetyltransferase activity; Biological process=response to antibiotic
  Homolog annotation: Hit_ID=P62577; Match level="QueryCoverage=94%, HitCoverage=86%, E-value=1e-111, Identity=100%"; Hit description =Chloramphenicol acetyltransferase
  Pfam annotation: Domain name=CAT; Domain location=6-197; Score=438.5; E_value=9e-129; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQAGRNFFKAVIGA

SEQ ID NO: 164846 - protein, 175 aa, Glycine max
  Coding DNA Sequence Number=SeqID_73161
MEPTRHPLDPEKSNRALRVPVTPSKVIRPPITRAFIKKFCTPRQAQGDAHQDAGAPPPPRQADSARPLGVERYLQHLVRQQAANHRGQVHIHECLYRFSLSQQGQGSAPFVCPTPEQFGAEVAWPGDWPDAQAGEEPARSPGEADESRMDEDMTTCSVSWEGAEQHDQVIVFVVI

SEQ ID NO: 164847 - protein, 236 aa, Glycine max
  Coding DNA Sequence Number=SeqID_73162
LHVVTFRGYTPSPLEDYTSSPSKDQTSSSSKDYMSSSSEDYASSPSEGYTPSPSEGYTSLPSEDYTFSPSKGCMSLPSEDYTSSTSEDYTWPPPDPGGGPTMQVQPKEEAIVQLLCIPGQDFTRAAAKRRLRIMRTNMTTLTQIWMTLLLSNILPSDRNADLPLRKDHAHKAPSGPGEVQQGPGDASSGYGPLSVQQGIAPARHPVDSEKSNRVLGFPALITGLCQFYRVLITPNK

SEQ ID NO: 164848 - protein, 297 aa, Glycine max
  Coding DNA Sequence Number=SeqID_73163
  Homolog annotation: Hit_ID=Q6WAY6; Match level="QueryCoverage=73%, HitCoverage=41%, E-value=1e-11, Identity=28%"; Hit description =Putative uncharacterized protein
  Pfam annotation: Domain name=DivIVA; Domain location=38-192; Score= -70.6; E_value=0.095; Accession=PF05103.4; Description=DivIVA protein
FPNVPLIGTRGCISYNPVLVISQLGYPMRGAPLEEELMPIIARGFNKTNVEALQKVHKAWEMVQKKDKELRGSNNGPIGNYRDEEVQALRAELEQAQSVKERFKSTTLKIQKENAELRDVNKATTKALERKTKRARREEYRGALWGSNSELKLRREEKDQSRVGSLILKDELKVCLRSKRSLSQRLCEIEINMLAIISRYQDELNLAMAHEHKVADEYARVYAEKEARGRVINSLHQEATMWMDRFALTLNGSQELPRLLARAKAMADTYSAPEEIHRLLSYCQHMIDLMTHIIRNH

SEQ ID NO: 164849 - protein, 190 aa, Glycine max
  Coding DNA Sequence Number=SeqID_73164
  Homolog annotation: Hit_ID=Q2HW90; Match level="QueryCoverage=96%, HitCoverage=36%, E-value=2e-20, Identity=32%"; Hit description =Putative uncharacterized protein
MVEVSVEAIASLTQYYDQPLRCFTFRDFQLVPIVEEFEEIMGCPLGGRKPYLFSRFYPSMEKVVKVVKISIQELDHVKQNRNGVVEIPRKHLEEKAKALADQGEWASFIDILTLLIFGFVLFPNVDGLVDLEAIDAFLAYHHSKESPIIAILADVYDMFDRRCEKSGPRIVCYTLALYVWLVSHLFLSRK

SEQ ID NO: 164850 - protein, 103 aa, Glycine max
  Coding DNA Sequence Number=SeqID_73165
  Homolog annotation: Hit_ID=Q3BKH8; Match level="QueryCoverage=61%, HitCoverage=82%, E-value=1e-18, Identity=71%"; Hit description =Putative uncharacterized protein
MSALRHWGCSMFQGLGCSPIKAVRELGSERRETVRSISGVGVRALRGPFPSTRGPGRTHLWCASYRAHGKRWVAKASGSTAETAMGSLPQRGWSERSFENSRE

SEQ ID NO: 164851 - protein, 100 aa, Glycine max
  Coding DNA Sequence Number=SeqID_73166
MAKPFAISIRNSLPKILVIILMLWLVFLNHCLEFKLEIPFASFASIIMIFIKTSKAIASQAPVTLAQPGGEDGALSELRSLSASIQLILLQELSPRLAIR

SEQ ID NO: 164852 - protein, 167 aa, Glycine max
  Coding DNA Sequence Number=SeqID_73167
PTGCPSPPARSCHRDIGIVPARHPMDPEKSNRALRKAQGETPQQAGDGQQQAIDAPPPPPEPLSSSTKARALPTTCGRPASDQVQSQRYLAPIVTQSVRFRNMLEIKRKHCYAILEVPQHSESQKGDDYVIRKVPVQIATRLTWAFQDVPPEGGCFWRKQPSSPGRA

SEQ ID NO: 164853 - protein, 72 aa, Glycine max
  Coding DNA Sequence Number=SeqID_73168
MGGGASAACGWWCLVWAWPIVVVGVGLADGGGSDVGFRPLGARPDGGGFTEEKRGTEWGLGVALGCPGAFAV

SEQ ID NO: 164854 - protein, 156 aa, Glycine max
  Coding DNA Sequence Number=SeqID_73169
RIPLVRTSSELTVRRPGKRPRRARSQSVPRPARDDPLSPRKQLEQSTDSRRVRDWDPRAQPSEPILFPRGCSPWRPDAVMSTTGRGRHSVLRIFKGRRGRTGHHATCEKITLSGAPADVSGLPNVAVSRTSRFRNLTRFPFGVRAQSAIRRASPVP

SEQ ID NO: 164855 - protein, 70 aa, Glycine max
  Coding DNA Sequence Number=SeqID_73170
MQCGILSMKNLVGRLGGDQSGSQCLARMLQPCGIDTCLKEHSNRVTLKAYIPKSPLGPLPPDSGPTQKTF

SEQ ID NO: 164856 - protein, 205 aa, Glycine max
  Coding DNA Sequence Number=SeqID_73171
  Homolog annotation: Hit_ID=A5AK31; Match level="QueryCoverage=45%, HitCoverage=8%, E-value=3e-08, Identity=35%"; Hit description =Putative uncharacterized protein
  Pfam annotation: Domain name=Retrotrans_gag; Domain location=109-182; Score=-2.0; E_value=0.084; Accession=PF03732.8; Description =Retrotransposon gag protein
CMTRGNPSDLQPFDPEIDRTFHRLVRHHFIPFDHPEHSITGEFVHSVIGDFEHPDLEHYNFEHSDSEHSDFAHSENMAQPPSRERTLREMAAPDFTYESLCIQYPDEDGVAKDWLYYLAPRSITSWDDLKRVFLEKNFPASRTTAIRKDISGLSNMEKSMIDAASGGALGDMTLAEARNLIEKMASNSQQFSARNDAIVIRGVHE

SEQ ID NO: 164857 - protein, 148 aa, Glycine max
  Coding DNA Sequence Number=SeqID_73172
  Homolog annotation: Hit_ID=Q6UUU1; Match level="QueryCoverage=58%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMAAFVSSTPDTQFR

SEQ ID NO: 164858 - protein, 69 aa, Glycine max
  Coding DNA Sequence Number=SeqID_73173
MVDYKEDCVKRPFAGCWSWHMSLEVGKARRNLSSKNPPNAKGFSGMDLSLLHKFACMYMTLWHPEHSLI

SEQ ID NO: 164859 - protein, 495 aa, Glycine max
  Coding DNA Sequence Number=SeqID_73174
  Gene Ontology: Cellular component=endoplasmic reticulum
  Homolog annotation: Hit_ID=A7QKI5; Match level="QueryCoverage=94%, HitCoverage=66%, E-value=0.0, Identity=72%"; Hit description =Chromosome chr2 scaffold_112, whole genome shotgun sequence
MALCSAITLMIIFILSSFHVVGIQIISKSKLEKCEKNSNSDDNLNCTTKIVLNMAVPSGSSGGEASIVAELVEVEENSSRKMQTLRITPVITVNKTSAYALYQLTYIRDVPYKPEEYYVKTRKCEPDAGANVVKICERQAILRDEEGHIIEYTQPICCPCGPQRWMPSSCGNFFDKLTKGKANTAHCVHFPGDWFHVFGIGQRTLGFSVQIQVKSGTKVSEVVVGPQNRTVISDDKFFRVNLIGDFVGYTNIPSFEDFYLVVPRQGSPGQPQDLGRNISMWMLLERVRFTLDGIECNKIGVNYEAFNQQPNFCPSPFWTCLHNQLWNFRESAGSYSFSIGITEVLNTNLVLELSANDVEYVYQRSPGKIISVSVPTFAALTQFGVATITTKNTGEVEASYSLTFNCSKDITLMEEQFLIMKPNEVTTQSCKIYPTTDQASKYFCAAVLKDSDYNEVDRAECQFATTATVLDNDTQDDKEDFTAVLLSAVSLHKYI

SEQ ID NO: 164860 - protein, 50 aa, Glycine max
  Coding DNA Sequence Number=SeqID_73175
MDGVRKIFDCKRGREMRLTMVGTNSKQKANRELGKKSKQSELASLMGNCF

SEQ ID NO: 164861 - protein, 950 aa, Glycine max
  Coding DNA Sequence Number=SeqID_73176
  Gene Ontology: Mol. function=transferase activity; Cellular component= endoplasmic reticulum; Biological process=calcium-mediated signaling
  Homolog annotation: Hit_ID=A7QIV4; Match level="QueryCoverage=100%, HitCoverage=100%, E-value=0.0, Identity=74%"; Hit description =Chromosome chr2 scaffold_105, whole genome shotgun sequence
  Pfam annotation: Domain name=C2; Domain location=272-352; Score=90.7; E_value=4.6e-24; Accession=PF00168.21; Description=C2 domain
  Pfam annotation: Domain name=C2; Domain location=436-518; Score=87.0; E_value=5.9e-23; Accession=PF00168.21; Description=C2 domain
  Pfam annotation: Domain name=C2; Domain location=598-688; Score=79.6; E_value=1e-20; Accession=PF00168.21; Description=C2 domain
  Pfam annotation: Domain name=C2; Domain location=6-91; Score=89.9; E _value=7.8e-24; Accession=PF00168.21; Description=C2 domain
  Pfam annotation: Domain name=PRT_C; Domain location=795-950; Score =418.8; E_value=7.7e-123; Accession=PF08372.1; Description=Plant phosphoribosyltransferase C-ter
  Pfam module annotation: Pfam domain module=C2::C2::C2::C2::PRT_C; Domain location=272-352::436-518::598-688::6-91::795-950
MNNFKLGVDVVSAHNLLPKDGQGSSNAFVELYFDGQKYRTTIKERDLNPVWNESFYFNISDPSNLHYMALDVYIHCHTKATNSTSFLGKVSLTGTSFVPYSDAVVLHYPLEKRGIFSRVRGEIGLKVYITNDPTIKSSIPTPVVESMPTNYSSSTHSEVRAPASTMTNSLPNEKVESRHTFHHLPNTNHHQHQQHSSGFADTHYVTKYEADAMKSEPQPMKLVRTATSVQPVDFALKETSPYLGGGRVVGGRIVHKDKTASTYDLVERMYFLYVRVVKARELPAMDVTGSLDPFVEVRIGNYKGITRHFDKNQSPEWNQVFAFSKDRMQASVLDVVIKDKDLIKDDFVGIVRFDINEVPLRVPPDSPLAPEWYRLEDKKGEKNKGELMLAVWIGTQADEAFSDAWHSDAATPVDSTHAISAVMRSKVYHAPRLWYVRVNVVEAQDLVPTEKNRFPDVYAKVQIGNQVLKTKTVPARTLSALWNEDLLFVAAEPFEDHLIISVEDRVSPGKDEIIGRIIIPLNSVERRADDRIIHSRWFNLEKPVAIDVDQLKKEKFSSRIQLRLCLDGGYHVLDESTHYSSDLRPTAKQLWKPPIGVLELGVLNAVGLHPMKTRDGRGTSDTYCVAKYGHKWVRTRTIADNLCPKYNEQYTWEVFDHATVLTVGVFDNSQLGEKANGSSKDLKIGKVRIRISTLETGRIYTHSYPLLVLHPTGVKKMGELHLAIRFSCTSFANMLYLYSRPLLPKMHYVRPFSVTQLDMLLGKWFGDICMWRNPITTVLVHVLFLMLVCFPELILPTIFLYMFLIGVWNFRYRPRYPPHMNTRISQAEAVHPDELDEEFDTFPTSRSPDLVRMRYDRLRSVAGRIQTVVGDLASQGERIQALLSWRDPRATSIFITLSLLSALVLYVTPFQAVAGLAGFYIMRHPRFRHRLPCTPVNFFRRLPSRTDTML

SEQ ID NO: 164862 - protein, 137 aa, Glycine max
  Coding DNA Sequence Number=SeqID_73177
MNPRVGEEHVKQSSHHGAAPAVPGGLSENVPLGVTEICGDQVSTSLQTRDSNSTQETVAGGNYEIGTSSNSEKLKESDTAVKLGSAKDSEIEFSKLEKTVILEEEEEEDPCLICLIGDVATASLYIQLLWLSALTKL

SEQ ID NO: 164863 - protein, 534 aa, Glycine max
  Coding DNA Sequence Number=SeqID_73178
  Gene Ontology: Mol. function=transferase activity, transferring glycosyl groups; Cellular component=membrane
  Homolog annotation: Hit_ID=Q2PF02; Match level="QueryCoverage=94%, HitCoverage=99%, E-value=0.0, Identity=69%"; Hit description =Putative uncharacterized protein
  Pfam annotation: Domain name=DUF604; Domain location=254-508; Score =632.8; E_value=3e-187; Accession=PF04646.3; Description=Protein of unknown function, DUF604
  Pfam annotation: Domain name=Fringe; Domain location=120-368; Score= -94.3; E_value=0.035; Accession=PF02434.7; Description=Fringe-like
  Pfam module annotation: Pfam domain module=DUF604::Fringe; Domain location=254-508::120-368
CQPSLVQKSVQAGTFACEFYISRRGGMKDSDKLTWDQGRCLSPAQARSSASQKLMVSLMFLVSLTYMAYTLKLVSTSTSSSTCSHAPFIINHLFPSSNVTEWPSSSQTSRTGKGKRPGRQKTELRHLVFGIAASSKLWEHRKNYIKTWYKKDKMRGVVWLDDRVKTNPKEGLPPTKVSTDTSNFVYTNKLGHRSAIRISRIVTETLRMGHKDVRWFVMGDDDTVFVTDNLLRILNKYDHNYMYYIGSLSESHLQNIFFSYGMAYGGGGFAISYPLAKALSKMQDRCIQRYPALYGSDDRMQACMAELGVPLTKEIGFHQYDVYGNLFGLLAAHPVTPLVSLHHLDVVEPIFPNATRVEAIKRLTIPMKLDSASLIQQSICHDRNRRWTISVSWGFAVQIFRGIFTQREMEMPSRTFLNWYRRADYTAYAFNTRPFSRNPCQKPFVFYFSKAKLNSTLQQTVTEYERDPIPPPECRWNMADPSALDKIEVHKKQDPHLWDRAPRRNCCRVMKSNKTGILKIEVAVCRDGEFSEPA

SEQ ID NO: 164864 - protein, 534 aa, Glycine max
  Coding DNA Sequence Number=SeqID_73179
  Gene Ontology: Mol. function=transferase activity, transferring nitrogenous groups; Cellular component=cytoplasm; Biological process= ethylene biosynthetic process
  Homolog annotation: Hit_ID=P31531; Match level="QueryCoverage=89%, HitCoverage=99%, E-value=0.0, Identity=77%"; Hit description=1 -aminocyclopropane-1-carboxylate synthase
  Pfam annotation: Domain name=Aminotran_1_2; Domain location=102-485; Score=496.8; E_value=2.7e-146; Accession=PF00155.12; Description =Aminotransferase class I and II
MKRTTYEEVSSQCPPSRKLHIIFGPAGFSPLKINANLREHAINTSHGVVVHSQIHVLMSVNEPQLLSKIATGDGHGENSPYFDGWKAYEDDPFHPIKNPNGVIQMGLAENQLASDLVQNWLTNKPRASICTPEGVRDFKAIANFQDYHGLPKFRKAVAKFMARTRGNRVTFDPDRIVMSGGATGAHEVTAFCLADPGEAFLVPTPYYAGFDRDLRWRTGVELVPVKCESSNDFKLTRKALQEAYEKGKENNIRIKGLLITNPSNPLGTIMDRETLRTVVSFINEKHIHLVSDEIYAGTVFCHPGFTSIAEVIEEDTDIECDRDLIHIVYSLSKDMGFPGFRVGIIYSYNDAVVNCARKMSSFGLVSTQTQYLLASMLSDDEFVERFLEESAKRLAKRYGVFCRGLAQVGIKCLASNAGLFLWMDLRRLLKKPTFEAEMELWKVIIEQVKINISPGSSFHCSEPGWFRVCYANMDDRTVEVSLARMRTFVNQNTEAKKSCSQRNLRLSFSFRKMDEYLVSPHSPFPQSPLVKAST

SEQ ID NO: 164865 - protein, 313 aa, Glycine max
  Coding DNA Sequence Number=SeqID_73180
  Gene Ontology: Mol. function=oxidoreductase activity; Cellular component=integral to membrane; Biological process=electron transport
  Homolog annotation: Hit_ID=A7QNH0; Match level="QueryCoverage=98%, HitCoverage=34%, E-value=1e-116, Identity=70%"; Hit description =Chromosome chr2 scaffold_132, whole genome shotgun sequence
  Pfam annotation: Domain name=NADPH_Ox; Domain location=145-244; Score= 214.4; E_value=2.7e-61; Accession=PF08414.1; Description=Respiratory burst NADPH oxidase
MNGAPKHERRWASDTVPEMAFVSAGTSPGTEYNSVTDEYVEVTLDVQDDHTIVLRGVEPVTVVNVDDGVATSGNETPASSAWSPSIRRSSPNRWRQFSQELKAEAVAKARQFSQELKAELRWFSWSQGGSEAALVARDLRKQRAQLERNRSDTKKALRGLKFISSKSNGVDAWNEVQSNFYSLAKDGYLYRTDFAQCIGMKDSKEFALELFDALSRRRRLKFEKISRDELNEFWSQITDQSFDSRLQIFFDMVDKNEDGRIIEEEVKEIIMLSASANKLSRLKEQAEEYAALIMEELDPERLGYIEVGILYKR

SEQ ID NO: 164866 - protein, 214 aa, Glycine max
  Coding DNA Sequence Number=SeqID_73181
  Gene Ontology: Mol. function=sequence-specific DNA binding; Cellular component=nucleus; Biological process=regulation of transcription, DNA-dependent
  Homolog annotation: Hit_ID=A7QNH9; Match level="QueryCoverage=42%, HitCoverage=45%, E-value=4e-26, Identity=64%"; Hit description =Chromosome chr2 scaffold_132, whole genome shotgun sequence
  Pfam annotation: Domain name=WRKY; Domain location=122-184; Score =119.0; E_value=1.4e-32; Accession=PF03106.6; Description=WRKY DNA -binding domain
MDWDLQAIVGCTKAPAATVMDNSHLMFFQHLCPEEQDDLLFNFQEFSETTTVVDELEELYKPFYPPHVHVDNNNPLPIVANSLPIPDEEVKELKPSHKAASRCKKSKKQQKNKRVVTAADGVSDPWAWRKYGQKPIKGSAYPRSYYRCSSSKGCLARKHVERSQLDPGVLIVTYTAEHSDPHPTCKNSQQRNNSSTTTIAPATPRTHDGGGYRR

SEQ ID NO: 164867 - protein, 484 aa, Glycine max
  Coding DNA Sequence Number=SeqID_73182
  Gene Ontology: Mol. function=hydrolase activity, hydrolyzing O -glycosyl compounds; Cellular component=extracellular region; Biological process=polysaccharide catabolic process
  Homolog annotation: Hit_ID=P22503; Match level="QueryCoverage=95%, HitCoverage=96%, E-value=0.0, Identity=81%"; Hit description =Endoglucanase precursor
  Pfam annotation: Domain name=Glyco_hydro_9; Domain location=24-462; Score=834.9; E_value=4.3e-248; Accession=PF00759.10; Description =Glycosyl hydrolase family 9
MASHINGLAMMDGKLMSSSANNYDYGDALGKAILFFEGQRSGNLPATQRVKWRGDSALSDGKLQNVDLIGGYYDAGDNVKFGWPMAFTTSLLSWAAVEYESEISSVNQLGYLHSAIHWGADFILRAHTSPTTLYTQVGDGNADHNCWERPEDMDTARAVYKIDANSPGTEAAAESAAALAAASIVFKKIDANYSSTLLSKSKSLFDFADKYRGSYSGSCPFYCSYSGYQASGESKYLSYSIGNQGWSQAVSEFSWDNKYVGAQTLLTEEFYGGKKDLAKFKSDVESFICSVMPASSSLQIKTTPGGLLFTRDSSNLQYATSSTMVLFIFSKILNRNHIDRIHCGSALFTPSQIRAFAKTQVDYILGSNPMKMSYMVGFGSKYPKQLHHRGSSIPSINVHPTKVGCNDGLSVYYNSANPNPNTHVGAIVGGPDSNDRFSDARSDYSHSEPTTYMNAAFVASVSALLGKTTDRNQIQDSAVSPYRC

SEQ ID NO: 164868 - protein, 457 aa, Glycine max
  Coding DNA Sequence Number=SeqID_73183
  Gene Ontology: Mol. function=flavin-containing monooxygenase activity; Cellular component=intrinsic to endoplasmic reticulum membrane; Biological process=electron transport
  Homolog annotation: Hit_ID=A7QVE9; Match level="QueryCoverage=93%, HitCoverage=94%, E-value=1e-148, Identity=59%"; Hit description =Chromosome chr2 scaffold_187, whole genome shotgun sequence
  Pfam annotation: Domain name=AlaDh_PNT_C; Domain location=1-192; Score=-56.8; E_value=0.037; Accession=PF01262.12; Description =Alanine dehydrogenasePNT, C-terminal domain
  Pfam annotation: Domain name=DAO; Domain location=22-266; Score= -30.7; E_value=0.0011; Accession=PF01266.15; Description=FAD dependent oxidoreductase
  Pfam annotation: Domain name=FMO-like; Domain location=20-457; Score=- 227.9; E_value=1.6e-15; Accession=PF00743.10; Description=Flavin -binding monooxygenase-like
  Pfam annotation: Domain name=Pyr_redox_2; Domain location=22-312; Score=-15.7; E_value=0.00037; Accession=PF07992.5; Description =Pyridine nucleotide-disulphide oxidore
  Pfam module annotation: Pfam domain module=AlaDh_PNT_C::DAO::FMO -like::Pyr_redox_2; Domain location=1-192::22-266::20-457::22-312
MACEVPIKSMMSSAVTLLTPRHVAVIGAGAAGLVAARELRREGHRVVVFEKGEEVGGMWVYSPEVDSDPLGLEAKRRLVHSSLYDSLRTNLSRESMSFRDYPFRRREGKGRDSRRFPGHREVLLYLQDFAAEFEIGELVRFGTEVLFAGLDQCGKWRLTSTSPHTHPVDEIYDALIICNGHYVQPRLPHIPGINAWPGKQMHSHNYRTPEPFQDQVVVLIGSSASAVDISRDIATVAKEVHIAARSVEEDKLGKVPGHENMWLHSMIDSVHEDGTVVFQDGNAVGADFIIHCTGYKYDFPFLETNGEVTVDDNRVGPLYKHVFPPALAPWLSFVGLPWKVAPFSLFELQSKWIAGILSNRIALPSKEEMAKDVDAFYSSLEASGTPKRYTHNMGILQWDYNNWIADQCGVPSIEEWRRQMYIATSKNRVLRPESYRDEWDDDDLVLQAQQDFANYLT

SEQ ID NO: 164869 - protein, 218 aa, Glycine max
  Coding DNA Sequence Number=SeqID_73184
  Homolog annotation: Hit_ID=A5BYF8; Match level="QueryCoverage=73%, HitCoverage=80%, E-value=2e-13, Identity=32%"; Hit description =Putative uncharacterized protein
  Pfam annotation: Domain name=Hin1; Domain location=57-202; Score=7.9; E_value=0.00034; Accession=PF07320.4; Description=Harpin-induced protein 1 (Hin1)
MAKSLSSPSPNKYNMTTEEVITMFPSRKEEKQSSSKCLVYALVVLVAILFIWLVFASIVLRVVDPQIQLKSARLMHNTKNHSFSSTSSLNVTMIARVSLTNPNLFGRFYYGNSRVSVLYGASIVGAWELEGARLEGRETKEIDFMVHMRFSTKLLVIMRNLTNDTAHSDSAGMLKLRSYAKLSGTVHVLNMVNKKKTLGMACIMNLNLTSYSTQHFQC

SEQ ID NO: 164870 - protein, 194 aa, Glycine max
  Coding DNA Sequence Number=SeqID_73185
  Gene Ontology: Mol. function=carbohydrate binding; Biological process= carbohydrate metabolic process
  Homolog annotation: Hit_ID=A9NT43; Match level="QueryCoverage=85%, HitCoverage=81%, E-value=9e-47, Identity=48%"; Hit description =Putative uncharacterized protein
  Pfam annotation: Domain name=Aldose_epim; Domain location=1-194; Score=-48.5; E_value=0.0018; Accession=PF01263.11; Description =Aldose 1-epimerase
MKTTSGGGGGVGAAESDNRTATVGIEFTKDKNGISLLVLRNHRGASATVSLHGGQVLSWKTELGEELLFISNKPSIRDNLLLTLDSEVRVEGLETLDYLDNLYQRERFTEQGDSLTFESEVDRVYFDSSNIVIVLDHEKKRTFVIRKEGLPDVVVWNPWERKSKSILDLGDEEYKQMLCVDGAAVEKPNHLVAR

SEQ ID NO: 164871 - protein, 420 aa, Glycine max
  Coding DNA Sequence Number=SeqID_73186
  Gene Ontology: Mol. function=structural constituent of ribosome; Cellular component=ribonucleoprotein complex; Biological process =translation
  Homolog annotation: Hit_ID=A7PWE1; Match level="QueryCoverage=73%, HitCoverage=76%, E-value=2e-96, Identity=88%"; Hit description =Chromosome chr8 scaffold_34, whole genome shotgun sequence
  Pfam annotation: Domain name=Ribosomal_S5; Domain location=160-226; Score=140.1; E_value=6.3e-39; Accession=PF00333.11; Description =Ribosomal protein S5, N-terminal domain
  Pfam annotation: Domain name=Ribosomal_S5_C; Domain location=243-326; Score=89.3; E_value=1.2e-23; Accession=PF03719.6; Description =Ribosomal protein S5, C-terminal domain
  Pfam module annotation: Pfam domain module=Ribosomal_S5::Ribosomal_S5_ C; Domain location=160-226::243-326
MGVIMWCDDDEDNDNNCGDNVISGDGSVCDDYNGVANASAEGGGDNNNDSDDNSNNDGGDCYSGGNRKIIKHILMAERGGGDRGGDRGGFGRGFGGRGRGGDRGRGRRRGPRREEEEKWVPVTKLGRLVKEGRIRSLEQIYLHSLPIKEHQIIDTLVGPTLKDEVMKITPVQKQTRAGQRTRFKAFVVVGDNNGHVGLGVKCSKEVATAIRGAIILAKLSVIPVRRGYWGNKIGKPHTVPCKVTGKCGSVTVRMVPAPRGSGIVAARVPKKVLQFAGIDDVFTSSRGSTKTLGNFVKTTEFMYSSTVLPFACVSNLEDSLLFKRGTISQCKLVYGVFAAIEGIQNASWITCVICYSCVYVHDPLLERPATFDCLMKTYGFLTPEFWKETRFSKSPFQEYTDLLAKPTGKTLILEEERVDA

SEQ ID NO: 164872 - protein, 289 aa, Glycine max
  Coding DNA Sequence Number=SeqID_73187
  Gene Ontology: Mol. function=transcription factor activity; Cellular component=cytoplasm; Biological process=regulation of transcription, DNA-dependent
  Homolog annotation: Hit_ID=A7QNB6; Match level="QueryCoverage=79%, HitCoverage=81%, E-value=4e-41, Identity=44%"; Hit description =Chromosome chr2 scaffold_132, whole genome shotgun sequence
  Pfam annotation: Domain name=AP2; Domain location=111-162; Score =84.6; E_value=3.2e-22; Accession=PF00847.11; Description=AP2 domain
MTAPPTKYTHHTKLLIPPEEDPPKHHYPRLVRITVTDTDATDSSSDEEEEQTYHCNSSTRHRHRKFVNEISIESCSSENDGVVSRKRIRRRSTTTPKATRASDTRRVSDGKKFRGVRQRPWGKWAAEIRDPARRVRLWLGTYDTAEEAALVYDNAAIKLRGPHALTNFITPPSGEETHCNSKNIFSPTSVLHCCSLSEEAESVTAKDDDYSSVSENKVKAESAFPPEIDFEFRACSTVPESLLFCDDDWSSEFLNSYEDFGFKSWHTDRNRDFFQDIDDLFVSDPLLAL

SEQ ID NO: 164873 - protein, 104 aa, Glycine max
  Coding DNA Sequence Number=SeqID_73188
MASNRSSSWARGEGEGSRRGMQRKNEKARGRRLAEGRKAEARRRLSDSGRGEENYFNILNFFNEGKGVRAHEKVNKNERKHKNRRMLVEEPSPFSIVIVNCMEF

SEQ ID NO: 164874 - protein, 342 aa, Glycine max
  Coding DNA Sequence Number=SeqID_73189
  Gene Ontology: Mol. function=transcription factor activity; Cellular component=nucleus; Biological process=regulation of transcription, DNA-dependent
  Homolog annotation: Hit_ID=A7QN90; Match level="QueryCoverage=93%, HitCoverage=98%, E-value=1e-57, Identity=46%"; Hit description =Chromosome chr2 scaffold_132, whole genome shotgun sequence
  Pfam annotation: Domain name=AP2; Domain location=156-207; Score =77.0; E_value=6.2e-20; Accession=PF00847.11; Description=AP2 domain
REEEPVIFGEKYTGKFLPKEIMEGMRDTKSQLEIQDQEGTNIGSSLSKLILASGSGTNTLDSIFSNCPQTTNGSTSSNSVLDDLEPFRSSGCESLGSSVYLRQRDILQKFYQESRGNGNNNGSYNIPRSLANTSINSVCRSSSLSCYSLTKPCKKKLYRGVRQRHWGKWVAEIRLPQNRMRVWLGTYDTAEAAAYAYDRAAYKLRGEYARLNFPNLKDPTKLGFGDSARLNALKSSVDAKIQAICQKVKKERAKKNATKKKLHDSSGSTDPNGGQKINSSSCSSSSLSQPLSPPSIFYDNWANDLFSPASVSTECQSMETEELFEGCSLARLPSFDPELIWE

SEQ ID NO: 164875 - protein, 29 aa, Glycine max
  Coding DNA Sequence Number=SeqID_73190
MADALYMVYNLEARERKSWLMKHAPEPQK

SEQ ID NO: 164876 - protein, 863 aa, Glycine max
  Coding DNA Sequence Number=SeqID_73191
  Gene Ontology: Mol. function=hydrolase activity, hydrolyzing O -glycosyl compounds; Cellular component=vacuole; Biological process =carbohydrate metabolic process
  Homolog annotation: Hit_ID=Q43857; Match level="QueryCoverage=68%, HitCoverage=90%, E-value=0.0, Identity=74%"; Hit description=Acid beta-fructofuranosidase precursor
  Pfam annotation: Domain name=Glyco_hydro_32C; Domain location=497 -611; Score=174.0; E_value=3.9e-49; Accession=PF08244.3; Description =Glycosyl hydrolases family 32 C termi
  Pfam annotation: Domain name=Glyco_hydro_32N; Domain location=141 -456; Score=655.1; E_value=5.8e-194; Accession=PF00251.11; Description=Glycosyl hydrolases family 32 N termi
  Pfam annotation: Domain name=Pentapeptide; Domain location=700-739; Score=44.9; E_value=2.9e-10; Accession=PF00805.13; Description =Pentapeptide repeats (8 copies)
  Pfam annotation: Domain name=Pentapeptide; Domain location=757-796; Score=32.0; E_value=2.2e-06; Accession=PF00805.13; Description =Pentapeptide repeats (8 copies)
  Pfam module annotation: Pfam domain module=Glyco_hydro_32C::Glyco _hydro_32N::Pentapeptide::Pentapeptide; Domain location=497-611::141 -456::700-739::757-796
MGSHNTTTSSSSDSELPCSNYIPLPDGTHFPAEEAPRELLVIFCGLLVLVSLVAFNGYRAHPNDHHHVSSSLPTTLLTVTPNELELSPDTVPCSTSETTVSRGLSAGVSEKSSWQLNSNNGSGESYPWNNSVLSWQRTAYHFQPEKNWMNGPMFYKEWYHFFYQYNPKGAVWGDIVWGHAVSRDMIHWLHLPLAMMADQWYDKNGVWTGSATILPDGQIIMLYTGSTNESVQVQNLAYPADPSDPLLVDWIKYPANPVLFPPPGIDAKDFRDPTTAWLTSEGKWRISIGSKLNKTGIALVYDTIDFKTFEHVEGVLHAVPGTGMWECVDFFPVSSKGENGLNTSINGENVKHVVKVSLDDDRHDYYALGTYDEKNVKFTPDDFKNDVGIGLRYDYGIFYASKTFYDQSKGRRVLWGWIGESDSEYADVAKGWASVQGIPRTVTLDKKTGSNLLQWPVAEVESLRLRSEEFQNLKVTPGSVVPLEIGTAAQLDIVAEFEIDKEALEKTGQSNKEYKCSTSGGATERGAIGPFGLLVLADDDLSEYTPTYFYVVRGSDGQLKTSFCSDQSRSSLATDVSKKILGSLVPVLKDEKLSVRILVDHSIVESFAQGGRTPFPSLCAKLTQTEIIVKSVANAESTKWGKVVSATLAAAVIAFSSDMSALADLNKFEAEMRGEFGIGSAAQFGSADLRLVLKAVHVNENFRRANFTAADMRESDFSGSTFNGAYLEKAVAYKANFSGADLSDTLMDRMVSTSSLKVLNEANLTNAILLRTVLTRSDLGGAIIEGADFSDAVLDLPQKQALCKYASGTNPVTGVSTRVSLGCGNKRRNAYGSPSSPLLSAPPQKLLDRDGFCDDATGLCDAK

SEQ ID NO: 164877 - protein, 214 aa, Glycine max
  Coding DNA Sequence Number=SeqID_73192
  Homolog annotation: Hit_ID=A7PYB0; Match level="QueryCoverage=99%, HitCoverage=99%, E-value=9e-63, Identity=55%"; Hit description =Chromosome chr15 scaffold_37, whole genome shotgun sequence
  Pfam annotation: Domain name=DUF1442; Domain location=1-214; Score =378.4; E_value=1.2e-110; Accession=PF07279.2; Description=Protein of unknown function (DUF1442)
MKLAWSPERASKAYIHTVQSCQVFRESGAAEFISAMAAGWNSQLIVETWSQGGVIATSVGLAVARSHTCGRHVCVVSDERGRSEYVERMGEAGVTAEIVVGEPEDVMEGLVGVDFLVVDSRRKDFTRVLRLAKLSNKGAVLLCKNANSNSKGFIWRSLVAKGSSRRLVRSAFLPVGKGLDMAHVSASGGNNSSSGHRWIKHVDQHSGDVHFIRR

SEQ ID NO: 164878 - protein, 122 aa, Glycine max
  Coding DNA Sequence Number=SeqID_73193
  Gene Ontology: Mol. function=triacylglycerol lipase activity; Biological process=lipid metabolic process
  Homolog annotation: Hit_ID=Q06H29; Match level="QueryCoverage=75%, HitCoverage=81%, E-value=2e-33, Identity=76%"; Hit description =Triacylglycerol lipase
MTPHLLVTRQTKSPRDNAYHRKSVAASLVQCVYVLEKDRQEQREGSDALALPWWAFFHIQLLRTLVVDVDASIFAAIHEFKPPSSMCNDTLRRGPRYVIAFRGTITKAGSVSCDIELDINFV

SEQ ID NO: 164879 - protein, 63 aa, Glycine max
  Coding DNA Sequence Number=SeqID_73194
MMSEWNKTRMKSGVKIGIGDGGEGGGSGGTHGGAASVEFGLKIWCWQIVELGSADTKGFRLES

SEQ ID NO: 164880 - protein, 956 aa, Glycine max
  Coding DNA Sequence Number=SeqID_73195
  Gene Ontology: Mol. function=protein transporter activity; Cellular component=clathrin adaptor complex; Biological process=intracellular protein transport
  Homolog annotation: Hit_ID=A7QNL1; Match level="QueryCoverage=93%, HitCoverage=100%, E-value=0.0, Identity=83%"; Hit description =Chromosome chr2 scaffold_132, whole genome shotgun sequence
  Pfam annotation: Domain name=Adaptin_N; Domain location=71-593; Score= 730.7; E_value=1e-216; Accession=PF01602.11; Description=Adaptin N terminal region
  Pfam annotation: Domain name=Alpha_adaptinC2; Domain location=728 -835; Score=0.1; E_value=0.0041; Accession=PF02883.11; Description =Adaptin C-terminal domain
  Pfam annotation: Domain name=B2-adapt-app_C; Domain location=844-956; Score=127.6; E_value=3.7e-35; Accession=PF09066.1; Description=Beta2 -adaptin appendage, C-terminal s
  Pfam annotation: Domain name=HEAT; Domain location=176-212; Score =29.3; E_value=1.4e-05; Accession=PF02985.13; Description=HEAT repeat
  Pfam annotation: Domain name=HEAT; Domain location=214-251; Score =16.7; E_value=0.086; Accession=PF02985.13; Description=HEAT repeat
  Pfam module annotation: Pfam domain module=Adaptin_N::Alpha _adaptinC2::B2-adapt-app_C::HEAT::HEAT; Domain location=71-593::728 -835::844-956::176-212::214-251
MVFFVNFLVKNSGKRKRGCYDAVLCIILPLPRSAVLFCSESEIGNWKQKNSLQRRVKSMSRNDSKYFSTTKKGEIPELKEELNSQYKDKRKDAVKKVIAAMTVGKDVSSLFTDVVNCMQTENLELKKLVYLYLINYAKSQPDLAILAVNTFVKDSQDPNPLIRALAVRTMGCIRVDKITEYLCDPLQRCLKDDDPYVRKTAAICVAKLYDINAELVEDRGFLESLKDLISDNNPMVVANAVAALAEVQENSSRPIFEISSHTLSKLLTALNECTEWGQVFILDALSRYKAADAREAENIVERVTPRLQHANCAVVLSAVKMILLQMELITSTDVVRNLCKKMAPPLVTLLSAEPEIQYVALRNINLIVQRRPTILAHEIKVFFCKYNDPIYVKMEKLEIMIKLASDRNIDQVLLEFKEYATEVDVDFVRKAVRAIGRCAIKLERAAERCISVLLELIKIKVNYVVQEAIIVIKDIFRRYPNTYESIIATLCESLDTLDEPEAKASMIWIIGEYAERIDNADELLESFLENFPEEPAQVQLQLLTATVKLFLKKPTEGPQQMIQVVLNNATVETDNPDLRDRAYIYWRLLSTDPEAAKDVVLAEKPVITDDSNQLEPSLLDELLANIATLSSVYHKPPDAFVTRVHSAQRTEDEDYAEGSETGFSESPANPANGPASPPTARQSAPTSAIGAPATPPPVAPVPDLLGDLMGMDNSIVPIDQPATPTGPPLPILLPAATGLGLQISAQLTRQDGQIFYSLLFENNSQVPLDGFMIQFNKNTFGLAAAGPLQVSQLQPRMSARTLLPMVMFQNMSQGPPSSALQVAVKNNQQPVWYFSDKISLLVFFTEDGRMERSSFLETWRSLPDSNEVSKDFPAIVIGNADATLERLAASNMFFIAKRKNANQDVFYFSAKLPRGIPFLIELTTLIGNPGVKCAIKTPSPEMSALFFEAIETLLMG

SEQ ID NO: 164881 - protein, 102 aa, Glycine max
  Coding DNA Sequence Number=SeqID_73196
  Homolog annotation: Hit_ID=A7Q4W0; Match level="QueryCoverage=100%, HitCoverage=11%, E-value=2e-33, Identity=63%"; Hit description=Non -specific lipid-transfer protein
  Pfam annotation: Domain name=PPR; Domain location=17-51; Score=37.6; E_value=4.5e-08; Accession=PF01535.11; Description=PPR repeat
  Pfam annotation: Domain name=PPR; Domain location=52-86; Score=11.5; E_value=0.34; Accession=PF01535.11; Description=PPR repeat
  Pfam module annotation: Pfam domain module=PPR::PPR; Domain location =17-51::52-86
MDSAEKVFVNLNLHSVVSWNIMIAGYGNRCNSEKAAEYLQRMQCDGYEPDDVTYVNMLTACVKSGDVRTGRQIFDCMPCPSLTLWNALLSGYNQKADHREEV

SEQ ID NO: 164882 - protein, 148 aa, Glycine max
  Coding DNA Sequence Number=SeqID_73197
  Homolog annotation: Hit_ID=A2YTD3; Match level="QueryCoverage=55%, HitCoverage=85%, E-value=5e-26, Identity=68%"; Hit description =Putative uncharacterized protein
  Pfam annotation: Domain name=Complex1_LYR; Domain location=11-77; Score=53.7; E_value=6.3e-13; Accession=PF05347.6; Description =Complex 1 protein (LYR family)
MGSSKVQRLSGMQKQVLSLYRGFLRAARSKSEEERCKIESIISQEFRRNAEDVDRKNFLYIEYLLRRGNKQLDQLKNPGTTGLSSLQLHYSHPSTQTLSLQSRFLSSDTYLLPPQRHVTSLTTTVVSSSPYTTGIAPPPQKCMRPSGS

SEQ ID NO: 164883 - protein, 295 aa, Glycine max
  Coding DNA Sequence Number=SeqID_73198
  Gene Ontology: Mol. function=aspartic-type endopeptidase activity; Cellular component=extracellular region; Biological process =proteolysis
  Homolog annotation: Hit_ID=A7PSJ8; Match level="QueryCoverage=95%, HitCoverage=96%, E-value=1e-67, Identity=40%"; Hit description =Chromosome chr6 scaffold_28, whole genome shotgun sequence
  Pfam annotation: Domain name=Asp; Domain location=30-290; Score= -190.1; E_value=0.023; Accession=PF00026.14; Description=Eukaryotic aspartyl protease
MHRPGSFYQVPKKSYASNGPFTRVTSNNGDYLMKLTLGTPPVDVYGLVDTDSDLVWAQSCDYVYAYADDSATKGMLAKEIATFSSTDGKPIVESIIFGCGHNNTGVFNENDMGLIGLGGGPLSLVSQMGNLYGSKRFSQCLVPFHADPHTSGTISLGEASDVSGEGVVTTPLVSEEGTPETYLPQEFYDRLVEELKVQINLPPIHVDPDLGTQLCYKSETNLEGPILTAHFEGADVKLLPLQTFIPPKDGVFCFAMTGTTDGLYIFGNFAQSNVLIGFDLDKRIVFFKPTDFTKP

SEQ ID NO: 164884 - protein, 57 aa, Glycine max
  Coding DNA Sequence Number=SeqID_73199
MEAENVGHEVWQGTKSSKGSRPNITERTWRNIQHNRDIVNSTCRLVEVAPLNKFIVP

SEQ ID NO: 164885 - protein, 622 aa, Glycine max
  Coding DNA Sequence Number=SeqID_73200
  Gene Ontology: Mol. function=protein transporter activity; Cellular component=nuclear pore; Biological process=protein import into nucleus, docking
  Homolog annotation: Hit_ID=A5BVQ5; Match level="QueryCoverage=97%, HitCoverage=55%, E-value=0.0, Identity=83%"; Hit description =Putative uncharacterized protein
  Pfam annotation: Domain name=CRM1_C; Domain location=259-581; Score =749.3; E_value=2.6e-222; Accession=PF08767.2; Description=CRM1 C terminal
MAEKECIGSYDGLVRTEHRATKEARTSLDREETELYNWEKGFWVKCNTRDASLEGRPNGLTYENRFLVMVIRDLLNLCEITKGKDNKAVIASNIMYVVGQYPRFLRAHWKFLKTVVNKLFEFMHESHPGVQDMACDTFLKIVQKCKRKFVITQVGENEPFVSELLSGLPNTIADLEPHQIHTFYESVGNMIQAESDAQKRDEYLQKLMVLPNQRWMEIIGKAHQNADFLKDQDVIRNVLNILQTNTSVASSLGTYFLPQITLIFLDMLNVYRMYSELISKSIAEGGPFASRTSYVKLLRSVKRETLKLVETFLDKAEDQPQIGKQFVPPMMDPVLGDYARNVPDARESEVLSLFATIVNKYKAAMVEDVPQIFEAVFQCTLEMITKNFEDYPEHRLKFFSLLRAIATHCFPALICLSSQQLKLVMDSIIWAFRHTERNIAETGLNLLLEMLKKFQASEFCNQFYRTYFLTIEQEIFAVLTDTFHKPGFKFHVLVLQHLFCLAETGALTEPLWDAATNPYPYPSNAAFVREFTINLLSTSFPNMTASEVTQFVNGLLESTNDLPTFKTHIRDFLVQSKEFSAQDNKDLYAEEAAAQRERERQRMLSIPGLVAPSELQDEMVDS

SEQ ID NO: 164886 - protein, 143 aa, Glycine max
  Coding DNA Sequence Number=SeqID_73201
  Gene Ontology: Mol. function=drug transporter activity; Cellular component=membrane; Biological process=multidrug transport
  Homolog annotation: Hit_ID=A7QK87; Match level="QueryCoverage=90%, HitCoverage=26%, E-value=7e-36, Identity=62%"; Hit description =Chromosome chr2 scaffold_112, whole genome shotgun sequence
GNLGPLFSHDVGIIKGVKKTMLLMGLVEVFNFPLAVCGGIVRGTARPWLGMYANLGGFYFLALPLGVVSAFKLRLGLVGLFIGLLTGIVTCLTLLLVFIARLNWVEEAAQAQTLTGQEQLLSSSSNQVYTYLQTPGHDEKDMA

SEQ ID NO: 164887 - protein, 997 aa, Glycine max
  Coding DNA Sequence Number=SeqID_73202
  Gene Ontology: Mol. function=DNA binding; Cellular component=nucleus
  Homolog annotation: Hit_ID=Q700D6; Match level="QueryCoverage=29%, HitCoverage=44%, E-value=2e-32, Identity=33%"; Hit description =Putative uncharacterized protein
  Pfam annotation: Domain name=Myb_DNA-binding; Domain location=824 -870; Score=46.7; E_value=8.3e-11; Accession=PF00249.22; Description =Myb-like DNA-binding domain
MDPFDDILPTAPAARSKCLGSNDTGTRLGAKFIPKAKSKQFPRKGIPASEHSTSSKDGILGNECQNAVASALSMPAEEPKGSVHHTQVEIPNSEDSTNRKQVSVKGDSAALVDDSTITATEVDADQKSMNFLKPICEVTEGDPVYFEGASVTSFVPETNLNNGTTQPVHPANAVENEFNVAAPSATCSAIDRMKEQPKIGEGSFLDSNKLIDNSIQVGTDLGFQGSSDDKIAIIQSNFDSKSNFGKKQEGVSAEFELDPFSNILPYPGAGNVHKFKPKIKPRPRVSNVPAIASDSSNVMMEKSVELPTSCTNDFQFFQSCGDGSGGLNQSASLPLPTSEILRTTELPDKFDDTSSSILSEDNKSLAAAIPSQLDSLNAMLSEDAVHNGTTDWPSSFGKSSREAADIFSGLESLDDFLTQAATGTERHLYCAAALNLTVMVDWLPANSLHSFNGKGGEENFVTPASSSINSFGECDTTQVQRCPEYHTPQDSLTFNEAAVFNEDDIHTSNRRLETEEIVDLNPACPGDDVIDYQSMKSGEDPTLGIPVHEELTNAADSPTLVDFLHADVTREKEDSNKRKKDGSTSCSLRKNRRCIAGEEDKGAKTSRQLRKQAARKPVNSSLNEDVEDNNDLDPSYNSNGDELQENDDEYEVDYPSRKRRVSNSSQKKPVAKSGKTSQKPKKANDDLEKTEEPPKKFSHSTRRRKRCVDKALLEIPEDELDRLNIPIKDIILLEEHRERLAKKEAMTSNTSSTNQSGGDSLHEAGSYNEGAYDDGAYDDGAYNDEEFLGSEDGRDPYDNQANEGITSTSVLLNYQSFREKKTPRGKWSKQETELFYEAVREMGTDFSVIQKTFFPDKTRHQIKLKYKKEERQQPLQLTDAVNNSAKDHPHSKLFIELLKLASTKAEEYPGRDASDLVMAEEVVDLTAGTHHRLYGLPCMTMKHGHSSPLPCPVSDTRLCQCPTPTRHPYYVLYFGHYRCLRVRVRVVSGVRVGVGAS

SEQ ID NO: 164888 - protein, 1546 aa, Glycine max
  Coding DNA Sequence Number=SeqID_73203
  Gene Ontology: Mol. function=metalloendopeptidase activity; Biological process=proteolysis
  Homolog annotation: Hit_ID=Q40983; Match level="QueryCoverage=78%, HitCoverage=95%, E-value=0.0, Identity=77%"; Hit description =Metalloendopeptidase
  Pfam annotation: Domain name=Acetyltransf_1; Domain location=108-206; Score=57.2; E_value=5.7e-14; Accession=PF00583.15; Description =Acetyltransferase (GNAT) family
  Pfam annotation: Domain name=Peptidase_M16; Domain location=470-637; Score=21.7; E_value=8.7e-06; Accession=PF00675.11; Description =Insulinase (Peptidase family M16)
  Pfam annotation: Domain name=Peptidase_M16_C; Domain location=1181 -1411; Score=89.4; E_value=1.2e-23; Accession=PF05193.12; Description= Peptidase M16 inactive domain
  Pfam annotation: Domain name=Peptidase_M16_C; Domain location=647 -850; Score=57.0; E_value=6.5e-14; Accession=PF05193.12; Description =Peptidase M16 inactive domain
  Pfam module annotation: Pfam domain module=Acetyltransf_1::Peptidase _M16::Peptidase_M16_C::Peptidase_M16_C; Domain location=108-206::470 -637::1181-1411::647-850
MAVVGGNDDDNDDNNNDRGGSSDDDNDGNENGKIRESGCLVWSEKDSMVKPKVSTQPKICYRPIRPSDLDILEHIHGRLFPIRYESTFFHDVVNGRDIVSWGAVDSSRPDGQSDELIGFVTARIVLAKESEIVDMLGYDSAKSDQTLVYVLTLGVVEAYRSLGVASSLIREVIKYASSIPTCRAVYLHVISYNNPAINLYKKMSFKSFCTITLNWDTSFRNFFEVELELQGCARTEAGRSQGGQSVKKVILLCQQHPTKETWQSNVLAKELVSYYAYAYGCFDFNFNFNLSLRRGNWPRLPAPSSRRILLCSFSHSIAQQQPFLPIFFSSKAVCGGGLGLLRRNKSRGGHAFVVGEPSFLLPQHSCASCCCLARKRRSNLSTFVPGAFLDKSSFRLSNNKLNRSPVQIPRATVGPDEPHAASTTWPDGLAEKQDLTVYDSELEQIEGFLSSELPSHPKLHRGQLKNGLRYLILPNKVPPTRFEAHLEVHAGSIDEEEDEQGIAHMIEHVAFLGSKKREKLLGTGARSNAYTDFHHTVFHIHAPTSTKASIKAAPKEAAVKAGTDHLRQFESAHDSDGDLLPFVLDALNEIAFHPKFLASRIEKERRAILSELQMMNTIEYRVDCQHLHSENKLSKRFPIGLEEQIKKWDADKIRKFHERWYFPANATLYIVGDIDNISKTVYHIEAVFGQTGADNEKGSVATPSAFGAMASFLVPKLSVGLGGNSIERSANATDQSKVFNKERQAVRPPVKHNWSLPGSGADLKPPQIFQHELLQNFSINMFCKSSNPPFTSVELDHSDSGREGCTVTTLTITAEPKNWQNAIRVAVQEVRRLKEFGVTQGELTRYLDALLKDSEHLAAMIDNVSSVDNLDFIMESDALGHKVMDQRQGHESLLAVAGTVTLEEVNSVGAKVLEFIAEFAKPTAPLPAAIVACVPKKVHIEGAGETEFKISSIEITDAIKAGLDEPIQPEPELEVPKELIQSTKLEELKKLRKPAFIPVNPETDATKLHDEETGISRRRLSNGIPVNYKISKTETQSGVMRLIVGGGRAAESPESRGSVIVGVRTLSEGGRVGNFSREQVELFCVNHLINCSLESTEEFISMEFRFTLRDNGMRAAFQLLHMVLEHSVWVDDAFDRARQLYLSYYRSIPKSLERSTAHKLMVAMLDGDERFIEPTPKSLENLTLQSVKDAVMNQFFGDNMEVCIVGDFTEEDIESCILDYLGTAQAARNHEREKEFNPPLFRPSPSDLQFQEDTDERACAYIAGPAPNRWGFTVDGVDLLESINNASTINDDQSKSNAQQTQGLQKSLCGHPLFFGITMGLLSEIINSSLKSDYTFLYRLFTSVRDSLGLTYDVSFELNLFDRLKLGWYVISVTSTPSKVHKAVDACKNVLRGLHSNKITERELDRYELILQLPIVFLRDGLVNTFLVKMHMAKRTLLMRHEAEIKSNAYWLGLLAHLQASSVPRKDISCIKDLTFLYEVATIEDIYRAYEQLKVDENSLYSCIGIAGAQAAQEIAAPLEEEVADDVYPGVIPVGRGLSTMTRPTT

SEQ ID NO: 164889 - protein, 620 aa, Glycine max
  Coding DNA Sequence Number=SeqID_73204
  Gene Ontology: Mol. function=DNA-directed RNA polymerase activity; Cellular component=nucleus; Biological process=transcription
  Homolog annotation: Hit_ID=A7PUY2; Match level="QueryCoverage=82%, HitCoverage=71%, E-value=1e-115, Identity=45%"; Hit description =Chromosome chr4 scaffold_32, whole genome shotgun sequence
  Pfam annotation: Domain name=Sin_N; Domain location=101-501; Score =344.5; E_value=1.9e-100; Accession=PF04801.4; Description=Sin-like protein conserved region
MDFDDLEEAPIKATSRVSKFAPKSSKLKPKPKSEPAPPKPEPQPPISKPEPQEFVAATVKKNEDDGVETVPPTHTKPELDATVKMEEAEDEPESVRDDPIDEDIPEEDTVVREIDVFFSPSVDAQTQLYVFQYPLRPSWRPYDLDEQCEEVRLKTKTSEVEIDLSIDLDSDHIDKEFATKYNITKQTLSTTWKPSHANGCAVGLLMGDKLHLHPVHAVVQLRPTLQHLNSGGSKRKNAASTGANATVKIEGSNEEKSVATSKKQNKQTGPSIIEQKSDGDECWVPLKYHSCKSDISSRYLQQMVTQESSPINFTMRAYDYVTALCPGGSSNNLPKGLSKRYLLSLPVEERLKKMLEDRPLHRFSAIKHFAPEYSENELLGFLQQHAILVWGLWTAKSSLLYPDGGVETLARDYSLLLFSKSLKVQFSDVSIRGGELVNRVRNCLKIFGVERNDLDKSTGKPNPYWKFRELPDESFKKLYPDIVEKQEELFKGLEKQLSGFSSNVGKRKIGKNAVANQGVNTEVHKSESSDQRVTSLGRVPPAKMTMSNETRHALPIALKKLFQTHKVCRLFIHLGICRHDRCNIPNLIFGKTLRSCGLLTTPIEHVTRPHMVSRILIQIL

SEQ ID NO: 164890 - protein, 625 aa, Glycine max
  Coding DNA Sequence Number=SeqID_73205
  Gene Ontology: Mol. function=binding; Cellular component=nucleus; Biological process=activation of protein kinase C
  Homolog annotation: Hit_ID=A7NWS0; Match level="QueryCoverage=90%, HitCoverage=84%, E-value=0.0, Identity=38%"; Hit description =Chromosome chr5 scaffold_2, whole genome shotgun sequence
  Pfam annotation: Domain name=PPR; Domain location=144-178; Score=7.8; E_value=0.92; Accession=PF01535.11; Description=PPR repeat
  Pfam annotation: Domain name=PPR; Domain location=206-240; Score =43.1; E_value=1e-09; Accession=PF01535.11; Description=PPR repeat
  Pfam annotation: Domain name=PPR; Domain location=307-341; Score =35.1; E_value=2.5e-07; Accession=PF01535.11; Description=PPR repeat
  Pfam annotation: Domain name=PPR; Domain location=342-376; Score=8.7; E_value=0.72; Accession=PF01535.11; Description=PPR repeat
  Pfam annotation: Domain name=PPR; Domain location=378-412; Score =15.3; E_value=0.12; Accession=PF01535.11; Description=PPR repeat
  Pfam annotation: Domain name=PPR; Domain location=444-478; Score=0.5; E_value=6.8; Accession=PF01535.11; Description=PPR repeat
  Pfam annotation: Domain name=PPR; Domain location=74-108; Score=30.6; E_value=5.8e-06; Accession=PF01535.11; Description=PPR repeat
  Pfam annotation: Domain name=PPR; Domain location=8-42; Score=12.6; E_ value=0.25; Accession=PF01535.11; Description=PPR repeat
  Pfam module annotation: Pfam domain module=PPR::PPR::PPR::PPR::PPR::PP R::PPR::PPR; Domain location=144-178::206-240::307-341::342-376::378 -412::444-478::74-108::8-42
RGVEPNPVTMVCVISACAKLKDLELGKKVCSYISELGMELSTIMVNALVDMYMKCGDICAARQIFDECANKNLVMYNTIMSNYVHHEWASDVLVILDEMLQKGPRPDKVTMLSTIAACAQLGDLSVGKSSHAYVLRNGLEGWDNISNAIIDMYMKCGKREAACKVFEHMPNKTVVTWNSLIAGLVRDGDMELAWRIFDEMLERDLVSWNTMIGALVQVSMFEEAIELFREMQNQGIPGDRVTMVGIASACGYLGALDLAKWVCTYIEKNDIHVDLQLGTALVDMFSRCGDPSSAMHVFKRMEKRDVSAWTAAIGVMAMEGNTEGAIELFNEMLEQKVKPDDVVFVALLTACSHGGSVDQGRQLFWSMEKAHGIRPHIVHYGCMVDLLGRAGLLEEAVDLIQSMPIEPNDVVWGSLLAACRKHKNVELAHYAAEKLTQLAPERVGIHVLLSNIYASAGKWTDVARVRLQMKEKGVQKVPGSSSIEVQGLIHEFTSGDESHAENTHIGLMLEEINCRLSEAGYVPDTTNVLLDVDEQEKEHLLSRHSEKLAMAYGLITTGQGLPMDFFNEPDGGLSFVWMNYGVQGLVFILTANSQLIPLLEENICECLDDLGLGSASCNPDTFLPV

SEQ ID NO: 164891 - protein, 861 aa, Glycine max
  Coding DNA Sequence Number=SeqID_73206
  Gene Ontology: Mol. function=phosphoprotein binding; Cellular component=membrane; Biological process=signal transduction
  Homolog annotation: Hit_ID=A7PB81; Match level="QueryCoverage=96%, HitCoverage=96%, E-value=0.0, Identity=56%"; Hit description =Chromosome chr16 scaffold_10, whole genome shotgun sequence
  Pfam annotation: Domain name=DUF593; Domain location=203-291; Score= -30.4; E_value=0.064; Accession=PF04576.6; Description=Protein of unknown function, DUF593
  Subcellular localization annotation: CTP_CleavageSite=61; ConfidenceScore=5.91e-01
MASKSRSSLSETPNKATPATPNKARPSTPNKTSPATPKVSRLSKGVSKPESESPSPLQNLRLSSEKSSPRALNSKPATERKSPRPTSTTPDKQIPRVAKGSELQAQLNLAQEDLKKAKEQLVQAEKEKEKAIGELKEAQRVAEEANEKLSEAIVAQKRAEESSEIEKFRAVELEQAGIEAAQKKEEEWQEELESVRNQHALDVSALLSTTQELQRIKQELAMTCDAKNQALSHADDATKIAELHVEKAEILSVELIRLKAVLDSKLETEAIANNIVLELQAEIEALKEELEKAKGYDAKLAEKENYIEQLNVDLEAARMAESYAHSLLEEWTKKVEELEVRVEEANKLERSASVSLESVMKQLEVNKDLLHEAESEISSLKEKVGLLEMTIARQTGDLEDSECCLHVAKEESLELSKKVESLESELETVKEEKALALNNEKLSASSVQTLLEEKDKLINELEILRDEEEKTKKAMESLASALHEVSAEARDSKEKLLANHVEHENYETQIEDLKLVLKATNEKYESMLNDARHEIDTLTCSVENSKSNIENSKAEWEQREHHLVNCLKLTEEENSSLGNEINRLIRLLKDTEEEANAKREEEGQLKENLKEVEAEVIHLQEELKEAKAESMKLKESLLDKENEFQNVFQENEELRLRESTSIKKVEELSKMLDEVTSRNQTEENGDLTESEKDYDMLPKVVEFSEENGHGGEDLLSKKVELSANEEGLKQRVQEESIPMDDKSEKTESPNPENVNGKVNEDASKGKDALVDAEFKMWESCKIEKKEFSPEREPEPESFEEEEVDSKIEGGEGFDQVNGTSLKEKVDDIGNSPSKQQVKKKKKPLLGKFGSLLKKRGGSNHK

SEQ ID NO: 164892 - protein, 521 aa, Glycine max
  Coding DNA Sequence Number=SeqID_73207
  Homolog annotation: Hit_ID=A5B3L6; Match level="QueryCoverage=99%, HitCoverage=24%, E-value=2e-14, Identity=25%"; Hit description =Putative uncharacterized protein
MPVEEKSSTAVLTMPETHCSPQCKDEESSDCDKACNALLPSTSIDQHQTTGSRNVDVNDQTHLGSQVSLEKLDSRIDSKSTSRVPTSSTLLCQEMNSTGSSLKVSVLEQEQCRESKPPEAMGRSATSRIVETKTDSDISVKQENTVSLFPSEKGAASNIDKDKISEKMNSDEDQQRPKKKQEEDCPYIDLEANIENQETVAASNFSRDQNSVTIVVDEDQQRPKRKQKDDHYIDLEATLEDQETGAVTNICEDKTSEKMDVEEDWQWLKRKQKADHYIDLEATFHEDPSEEGINCALPYDKVQHVDLSDTIMQGSGISCQKIPWNEGNAKLEDRESSGKKLKTIFGGIYGSGGRDSFNDSFTSLGNDLGSCSSVEDKGCEEACDEKIIQEDLGTLERTFFPVGTLNITNSLSVMDSMSTKGVGEYDEGFQDGIPNLELALGGKTKPPPAAPKGMLPFLVGAVDRQNNHPDNLGDRQEDEGVAASLSLSLSFPSPNKEHTNAAELLPDGQRVNNPFFLFGRK

SEQ ID NO: 164893 - protein, 211 aa, Glycine max
  Coding DNA Sequence Number=SeqID_73208
  Gene Ontology: Mol. function=kinase activity; Cellular component =intracellular; Biological process=intracellular protein transport
  Homolog annotation: Hit_ID=A7P260; Match level="QueryCoverage=75%, HitCoverage=41%, E-value=2e-68, Identity=79%"; Hit description =Chromosome chr19 scaffold_4, whole genome shotgun sequence
  Pfam annotation: Domain name=VHS; Domain location=70-204; Score=70.3; E_value=6.5e-18; Accession=PF00790.10; Description=VHS domain
MRAWALGLWEWRPSGKRRRGAWRKVRERKVGGAIRKRTEIREDGERLKIGGVEVGRKMSSMSFKVKDFFNGGPNQADKLVEDATSEALDEPDWALNLDLCDLINADKLSSVELVRGIKKRIVLKSPRVQYLALVLLETLVKNCEKAFSEVAAERVLDEMVRLIDDPQTVVNNRNKALMMIEAWAESTGELRYLPVYEETYKTKEAFDVARK

SEQ ID NO: 164894 - protein, 1746 aa, Glycine max
  Coding DNA Sequence Number=SeqID_73209
  Gene Ontology: Mol. function=microtubule motor activity; Cellular component=cytoplasm; Biological process=keratinization
  Homolog annotation: Hit_ID=A5B4K2; Match level="QueryCoverage=92%, HitCoverage=86%, E-value=0.0, Identity=35%"; Hit description =Putative uncharacterized protein
  Pfam annotation: Domain name=KIP1; Domain location=1-45; Score=63.9; E_value=5.5e-16; Accession=PF07765.3; Description=KIP1-like protein
  Pfam annotation: Domain name=M; Domain location=1070-1090; Score=2.9; E_value=54; Accession=PF02370.7; Description=M protein repeat
  Pfam annotation: Domain name=M; Domain location=264-284; Score=0.8; E_ value=1e+02; Accession=PF02370.7; Description=M protein repeat
  Pfam annotation: Domain name=M; Domain location=605-625; Score=3.0; E_ value=53; Accession=PF02370.7; Description=M protein repeat
  Pfam annotation: Domain name=M; Domain location=654-674; Score=0.2; E_ value=1.2e+02; Accession=PF02370.7; Description=M protein repeat
  Pfam annotation: Domain name=M; Domain location=873-893; Score=5.5; E_ value=25; Accession=PF02370.7; Description=M protein repeat
  Pfam annotation: Domain name=M; Domain location=929-949; Score=4.8; E_ value=30; Accession=PF02370.7; Description=M protein repeat
  Pfam module annotation: Pfam domain module=KIP1::M::M::M::M::M::M; Domain location=1-45::1070-1090::264-284::605-625::654-674::873 -893::929-949
MIKLIDEEADSFARRAEMYYKKRPELMKLVEEFYRAYRALAERYDHAMGELRHAHKTIAEEHYMLTDDSSPCVESHTPGVPCPNYCESEHAEKADSEVQTLRKGLAKIQSDKDAIFLQYQKSMDKLSEMERDLNKAQKDAGGLDERASKAEIETRVLKEALAQLKSEKEAGQVQYNQCLESIAKLETMLSLAQLDAKEFDEKTSKAELEAKILRQELGQLEAQKDAGFLRYKQCVENISVLEAKITLAEENSRMLSEQLEKAELEVKALRKNLAELNGEKESLAVLYHQCLEKISKMENEILLAQENSEKLNREIEKGAEKLKTAEEHCDMLEKSNQSLRLEAENLLQRIAMKDQALLEKHAEIERLQTLMQEEHSHFLEIESTLQTLQMLYSKSQQEQGSLVMELKYGLQLLKDLELPKQGVFKEEMQENVEENRTLNEITFSSTRSLLRRQQTEISKLKEIKEKLEREFVVNSEESNALQQEAHQIKNDIQHLNNRYHAMLGQLQTLGLDPKCFAASVKDLQNENSNLKEVCKMERNAKEALREKSKDMDELLIENEFMEFSLSRLNDELDGLRATVRKFQESCQVLQEEKSMAVDEKSALFSQLQIVTESMQKLLEKNALLEKSLSDSKIELEDLKAKSTDLEEFCKLLNDEKYNLLSERSILVSQLESVEAKLSNLEKMFTKLEEKYADSEKDKESTGNQVEEIRASILVQKQKHANHKHLSEVRLTNLENLFHALQEELRLGKIEFEKEVDKAVNAQMEMFILQSCIEDLEQKNLALLTECEKHVEASKFSYKVISELETENFMQLMEEEFLLHEIRKLKMAIHQVCGALQIDPYGVHDKGIKQEEMPILHILDNIEDLKSSYVKSQEEKQQLLVENSVLLTSLEQNRSEREKMESEKKIMEQDFEKTRQKNSMLQKAKVDLLEKNRQLRTEVAKGEERDNASKSKLAALHAELIDLQTKNQVFQEENNMMLEEKNSLLRSVLDLKDAMSVAEDENSVILHKVLALSNLNLVYESFLTQKVIEQEALSEHLSSNLSRLNGDLNQELGVLRKKFEVKEEENVYLNEATKRMDKELQEIKNANCRLSHQVENSENLLKKKDIELLETETRLKAAEKLNGEFCRYIEEMKMDKKESRLTRENLDRQILELSENGMNQKREIEHLNEENRSFQSVMRSLLHEVEQHKAREQALNTELQDKTNECQHCEAEAASFYLELQISSISEELLKGKVTELTGVCKRLDDESAGKGLVIEQMIERIGLLEKEIRGLKGQLSAYTPTITSLKEDFASLEHTYFLLTNKTFAVGNIEQKVSSCFTQILCTCICFFLVSCQNSLCSSLIFSIYPCLSRMFFQDVVTEICLQEANSYRSLKGNESTLTPDGVTDLLSMQTRIRAVEKLMMEELERHVEEESLTTNVKAEAVTEMTEHSNLEVGTYPEIDDRKVVMKIKKDNSKRGNNAWRTKSQKRLIMIDIPLDDYKDDPDSNKYCKRDHTRCNDHMLELCETDQHDVTEESKHNSVSIEDVITCHESERCQNYSSELETEKELGVDKLELWKTRKETTSEDSKRKILERLASDSQKLAILKMTLQDLKKKPETQKKSSKVNEIEYETVKRHIEDVEEAVMQQIGIYDQLAKDIEECTSSSSDTNTMQMEKQGGHGQRKKLTEQARRGSEQIGRLQFEVQNIQYILLKLADVKNNKCKNKNTRPTGKITEGAVRDVLVDVQGLQLMRTKSDTASSKIEGLPKKK

SEQ ID NO: 164895 - protein, 105 aa, Glycine max
  Coding DNA Sequence Number=SeqID_73210
  Homolog annotation: Hit_ID=A7NWQ4; Match level="QueryCoverage=40%, HitCoverage=24%, E-value=5e-10, Identity=64%"; Hit description =Chromosome chr5 scaffold_2, whole genome shotgun sequence
MTVMNTTRVMKSSYQVEASFQPSQEALAYIEKVAIPHPWSQSKCVDDCSIGYVSVKPECGDYRCKHMLAMQCLRNSYGGFEEGNTNCLQKISLIIFSFLATDKIK

SEQ ID NO: 164896 - protein, 1995 aa, Glycine max
  Coding DNA Sequence Number=SeqID_73211
  Gene Ontology: Mol. function=metal ion binding; Biological process =metabolic process
  Homolog annotation: Hit_ID=A7NWM7; Match level="QueryCoverage=84%, HitCoverage=81%, E-value=1e-170, Identity=46%"; Hit description =Chromosome chr5 scaffold_2, whole genome shotgun sequence
  Pfam annotation: Domain name=PHD; Domain location=1942-1984; Score =31.2; E_value=2.9e-06; Accession=PF00628.20; Description=PHD-finger
  Pfam annotation: Domain name=PHD; Domain location=720-763; Score =65.0; E_value=2.5e-16; Accession=PF00628.20; Description=PHD-finger
  Pfam module annotation: Pfam domain module=PHD::PHD; Domain location =1942-1984::720-763
  Subcellular localization annotation: CTP_CleavageSite=86; ConfidenceScore=5.15e-01
MESGVGSGGSGVVVKSRNSSGCLIVRKKGDGLGATASTSRKLYESKKRPNINVPVSSSDSGSSDELLMPPGRRLGPETIRVCNGLVASERVGSEISRKRDRVGRISGSGEGIGAEKGLEQWERKRSKLDVYDFDEYDGMDVENMRRRHLDGPGGGRFMGSVHAATSGIDRDFRTGSSGRVLDKRKNSYADRPSCFYPEDYVCNSRFKMNNDGAQVPPPSQREKFNSDESIRVQGKNGVLKVMVNKKKVGGTSEQYYDHHKPLESRQRLKTEETAKRLKTEETAKRLKTEGTAKRNIPILKKNEKKPVDKPALLKRPEKKRTASRKSLSSKDSKGDEGDSDNSDTSLNPRIRNTEARKSVKKIISEDEQTPVREKTPTTRTKEGKIKRGSGTEKQKLREQIREMLLNSGWTIDYRPRRNRDYLDAVYINPAGTAYWSIIKAYDALQKQSNDDADEVKPKGDSSSFAPIADEVLSQLTRKTRKKMEKELKKKKKRHDSESDNEKEPQIRRSASHKRDMNSMDSDSNEEKLSSFIKQGNRSMKNKMFENTSISARSKIQNATHQSSDGIEKPLFGCDPHIHGRKSKKHGRCTLLVRSSNKGSNSESDGFVPYMGKRTVLAWLIDSGTVELSQKVQYRRRKKVMLEGWITRDGIHCGCCSKILTVSKFELHAGSKLPQPYQNIYLESGVSLLQCQIDAWNRQEHAEKIGFHSVDIDGNDPNDDTCGICGDGGDLICCDGCPSTFHQSCLDIQMLPPGEWHCPNCTCKFCGIASETSDKDDASVNVLRTCILCEKKYHDSCTKEMDTLPNNINSSSLSFCGKECKELSEYLKKYLGTKHELEAGFSWCLIHRSDEDSEAACRGLTQRVECNSKLAIALTVEKLVIPAVAELTHTWTTVFGFTYLDESLRQEMKSLNMMVFPGIDMLQKLLVEQGNHEGSEKMENGDNDFIKTKMGNKSDMGSSTPQDSHGSDDVSSNPANETNDECSDASQELNNQVLVDGIICSKSHSEEMMSDPISDKCDSPSRTSNSELEMKNKVAAAPPVDRLDSSTKCQSISPIDTSVSSHPVDILKVQALVQETTYSDPCSEEENLDKKCHSSTAMNCDSSELDINPVLNSQMADNTLPTKEVCMNDTLEVVPSGNISEDNITKRNNRNVDESSSALNHADEKLHCLVSKSIFKAFEASAMCFDLVASLSDHFGFFSGDLRRTRMQQFTARYGIREFSGEMESGVRSGGSGVVVKSRNSSGCLIVRKKGDVLGATASTSRKLYESKNRPNINVPLSDSGSSDESPVPPGRRLGPETIRVFNGFAAASERGGSEISRKRYRVQRIRGNGEGIAAEKGLEQWERKRSKLVVYDFDDYNGMDVENMRRRHLDGHGGGRFMGSVHAARIGIDREFKTGSSGRILDKRNNSYGDRPGGLYPGDNVDHSRYKINRDGLRVPLRLQREKFNSDESIRVQGRNGVLKVMVNKKKVGGPSEQYYDHHKPVERRQRLKTEETAKRLMTEETAKRLKTEEAAKRNVNVPIRPLSYLEMKPVEKTGLLKRPEKKRIASRKSLSSKDSKGDEGDSDNSDTSLNLGIRNTEARKPAKKIISEDEQTPVHEKLPTTRTKEGKIKRGSGTEKQKLRERIREMLLDSGWTIDYRPRRNRDYLDAVYINPAGTAYWSIIKAYEALQKQLNEDANEAKPKGDSSSFAPIADEVLNQLTRKTRKKMEKELKKKKKYDSESDNEKEPQIRSASHKRDMNSTDGDNNEEKLSSFIKQGSKSMKNKMFENTIISAPSKIQNATNHSGDGIEKSLFGCDPQIHGRKSKKHGRCTLLVRSSNKGSNSESDGFVPYTGKRTVLAWLIDSGTVELSQKVQYRRRKKVMLEGWITRDGIHCGCCSKILTVSKFELHAGSKLPQPYQNIYLESGVSLLQCQIDAWNRQEHAEKIGFHSVDIDGGDPNDDTCGICGDGGDLICCDGCPSTFHQSCLDIQGAVISHSLELCCFEVKGTEDTFLLL

SEQ ID NO: 164897 - protein, 355 aa, Glycine max
  Coding DNA Sequence Number=SeqID_73212
  Gene Ontology: Mol. function=pyridoxal phosphate binding; Cellular component=cytoplasm; Biological process=cysteine biosynthetic process from serine
  Homolog annotation: Hit_ID=Q8W1A0; Match level="QueryCoverage=69%, HitCoverage=76%, E-value=1e-128, Identity=95%"; Hit description =Cysteine synthase
  Pfam annotation: Domain name=PALP; Domain location=12-289; Score =348.4; E_value=1.2e-101; Accession=PF00291.16; Description=Pyridoxal- phosphate dependent enzyme
MAVERSGIAKDVTELIGKTPLVYLNKLADGCVARVAAKLELMEPCSSVKDRIGYSMIADAEEKGLITPGKSVLIEPTSGNTGIGLAFMAAARGYKLIITMPASMSLERRIILLAFGAELVLTDPAKGMKGAVQKAEEILAKTPNAYILQQFENPANPKVHYETTGPEIWKGSDGKIDAFVSGIGTGGTITGAGKYLKEQNPNIKLIGVEPVESPVLSGGKPGPHKIQGIGAGFIPGVLEVNLLDEVIQPLCICKGKAAYNIPPPYLRIAKSLWTMGASPGAAVKLCLGDLLVMGSNPETASLHMQGKNSIRKIGQNGIDAGTKNNAEDIAGGTRTTSRRGDNGNCDCDVSGDRKW

SEQ ID NO: 164898 - protein, 175 aa, Glycine max
  Coding DNA Sequence Number=SeqID_73213
  Gene Ontology: Biological process=trichome morphogenesis
  Homolog annotation: Hit_ID=Q6EEW1; Match level="QueryCoverage=86%, HitCoverage=40%, E-value=8e-51, Identity=65%"; Hit description =Cyclin T1
MQWWHVLIATAALFLVGKSEETPCPLNNVLQASSEILHEQDFTLLSYLLPVGWFEKYHDRVLEAELLLLTTLNFELNVEHPYTSLTSVLNKLDPSKTVLVNLALNLISKGLQSSLWLQYKPHHIAAGAAYLASMFLKIDLTAYHNIWQEFEATPSILRGTLHPLLPSFPFSPFPC

SEQ ID NO: 164899 - protein, 648 aa, Glycine max
  Coding DNA Sequence Number=SeqID_73214
  Gene Ontology: Mol. function=nucleic acid binding; Cellular component= SWI/SNF complex; Biological process=response to water deprivation
  Homolog annotation: Hit_ID=A7NWI8; Match level="QueryCoverage=94%, HitCoverage=55%, E-value=0.0, Identity=69%"; Hit description =Chromosome chr5 scaffold_2, whole genome shotgun sequence
  Pfam annotation: Domain name=DEAD; Domain location=401-568; Score= -20.1; E_value=0.0013; Accession=PF00270.20; Description=DEADDEAH box helicase
  Pfam annotation: Domain name=ResIII; Domain location=397-562; Score =3.7; E_value=2.4e-05; Accession=PF04851.6; Description=Type III restriction enzyme, res subunit
  Pfam annotation: Domain name=SNF2_N; Domain location=403-647; Score =315.4; E_value=1.1e-91; Accession=PF00176.14; Description=SNF2 family N-terminal domain
  Pfam module annotation: Pfam domain module=DEAD::ResIII::SNF2_N; Domain location=401-568::397-562::403-647
MEEIERRREGCMKGEFDSFGTERKVKAPAMEQAVSLIGALNLVSRNLPLPPDLFDTVSSIYHRSNPLSSEADAPEQDLLADLQNALLEQRPNYASASKLNKTRESRYHTQIRHRLTQLQGLPSSRGEDLQTMCLLELYGLKLAELQRKVQTDVNSEYWLNVKCAYPDRQLFDWSMMRLRRPLYGVGDPFSMDADDQIRKKRDAERLSRLEEQAKNHMETRKRRFFAEILNAVREFQLQIQAFLKRRKQRNDGVQAWHGRQRQRATRAEKLRFQALKADDQEAYMRMVKESKNERLTLLLEETNKLLVNLGAAVQRQKDSKQSDGIEPLEDSETDLPESDGLKNGISKESPLEEDVDLIDSDRNGGDTSDLLEGQRQYNSAIHSIQEKVSEQPSILQGGELRPYQLEGLQWMLSLFNNNLNGILADEMGLGKTIQTISLIAYLMEHKGVTGPHLIVAPKAVLPNWINEFSTWAPSITTILYDGRLDERKAMKEELSGEGKFNVLITHYDLIMRDKAFLKKIHWLYLIVDEGHRLKNHECALARTLDSGYHIQRRLLLTGTPIQNSLQELWSLLNFLLPNIFNSVQNFEDWFNAPFADRVDVSLTDEEQLLIIRRLHQVIRPFILRRKKDEVEKFLPSKSQLVLCDELVK

SEQ ID NO: 164900 - protein, 50 aa, Glycine max
  Coding DNA Sequence Number=SeqID_73215
TKKKNQNGTGSTEEEEEPQGTIMNMNDDRKNKRRRKRKANKKHKKKAIGR

SEQ ID NO: 164901 - protein, 52 aa, Glycine max
  Coding DNA Sequence Number=SeqID_73216
MTYFEEDAINGDGDRTRDVNRNHDGGGELYVNLRWDPQPEAPNTNRRGSSRL

SEQ ID NO: 164902 - protein, 1323 aa, Glycine max
  Coding DNA Sequence Number=SeqID_73217
  Gene Ontology: Mol. function=DNA-directed RNA polymerase activity; Cellular component=DNA-directed RNA polymerase II, core complex; Biological process=transcription
  Homolog annotation: Hit_ID=Q01JX0; Match level="QueryCoverage=95%, HitCoverage=98%, E-value=0.0, Identity=36%"; Hit description=DNA -directed RNA polymerase
  Pfam annotation: Domain name=RNA_pol_Rpb1_2; Domain location=235-394; Score=117.3; E_value=4.6e-32; Accession=PF00623.11; Description=RNA polymerase Rpb1, domain 2
  Pfam annotation: Domain name=RNA_pol_Rpb1_3; Domain location=397-548; Score=102.3; E_value=1.5e-27; Accession=PF04983.9; Description=RNA polymerase Rpb1, domain 3
  Pfam annotation: Domain name=RNA_pol_Rpb1_4; Domain location=600-680; Score=7.5; E_value=0.0018; Accession=PF05000.8; Description=RNA polymerase Rpb1, domain 4
  Pfam annotation: Domain name=RNA_pol_Rpb1_5; Domain location=725 -1067; Score=-100.4; E_value=0.00011; Accession=PF04998.8; Description=RNA polymerase Rpb1, domain 5
  Pfam module annotation: Pfam domain module=RNA_pol_Rpb1_2::RNA_pol _Rpb1_3::RNA_pol_Rpb1_4::RNA_pol_Rpb1_5; Domain location=235-394::397- 548::600-680::725-1067
MDDDLFQRNKTPSGVIKAIKFDENIAVLEINAAGQVTGSSLGFPNASDECATCGSKDKRFCEGHFGVIKFPTPILHPYFMSEIAHILNKICPVCKSIRHKSKGVRLIYGTKRSNDCNYCSAYPSMKFRVSSNDLFRRTAIIVEVKASKKTLGTEIPADYWNFIPCDAQQEENYVNRRVLSPAQVLAFRLCFSFDEMQLNPDKTPNSIFADIQQRKIGENACNSSGLRWIKDVVLGKRNDSSLRTVVVGDPDLELSEVGIPCHIAESLQVSEYVNRQNREKLLYCCELRLLEKGKIDVCRNGSKVHLYKKEDLQIGDKIYRPLADGDKVLINRPPSIHQHSMIALTVRVLPISSVVCINPLCCSPLRGDFDGDCLHGYIPQSVTARIELNELVALDRQLINGQSGRNLLSLSQDSLTAAYLLMEDGVLLNVYQMQQLQMLSISDKRLIPPAVVKAPSSNSSLWSGKQIFSMLLPYDFDYSFPSDGVVVSDGELVSSSEASGWLRDSDYNVFQSLVEHYQGKTLNFLYTAQKVLCEWLSMTGFSVSLSDLYLSSDSYARKNMIEEIFYGLQDAEQACNFKQLLLDCYCDFLSGSIQESENAITVDADRLNYERQISAALSQASVDAFRQVFRNIQSLADKYACKDNAFLAMFKAGSKGNLLKLVQHSMCLGMQNSLVRLSYRLPRHLSCAAWNSQKWLDSIQMSSGTLESVQSYIPYAVVESSFLTGLNPLECFVHSVTNRDSSFSDHADLPGTLTRRLMFFMRDLHDAYDGTVRNLYGNQLIQFSYDIEEDSSCDKGFQEYAIGGEPVGAISACAISEAAYSALGQPVSLLETSPLLNLKNVLECGSRKRNGDQTVSLFLSEKLGKQRHGKCSADSMAKEGEDTSIDKKEGDDCITVTIVENSKNPIQLDSVRDLVIPFLLGTAIKGFLDVKKVDVLWNNQSKVKNSCNGFSGELYLRVTLSSEGSRGRFWGVLLNLCHKIMHIIDWTRSHPDNINHFSSAYGIDAGWQYFFNSLASATSDTGKSILPKHLCLVANSLSCSGEFVGLNAKGMALQRKHASVSSPFVQACFANPGSCFIKAAKSGVTDNLQGSLDALAWGNCLSMGTSGMFDIIYSEKVAKSGNVYELLEASFDKPNNKAGTHLHKYSSDKCGSEFRHKNGYALKEGKQWKTILRNFVTVNDIQKLTFASRYSIDELLSESDRSTMLRVLNFHPRKSEKFGIGPQDIKVGWHPKYKDSRCFHIVRIDGTVEDFSYRKCILGALDIVDPKKSKIQEKKWSGHGCPESVVESTVLFCEFRVMLLALLQLIGGNSLQPSFVVFYYLQG

SEQ ID NO: 164903 - protein, 262 aa, Glycine max
  Coding DNA Sequence Number=SeqID_73218
  Homolog annotation: Hit_ID=A4PP05; Match level="QueryCoverage=51%, HitCoverage=39%, E-value=2e-10, Identity=35%"; Hit description=IMP dehydrogenase/GMP reductase, putative
MHVVFLDAFRDLSQTGSYAWGFVALCWIYEHFPTITSSIVAEDYHERKPRACRWKSGKALPVSTYRKRLDRLTSDVVCWIPYDISDGVHLLSYTERVVHQFGYVQTIPPHHSAPSLPIEDIDDRWIQFFEYLALCALDYMNWFYFISHPFMSPTQLEDPPRHPSMVHDDTFIELDPPQYPVSTVAMPEPPAAAPADVDMPRHAHEVCQAIIERLKLLINLRVVTEGTYAYTVTEECPRIASSVTMQGNVYVRSRRKWCMPDA

SEQ ID NO: 164904 - protein, 67 aa, Glycine max
  Coding DNA Sequence Number=SeqID_73219
MSDDAILPRRGPITVEAMPSKVILMMPKNPELSKFQRFKNQVSRIKIRDSRIKFQESRSRFKNQEKT

SEQ ID NO: 164905 - protein, 210 aa, Glycine max
  Coding DNA Sequence Number=SeqID_73220
MDDIYYPAFMNKMLWDQGVYRVFDKLDDDLKHNLKIKGSMVAKQQSFSKTNLKAMKVVMEEQKLIPQVDVEAIKQRKQKRLTKAIANKDKGPPDGSNTSESDINPFLLQSSQNPTTQENKKPLSSTWKAMQKPSPKKVIRRRFSIAFLNLNEQNLHKPSEVIEKPPQEPIQRHHITVIPTPWTRYDYTRSPSEAYKAFPLDAIVYLEALS

SEQ ID NO: 164906 - protein, 330 aa, Glycine max
  Coding DNA Sequence Number=SeqID_73221
MSSSFLHLVAPFASSHHRHRVCLCLDEVHEQPQEAVDAQDFSGKPHDTSVLMNYVHHVIVTVWNGDLSSHGRKVEKVGRSAPEIKDIVAATRLSPLIAYSLDTGDKGLISVLRRDTFHTFDALHVDQVVDLLVDLLEVSSQEARDETFQWGHMFGYPGCKTFIVANCWIYEHFSTIASYIAAKDYHERKPRVCHWKSGKALLVSMYHKRLDRLMFDVICVAPGQCVKHYMEWFYMISHLFMSPTQPGDPLRHPPMVHNDTFIELNPPKQSVATPAMPKPPEACHAITERLECLINLRVVTKGTKTYNVTKECLRIAKGAIAQGNVYVRSR

SEQ ID NO: 164907 - protein, 189 aa, Glycine max
  Coding DNA Sequence Number=SeqID_73222
MRGYEDLRGGEHSPYPRPRISCGGGYHPHPRPRGEFFLDRRAPNGAIPAGIPELQGELPCLLITWHITRWFIIGLLTFKRRFGDPFVAHDLNQRVVVSWEQSTIKFFDQCSVGLCIFFSFISSTFLTKVLLALAAVEKADIGRRSGKGSIKERVWWEGEGEKQDHKGSGSDVGLDSDGCLMGFEEGEKG

SEQ ID NO: 164908 - protein, 483 aa, Glycine max
  Coding DNA Sequence Number=SeqID_73223
  Gene Ontology: Mol. function=aspartic-type endopeptidase activity; Cellular component=small subunit processome; Biological process=DNA integration
  Homolog annotation: Hit_ID=A5CB76; Match level="QueryCoverage=34%, HitCoverage=59%, E-value=2e-27, Identity=37%"; Hit description =Putative uncharacterized protein
MGAGWGRTSTESAVEQLPPSPFSTAIVDSDDEPNTHSLHGFSPARFSGSPIGGSSTWSPPSTVDHRWRRRTVGLYPACRGNDIMTGAYVSSLHCHEHLPSAADLPPPDADQRECIGPNCLDMHPTLFLEGDIEDIPPPAFKSPYNLRVKQDEPSVNTPGSTPLVNYVSSLTPPYQKEFAAEEGEVLNHTMGLGLRSGWGPRPFKVMDWWLQDKDFQKMVSHRWGNYHPSGWGFGSPRKARSTPGTRAAVGRRTRPHAPPFLRAISGACCSRAAVPASGAVPSGPGSLAVTSWTCFRLQILLPASRLVTPCVFASRHHDHLEKTSDFVSDDKRAEWEKLDYQLCVVLWQSVEPDILEILRSFKSCRSFWKKAQEIFANDIQSLFDATMKVTALKQTGHDMIAHVGKARAAVEELRKFFVADSLEEVNRKLDKFYMVLILRSLHSDFDHVRDQVLAGDQIPSMDSLITRLLRVPHLLKDENPTDG

SEQ ID NO: 164909 - protein, 618 aa, Glycine max
  Coding DNA Sequence Number=SeqID_73224
  Gene Ontology: Mol. function=microtubule motor activity; Cellular component=microtubule associated complex; Biological process =microtubule-based movement
  Homolog annotation: Hit_ID=Q9FKP4; Match level="QueryCoverage=98%, HitCoverage=47%, E-value=0.0, Identity=72%"; Hit description =Similarity to kinesin heavy chain
  Subcellular localization annotation: CTP_CleavageSite=28; ConfidenceScore=5.20e-01
GSSKALMIVNVCPSISNLSETLSSLNFSARARNSTLSLGNRDTIKKWRDVANDARKELNEKEKEIHDLKQEGLKLKQALKDANDQCILLFNEVQKAWKVSSVLQTDLKSEHVLLSDKHKIEKEQNNQLRNQVAQLLRLEQDQKLQIQEQDSTIQSLQAKIRTLETQFNEAIKSSESRSTFVYETESADQSNSGPTGDGIDSSAVTKKLDEELKKRDALIERLHEENEKLFDRLTQKASTAGSPKLSSPLARGSANVQPRDIGRNGTNNNTSSRSMGVLPSPLATDKNDGTVALVKTGSEIVKTTPAGEYLTAALNDFDPDQYEGHAAISDGANKLLMLVLAAVIKAGASREHEILAEIKDSVFSFIRKMEPKRVMDTMLVSRVRILYIRSLLARSPELQSIKVLPVECFLEKTNTGRSRSSSRGSSPGRSPVLYVDEQIQGFKVNLKPEKKSKFSSVVLKIRGIDEQVTGGKLREITEEAKSFAIGNRALAALFVHTPAGELQRQIRSWLAENFEFLSLTGEDASGGSTGQLELLSTAIMDGWMAGLGAALPPHTDALGQLFFEYSKRVYTSQLQHLKDIAGTLATEEAEDAAQVAKLRSALESVDHKRRKFCHCIGY

SEQ ID NO: 164910 - protein, 114 aa, Glycine max
  Coding DNA Sequence Number=SeqID_73225
  Gene Ontology: Mol. function=hydrogen ion transmembrane transporter activity; Cellular component=integral to membrane; Biological process=proton transport
  Homolog annotation: Hit_ID=P21616; Match level="QueryCoverage=48%, HitCoverage=7%, E-value=6e-23, Identity=94%"; Hit description =Pyrophosphate-energized vacuolar membrane proton pump (EC 3.6.1.1) ...
  Homolog annotation: Hit description=(Pyrophosphate-energized inorganic pyrophosphatase) (H(+)-PPase) (Vacuolar H(+) -pyrophosphatase)
MGFLLAANGLLVLYIAINLFKIYYGDDWGGLFEAITGYGLGGSSMALFGRVVDGVIGAEAPSAYHMAPRSEAPSQVPPPVPEATAGAIGVSPVSVELDGTTAKKKSDSILAREC

SEQ ID NO: 164911 - protein, 21 aa, Glycine max
  Coding DNA Sequence Number=SeqID_73226
MEVTYLSLMEEGLKNTCLDSS

SEQ ID NO: 164912 - protein, 156 aa, Glycine max
  Coding DNA Sequence Number=SeqID_73227
MYTLGFGNCIGRPIRVDSNTLDACKGRYAMWMLWAFVKGCKVSVQSPMEESSKLDQNSTVVQISPNQTALANSSMSMNANDSNIGVMDTIITINSGASLKVYDIDGEGKSMVNMHKVFSIRYSVLMEEENAPANECATMKVIQPDSVPMVSDQVHP

SEQ ID NO: 164913 - protein, 99 aa, Glycine max
  Coding DNA Sequence Number=SeqID_73228
  Gene Ontology: Mol. function=hydrolase activity, acting on glycosyl bonds; Cellular component=beta-galactosidase complex; Biological process=carbohydrate metabolic process
  Homolog annotation: Hit_ID=A7P6Q6; Match level="QueryCoverage=30%, HitCoverage=3%, E-value=1e-09, Identity=90%"; Hit description=Beta -galactosidase
MKQYHISKNHIDSHKWGSTTKSEYQEQQVVGVWHQQQQNIQRRECLARQPKWGHLKDLHRAIKLCQPALVSGDPTSLTCTIFCTLHSNNTELNMHGRYC

SEQ ID NO: 164914 - protein, 88 aa, Glycine max
  Coding DNA Sequence Number=SeqID_73229
MHGYIKETKHSAFVPCPYFRNLLGGTKVGTTSDNISSKRKTLDEASLSSSESETQHDHRSTSTSYVSMDPGIRPNNSPMCKGVSAMCA

SEQ ID NO: 164915 - protein, 179 aa, Glycine max
  Coding DNA Sequence Number=SeqID_73230
MEDNAAAVAATSATAEVDLTHPSDINQTSHPVLDMVGQGGEVLGSTGGPHVVQNKNSCPPYGLPPNYTPPNAMHVPNENATHSVLVPLEGQQPQLGHTPFAQPVGEACEEPRGHALGEFEPYPTYATEGPAFNGMPQPNAAGAPQHHPMQPLHFSVGRLPPAMEEREKLDLIKEKVEGH

SEQ ID NO: 164916 - protein, 76 aa, Glycine max
  Coding DNA Sequence Number=SeqID_73231
  Gene Ontology: Mol. function=oxidoreductase activity, acting on CH-OH group of donors; Biological process=electron transport
  Homolog annotation: Hit_ID=A7Q1Q0; Match level="QueryCoverage=65%, HitCoverage=6%, E-value=1e-18, Identity=80%"; Hit description =Chromosome chr7 scaffold_44, whole genome shotgun sequence
MGASEEEGALDENGETWEAEGLYVCDGNVLPSAVGVNPMVTIQSTSYCIASVQAATRYYYKCGDSSIPAMTQEHFF

SEQ ID NO: 164917 - protein, 85 aa, Glycine max
  Coding DNA Sequence Number=SeqID_73232
MSSDSPSLDDKGADDHNLSLRVNGLACLWLAKGAGPYGSPACHRTRRLWMKKGQYDRDCGVADKSEALAPTYPQFVMRNSDLRSS

SEQ ID NO: 164918 - protein, 235 aa, Glycine max
  Coding DNA Sequence Number=SeqID_73233
IGTRLISQYDTRRFSSLDAWTRYTDNVLGRIILPERKVELYHTELDDFKVELERRNFHKCLTNLAGGSIDLALVKEFYANLYSSEDRPPKQFRVRGHLVKIDVASLNTFLETPVMMAPPNSIPTVEQFNEMVAWPGTEPSLHKEDEGPTAQVPQHMEDESFEATILEPFDIEEEAEETQATSEPSTPVVNLPSPQPAPDPSTPLLQMPEDQTTPVLDVDTSPPTTPVLQLTDEED

SEQ ID NO: 164919 - protein, 62 aa, Glycine max
  Coding DNA Sequence Number=SeqID_73234
MDSTKLASYVAGCDDSHNDPSPSHERDDARERHQRLVLIRLALEKVAFTFSLSQSAALASLR

SEQ ID NO: 164920 - protein, 143 aa, Glycine max
  Coding DNA Sequence Number=SeqID_73235
MKPWKLRYEAEDAEEGEVEAKELEGEDFGRDDGVEEGGKGLEEVRVRVRVRVWRKCENYIVTFHVIENHTAIAVQYNCRRYHNNNIVVIIVFADCYVKPCFKGNSGRMTIMIFIKDNTLRMSMLISTEKIFDAWKCNPNLSSI

SEQ ID NO: 164921 - protein, 105 aa, Glycine max
  Coding DNA Sequence Number=SeqID_73236
MALRANAPLPYPHLVTLFLHHFNVPLDDEPYVKVKRSFSIGVDVVTSFGYRKDVDVLTELHDLRAFVGEHFDAMDTRFDGMDTCITRLEDDMSFIRRCFDPSADS

SEQ ID NO: 164922 - protein, 86 aa, Glycine max
  Coding DNA Sequence Number=SeqID_73237
CTLANGRHFAKENLVVWFCSLHNRPDNYLKGIINSALKGLDDTPQPKSKAGARWIVVKTIESREIEGASHPVGTILSQSQKSNLGC

SEQ ID NO: 164923 - protein, 127 aa, Glycine max
  Coding DNA Sequence Number=SeqID_73238
  Gene Ontology: Mol. function=protein kinase activity; Cellular component=integral to membrane; Biological process=protein amino acid phosphorylation
  Homolog annotation: Hit_ID=A7P9P7; Match level="QueryCoverage=79%, HitCoverage=13%, E-value=4e-32, Identity=67%"; Hit description =Chromosome chr3 scaffold_8, whole genome shotgun sequence
  Pfam annotation: Domain name=LRR_1; Domain location=43-66; Score =12.5; E_value=1.5; Accession=PF00560.24; Description=Leucine Rich Repeat
  Pfam annotation: Domain name=LRR_1; Domain location=67-89; Score =13.3; E_value=0.9; Accession=PF00560.24; Description=Leucine Rich Repeat
  Pfam annotation: Domain name=LRR_1; Domain location=91-114; Score =7.5; E_value=12; Accession=PF00560.24; Description=Leucine Rich Repeat
  Pfam module annotation: Pfam domain module=LRR_1::LRR_1::LRR_1; Domain location=43-66::67-89::91-114
MVLHACSEIGAPGTPDFFRVTSLALPNSQLLGSISEDLGLIQYLRHIDLSNNFLNGYLPNTIFNSSELHVLSLSNNVISGELPQLIGKMTNLKLLNLSDNAFGGLIPEKQFLIYVKQSQNIKHELDK

SEQ ID NO: 164924 - protein, 142 aa, Glycine max
  Coding DNA Sequence Number=SeqID_73239
MDNEEGVQEQMKADLSALKDQMASISEVMLKLQKTIEDKATATASSTVREAEPVLQPALNPGLDRNTAMFDRRYSLQAYPYGLPPDFTPRATLEDLSQAPTFEGQLPPYEDYPGQDDGEGDTHLGPLLHLKDPSPHELPSRT

SEQ ID NO: 164925 - protein, 46 aa, Glycine max
  Coding DNA Sequence Number=SeqID_73240
MTILYDAILPRKGPVTRAMSKRLQEDWARAAEEVPRVLMNLKGSIM

SEQ ID NO: 164926 - protein, 107 aa, Glycine max
  Coding DNA Sequence Number=SeqID_73241
PWGFQLWLRASVVLQGARSPRQGHVIIGIAPARHPVDPKKSNRVLELSSPNYGAKHHSSLGMASSGQQSTTITSRVHLSSSTKRSVTDKSSGVPAQDVKEALLGGNL

SEQ ID NO: 164927 - protein, 261 aa, Glycine max
  Coding DNA Sequence Number=SeqID_73242
  Homolog annotation: Hit_ID=Q6WAY3; Match level="QueryCoverage=91%, HitCoverage=11%, E-value=1e-06, Identity=26%"; Hit description =Gag/pol polyprotein
MFQEDGPNVKTNPLAIHGGPAVNAVEECGPRRPKQMKVVTSRRFILKTLCEVGIICFDGGKGDTCFIQSGAAHEVETCPVAEDLLQGIMDQGRFEVGGTSKGEQHVCMQSVDKSPSKPKPLVIHFTRDAATQKPQGFQPIPGKKPIHFPYKSDKAVPWRYAPQKPDGRKDESIGDDLSSTKVTNISGMSSMTRSGQIFVAPDPLVQSKDTKGKAKVGTEESDKASLILDEEIPARRFAKGEEDFSRKKISTKEANEFLRII

SEQ ID NO: 164928 - protein, 84 aa, Glycine max
  Coding DNA Sequence Number=SeqID_73243
MQLTENQFPEKRLPEDFRKKLLPEDNGILPEEASSGSLPDDVLPEIVCEYFRKTQIILPEEPSSGRLIAEGQFRYFTVCWVPQQ

SEQ ID NO: 164929 - protein, 193 aa, Glycine max
  Coding DNA Sequence Number=SeqID_73244
  Homolog annotation: Hit_ID=Q6UUU1; Match level="QueryCoverage=31%, HitCoverage=40%, E-value=2e-18, Identity=78%"; Hit description =Putative uncharacterized protein
DKYYERYEETGQHLGPFAKLVQKLRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNSLQAGLYARTPRSVRPLRLIRHAPVKAKLKGQVLVTALLQASYLGSKSW

SEQ ID NO: 164930 - protein, 166 aa, Glycine max
  Coding DNA Sequence Number=SeqID_73245
MGPNWKTFTAHEDVWKDYLKSHPSHSKLRGKSMVDYEYLKIVVGGGVSSGNNSISVDPDDTDATTFEPENRTVGIEEFSYDPNSDTFITPNNYEPAYQPPSPNQPSPPSHPPLDSEGVQALLGSTIKAIVLENLSVGIGTIAVNFEKISNMMEKREKDRDRDRELE

SEQ ID NO: 164931 - protein, 104 aa, Glycine max
  Coding DNA Sequence Number=SeqID_73246
  Subcellular localization annotation: CTP_CleavageSite=55; ConfidenceScore=5.24e-01
MFVFNSALKGLDDTPQSKSKAVARWIVVKGTSFVVQVEGTSTWVVVTENKRRYISCGSVQVEGTSTWLFKENKGGYIPCGSLLVKAFTRLKRNLKDRRSLENWM

SEQ ID NO: 164932 - protein, 77 aa, Glycine max
  Coding DNA Sequence Number=SeqID_73247
  Homolog annotation: Hit_ID=A7QFF8; Match level="QueryCoverage=36%, HitCoverage=31%, E-value=6e-08, Identity=96%"; Hit description =Chromosome chr8 scaffold_88, whole genome shotgun sequence
MGAGHARSRYLNRKEGDAEGRASDWSEVVKGSRTGRKERDGVSLAFGIAGPGGRPARRAISSVVERAPDNCVVVPGL

SEQ ID NO: 164933 - protein, 254 aa, Glycine max
  Coding DNA Sequence Number=SeqID_73248
MASKKRKAPSTPTQARYDRSRKLLPEKNVVVYYTEFDEFKEELKRRHWDEKLIDFANSSINITIVKEFYANLYDPEDKSPKQVRVRGHLVKFDEDTLNTFLKTPTILEEGENLSTYSRFALLRPDPQELAAKLCIPGRGFKINVDGQPLKILRKNMTTLAQTWSVLSFSNLIPTSHTSNVTLDRAKLIYGIIMKMDMNLGYPISHQISLIAHDTFILGFHALITALCKAIGVQSDSRSLENLSPAINLAYIKQN

SEQ ID NO: 164934 - protein, 43 aa, Glycine max
  Coding DNA Sequence Number=SeqID_73249
MAEPSKKRKGSSSRSQWHFETQEMPIPSSIPSASLFSSEEQLI

SEQ ID NO: 164935 - protein, 84 aa, Glycine max
  Coding DNA Sequence Number=SeqID_73250
  Homolog annotation: Hit_ID=A4W521; Match level="QueryCoverage=100%, HitCoverage=18%, E-value=2e-41, Identity=90%"; Hit description =Putative uncharacterized protein precursor
MVSTWDGQWLRPVLLFCAGLVLLPVIQERFPSLSAARFFTLVVLFFWGVVCIHLLDTAWLYWRDGVIHWGETRIVYNRTRMSFQ

SEQ ID NO: 164936 - protein, 145 aa, Glycine max
  Coding DNA Sequence Number=SeqID_73251
  Gene Ontology: Mol. function=transferase activity, transferring glycosyl groups; Cellular component=membrane; Biological process =biosynthetic process
  Homolog annotation: Hit_ID=A4W522; Match level="QueryCoverage=100%, HitCoverage=39%, E-value=1e-72, Identity=91%"; Hit description =Glycosyl transferase, group 1
  Pfam annotation: Domain name=Glycos_transf_1; Domain location=21-145; Score=3.8; E_value=0.00029; Accession=PF00534.11; Description =Glycosyl transferases group 1
MSQSTSVPSGVDTQRFHPGDKHQARAHCGLSQDDFWLGVVSHLRPNKGHSVLLRALAKIDNPQIRLAIVGEGPHKAALEQEITALGLQQRVVMAGHQSDPERWFPAFDIALSPSHDMEGVPQGVLQSLASRIATIATDAGGTGDA

SEQ ID NO: 164937 - protein, 169 aa, Glycine max
  Coding DNA Sequence Number=SeqID_73252
  Subcellular localization annotation: CTP_CleavageSite=41; ConfidenceScore=5.40e-01
MAESSKKQKGSFSTTAAAGHRRHGPSEAPTTPIHPSLSSPRSSTLFSSDDQCLGYNSQFSSRIILDPKYLNTNFFNDETFDYYQVFQNSGLVDFMSLKLPYCPELVKVFYSNLKIQDGIISSEVHGIFMIIDQSLFFSLTKLPSQGAPFEGTIVDDWKFDYSNHDARRM

SEQ ID NO: 164938 - protein, 92 aa, Glycine max
  Coding DNA Sequence Number=SeqID_73253
MLWESPPTFIVENVRKTKNGYAKLRIRAWELFTHGEAPRPHFSILSSSSFPLLSISVNTKPWNLFLSPLHAYLYPKMAFGGPAACPGELELA

SEQ ID NO: 164939 - protein, 106 aa, Glycine max
  Coding DNA Sequence Number=SeqID_73254
MQHLMKLLERDQYIHWHRLKDEDVNDDDVNTMLMCNHQFSCVGTIELLCTIGRTPDGILNLLEATMTPTHDALLYYNGRWNMPCQHEFVGYLFIGKNPKKFDIPSG

SEQ ID NO: 164940 - protein, 241 aa, Glycine max
  Coding DNA Sequence Number=SeqID_73255
  Gene Ontology: Mol. function=motor activity; Cellular component=cell projection
  Homolog annotation: Hit_ID=UPI00016621D1; Match level="QueryCoverage =85%, HitCoverage=41%, E-value=4e-17, Identity=33%"; Hit description =UPI00016621D1 related cluster
PGQFLPFYKVMTKDKVDTSKPYTGAMRGIVHEPRVNLGADQKVDPWVLVPIAFRGLHVLAFRGLHALTFRGLHALACTGLHALTFRGLQVLAFRGLQVFAFRGLHVLTFRGPHVLAFRGLHVLTFRGLHVLAFKGLQVLAFRGLHFPSFRGPHALAFRGLHTLTFRGLHVLDFKGLQVLTFRGLHALLFKGLHVLAFRGLHVLACRGLHALAFRGLHALDFKGLHILAFGGPHVLDFRGLH

SEQ ID NO: 164941 - protein, 60 aa, Glycine max
  Coding DNA Sequence Number=SeqID_73256
MAEPPAAASADVDMPRHALEACQTIAERLECLINLRVVTKGTEAYTVTKEYLRIARGTTA

SEQ ID NO: 164942 - protein, 259 aa, Glycine max
  Coding DNA Sequence Number=SeqID_73257
MTDGFDEEAIAQILCTSGQDFARTAAGRRVRIMRTSMTTLTQMWMTLLLNNVLPSDHNSDLPLPKSRLVYAILTRMSIHVAQLIADAIYLFAGMPPTKHPLDPDKSNRALGFPTLITGLCHSFGVPVTPSKYCSRRKAQGDAPQAADAPPPPHQADPAGSLGMERYLQHLVRQQAANHWGQVQIHECLYQLSLSQQGQGFAPFACPTPDQFRAKVAWPGDWLEAHAGETPAGAPGDAEEACMDEEMTDLLSFLGGSGAT

SEQ ID NO: 164943 - protein, 50 aa, Glycine max
  Coding DNA Sequence Number=SeqID_73258
MALNSLHCMKSLTNNSNLSASWEVIRRNATMAVEFLEETVGLAVQQQGAD

SEQ ID NO: 164944 - protein, 59 aa, Glycine max
  Coding DNA Sequence Number=SeqID_73259
MSSGFGQYGDAAHKSAANTKDVNVHKIYQNSLTHAFYQTTPGVGIGGSVLQYPQPGKCR

SEQ ID NO: 164945 - protein, 110 aa, Glycine max
  Coding DNA Sequence Number=SeqID_73260
MINAGMICPLQCHEEMHDVIKEQARVLSAAMHHRERKTLDEASLLSSESETQHDHKSTSIPYGSHRPGSPVESPFAATYPTMGVQGETPKERLPKRKTCGSHHQRLFEEN

SEQ ID NO: 164946 - protein, 214 aa, Glycine max
  Coding DNA Sequence Number=SeqID_73261
  Gene Ontology: Mol. function=translation initiation factor activity
  Homolog annotation: Hit_ID=A2X8Y8; Match level="QueryCoverage=92%, HitCoverage=12%, E-value=1e-27, Identity=38%"; Hit description =Putative uncharacterized protein
LMRDRALYRVTSDFVDAAISGAVGVISGCIPPINPTDPEHLYIFSVDTDLQKLSKKSTDDNSQTWSTGTPHSSSEKSCDFQVPNGGNNDGSSSEDKFVILLYPILTELGLHKQMASIVVVVRPLQDAPAQQSNGAYVVLLLSINDMEVIQDIPPEAELAESDVATYASLNNDLNGTKADQEADVPGLHNLAVAIIDYKIFSLFCYIRKREKVKG

SEQ ID NO: 164947 - protein, 43 aa, Glycine max
  Coding DNA Sequence Number=SeqID_73262
MVEPSMKRKGTSSRSQRHSGSQETPIPSSIPSGSLFSSKEQWI

SEQ ID NO: 164948 - protein, 69 aa, Glycine max
  Coding DNA Sequence Number=SeqID_73263
MHEGMHITQMQLRNAGAREIVSFLDTTSRVSKVPQRDTDPPLVCLQRGSRQNPYAMHMQKTQYGNDNIH

SEQ ID NO: 164949 - protein, 172 aa, Glycine max
  Coding DNA Sequence Number=SeqID_73264
MNEVLGGYFAGKVLGIIVKLTAKAIAQGIGCERRGTKFMNNRGNELEDYIGGTPCEELGEDSKEIWNPIEQVGLNIGPDDQLDAIWEKATEQDEGMDANATTSQVQKKTKKKMDTSSSKVASTYQRPPPTLFAPNTTGAMAYVSRRVASKKQQPSSTVDCVMTRLIATISPL

SEQ ID NO: 164950 - protein, 80 aa, Glycine max
  Coding DNA Sequence Number=SeqID_73265
MSHAVKDNRGKWTPKYEGPFVVKRAFFWGCSNTHPHGWRRAVLARELRSRSRIISGHSQKSRQADGRNQPRYLGTEANGG

SEQ ID NO: 164951 - protein, 62 aa, Glycine max
  Coding DNA Sequence Number=SeqID_73266
MDTNAHAFLSCESKDRDRIVSSDGQYGAKSKTGMNRGTRPVINKSSSRDRLHTLRRPYWETT

SEQ ID NO: 164952 - protein, 60 aa, Glycine max
  Coding DNA Sequence Number=SeqID_73267
MYGSLPKFTLTFAFSEGVVPPYCLVLLIRCKFREMAPKKLSTKRSRRDACNILEISTRNF

SEQ ID NO: 164953 - protein, 250 aa, Glycine max
  Coding DNA Sequence Number=SeqID_73268
  Gene Ontology: Mol. function=motor activity; Cellular component=cell projection
  Homolog annotation: Hit_ID=UPI00006A2D9E; Match level="QueryCoverage =62%, HitCoverage=80%, E-value=9e-13, Identity=12%"; Hit description =UPI00006A2D9E related cluster
VARHCLQRTARPRLQRTARLHLQRIARPRLQRATRPRLQRAARLAFIGLHALAFRGLHALAFRGLHVFAFRGLHGLAFRGLHVLAFRGLYVVVFRGLHALAFRGLYVLAFRGLHALAFRGLHVFPFRGLHVLTFRELHVLTFRGLHVFAFKGFHVLAFRGLHVLAFKGLHILTFRGLHSLAFSGLHVLAFRGLHIRAFRELKFLGHPLDLGGGPTMRAQLEEEADHCKEMSADPAHQHDHSYADMDDVAT

SEQ ID NO: 164954 - protein, 224 aa, Glycine max
  Coding DNA Sequence Number=SeqID_73269
MEALREAGVIDLDGKKRDSCLMHPEVLHNVETCPIAEDLLQGLISRGQIEICSAKKEEGKVCLQLGERNMSKPKPLVIHFTRGITTHIPRGIQAHIAKTLGPFPCKSDKAVPWKYGVQGPNGRQDASDIRVGNGMPVAKIKNISGMSGMTRSGCIFSPPELLARSKDKGKEEADIGEREKTGPTVNDEALIGKIAKEGDDFSKREISTEEATGFSRIIQQSEFK

SEQ ID NO: 164955 - protein, 99 aa, Glycine max
  Coding DNA Sequence Number=SeqID_73270
MTGIPKPFDTFSRGAALEQVPIGAKSIIGFAHNQGKDLGRMRCRPQTTRPAKDVKEALLGGNLAMAPKKFSAKRARKATTGEGSSAASQAKIEFDRHCF

SEQ ID NO: 164956 - protein, 158 aa, Glycine max
  Coding DNA Sequence Number=SeqID_73271
  Gene Ontology: Mol. function=acid phosphatase activity; Cellular component=cellulose and pectin-containing cell wall
  Homolog annotation: Hit_ID=Q9LU48; Match level="QueryCoverage=44%, HitCoverage=27%, E-value=3e-21, Identity=68%"; Hit description=Acid phosphatase
  Pfam annotation: Domain name=Acid_phosphat_B; Domain location=6-157; Score=-26.5; E_value=2.7e-06; Accession=PF03767.5; Description=HAD superfamily, subfamily IIIB (Acid
MNPTDFRFLLAPSSIEAPSPVLPLKLLPLLPLKLLQLFDFIAPTSPLEASLIGSCTVEERLEVFDREKFNNWVEKGVTPAIEPSLKLYEDVLNLGFKVILLTGRSERRRSVTVDNLINAGFKEWDQLILRRNLANNPLIPASFFRWTAESAYLKSSWR

SEQ ID NO: 164957 - protein, 118 aa, Glycine max
  Coding DNA Sequence Number=SeqID_73272
  Gene Ontology: Mol. function=nucleic acid binding; Cellular component= nucleus; Biological process=mRNA processing
  Homolog annotation: Hit_ID=Q9FT01; Match level="QueryCoverage=57%, HitCoverage=17%, E-value=9e-22, Identity=80%"; Hit description =Putative splicing factor
MPLKATELFFKSWQGQLLLNLIYFCHWNFDDLPIELFFLHWNFIDLCCQLLLGQLVMVKPSEAEKNLVQSNAYGGAAGVTGPYGAVDQKLYVGNLHFNMTESQLWESFGMFLGLCYIY

SEQ ID NO: 164958 - protein, 128 aa, Glycine max
  Coding DNA Sequence Number=SeqID_73273
MTRGNLGDLQSFDPEIDRTFHRLVRHSVHPDHSVHFEHSEYFVACDSEYSDFEHSTTNFHTENMAQPPPCERTLREMAAPDFTYESLCIQYPDEDPHKHLSYPNFVRGPLLDDMRPFFGPCEVLGTHH

SEQ ID NO: 164959 - protein, 180 aa, Glycine max
  Coding DNA Sequence Number=SeqID_73274
MITIVKQKTIILTTQPMLMNQVDWARDAREGPRVLMSLRTHLLLEVTSPLSLPFSIPLPFIFQEAKESIDEEDPRPTSSNGACISESSRHQQLEVLQMVLEKVSLAVRCGLWMYLVEACEHVTPSANTHQNERDLEVVNYEMSDFLGSFLGSILTKCIQCNKKKNIKGEIPEDIHRSLRA

SEQ ID NO: 164960 - protein, 203 aa, Glycine max
  Coding DNA Sequence Number=SeqID_73275
  Homolog annotation: Hit_ID=A7UQU7; Match level="QueryCoverage=64%, HitCoverage=23%, E-value=2e-07, Identity=30%"; Hit description=IMP dehydrogenase/GMP reductase, putative
RALSREVSHDADEGPQRRRPTTSARRQWEVTPIAEDVKHVDHATKEVHEQPQEAPAADVVSDVEGFPDRPHNTSVLMDYVHHVTVIVWNEEERFELKLFSHGRKVEKFGRSAPKIESLVVVTGLSPLIACSLDNGDRGLVSTFAERWHKETSSFHLLVGGRQEQRRYNAMGHMFVYPGYETYIGANVTWQSGLWQLQHICCIY

SEQ ID NO: 164961 - protein, 100 aa, Glycine max
  Coding DNA Sequence Number=SeqID_73276
MVVIIKKRENVNTTATTSTVVCGQVEVVAVVGLAINSGGKIDEDQWMYDIIMSEEVDMNEQNEDEAGVNEEHVDYCDAFNTFQVFATLDDVLHWARSIAY

SEQ ID NO: 164962 - protein, 127 aa, Glycine max
  Coding DNA Sequence Number=SeqID_73277
MELHQLEKLLILRILTGGTEAYTVAEECLSIARSYIDQPIGGHRSRSPDGILNLLQATMTPTHDTLLYYNRRWNMPHQDDFMGYSFTGKNPKRFDIPSGCSIDGIKDVIMQVAPQGIPLMVFMNHKW

SEQ ID NO: 164963 - protein, 58 aa, Glycine max
  Coding DNA Sequence Number=SeqID_73278
MGSKIYPKNDPAWVGDLEDTEDAFLVVGSGRASLKPFPELQPPLREVPTALGGITVFL

SEQ ID NO: 164964 - protein, 98 aa, Glycine max
  Coding DNA Sequence Number=SeqID_73279
MKRENGERISDAERDLGAIAGGRSEKRGSEERESNHWRRRRRREQNSNPRKLKSGLLRFMHKRGSATWMEKWEPMSLVVGGGSKEDEAVGGGDGLREG

SEQ ID NO: 164965 - protein, 110 aa, Glycine max
  Coding DNA Sequence Number=SeqID_73280
MDEDQWMYDTIVSEEVDMDDQNEQECGVNEPQVDCSDAFNTSQWARSVAHENRFMAVIIRFDTNTGVVSIGVGRMNLLEEILGIRKCGCPFKLCGKPVVRGQGWDGEVDV

SEQ ID NO: 164966 - protein, 265 aa, Glycine max
  Coding DNA Sequence Number=SeqID_73281
  Homolog annotation: Hit_ID=A2Q4S5; Match level="QueryCoverage=26%, HitCoverage=10%, E-value=1e-07, Identity=41%"; Hit description=IMP dehydrogenase/GMP reductase, putative
  Subcellular localization annotation: CTP_CleavageSite=62; ConfidenceScore=5.52e-01
MFLCSMLKPKVVNFNPLFSHHAKRTVAALSGRCALSPQRRRPTTSARRQREVAPIAEDEPVVAADVHAPDADAGHDAEGFPGGRCDPSEHLELKLSSHGRKVQKFGRLAPEIKGLVAATGLSPLIACSVDTGDRGLISAFMKSITLDDVVSLLHLPIVGAFHNFEPLHVDEAMLMLVELLEVSGEEARAETTQYHGPYCWIYEHFPSVAEYMADSDYDEVSPRACRWNATKATLKSISIATYRQRLDRLRIPDVCWMPYGEHRPV

SEQ ID NO: 164967 - protein, 310 aa, Glycine max
  Coding DNA Sequence Number=SeqID_73282
  Gene Ontology: Mol. function=aspartic-type endopeptidase activity; Cellular component=small subunit processome; Biological process=DNA integration
  Homolog annotation: Hit_ID=A5AE61; Match level="QueryCoverage=59%, HitCoverage=14%, E-value=5e-24, Identity=34%"; Hit description =Putative uncharacterized protein
MSQSWFDVGHGSDKEDGGGKELGMASSISSLIVIGAGGGVIRRRRCRHFPAAISPAKPGLGLPWEAPRAAPPPFPPSAPPESVPALSFQFPGFILWVKMTSPGPVFSFSGTPTITAAKLNWKNYPSWSASVELWFLGQGHHDHLEKASDSVSSDKEPNGRNLTINCAQEIFANDVQSLFDATMKVTALKQTSHDMIAHVGKARATVEELRKFLVADSLEEVNRKLDKFYMVLILRSLHSDFDHVRDQVLAGDQVPSMDSLITRLLRVPHVSKDENPTDSVETSAMVASRGRGGGRNSRGGRSGRGERPHC

SEQ ID NO: 164968 - protein, 93 aa, Glycine max
  Coding DNA Sequence Number=SeqID_73283
  Homolog annotation: Hit_ID=A5AV22; Match level="QueryCoverage=84%, HitCoverage=6%, E-value=3e-16, Identity=51%"; Hit description =Putative uncharacterized protein
MCFMSQNICEFYYEEKVHYEAWERSNKLSLMFMRMIVADSIKTTLPKTDNAEEFMGLVGERSQTTDKSVAGTLMSTLTTMKFDGSRTMRMSLR

SEQ ID NO: 164969 - protein, 43 aa, Glycine max
  Coding DNA Sequence Number=SeqID_73284
MDRRLQEDWAKDAREGPRVLMSLRVGYPRIVGFFSPCILGHQD

SEQ ID NO: 164970 - protein, 159 aa, Glycine max
  Coding DNA Sequence Number=SeqID_73285
  Homolog annotation: Hit_ID=A5BQA5; Match level="QueryCoverage=38%, HitCoverage=15%, E-value=1e-07, Identity=42%"; Hit description =Putative uncharacterized protein
MEGVFPSVGMLDPLEKLEWGNSPKPKPSVEEPPELEFSSFLPASILKDNNEVFGWITHDIKGLDPTLSTHKFNIEEGFPPKWLFQKRLNPNIMEVVKREDVKPTFKTNAHKVKARDVKEVLSGRQPVIALSIKYDRHHLTMTQTVIIGVEYNCGDSTTV

SEQ ID NO: 164971 - protein, 104 aa, Glycine max
  Coding DNA Sequence Number=SeqID_73286
MVEAHSISFQWYPTTSCLDMVLMLFMIQPYTGALPQGLLFYFAPNLISRWSRKQKVTVRSSTEDEYPTLDQWADILTKPLFAPRFEVLQGKLNVKSVSPENSSP

SEQ ID NO: 164972 - protein, 270 aa, Glycine max
  Coding DNA Sequence Number=SeqID_73287
  Gene Ontology: Mol. function=aspartic-type endopeptidase activity; Biological process=DNA integration
  Homolog annotation: Hit_ID=A5BFT3; Match level="QueryCoverage=34%, HitCoverage=6%, E-value=1e-11, Identity=39%"; Hit description =Putative uncharacterized protein
MKTRARQLRTVMRAVTLDGKTIEEYLGKIKGFVDELAGVGVLVHHEEYVDALLEGLSSDYASVVSVIESKKQTPSTAKIEALLYGHETRLMRYNKEAQAICIPTPIKLVVLAMHVVVVVVVVPFWTVVRAMVVVASAEIVVVDDLQIFNVKYVSNLGTQLMFVIFGMMRPSILMNLYLSLIPLHYNLSHTLLVQSEPQTPGLIQILRILVQFIVNSVSCSLVQPLKGMAKLRPIRSFLKELLVLMDFTPFIISSFKRVTADVCCFKCCLS

SEQ ID NO: 164973 - protein, 80 aa, Glycine max
  Coding DNA Sequence Number=SeqID_73288
MIVSLMLVVVAMLVVASSGGNMVVVVVAVTMTLIVMVMVMSSSYGSDNDGGIGGGNDKGGIGGCGDNDIDGGADGDVDFI

SEQ ID NO: 164974 - protein, 230 aa, Glycine max
  Coding DNA Sequence Number=SeqID_73289
MGFTLVDLQKVGYNDDPFIMAAQDESLKNLIWDDILGKFDIPKGDKAKKKVMSTVATRWGQFKSSLMTKYVYADNEGQQKDDPSVKYGFDAATWVEFAKSHQTPNWQDFLEEQTMQGSFVPHGREDILNTAIGRPEHPGRVRATGTGVTITQQQLVEIIGNLKEERRKEVEEENNNLQEAWRRKVDTRGLYVVSEESTQLVALGKVYDSSSTIHNVSYADDVVRVRVVKV

SEQ ID NO: 164975 - protein, 140 aa, Glycine max
  Coding DNA Sequence Number=SeqID_73290
MEVPEGPGTDDDSGGAGAEGAGGVKEEGAVVEASGPRARALRVLGKVIVGSSRFQQFFFMYAKLMAGLKDLNVNDYGTTPRATHRAVMSAGKLSLEELEYDRTLQVCASVVKSFLKSFQGAPSALSTYPFLGMQSLVASS

SEQ ID NO: 164976 - protein, 222 aa, Glycine max
  Coding DNA Sequence Number=SeqID_73291
  Gene Ontology: Mol. function=phosphatidylinositol binding; Cellular component=clathrin coat; Biological process=clathrin cage assembly
  Homolog annotation: Hit_ID=A7P5U4; Match level="QueryCoverage=76%, HitCoverage=29%, E-value=5e-37, Identity=44%"; Hit description =Chromosome chr4 scaffold_6, whole genome shotgun sequence
  Pfam annotation: Domain name=ANTH; Domain location=2-209; Score= -21.6; E_value=4.4e-06; Accession=PF07651.7; Description=ANTH domain
MENSSEDFSKSHGNRLNKTRDWIVAIKAFLLIHRLLLDAHPAFQDKIMHSTRLDTSRILNMSNFKDDAHSNSSDQVGFVRVYSLYHDAKVDFVAYRRKLSNGVVESVEFRDEFGFVERERERNEVTPVREMGDERVLKRLNRLLWMLDRVLGCRPSRAAKNNSLVLVALYQVVRDSFKLYAEMEYEHYVVGSMCEGLFLIQSKDLPHRHMTNSGNWILTVGT

SEQ ID NO: 164977 - protein, 177 aa, Glycine max
  Coding DNA Sequence Number=SeqID_73292
  Homolog annotation: Hit_ID=A5BKB8; Match level="QueryCoverage=61%, HitCoverage=25%, E-value=1e-14, Identity=46%"; Hit description =Putative uncharacterized protein
MGGGAWPFLVGGAICLVNSVNERDLSLLNSYVEVCDALRCSGPHARYTDVFNESIALADRSLQLLVFNEGIPSKRESSARVDYVPCPLYTPPRRSYRLNGSGEGVRIAATRSRNKVSVGEPAEGSLSMPHNQIDPRTCLFIYRREGGDDHGAPCARPPRPRDKHKPRRFVRQGTQIC

SEQ ID NO: 164978 - protein, 149 aa, Glycine max
  Coding DNA Sequence Number=SeqID_73293
  Homolog annotation: Hit_ID=Q6WAY6; Match level="QueryCoverage=66%, HitCoverage=17%, E-value=1e-13, Identity=40%"; Hit description =Putative uncharacterized protein
MFGGKSKNLGNFTPFLPRGEACHRSCTEKGGANWDQLLANKEGASVNWFPRWKEGRTGVLISCGGFPNVPLMGTRGCISYNLVLAIRQLGYPMRGAPLEDELSPVISRGFNKTNMETLQKVRKAWEVLQKKDKELRVVTMGPSVAIVSG

SEQ ID NO: 164979 - protein, 153 aa, Glycine max
  Coding DNA Sequence Number=SeqID_73294
  Gene Ontology: Cellular component=chloroplast
  Homolog annotation: Hit_ID=Q49KT9; Match level="QueryCoverage=56%, HitCoverage=92%, E-value=4e-26, Identity=63%"; Hit description =Putative uncharacterized protein ORF113
MGAGHARSRYLNRKEGDAEGRASDWSEVVTRALSHMDSLMCSSAPDPEMWIIQGTLAWRTSPVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 164980 - protein, 169 aa, Glycine max
  Coding DNA Sequence Number=SeqID_73295
  Subcellular localization annotation: CTP_CleavageSite=41; ConfidenceScore=5.01e-01
FPSFVGAAECIHRSESVLTGATRLRSPPTTNPGGPPRSPLRAPQTTDTKRDARYYEHSGISDLSCVSLRTSFVRPSALCGVILPQDATTGNISARSTFDWLATPRVGTKNTDHESHGSRATYVHGRADVTPREGTYSRKAFSANHPKHQKVDSFVREATQTQNSFSLLL

SEQ ID NO: 164981 - protein, 356 aa, Glycine max
  Coding DNA Sequence Number=SeqID_73296
  Gene Ontology: Mol. function=motor activity; Cellular component=cell projection
  Homolog annotation: Hit_ID=UPI00006A2D9E; Match level="QueryCoverage =92%, HitCoverage=100%, E-value=3e-16, Identity=17%"; Hit description= UPI00006A2D9E related cluster
MRGQHALTFRGLHVLAIRGLHVLAFRGLHALTIRGLHVLTFRGLHALAISGVHVLTFRGLHDLTFRGLHLLICRGLHALTYRGVHVLGFKGQQVQTFRGLHVLPIKGLHALAIRGLHALAIRGLHVLAIKLLHALTFRGLHVLTFKGLHALTFRGLHILTFRMLQVLTFRGLHVLAIRGQHALAYRGLHVLAIRGLHALAIRGLHVLAITWLHALTIKELHVLAFKGLHALAFRGLHVLAIRGLHVRAFRGLHALTLGGLHVLTIRGLHALAITRLHVLAFKGQHVQTFRGLHVLPIKGLHPSPSEDYTPSPLENYTFSPSEDYTPSPSEDYTSSPLECYKCSPSEDYTSSPSEGC

SEQ ID NO: 164982 - protein, 193 aa, Glycine max
  Coding DNA Sequence Number=SeqID_73297
  Gene Ontology: Mol. function=endonuclease activity
  Homolog annotation: Hit_ID=Q2HUP4; Match level="QueryCoverage=23%, HitCoverage=14%, E-value=4e-09, Identity=66%"; Hit description =Endonuclease/exonuclease/phosphatase
MTNEEHRTNNDVEVDYGRNSEIRASGTMVAHPSELLLSPEETGSLKRAAARPGVLQDIPQGEKVFLGGDLNGHVGSVARGFEGVHGGFGLGEMNGEGKSILEFSEALDLSVANTWFKKREEHLITYKSGGTCSQIDFFLIRKSDRKYCLNCKVIPGESLTTQHRVLVMDVRIRDRAKRRSPIVAPRIKWWHLK

SEQ ID NO: 164983 - protein, 42 aa, Glycine max
  Coding DNA Sequence Number=SeqID_73298
MDVPVDIMHLLHNNHLEEGPSREDNGYKSTTPNWIQVSPQQG

SEQ ID NO: 164984 - protein, 238 aa, Glycine max
  Coding DNA Sequence Number=SeqID_73299
  Homolog annotation: Hit_ID=Q6L477; Match level="QueryCoverage=71%, HitCoverage=31%, E-value=3e-07, Identity=27%"; Hit description =Putative uncharacterized protein OSJNBa0009L15.8
  Subcellular localization annotation: CTP_CleavageSite=51; ConfidenceScore=5.72e-01
MATSPVSPPPPLPPPPTDASASPSTLKRTRKATRLRTLATRPPGAERPVVNVDPATGKAEGLHKKKLRTYLEIVACDKVDITYDTWKEVPTAQKDLIWEDIQRQFKSDLTRKWALAADKDGANDIVCEKYGISREKWAQFCQTPKDPSWEDVRKKAQASQKQNTAPHVLSRGGYEYLEEKLMAEKTKKRLEEAAQSGSTESIIDPPSPIRRHVKWKMARTKKTGQMTSEAAKEIANRI

SEQ ID NO: 164985 - protein, 142 aa, Glycine max
  Coding DNA Sequence Number=SeqID_73300
VYEENDGVIFEGSKKAIQIKFFGKYVALQICDDEDVETMLESFQQQNQMSVLELYIEKDVTGGSMFHSANSLTCGNNLSNNEAQLPTNVSNLHGDDDDDDYLVSNSYVEESLDEDDSVDDISDTDDEVADMIQPVRIVHLAE

SEQ ID NO: 164986 - protein, 119 aa, Glycine max
  Coding DNA Sequence Number=SeqID_73301
MGKLDHLEERLRAIEGGEDYAFANLEELFLVPNIITPPKFKVSDFDKYKGNTCPKNHLKIFADLVFAGKRIETGLKRGKFDHPALMNEKTGANEEDENEEGNHVEVVIPTWPNFAPAQQ

SEQ ID NO: 164987 - protein, 183 aa, Glycine max
  Coding DNA Sequence Number=SeqID_73302
  Homolog annotation: Hit_ID=O52175; Match level="QueryCoverage=44%, HitCoverage=94%, E-value=2e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLAKLKGQVLVTALLQASYLGSRVGSSENLRKTALQGGFSFSEQRYAQTKRSQKIIYIR

SEQ ID NO: 164988 - protein, 118 aa, Glycine max
  Coding DNA Sequence Number=SeqID_73303
MTRGNPGDIQPFDPEIDRTFHRLVRHSVHPGHSVHFEHPDHFEHSVAGDSEYSDFKHSVVNFHTENIAQPPPRKRTLREMAAPDFTYESLCIQYPDEGVPYVKILISILRSSILFVPP

SEQ ID NO: 164989 - protein, 173 aa, Glycine max
  Coding DNA Sequence Number=SeqID_73304
MAPRKLSTKRSRKDVAAEGTSATPEFDSHRFRSAEHQQRFEAIKGWSFHRERRVQLRDDEYADFQEEIARRCWTSLVTPMAKFDPDVVLEFFANAWPTEEGVRDMRSWVRGQWIPFDAGALSQFLGDSLVLEEGQECEYSQRRNRADGFDEEVIAQLLCIPGQDFARTAAGRR

SEQ ID NO: 164990 - protein, 162 aa, Glycine max
  Coding DNA Sequence Number=SeqID_73305
  Homolog annotation: Hit_ID=A5AIK9; Match level="QueryCoverage=67%, HitCoverage=7%, E-value=3e-12, Identity=36%"; Hit description =Putative uncharacterized protein
MTRDNPSDLQLFDPEIDRPFHRLARHHFVPFEHREHSIIGESEHSVVGNFEHPDFEHSENMAQPPSRERTLREMVAPDFTYESLCIQYPDEDVPYVLKTGLIHLLPKFHGLAGEDPHKHLKEFHIVCSTMKPPDVHEDNIFLKAFPHSLEGVAKDWLYYLAP

SEQ ID NO: 164991 - protein, 101 aa, Glycine max
  Coding DNA Sequence Number=SeqID_73306
  Subcellular localization annotation: CTP_CleavageSite=23; ConfidenceScore=5.31e-01
MTTDSPPLLMFPWTQSPVESPTVATYPSTGGRRGAHGCVFQERKMHGVFTNVYLRKTSEKMERCGLRTLSVKGSGVVFTHGEGCFPCSYVFLNCDKEIRPT

SEQ ID NO: 164992 - protein, 74 aa, Glycine max
  Coding DNA Sequence Number=SeqID_73307
  Homolog annotation: Hit_ID=A6FJQ2; Match level="QueryCoverage=51%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARWVLKGSINLLSQKLSMKANERERS

SEQ ID NO: 164993 - protein, 100 aa, Glycine max
  Coding DNA Sequence Number=SeqID_73308
MVAFVRQYQYYSDMVPDRMQLQNMCKKGDDNRDVKGSMWVRKGGKFGHPTRTTEKTGANKEGEKEGETHAVTAIPIRPSFPPTQQCHYSANNKPPPYPPP

SEQ ID NO: 164994 - protein, 119 aa, Glycine max
  Coding DNA Sequence Number=SeqID_73309
MEYFDVQVAWPGAQPSPSRGGGAFATQEPVLGETAAVEGEDELTPPEPSYFDAGIHMAQEEDASTDQIHEPSSALVPNDATPSTPAPELEQPISQDSPVPQVLDLNEHAQEKPHDEQDI

SEQ ID NO: 164995 - protein, 134 aa, Glycine max
  Coding DNA Sequence Number=SeqID_73310
  Subcellular localization annotation: CTP_CleavageSite=86; ConfidenceScore=5.00e-01
MSLRLPGYGKLKILCWIFLVAFYSSMPLPCSRRCMPFLGSFNSGNWSDSDDLDRTGLSCRTITRNWVFYMHRSPTSNLVPLDLEIEATLRRNRAERRRKLLQDRTVASILEEETHFSDSLSPDSPSSRESATHC

SEQ ID NO: 164996 - protein, 186 aa, Glycine max
  Coding DNA Sequence Number=SeqID_73311
TSRGNGPLQLIRTVWTTIVCEKYGISKEKWAQFCQTRRDPSWEAIQKQNTAPHVLSRGGYEYLKQKLLAEKTKKKLKEAAQSGSVDGVIDSPSPVRRHVKWKMADTKKTGEMTTEAAMRITEKIDVLTAAIGRPEHPGCVRAVGAGVTIRQYFGSAPRTSCSSSLLPPEELQQLTQQIRDQLEERS

SEQ ID NO: 164997 - protein, 101 aa, Glycine max
  Coding DNA Sequence Number=SeqID_73312
MTKHQRSTKRDLSYWEYVDALHSVQNSNFLVKHSASSSDQGIPRRTMPMLDQFHLCIHDSIENIVDIKADGNCGYRAIDALLDMGEDSWSLVRNHLLKEMV

SEQ ID NO: 164998 - protein, 276 aa, Glycine max
  Coding DNA Sequence Number=SeqID_73313
  Gene Ontology: Mol. function=DNA (cytosine-5-)-methyltransferase activity; Biological process=DNA restriction-modification system
  Homolog annotation: Hit_ID=Q4AM33; Match level="QueryCoverage=81%, HitCoverage=55%, E-value=1e-89, Identity=67%"; Hit description =Cytosine-specific methyltransferase
  Pfam annotation: Domain name=DNA_methylase; Domain location=1-235; Score=-148.7; E_value=0.074; Accession=PF00145.8; Description=C-5 cytosine-specific DNA methylase
AMRQLFRESGYETEYRILSADDYGVLQTRKRIILVGRKGCMTGFYPEPEKWNPAVRVAEVFNDLPSLKAADGQVSPCQLKPYAGKWLYEAGIRNDAMPVTWHQSRPNTAQDLEIYRRVVEQWNQKQKRLEYNELPDYLKTHNNRTAFVDRFKVVAADLPSSHTVVAHLSKDGHYYIHPDISQNRSITPREAARLQTFPDDYYFESIKPKPGRTAAFRQIGNAVPLIQDSYAAVVELVKNAYDADSPNVDICFKAKEDRMGYTVTVQDHGHGMSRDT

SEQ ID NO: 164999 - protein, 89 aa, Glycine max
  Coding DNA Sequence Number=SeqID_73314
  Subcellular localization annotation: CTP_CleavageSite=46; ConfidenceScore=5.33e-01
MANFKPYPGYATKGPTFGGMPQPNTLRGPQHRPLQPLHFSVGRLPPAMEEREKFDLIEERLRAIERIGDYPFADMTELCLVPDVIIVRF

SEQ ID NO: 165000 - protein, 173 aa, Glycine max
  Coding DNA Sequence Number=SeqID_73315
  Gene Ontology: Mol. function=transporter activity; Cellular component= integral to membrane; Biological process=transport
  Homolog annotation: Hit_ID=A3XHV6; Match level="QueryCoverage=83%, HitCoverage=29%, E-value=2e-59, Identity=75%"; Hit description=Sugar transporter
MNVGFFGIQYSFGLQQTAVNPIYSFLGAHAEQLPILNLAGPITGLLIQPLIGAISDKTWSPKWGRRKPFFLLGALFCSIALFLFPFSSTIWMAAGLLWILDAANNTAMEPYRAFIGDKLPEDQQTFGFQMQSLFVGAEISRRKFYERRYSGLGLLFVFLRFLLLHCIGSLVCV

SEQ ID NO: 165001 - protein, 201 aa, Glycine max
  Coding DNA Sequence Number=SeqID_73316
MCDSVIDTFLNIKGKTIDGLNTCQDLAEMGIRDQLHPRSDGLSFVDLLILASPLTMLNSSYNAKQGIIRCFDQEGKRYQERRGKGSLVFLNPSPPRLASSSPGPPNAFKVKKPARLGKLMTLGLSLSSPGRAASAPSDPFPINKRARGAERGFHHRVVKEIERIKREEEERRGNEAEALPNHDCDQSLRCSLFSVLHANVS

SEQ ID NO: 165002 - protein, 260 aa, Glycine max
  Coding DNA Sequence Number=SeqID_73317
  Gene Ontology: Mol. function=pyridoxal phosphate binding; Cellular component=chloroplast; Biological process=amino acid metabolic process
  Homolog annotation: Hit_ID=Q9XFG0; Match level="QueryCoverage=67%, HitCoverage=31%, E-value=1e-48, Identity=63%"; Hit description =Cystathionine-gamma-synthase precursor
  Subcellular localization annotation: CTP_CleavageSite=34; ConfidenceScore=5.76e-01
MASFRSRRSSLPPKPTTATASPCRASTPTRASLRSSAGSGTVNIGIAEIVAASWSNNSDNSPAVGASAPPATTAADAATVPLPVDVAATEDIIVFAAATKNGTIQLNNSSYSFLKSDASKMIHAAERLGTGIETDGITTLVLNTSAYFFKKTVDLIDFKENRQVSYEYKRYENPTTVLLEEKIRFVVIINPSILEGAESTVILASGMSKKTRKGKSPGKGGNRFWKSIVLGFKTPMEAIEGMSLFYVNDENPLFSGLSLL

SEQ ID NO: 165003 - protein, 130 aa, Glycine max
  Coding DNA Sequence Number=SeqID_73318
MQSLQSSGLPSIMSTYEFLTQVAWPGVQPSPSGGGGTSAAQEPEQAIEELVLAEDELTPLEPFLVAVDTSIAQEGVSSPDSMPEPSPTPISEDTMPSVPAMEPEQPILQDAPAAPVLDLNEDQPQDEQDV

SEQ ID NO: 165004 - protein, 78 aa, Glycine max
  Coding DNA Sequence Number=SeqID_73319
MGLSLAIIGASMRSFNGDFPPWRCSGRQRRRGEGRHHPLGNKPWKKEFHHQECALDKKLEEDALMEEKKEREQERGRA

SEQ ID NO: 165005 - protein, 124 aa, Glycine max
  Coding DNA Sequence Number=SeqID_73320
  Homolog annotation: Hit_ID=Q40443; Match level="QueryCoverage=90%, HitCoverage=40%, E-value=2e-20, Identity=46%"; Hit description=Tumor- related protein
MAFLWIGGRRPSMAFHLLYSKFGLQFEARFDELIRGLRTHDLGDISASQLAQLDETQRRTIIEEREVTDLMETHQESLVDAPMVELSHVVAEMIRANETGENKEIEDKVESTLCQWWKVWRRFR

SEQ ID NO: 165006 - protein, 658 aa, Glycine max
  Coding DNA Sequence Number=SeqID_73321
  Gene Ontology: Mol. function=phosphoprotein phosphatase activity; Cellular component=nucleus; Biological process=multicellular organismal development
  Homolog annotation: Hit_ID=A7PCA4; Match level="QueryCoverage=99%, HitCoverage=99%, E-value=0.0, Identity=61%"; Hit description =Chromosome chr2 scaffold_11, whole genome shotgun sequence
  Pfam annotation: Domain name=PP2C; Domain location=360-622; Score =15.5; E_value=7.9e-07; Accession=PF00481.12; Description=Protein phosphatase 2C
MGSGVSTLCWCSGTNNEPDVIFSATDPLDETLGHSFCYVRSSARFLSPTHSDRFLSPSTSLRFSPTHTRPEFHETGFKAISGASVSANSSLPTTVIHLDEEVNGVSSRGNIVNGFESTASFSALPLQPVPRGGEPFEVSGFFLSGPIEANAVSGPLPSAAAYGVGGGDVPFSAPLAGLYSKKNKKKVISGFRKTFNRNTPEKKRPWVVPVLNFAGRKESEGRPQQPPQAAAAASNVQWALGKAGEDRVHVVVSEELGWLFVGIYDGFNGGDAPEFLMGNLYRAVHNELQGLFWELEEEEQPLPQESNPVVEGTESKRRKLWELLAEDGLDLSGSDRFAFSVDDALSVNNANAGSAVSRRWLLLSKLKQGLTKQKEGEGRGWNMGNEEKERENQEKHCGRKRRVGPVDHGLVLSALSRALEVTELAYLDMTDKLLDTNPELALMGSCLLVALMRDEDVYVMNVGDSRAIVAHYEPKEVDSSVELGSKRGVESGAQSIVEVPLGLGQIGSAQQKRLVALQLSTDHSTSIEEEVIRIKNEHPDDAQCIVNGRVKGRLKVTRAFGAGFLKQFLILSSDGLYQYLNNDEVVSHVESFMEKFPEGDPAQHLIEELLLRAAKKAGMDFHELLDIPQGDRRKYHDDVTVMVISLEGRIWKSSGKYP

SEQ ID NO: 165007 - protein, 108 aa, Glycine max
  Coding DNA Sequence Number=SeqID_73322
MIELVQQDLHHHHLYPNESTLIHRYMVVDASSIGACRPRIFFINGFLCFLEDEWQRNGERKRERRRHFKEKMSLEEAHHHRRPWIRAWRKKEMNEGRGKEEHEILCSK

SEQ ID NO: 165008 - protein, 322 aa, Glycine max
  Coding DNA Sequence Number=SeqID_73323
  Gene Ontology: Mol. function=binding; Biological process=thiamin biosynthetic process
  Homolog annotation: Hit_ID=A7QRN2; Match level="QueryCoverage=23%, HitCoverage=13%, E-value=2e-19, Identity=61%"; Hit description =Chromosome undetermined scaffold_151, whole genome shotgun sequence
  Pfam annotation: Domain name=PPR; Domain location=248-282; Score =33.1; E_value=1e-06; Accession=PF01535.11; Description=PPR repeat
MAEANRSKTRMESIEEAIAKLASNQLHVTTKLDKLIQRITVLETSQHHSPTPPSSSSVKAPLAHTPLPIPSPRPALMPQHPTPLPASLTSRGDTTRKLVAPFHPTLPLESGKNIHRGTRLPLNVLSVGNRVPQTILEKVLKDSASQTTNPEFHNVLHVVAQHHLVPLGSSLASFPRPPYLLPSPPPPPPKPRPPPRPQSARVCALWTMMFDRKADILLLITLLDVYAKTGDLDAAQKMFDNICKRDIASWNAMISRLAQGNRPNEAIALFNKMKDEGWRSNEVTVLGALLYSCTFLLSILSLLFQLDFLIAHFSFSTPPSFP

SEQ ID NO: 165009 - protein, 122 aa, Glycine max
  Coding DNA Sequence Number=SeqID_73324
  Homolog annotation: Hit_ID=A7PCB0; Match level="QueryCoverage=65%, HitCoverage=14%, E-value=8e-18, Identity=55%"; Hit description =Chromosome chr2 scaffold_11, whole genome shotgun sequence
MASNESRRMITGNLRKHVLAFGDKLRMLPSLAWESVWKMGRDDPRRVIHAFKVGFSLIIIVSLLYLLEPIFNGIGENVIWAVMTVVVVFQFTAGVLKLGVFTPKAYTPKSPSGPLPPDSGST

SEQ ID NO: 165010 - protein, 57 aa, Glycine max
  Coding DNA Sequence Number=SeqID_73325
MDHNIEYDFILLSYIQEPSQYLFTISKLKIVAISLNRTSFLSFVLDLTKGKVEGGNE

SEQ ID NO: 165011 - protein, 297 aa, Glycine max
  Coding DNA Sequence Number=SeqID_73326
  Gene Ontology: Mol. function=metal ion binding
  Homolog annotation: Hit_ID=A7PCB1; Match level="QueryCoverage=50%, HitCoverage=20%, E-value=5e-50, Identity=67%"; Hit description =Chromosome chr2 scaffold_11, whole genome shotgun sequence
  Pfam annotation: Domain name=zf-C3HC4; Domain location=205-238; Score= 0.3; E_value=0.085; Accession=PF00097.16; Description=Zinc finger, C3HC4 type (RING finger)
MADVAGRRKMAEFFFFVRASTQRDLGTSHDHCNQPRNQPRVTRCTQQPAATTHGVNGGDEHGSDEHGVNDGDANGEDDPEPRPRLILVKWKEELKAKEEALALVEEERHSKEAAESNNKRKLETLRLKIEIDFQRHKDDLLRLEQELSRLKASAQSAELHNQSSTSPTSDSEGAKPQRETIARLLQELDNLEDLSEKEVNSNRECIVCMKDEVSIVFLPCAHQVMCASCSDEYGRKAWKAQALVGVNLLNWIVPNLSSVKLERCMCFRLVSYARRSTTSQALSLKGMCLFKMTFLAE

SEQ ID NO: 165012 - protein, 634 aa, Glycine max
  Coding DNA Sequence Number=SeqID_73327
  Gene Ontology: Mol. function=metal ion binding
  Homolog annotation: Hit_ID=A7PCB1; Match level="QueryCoverage=86%, HitCoverage=76%, E-value=0.0, Identity=65%"; Hit description =Chromosome chr2 scaffold_11, whole genome shotgun sequence
MGCTMREKHIRANRRPRSVKPDSDSCDKDAISKSIAESGLKPFKYHLDLNDSSQSPNSNPNVEETGWGYCTEEQLEEILLKNLEFIYNEAVSKLVALGYDGDVAVKAILRNGHCYGGMDVLTNILHNSLAFLNTNSDGDGGGYSSNGGNLHESEPVFSDLRQLEEYSLAGMVCLLQQVRPHLSKGDAMWCLLMSDLHVGRASAMEIPVPDNGSTVPATGEGGANSAGVMAPALCRFHGGWGFGNGGGLEFPVNGIFSCGAEMNLQLQRDIEFPKRLNLSPSMKSLLKRNVAMFAAGFRANSKQLQAQVKAFPGRSTAPNLDSLDVSGTEVLAEQSGGDSENLDNQDAVNSVLSKFRDLNLDENLDLVAEDQKDEVIVSLFHQIRDLEKQVNERKDWAHQKAMQAARKLSSDLTELKMLRMEREETQKLKKGKPELEDTTMKRLSEMENALRKASGQLDLANAAVRRLETENAEMKAEMEASKLSASESVTACLEVAKREKKCLKKLLAWEKQKAKLQQDISDEKEKILKTQEILVQIRQCQKEAESKVIDWTYISHVGIKVTYFNPRCSLICKLSFLGWTLLALERLEVETHWKRLVARDKPTPKQGSVHTQEWVESPHGHSEKKVSKSDINMT

SEQ ID NO: 165013 - protein, 44 aa, Glycine max
  Coding DNA Sequence Number=SeqID_73328
MPNTVMRTQQRARTMKHLKAQVEKDKGPETEALPRLLIVAEGPS

SEQ ID NO: 165014 - protein, 155 aa, Glycine max
  Coding DNA Sequence Number=SeqID_73329
MRKCQRYVGKVVCKSKNQGELGIKNIFIFNDVLLGKWRGWIGLKKEEVLEKSSLWWRDLCRTCGGMNERLKVPPKGSRGIIVEAAKFYVFWRTLYGGNTRLNAQGLVLGVLMHFWWVLDEDKARNKGDVNHEVECLIQATKIWMTPLPVKEDKLG

SEQ ID NO: 165015 - protein, 142 aa, Glycine max
  Coding DNA Sequence Number=SeqID_73330
  Homolog annotation: Hit_ID=A5AHJ1; Match level="QueryCoverage=99%, HitCoverage=68%, E-value=7e-14, Identity=31%"; Hit description =Putative uncharacterized protein
MEIFIQSIDPGAWIAIVKEPFIPTKEVNGELVPEEWDELKDDEKKRVCISAKEIWKMLEVTHEKHYGYDELNIKILNCLTRTWEPKITTIKESKDLASMSMEALFVKLFAYEHELIQQSHAEETEKKRKGIALKVSSSKEDR

SEQ ID NO: 165016 - protein, 151 aa, Glycine max
  Coding DNA Sequence Number=SeqID_73331
  Homolog annotation: Hit_ID=A7QGX9; Match level="QueryCoverage=66%, HitCoverage=23%, E-value=3e-23, Identity=57%"; Hit description =Chromosome chr3 scaffold_95, whole genome shotgun sequence
MKPLLDFGIAFLLLLHSFLTSDIPYPKAIFDLKDTIVKGFGFTAENDVKLTGFDPRDATVGHSVEYQFDLEINHKVIPFKLLEDVKHWDYMDLPIFQAEAPIGFVQKQASADGLPVLASFVLAMMKKDDWRRHFKEKMSQEEDESRRRSQP

SEQ ID NO: 165017 - protein, 128 aa, Glycine max
  Coding DNA Sequence Number=SeqID_73332
MWCAVRDSGGHYCPKKTDDLCGDVCGQPKDLVPIATGHEYEEIQADLEEMCEDDKGYNFWQRFCSSRLGSLWLLTCVEVEAAAVGTTEEEAGVPSSKDVAGLEEGNNKSPETKVALAVGLDFKVISTD

SEQ ID NO: 165018 - protein, 84 aa, Glycine max
  Coding DNA Sequence Number=SeqID_73333
MPKTLLKDVEGTSVVEAESPPFQTLQTLGFSNSYHNYQILDADPLLQPRLQPPNEFGAFGFSLKREVQWTESSLHYIGVEENNM

SEQ ID NO: 165019 - protein, 205 aa, Glycine max
  Coding DNA Sequence Number=SeqID_73334
  Pfam annotation: Domain name=Transposase_23; Domain location=82-152; Score=-3.0; E_value=0.0025; Accession=PF03017.5; Description =TNP1ENSPM transposase
MARTKKADQMTSDAAKEIVEKIASQGSFVPHGCQDVLTVAIGLEPMQAQGLALHPEPKVGPSAARASTKESCVDPSGNNPETGDSDKCRLYIEENPPHLVALGKVYEGSTTVHNIPLLHNQVKVGVEEVKDVAAPVPVPTDEVNLVGQTLNTFLAWPTHLGAVGPAKLADRPDHEVMWDATMFGVFNQDFPLYIKHEDLSEIAHG

SEQ ID NO: 165020 - protein, 558 aa, Glycine max
  Coding DNA Sequence Number=SeqID_73335
  Homolog annotation: Hit_ID=A1FYU6; Match level="QueryCoverage=70%, HitCoverage=34%, E-value=1e-13, Identity=38%"; Hit description =Putative uncharacterized protein
GSGVQLTGSCGCCCAAALRARLRLQVADLEREAVNVRQRLAGHVVPAVQQRQEVDLHVRPAVALAVGEGGAFQHVGREHAAAKRQPLRAVAQRLQAAIGAEQADRLAGADVDRHVQMVVEVFAHRQIRPHLDAQLLQVVARADAGQHQQLRRTDRAGADDHLFGGARGHFRAAVLAVDHAGGDVALEGQPVRQGVQFHHQPPFVAHRLQVGAGGAGAFAVVGGGLVETDAVLAVAVEVVAVGQVQLLAGADKRHAERVAVAVFADRQQPVGAVVVVRQAFVGLCAFEIGQHLPVAPSGAAIALGPVVVVLRLTAQVDHAVDRTAAAQHLALRDLHAAVVGVRFRLRFVGPALFGDDLGHAGRHLDEQVIVVAAGFQQQHPRLGAADQLRRQHAAGGTGADDDVIKGIFRHDSSPCAIGILADKLRPDGKAGRLQRFQHGDFAIDVAGGAHRVVDVFEAQVFVQRNGLRQAGGGLEVTTAEAVLAGEIQRLQRQAFRQSLAAQHRQEIHLSGNSHISSAPPLGSGRRMARPPAGQTFAVLTLRINPIKALAPGRLVKKP

SEQ ID NO: 165021 - protein, 83 aa, Glycine max
  Coding DNA Sequence Number=SeqID_73336
MWCYEWKKSEALRVGRPNLDLVVFGGVERNEDKGYVGVRELSEGGQLGMVGLCVICGCGELNCTIARPPPSTTCDGYPIILQA

SEQ ID NO: 165022 - protein, 107 aa, Glycine max
  Coding DNA Sequence Number=SeqID_73337
MTVVEYAAKFEELTLETRRPIIGVQFQYGVLLLGDLQAVVVANPILSPLISFVTDVGHTQRDYSRPKKEQNGGGPNDQTRHPKAMGRVFTLNGAEASKSKDLIQDFW

SEQ ID NO: 165023 - protein, 20 aa, Glycine max
  Coding DNA Sequence Number=SeqID_73338
ELHKGMLDPYYLTVDCSSIL

SEQ ID NO: 165024 - protein, 30 aa, Glycine max
  Coding DNA Sequence Number=SeqID_73339
MTNDLTTHAYEDQKVFKGCNGTKDKYEIED

SEQ ID NO: 165025 - protein, 119 aa, Glycine max
  Coding DNA Sequence Number=SeqID_73340
MMSGLKVHLSRCSFSYFFDSCFHILMFLIFNTSALKGLDDTPQSKSKAADRWIVVKCNRQKGITKCGYYVMHWMSTIILGSFRNNLETYFNEVRPLEAERFKALRIQWAQCYLKVRNQT

SEQ ID NO: 165026 - protein, 212 aa, Glycine max
  Coding DNA Sequence Number=SeqID_73341
  Homolog annotation: Hit_ID=Q80R01; Match level="QueryCoverage=42%, HitCoverage=11%, E-value=7e-07, Identity=35%"; Hit description=RdRp -like protein
MNKKACSSSFVLLSLEMCAYFSSLLRERLTWKGDYPLFKLFPTTLSLWGKAVLYPFDNKESQEFIILDHFAQNQGLHRSIFDYFTRCRKLVPIGRLAFTVEGGGKLRMFAIGNYVRQRLIKPLHDWAMKVLASIPNDGTYDQGAPLSTMGGLHREISPSNSNLVDATRDSSYHPDLSSTGDKSLYKLIRLAKKIEKTTFASVVTPMATKEAV

SEQ ID NO: 165027 - protein, 110 aa, Glycine max
  Coding DNA Sequence Number=SeqID_73342
MDSGRFKISVPCDGCPNKALLKEMHQQLFIFHGLVPPQNARVMVVGKTEGPPKCLAGARLEVGSIVVGYFMCPPYGLRDRCMTRSRLLALNEYVSGVIDILIGSSVPHWV

SEQ ID NO: 165028 - protein, 172 aa, Glycine max
  Coding DNA Sequence Number=SeqID_73343
  Gene Ontology: Mol. function=hydrolase activity, hydrolyzing O -glycosyl compounds; Biological process=carbohydrate metabolic process
  Homolog annotation: Hit_ID=A8GCX0; Match level="QueryCoverage=78%, HitCoverage=29%, E-value=4e-36, Identity=57%"; Hit description =Glycoside hydrolase family 4
  Pfam annotation: Domain name=PTS_IIB; Domain location=1-67; Score= -0.4; E_value=0.021; Accession=PF02302.8; Description=PTS system, LactoseCellobiose specific IIB subunit
MQHAAQARGLAINIQAVPVADFERILPDADVVLLGPQVQFEAARLTAIAAPQGKAVRRYRHDGLRHDARRTDLHAEAVARYSNAKIIGLCNVPVNMHHMIAGMLQAPFDEVALRFAGLNHLVWVHQVLCRGEDVTAGVIEQLCEGQALTMNNIKEMPWSPAFLRALQAIPCP

SEQ ID NO: 165029 - protein, 125 aa, Glycine max
  Coding DNA Sequence Number=SeqID_73344
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=A4YY13; Match level="QueryCoverage=84%, HitCoverage=29%, E-value=8e-44, Identity=79%"; Hit description =Tartrate dehydrogenase/decarboxylase
MRNYKIAAIPADGIGPEVISAGIEVLQALTRHDEQLTFDVQTFDWGSDYYKQHGVMMPEDGLQTLKQFDAIYFGAVGAPDVPDHITLWGLRLPICQGFDQYSGNVRIAACQKRWALKWRFSPASA

SEQ ID NO: 165030 - protein, 167 aa, Glycine max
  Coding DNA Sequence Number=SeqID_73345
  Gene Ontology: Mol. function=transporter activity; Cellular component= integral to membrane; Biological process=transport
  Homolog annotation: Hit_ID=Q89FX9; Match level="QueryCoverage=98%, HitCoverage=37%, E-value=5e-67, Identity=76%"; Hit description=MFS permease
MALVQGTTSFYLLRFLLGVAEAGFFPGIILYLSYWFPAAKRAQVTAIFMAAAPLSTALGSPVSAALLEMHGLLGYAGWQWMFVLEAIPALLLGIVVLFFLTDRPAQAKWLNAEERRWLQETMQAEEQARSMQHGHSSAWRGLADKRVLALALVYFGTSAGLYTLGDL

SEQ ID NO: 165031 - protein, 711 aa, Glycine max
  Coding DNA Sequence Number=SeqID_73346
  Gene Ontology: Mol. function=mannonate dehydratase activity; Cellular component=intracellular; Biological process=glucuronate catabolic process
  Homolog annotation: Hit_ID=A6TEM9; Match level="QueryCoverage=46%, HitCoverage=93%, E-value=1e-168, Identity=84%"; Hit description =Mannonate dehydratase
  Pfam annotation: Domain name=AP_endonuc_2; Domain location=430-632; Score=-9.8; E_value=0.1; Accession=PF01261.15; Description=AP endonuclease family 2
  Pfam annotation: Domain name=GerE; Domain location=260-317; Score =43.2; E_value=9e-10; Accession=PF00196.10; Description=Bacterial regulatory proteins, luxR family
  Pfam annotation: Domain name=Response_reg; Domain location=92-216; Score=11.1; E_value=0.00052; Accession=PF00072.15; Description =Response regulator receiver domain
  Pfam annotation: Domain name=Sigma70_r4; Domain location=259-307; Score=17.9; E_value=0.0082; Accession=PF04545.7; Description=Sigma -70, region 4
  Pfam annotation: Domain name=Sigma70_r4_2; Domain location=253-305; Score=17.1; E_value=0.013; Accession=PF08281.3; Description=Sigma-70, region 4
  Pfam annotation: Domain name=UxuA; Domain location=340-689; Score =689.9; E_value=2e-204; Accession=PF03786.4; Description=D-mannonate dehydratase (UxuA)
  Pfam module annotation: Pfam domain module=AP_endonuc_2::GerE::Respons e_reg::Sigma70_r4::Sigma70_r4_2::UxuA; Domain location=430-632::260 -317::92-216::259-307::253-305::340-689
LAQDAGMNGCLFKPLERAQLLQVITGAPMNPTRDDTLLTLENLAANNPQAWRDLVTTARQQNSYDLAQLTQAAAEHEDGALLQQLLPEVAGAVAELDALFLRALETPIPEEVIHAVPLSAGAAARFWPGAFAQRQQLMNFLQRHPLDILVLDYMLGEDQLDGLQMVKQLRLHYPQLKILVSSAVEKPAIVQLLLKAGVQGFVGKSHDQEVLIDAIHQICRGKRFLTPDMMLELDKFQESDREMHDYLTPRQAGDDISLLLRELSPREIEVIRCYLDGLSITQIAGKYARSRKTISGQKQTALRKLGLRSDLELFKYKQYFTELVTTHRYHTDTMTVDDIMQLTMRWFGPKEDKVSLEYIRQVPGVRGVVGALYDVPVGETWPQEKIQALVDQVHAAGLTVEVIESVNIHDDIKIGLPSRDRYIANYQQSIRNLAAAGVKVICYNFMPVFDWMKTDMNYVLPDGSITMAFEKQGIDKSLDEVVKEVLGSANGFALPGWEPERLAKVQELFAKYQDVDDAKLRENLAYFLKAVIPVCEEVGVKMAIHPDDPPYSIFGLPRVVKNRDDLDWICNVVDSEANGITLCTGSIAEDPQNNVYAILAEFSRRKRIPFAHVRNIRIIRDKDFYECAHPTEYGSLDMYKVLQSMYDNGFDGYIRSDHGRFIWGETGRPGYVSVDGLRSGAHPCGFFSNGTSSAATKKPVMISQNASEKAW

SEQ ID NO: 165032 - protein, 104 aa, Glycine max
  Coding DNA Sequence Number=SeqID_73347
MQNVCLKARDSLWYLDNGCPRHMMAGKSKLTDFVSKEGGYVTVATYPSAGGRRVTRGMRVPRKEYARSRHQRLFEENVGKTGKDAIYELLSERFRSCIYARGRY

SEQ ID NO: 165033 - protein, 111 aa, Glycine max
  Coding DNA Sequence Number=SeqID_73348
MHRSPIGNLVPLNLEIESTLRRNRVEKRRKLLQDRTVASILEEKTHFSDLLSPDSPSSRESATQLPEVITMAEEHDRGLPLRITQVVQYHNFSPALHVLKCKLTTSITHIP

SEQ ID NO: 165034 - protein, 58 aa, Glycine max
  Coding DNA Sequence Number=SeqID_73349
MTGPLDESISCFPKGGPLVRGLHVLAIRGLHALTSRGLPVLALRGLHALTLGTSYPHQ

SEQ ID NO: 165035 - protein, 121 aa, Glycine max
  Coding DNA Sequence Number=SeqID_73350
MDRASSCCCETELPVASLLPNQPVDRDRRSFLCRHIYGSISNLRYWVVRSAADTPTFKRVFRIGVDYSSRPSRSLSGQLLDILLFYYYTRYARAVGPDSELLVRLVLYQSKAQHAHGTALN

SEQ ID NO: 165036 - protein, 64 aa, Glycine max
  Coding DNA Sequence Number=SeqID_73351
MLIDVGNALACACCVCSWGAKCTNLIVSLALALGHVHTLDVVVCHGGLSALTLSDDPDVGNKHG

SEQ ID NO: 165037 - protein, 121 aa, Glycine max
  Coding DNA Sequence Number=SeqID_73352
MTRGNPSDLQPFDPEIDRTFHRLIRHHFIPFDHSEHSITGESVHSVIGDFEHPDLEHYNFEHSDSEHSDFAHSENMAQPPPRERTLREMAAPDFTYESLCIQYPNEDVPYVLKTGLIHLLQ

SEQ ID NO: 165038 - protein, 319 aa, Glycine max
  Coding DNA Sequence Number=SeqID_73353
  Gene Ontology: Mol. function=ATP-dependent DNA helicase activity; Cellular component=intracellular; Biological process=DNA recombination
  Homolog annotation: Hit_ID=Q8XD86; Match level="QueryCoverage=100%, HitCoverage=46%, E-value=1e-161, Identity=88%"; Hit description=ATP -dependent DNA helicase recG
  Pfam annotation: Domain name=Helicase_C; Domain location=138-215; Score=81.7; E_value=2.4e-21; Accession=PF00271.22; Description =Helicase conserved C-terminal domain
MVVGTHALFQEQVKFNGMALVIIDEQHRFGVHQRLALWEKGEEQGFHPHQLIMTATPIPRTLAMTAYADLDTSTIDELPPGRTPVTTVAIPDTRRSDIITRVQSACHEGRQAYWVCTLIDESDVLEAQAAEATWQELKVALPDLQVGLVHGRMKPAEKQAVMAAFKANEIQLLVATTVIEVGVDVPNASLMIIENPERLGLAQLHQLRGRVGRGAVASHCVLLYKAPLSKTAQKRLQVLRDSNDGFVIAQHDLEIRGPGELLGTRQTGNAEFKVADLLRDQSLIPEVQRVARHIHHHYPEQAQALIERWLPETERYSHA

SEQ ID NO: 165039 - protein, 59 aa, Glycine max
  Coding DNA Sequence Number=SeqID_73354
MGSSLAIGCSARLDVCVCGSCEGGIKGDEGWYCWSKDVSWAVVVVMDMRVVEMMVVVEE

SEQ ID NO: 165040 - protein, 72 aa, Glycine max
  Coding DNA Sequence Number=SeqID_73355
MTENVSQFVRLIVKECINRISCRNLPFGGRATRDSRDACSTKGIRAESPPTFIRGKRRKNRKRRDLRTFKLK

SEQ ID NO: 165041 - protein, 220 aa, Glycine max
  Coding DNA Sequence Number=SeqID_73356
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q8S3J3; Match level="QueryCoverage=95%, HitCoverage=45%, E-value=1e-67, Identity=56%"; Hit description =Hydroxyisourate hydrolase
  Pfam annotation: Domain name=Glyco_hydro_1; Domain location=1-198; Score=-286.5; E_value=0.00026; Accession=PF00232.9; Description =Glycosyl hydrolase family 1
DKQHGFVGISIYTFGIFPQTNTEKDRVASQRARDFFVGWIMEPLQYGDYPISMKTNAGVIHYTNLNVSDNSDALKNQLRDFTADMAANICQRTASNSSLQDVTRVKYLHGYIGSVLDALSDLEKGLTQRINQTRTYTDTDGSNIKGYFAWSFLDLFELLDGYKSSFGLYYVDRDDPELKRYPKLSAKWYNRFLKGRRTSIVGTIELEKDPSLVFVSQLFE

SEQ ID NO: 165042 - protein, 278 aa, Glycine max
  Coding DNA Sequence Number=SeqID_73357
  Gene Ontology: Mol. function=oxidoreductase activity; Biological process=electron transport
  Homolog annotation: Hit_ID=Q4H439; Match level="QueryCoverage=89%, HitCoverage=42%, E-value=3e-68, Identity=55%"; Hit description =Polyamine oxidase
MYISNCKQEHEHSSISAAKLLAENGVKDLVILEASNCIGGRIRKENFGGVSVELGAGWIVGVGGKESNPIWELVAEYGLRTCFSDYTNVPYNIYDRRRDSISFSIFLLLLLCRLLCSIIPVIVHSSGKIFSSGIAADSYKKAVDSAIRNLTNQEEADRQGNSSKTTEPPSSPLELAIDFILHDFEMAVSWFMDVCSETVKVVDAEAVPISTFTAFGEREFLVADERGFDYLVYKMAEDFLLTSEGKILDTRLKLNHGNNGLVRYIIFIRLLRGFFSAL

SEQ ID NO: 165043 - protein, 511 aa, Glycine max
  Coding DNA Sequence Number=SeqID_73358
  Gene Ontology: Mol. function=protein kinase activity; Cellular component=mitochondrial inner membrane; Biological process=protein amino acid phosphorylation
  Homolog annotation: Hit_ID=A7Q2T3; Match level="QueryCoverage=99%, HitCoverage=93%, E-value=1e-171, Identity=47%"; Hit description =Chromosome chr1 scaffold_46, whole genome shotgun sequence
  Pfam annotation: Domain name=PPR; Domain location=106-140; Score =19.5; E_value=0.013; Accession=PF01535.11; Description=PPR repeat
  Pfam annotation: Domain name=PPR; Domain location=213-247; Score =38.3; E_value=2.8e-08; Accession=PF01535.11; Description=PPR repeat
  Pfam annotation: Domain name=PPR; Domain location=248-282; Score =41.1; E_value=3.8e-09; Accession=PF01535.11; Description=PPR repeat
  Pfam annotation: Domain name=PPR; Domain location=283-317; Score=0.5; E_value=6.8; Accession=PF01535.11; Description=PPR repeat
  Pfam annotation: Domain name=PPR; Domain location=351-385; Score =47.8; E_value=3.8e-11; Accession=PF01535.11; Description=PPR repeat
  Pfam annotation: Domain name=PPR; Domain location=404-438; Score=2.3; E_value=4.2; Accession=PF01535.11; Description=PPR repeat
  Pfam annotation: Domain name=PPR; Domain location=7-41; Score=13.7; E_ value=0.18; Accession=PF01535.11; Description=PPR repeat
  Pfam module annotation: Pfam domain module=PPR::PPR::PPR::PPR::PPR::PP R::PPR; Domain location=106-140::213-247::248-282::283-317::351 -385::404-438::7-41
  Subcellular localization annotation: CTP_CleavageSite=45; ConfidenceScore=5.35e-01
MPQPNVASLNAALSGFSRNGRRGEALRVFRRAGLGPLRPNSVTIACMLGVPRVGANHVEMMHCCAVKLGVEFDAYVATSLVTAYCKCGEVVSASKVFEELPVKSVVSYNAFVSGLLQNGVPRLVLDVFKEMMRGEECVECKLNSVTLVSVLSACGSLQSIRFGRQVHGVVVKLEAGDGVMVMTALVDMYSKCGFWRSAFEVFTGVEGNRRNLITWNSMIAGMMLNKESERAVDMFQRLESEGLKPDSATWNSMISGFAQLGECGEAFKYFGQMQSVGVAPCLKIVTSLLSACADSSMLQHGKEIHGLSLRTDINRDDFLVTALVDMYMKCGLASWARGVFDQYDAKPDDPAFWNAMIGGYGRNGDYESAFEIFDEMLEEMVRPNSATFVSVLSACSHTGQPKPEHFGCIVDLLGRSGRLSEAQDLMEELAEPPASVFASLLGACRCYLDSNLGEEMAKKLLDVEPENPAPLVVLSNIYAGLGRWKEVERIRGVITDKGLDKLSGFSMIELA

SEQ ID NO: 165044 - protein, 59 aa, Glycine max
  Coding DNA Sequence Number=SeqID_73359
MEFPKAFQPRRYGMIHCIDKKHKYNQNEQNINHVECTGKLESLKKNFVPHYPEALRYAK

SEQ ID NO: 165045 - protein, 385 aa, Glycine max
  Coding DNA Sequence Number=SeqID_73360
  Gene Ontology: Mol. function=peptidyl-prolyl cis-trans isomerase activity; Cellular component=cytoplasm; Biological process=protein folding
  Homolog annotation: Hit_ID=Q41119; Match level="QueryCoverage=22%, HitCoverage=66%, E-value=4e-20, Identity=53%"; Hit description =Peptidyl-prolyl cis-trans isomerase
  Pfam annotation: Domain name=Pro_isomerase; Domain location=123-259; Score=20.5; E_value=2.4e-10; Accession=PF00160.12; Description =Cyclophilin type peptidyl-prolyl cis-tr
MKIVAEAEPFGSDENCVEGEEEWVVELCVPDLGSKEDAWGLPLTGGGKLPWEGESTWFRLWVVTLQWKKIESVASSTMAASRGSGLAEEGTTSVIGGRQVGPIVMNRGFLPCIRGQAIMPNPKVFFYMTIDGKPVGRIVMGLYTNVTPHTAKNFGAFCTGEKGGGHFTAGKETRGESIYGAKFTVKKHICLDILSMANIDPETIILKKGKLGREEQDRAGHGGGGGGGLCITILIADLVDGSAAPAKGAISKTVSAGAVAEGDLVEDEGTCCGGRMGNWLFCAPVKKYGGGGGDDRYNGCGREASILSRGRQGHFMVLVVFMKASNWFYSQNQSQGIKLGAHKEKVGASGWLCGKTMMERGGLVGGVVWRGSHERQGNGMSDQLL

SEQ ID NO: 165046 - protein, 465 aa, Glycine max
  Coding DNA Sequence Number=SeqID_73361
  Gene Ontology: Mol. function=protein serine/threonine kinase activity; Cellular component=plasma membrane; Biological process=two- component signal transduction system (phosphorelay)
  Homolog annotation: Hit_ID=A7Q2R5; Match level="QueryCoverage=73%, HitCoverage=98%, E-value=5e-91, Identity=47%"; Hit description =Chromosome chr1 scaffold_46, whole genome shotgun sequence
  Pfam annotation: Domain name=PAS; Domain location=130-244; Score =12.0; E_value=0.031; Accession=PF00989.15; Description=PAS domain
  Pfam annotation: Domain name=PAS_3; Domain location=158-251; Score =14.6; E_value=0.0041; Accession=PF08447.2; Description=PAS fold
  Pfam annotation: Domain name=PAS_4; Domain location=139-252; Score =18.0; E_value=0.0035; Accession=PF08448.1; Description=PAS fold
  Pfam module annotation: Pfam domain module=PAS::PAS_3::PAS_4; Domain location=130-244::158-251::139-252
MVKSQYVLSKERVSNIVEEGSALGTGNVQMEERKKEKDKARYSLPPSSSHSIKRRRFHDSIIHRKQNNNKKQQQQREFTWDWEQPREAEEESSSKKVLEQEHTTTPTTPMPMELEQELGSTTIQRSFDARYTRHARDSLGELPDSFTITDPSIPGHPIVFASPGFLKLTGYSLREVLGRPAAIFQGPRTSRKSVIEIREAVREERNAQVVLLNYRRDGTPFWMLFRVSPVFSSDGGAVVHFVAVQVPLQKKEGSGVRDFGFGCCRKEVCVDSLAEIDRVCSLEQVLEPDVRALWDAEVEREEPCEASDDEKRSAVTAMDSIFSVLTHYSEATGRLVCRKRSSIPDVGLLSTSLIISLGRIKQSFVLTNPHLPDMPIVYASDAFLKLTVFCNTNRKDKSSFWNFLHISPVRDASGKVAYFVGVQIEDNNKNDDSHCLSPEKRQLSVVGVVKVAVRSLSMTAGSSES

SEQ ID NO: 165047 - protein, 959 aa, Glycine max
  Coding DNA Sequence Number=SeqID_73362
  Gene Ontology: Mol. function=alpha-amylase activity; Cellular component=chloroplast; Biological process=carbohydrate metabolic process
  Homolog annotation: Hit_ID=Q5BLY3; Match level="QueryCoverage=100%, HitCoverage=100%, E-value=0.0, Identity=60%"; Hit description =Plastid alpha-amylase
  Pfam annotation: Domain name=Alpha-amyl_C2; Domain location=898-958; Score=106.4; E_value=8.4e-29; Accession=PF07821.3; Description=Alpha- amylase C-terminal beta-sheet dom
  Pfam annotation: Domain name=Alpha-amylase; Domain location=537-897; Score=179.1; E_value=1.1e-50; Accession=PF00128.15; Description =Alpha amylase, catalytic domain
  Pfam module annotation: Pfam domain module=Alpha-amyl_C2::Alpha -amylase; Domain location=898-958::537-897
  Subcellular localization annotation: CTP_CleavageSite=58; ConfidenceScore=5.01e-01
MSTVALETLFPLCRRKPSFHRHKPIPLRPFFVTCSSNLNDDASFIFHQQPRKTLSPVHAVSHTDTSVLHSLQCPHTITNTFLINTTETVEGKIFVRLDHGKGLRDRELTVGCNLPGKWILHWGVTYVDDVGREWDQPPRDMIPPGSILIKDYAIETPLKESSLSAEGDTLHEIRIDLKANNGIAAINFVLKDEETEAWYKNKRRDFKVSLVNNLKEDNSIIGPKWGFDLWPGNLGQISKMFLQSEEADQDDSSESRVPEQDNNQPESFCEEVPITKKVLVQNSISVSTTKCHESGAVKELLLLETDLPGDVVLHWGVCRDDSRKWEVPPRPHPPGTVAFKERALRTQFRPRDDGKGSLALITLEEEFSGFMFVLKQNENTWFKYNGHDFYIPLSSSSSFLNSGNKEGQSEGMQREVTQEASQKSSFFAFTDTITNEIRNLVTDNSSEKIQRTKSKMAQRSIFQEIERLAAEAYNIFRISIPTFSEETAAEPEVTIVEPETSIVEPQATTIVIPETSVESETQSLDPKICSGTGTGYEILCQAFNWESHKSGRWYIELKEMASELASLGFTVVWLPPPTESVSPEGYMPKDLYNLNSRYGNIDELKDLVKRFHEVGIKVLGDAVLNHRCAHYQNQNGIWNIFGGPLNWDDRAVVADDPHFQGRGNKSSGDNFHAAPNIDHSQEFVRKDLKEWLCWLRLIFLDPNFLQLILNKRMFCQFNCILFSVTFRKEVGYDGWRLDFVRGFWGGYVKDYIDASEPYFSVGEYWDSLSYTYSEMDHNQDAHRQRIIDWINATNGTSGAFDVTTKGILHPALERCEYWRLSDEKGKPPGVLGWWPSRAVTFIENHDTGSTQGHWRFPSGKQMQGYAYILTHPGTPSVFYDHISSHDKSEIASLISLRKRNKIHCRSRVQISKAEKDVYAAIIDEKVAMKIGPGHFEPPSDSQKWSLAIEGKDYKIWEAS

SEQ ID NO: 165048 - protein, 125 aa, Glycine max
  Coding DNA Sequence Number=SeqID_73363
  Gene Ontology: Mol. function=transporter activity; Cellular component= membrane; Biological process=oligopeptide transport
  Homolog annotation: Hit_ID=Q9CAR8; Match level="QueryCoverage=83%, HitCoverage=17%, E-value=4e-31, Identity=64%"; Hit description =Nitrate transporter (NTL1); 53025-56402
MNVKRRIKVNFNVNGVELEAPQVSTWEGYVDWRNKPALRGRHGGMLAASFVLVAEILENLAFLANASNLVLYLRQYMHMSPSKSANNVTNFMGTAFLLALLGGFLSDAFFTTYRVYLISAVIEFL

SEQ ID NO: 165049 - protein, 78 aa, Glycine max
  Coding DNA Sequence Number=SeqID_73364
  Homolog annotation: Hit_ID=A6FJQ2; Match level="QueryCoverage=48%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTFQIEKVALISKGWFPQGCRNPK

SEQ ID NO: 165050 - protein, 141 aa, Glycine max
  Coding DNA Sequence Number=SeqID_73365
MEEFDAQVAWPRDQPYSSRGGGVSTAQEPVVGEHHPQKMVQGKFVPNFGEPLGMEAKCLKKKGKYGEGTNAKVKVILWMNALLEPKLLNPRKTMNCWQPNPITSLESPSDSFLCVHCCMIGDEMQRLELVLVVYDGISLNT

SEQ ID NO: 165051 - protein, 58 aa, Glycine max
  Coding DNA Sequence Number=SeqID_73366
IFIHYVMRILKLAKYRLKAQVEKDKAPEWRRMKAQVEKDEGPEAETLSRLLIVAEGPD

SEQ ID NO: 165052 - protein, 187 aa, Glycine max
  Coding DNA Sequence Number=SeqID_73367
MTDRVSAEDDVNLRVSMRLSAAIDEGRRRDVSLCVLSGFSSYRQQKRMFIRITTWVFPPVSVTQKSIAKRVYTDNHSGISARQRDSKVSMTDLVSAEDDVNLRVSTGLSAAIDEGRRKTTLVSACYQAFRLTDSKKEFIRITTSGISARQRDSNVSMTDLVSAEDDVNLRVSTGLSAAIDEGRRRRR

SEQ ID NO: 165053 - protein, 100 aa, Glycine max
  Coding DNA Sequence Number=SeqID_73368
  Subcellular localization annotation: CTP_CleavageSite=31; ConfidenceScore=5.14e-01
MAGGSSPLSAASRRLPAMRPISSYGSTMLVSGGEHTAASGPPPMLAIASWLGTETPACVTGHDGAARHFIAGTDQDVQFRPGETDLCQQAVAGGKGGHFW

SEQ ID NO: 165054 - protein, 141 aa, Glycine max
  Coding DNA Sequence Number=SeqID_73369
  Homolog annotation: Hit_ID=Q6WAY6; Match level="QueryCoverage=52%, HitCoverage=12%, E-value=4e-07, Identity=40%"; Hit description =Putative uncharacterized protein
MGTNQTGKRFYQVKIKGLDVTSLKELGRLMGPLQMQAFRKAKIAIVVRDSARELDRVKQTRNDVVGLPRKYLEGKARDMVNQEEWVPFMDVLALLIFGVVLFPNVDVLVDLAAIDAFLAYHHSKESPVVAILADLFDTFER

SEQ ID NO: 165055 - protein, 248 aa, Glycine max
  Coding DNA Sequence Number=SeqID_73370
  Homolog annotation: Hit_ID=A0ST23; Match level="QueryCoverage=10%, HitCoverage=51%, E-value=9e-07, Identity=100%"; Hit description =Putative reverse transcriptase
HRPDISAGKCSGHPARNHPHPAALNAPLQGASHSAIQAAQLLGRAIGAGLFAITPAGERGMCCKAIKLGNARVFPEFDHMQFKGLEDYELRRCPTYCWYKEGSLFEDDDAFDPHLERIKNEAGGDESGEEETTFIYVDQQYLKVGLGHEKISELEAYISVFATIELTSISIQYQAYRYRRPRGGARYQLWFPLVRVNFELGVIMVIAVSFGKPVVPAALMNRPTRGERRFAYWALAECILAYYVGTDE

SEQ ID NO: 165056 - protein, 136 aa, Glycine max
  Coding DNA Sequence Number=SeqID_73371
  Homolog annotation: Hit_ID=Q6UUU1; Match level="QueryCoverage=52%, HitCoverage=48%, E-value=4e-27, Identity=83%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPAVRSKLDCMHEPPVQSDRCALIPVTIVLSPTRKDMQKHHWQQPLVIDLEELVLKSCAG

SEQ ID NO: 165057 - protein, 117 aa, Glycine max
  Coding DNA Sequence Number=SeqID_73372
  Gene Ontology: Mol. function=aspartic-type endopeptidase activity; Cellular component=chromatin; Biological process=chromatin assembly or disassembly
  Homolog annotation: Hit_ID=A5BEK1; Match level="QueryCoverage=84%, HitCoverage=6%, E-value=6e-13, Identity=39%"; Hit description =Putative uncharacterized protein
  Pfam annotation: Domain name=Retrotrans_gag; Domain location=1-89; Score=21.1; E_value=0.00048; Accession=PF03732.8; Description =Retrotransposon gag protein
MMVAMDEEALGWFQWWESWNPNHSWEGFKIAISQRFQASNLGNPFQALLALEQEKAVQEFIGQFEKHVGMVKGLEEPFMVKVFLKGLKEDINTKVRLYEPKNLMESMVKACKGEDKN

SEQ ID NO: 165058 - protein, 253 aa, Glycine max
  Coding DNA Sequence Number=SeqID_73373
  Gene Ontology: Mol. function=transketolase activity; Cellular component=cytoplasm; Biological process=metabolic process
  Homolog annotation: Hit_ID=A7MKZ1; Match level="QueryCoverage=98%, HitCoverage=37%, E-value=1e-115, Identity=84%"; Hit description =Putative uncharacterized protein
  Pfam annotation: Domain name=Transket_pyr; Domain location=1-112; Score=86.8; E_value=6.8e-23; Accession=PF02779.15; Description =Transketolase, pyrimidine binding dom
  Pfam annotation: Domain name=Transketolase_C; Domain location=127 -242; Score=48.7; E_value=2e-11; Accession=PF02780.11; Description =Transketolase, C-terminal domain
  Pfam module annotation: Pfam domain module=Transket_pyr::Transketolase _C; Domain location=1-112::127-242
MTAIANGIAHHGGFVPYTATFLMFVEYARNAARMAALMKARQIMVYTHDSIGLGEDGPTHQPVEQLASLRVTPNFSTWRPCDQVETAVAWKAAIERHHGPTALILSRQNLLQPERSAQQVENIARGGYILKDCDGTPDVILIATGSEVEITLGAEAKLSADGHKVRVVSLPSTDVFDKQDVAYRESVLPSTVRARVAVEAGIADYWYKYVGIDGKIVGMTTFGESAPAGKLFPAFGFTVENVVSHAESLLKPA

SEQ ID NO: 165059 - protein, 54 aa, Glycine max
  Coding DNA Sequence Number=SeqID_73374
MSYPNFVRGPLLDDMRPFFGPCEKAVASGGSNLARLGELSSPGFYPFPSIMTSP

SEQ ID NO: 165060 - protein, 160 aa, Glycine max
  Coding DNA Sequence Number=SeqID_73375
  Subcellular localization annotation: CTP_CleavageSite=48; ConfidenceScore=5.14e-01
MPSPTINLAYIRKNSWNVNDLTVAFRGARRAKVRPADIPSTSTALSVLAHVDSQCFEAMLQRKVKVPQPRYPNKYRMLPLRPPFQSHSLFIMRQRSLEGTSEPPIPMADLSSPQPAADPSTPRLEIPEDLTTPVLALNTSPPATPILHLTNKDDAQTQGT

SEQ ID NO: 165061 - protein, 120 aa, Glycine max
  Coding DNA Sequence Number=SeqID_73376
MAYERGGDFLEDARKILNREAFPPGGSLVRSPVPAFRFTGVIPLLWPRLSHSTPDTQFRVGSSLQAGLYARTPRSVRPLRLIRHAPVKAKLKDKFCDCAPPSQYSSRVVAQRTFENSLQA

SEQ ID NO: 165062 - protein, 79 aa, Glycine max
  Coding DNA Sequence Number=SeqID_73377
MLRCERYFSQFKYDIEIPNGESSRNWVANLVLKFYDDPMMNESDIIIFLRQVWWSARKRKSFKRRKEKNENEAKRRHLT

SEQ ID NO: 165063 - protein, 159 aa, Glycine max
  Coding DNA Sequence Number=SeqID_73378
  Subcellular localization annotation: CTP_CleavageSite=31; ConfidenceScore=5.19e-01
MRAHTANSYQTTRDLVQVAPLPPKKPSRLVISSSIWDSSASPGDPIGSSPAWASGQSPGHATSAPNFSRITLHAQWPSRIGLPRRWRCACGLMCVTLRLPRCAILLNEGSGDRWSDYIIGGDGNSIGLAEAYDQCLKPQGPVGLIWVQRVPSSAIPANK

SEQ ID NO: 165064 - protein, 503 aa, Glycine max
  Coding DNA Sequence Number=SeqID_73379
  Gene Ontology: Mol. function=glycerol kinase activity; Cellular component=integral to membrane; Biological process=glycerol-3 -phosphate metabolic process
  Homolog annotation: Hit_ID=A7ZUE0; Match level="QueryCoverage=48%, HitCoverage=48%, E-value=1e-130, Identity=91%"; Hit description =Glycerol kinase
  Pfam annotation: Domain name=FGGY_N; Domain location=262-502; Score =432.3; E_value=6.9e-127; Accession=PF00370.12; Description=FGGY family of carbohydrate kinases,
  Pfam annotation: Domain name=MIP; Domain location=22-269; Score =338.1; E_value=1.6e-98; Accession=PF00230.11; Description=Major intrinsic protein
  Pfam module annotation: Pfam domain module=FGGY_N::MIP; Domain location=262-502::22-269
ASWLSRAAMLTININFFRIPIMSQTSTLKGQCIAEFLGTGLLIFFGVGCVAALKVAGASFGQWEISIIWGLGVAMAIYLTAGVSGAHLNPAVTIALWLFACFDGRKVVPFILSQFAGAFCAAALVYGLYYNLFIDFEQTHHMVRGSVESLDLAGIFSTYPNPHINFVQAFAVEMVITAILMGVILALTDDGNGIPRGPLAPLLIGLLIAVIGASMGPLTGFAMNPARDIGPKAFAFIAGWGDVAFTGGKDIPYFLVPLFAPGTTSSRAVVMDHDANIVSVSQREFEQIYPRPGWVEHDPMEIWASQSSTLVEVLAKADISSDEIAAIGITNQRETTIVWERETGKPIYNAIVWQCRRTSEICEQLKRDGMEEYVRSATGLVVDPYFSGTKVKWILDHVEGSRERAKRGELLFGTVDTWLIWKMTQGRVHVTDYTNASRTMLFNINTLEWDDKMLDALDIPRAMLPEVRKSSEVYGQTNIGGKGGTRIPIAGIAGDQQAALFGQ

SEQ ID NO: 165065 - protein, 225 aa, Glycine max
  Coding DNA Sequence Number=SeqID_73380
  Gene Ontology: Mol. function=ATP-dependent DNA helicase activity; Biological process=DNA repair
  Homolog annotation: Hit_ID=Q1H0G8; Match level="QueryCoverage=100%, HitCoverage=20%, E-value=3e-58, Identity=53%"; Hit description=DNA helicase/exodeoxyribonuclease V, subunit A
MRARILDSLLLAAAGVPREAPHKQITYTLGQQALKRSGELQWHLLESPARLRIYTIDSLCANLARQMPLLSRFGTQPAVTEDAWAYYREAAGLALQAMDEDTLGEPVRRVLRYMDNDQAKLEALLMSMLAKREQWLHLSQTNDREQAQDALIYLIESELQAALTAFPARLQQSLMPIARYAASQLPPEHILAQLLDWQIPFTAAIEDLPGWRALAELLLTSSGCL

SEQ ID NO: 165066 - protein, 208 aa, Glycine max
  Coding DNA Sequence Number=SeqID_73381
MGEVEEVQEQIKADTEVLKEKMATMMKAMMSIKEIMEVNADAIAATSTIAEVDQTTPYGLNQINHPTSDMVGLEGKELGGMGSPHLAQKKKTKHAFPPYMPCLPTIHHPMWHTLPMRMSIIESQQPQTDHAHVSQTMGETHEISHHNPAYFEPCLGYATEGQAVGGIPLQNTLERPQFRPQPQPFYGKIVGYTPSSFADLVFAGERIK

SEQ ID NO: 165067 - protein, 91 aa, Glycine max
  Coding DNA Sequence Number=SeqID_73382
HLVRQQAANHRGQVQIHDCLYQLSLSQQGQGFIPFVCPTPDQFRAEVAWPGDWPEAQAGEAPAEAPGDAEEARIDEEMTDLLNFLGGSGAT

SEQ ID NO: 165068 - protein, 196 aa, Glycine max
  Coding DNA Sequence Number=SeqID_73383
  Homolog annotation: Hit_ID=A5B5G6; Match level="QueryCoverage=32%, HitCoverage=20%, E-value=9e-08, Identity=45%"; Hit description =Putative uncharacterized protein
  Pfam annotation: Domain name=zf-CCHC; Domain location=126-143; Score =22.5; E_value=0.00059; Accession=PF00098.14; Description=Zinc knuckle
MSLHSSSSVNAEGSTPKDPLYKILDELRSLKLWKEKQERKEKGKKRVEEISQDEKEKIREEERRKMLKELRKEKMPPMVVITLERKPQEANINLPYFHGKDNLEANLDWEIRQPLKASMQEKTSSIKCFKCLGSGHITSQCPTKKTMIMRGQDIYSSQDEATTSPSSSESEEAKGEESSEEIYPQEEGQPLMVKKE

SEQ ID NO: 165069 - protein, 116 aa, Glycine max
  Coding DNA Sequence Number=SeqID_73384
MHRPWLSKDKLVTLWGLWVIAAIGIVWMANATSIDLSLADRQFDFASQRFSLKHDFFYETVMHIYAKHLLTVLWLGLLFLAWAPVKLIGNRLSPATRSQLRWIVFLALLNAIFVSC

SEQ ID NO: 165070 - protein, 32 aa, Glycine max
  Coding DNA Sequence Number=SeqID_73385
MCRSCALSFARLFQKDAISSISRAQELMKHWA

SEQ ID NO: 165071 - protein, 109 aa, Glycine max
  Coding DNA Sequence Number=SeqID_73386
  Subcellular localization annotation: CTP_CleavageSite=31; ConfidenceScore=5.09e-01
MVEPSKKRKGSSSRSQRHSEAQDTPIPSSISSSSLFSSEEKRIRYTNLFSSRSIIDPKFIDMDFFSDESFKCIQAFQNSNLIPFMSLKLLVYSELKYLDFRGLWDKNGH

SEQ ID NO: 165072 - protein, 138 aa, Glycine max
  Coding DNA Sequence Number=SeqID_73387
  Gene Ontology: Cellular component=periplasmic space
  Homolog annotation: Hit_ID=A4WCB4; Match level="QueryCoverage=100%, HitCoverage=27%, E-value=1e-51, Identity=65%"; Hit description=AsmA family protein precursor
GEAQEDLKDSRMEGINFQQLVQQAVEGSSDVKAQENYDSVTRLDSFSTDLTLDNGQLTLAAMQGTSSMLSLTGEGSLDLVKETADTRFNVRALNYSLQVDQILRKHLQDEAKRRLNSWADRNKDSQNGKDVKKLLDKL

SEQ ID NO: 165073 - protein, 56 aa, Glycine max
  Coding DNA Sequence Number=SeqID_73388
MEEFDAQVAWPRDQPYSSRGGGVSTAQEPESIIHRRWFKANLSQISGSHWVWKLSA

SEQ ID NO: 165074 - protein, 444 aa, Glycine max
  Coding DNA Sequence Number=SeqID_73389
  Gene Ontology: Mol. function=transferase activity, transferring glycosyl groups; Biological process=carbohydrate metabolic process
  Homolog annotation: Hit_ID=B0IB54; Match level="QueryCoverage=95%, HitCoverage=75%, E-value=1e-126, Identity=53%"; Hit description =Alpha-glucan phosphorylase
MYSFLEDTGIKFQIEIHSAPVWVKVWYLDPEIFHTAPMFFLSTDVPENDHVSKTICHKLYDANESTKLAQYILLGKGGAQLLDEMNLERDIYHLNEAHALPAAFYLLRKYNGDLSKVKEKLVFTTHTPEEAGNEKHNLKLCYDMSYFSGFSMEEAKSIEGVDDERFNHSLCALKMAKVANGVSQLHGVVSRAMWSKYPGICEIKSITNAQEFKYWADKRLYNSKDERDDQAFDYRKKYLKKRLFKIVADQTGNLFNPNIFTIVWARRFAGYKRADLLLHDKDRFYKLLNNPEHPVQIIWAGKPYPMDYSAISTFNTLVEESKNHKNMAVLTGYELSLSKSLKQGSDLWLNNPRVPREASGTSGMTAAMNGSVNLSTDDGWIPEFARHGQNSFVVQKADYLNMSIYEQDNYDLNQLYEILENQILQPTTIMQTAGGNTVQCHGRC

SEQ ID NO: 165075 - protein, 42 aa, Glycine max
  Coding DNA Sequence Number=SeqID_73390
MAQRDKFVTEMIVSIEYVKMEWKVAAAPKLVRDTTLRSKDKE

SEQ ID NO: 165076 - protein, 224 aa, Glycine max
  Coding DNA Sequence Number=SeqID_73391
MPTAILLLHQQYQSGGIGLEEVRVFQEELVDSRKWVVLREGDGERTTDMVELHGQCVVVGDNRSKLFQPLNAESNVGSTDGKDGVVTDSDLKRNGNDGEQTRTGEGLPGSNTGKGVEANEDVGEVRRRWDRWFGTRGFKCTSLIRVCELGDSFLEAVRGFGTGVVFCHDSAGRSDQFDGFASLNSRPRIISNEKREKKEKHKGHFEGHFTPFDGSLNLEGRPSH

SEQ ID NO: 165077 - protein, 142 aa, Glycine max
  Coding DNA Sequence Number=SeqID_73392
  Homolog annotation: Hit_ID=A7NUC4; Match level="QueryCoverage=88%, HitCoverage=19%, E-value=3e-28, Identity=57%"; Hit description =Chromosome chr18 scaffold_1, whole genome shotgun sequence
MPHHFFFFLMPSIIIGVVGSESCCVFGSSLASDPETKHKWYGSGVLKQERSAIASEDDEWRTSKVAKTDHDMSSASKAMLFQQRNNSLLRSNATLFSDGHHHQSQMLSFSSPKSESLLVDKASSNATLPFSYHQLSSNTRNA

SEQ ID NO: 165078 - protein, 64 aa, Glycine max
  Coding DNA Sequence Number=SeqID_73393
MEALAGTARRRCRRVVLLSSCYGSMTVVDLMCSDMTVLELMRGNVIMGVKDFENHQMQIHLVPY

SEQ ID NO: 165079 - protein, 103 aa, Glycine max
  Coding DNA Sequence Number=SeqID_73394
  Homolog annotation: Hit_ID=A7NU95; Match level="QueryCoverage=65%, HitCoverage=19%, E-value=3e-16, Identity=59%"; Hit description =Chromosome chr18 scaffold_1, whole genome shotgun sequence
MVKQGSQLKADYEVSWDKDGFFRNSRNQIQEKNNMVSTRAADHYRSEAPRRQAYNSRHSPDTVRPRRFKSLTVTCLTPYGARTTEWLVWKYASKAQNESYFLS

SEQ ID NO: 165080 - protein, 745 aa, Glycine max
  Coding DNA Sequence Number=SeqID_73395
  Gene Ontology: Mol. function=RNA-directed DNA polymerase activity; Cellular component=exocyst; Biological process=exocytosis
  Homolog annotation: Hit_ID=A7NU99; Match level="QueryCoverage=92%, HitCoverage=99%, E-value=0.0, Identity=57%"; Hit description =Chromosome chr18 scaffold_1, whole genome shotgun sequence
  Pfam annotation: Domain name=Exo70; Domain location=140-708; Score =124.7; E_value=2.8e-34; Accession=PF03081.6; Description=Exo70 exocyst complex subunit
  Subcellular localization annotation: CTP_CleavageSite=48; ConfidenceScore=5.60e-01
MSPSFTSTPTFSTSSSSASDNTFKLFGLTPSLHIILIRPKGNNMQCPKNMALEEDPTTLLKLESACSDLKTLLRASEETEENLGNTDTRLDLLQRSLSTASKRIVPLQSLAMSRKALDSRITRALAPALALLNTFKLTECLQNSLVELSTRLSSEKPLQKRLERLLEYTKYVDQLNEGLSNISDEVEVVIQKLQEVVEFISRTKAADQYREARLREALGTLKGLYEIEVDEMRFQGLLDQALVHVQDEFEGLLLRMKLRNLQGDLVHQHGDDFRELGSELEIEVLRRISTTLAANDCLDICIDIYVKARYRRAAKALMKLNPDYLRTYTPEGIEEMEWETLETATTLWIQHLEVAVKKVLLAEKKLCERVLGDFMEGLIWPECFIKISDKIMAVFFRFGEGVARSSKEPQKLFKLLDMFESLEKLKPEMSQIFEGEPGLDICTRFRELEKLIIDASSKVLWEFGLQIEGSIDGLPPAQDGSVPKLVRYAINYLKYLTTVNYRTSMVKVLRTQQTWEDRSINDMSSDEGLLKHAISNVMEALQRNIEAKRMCCRDKVLVHVFTMNTYWYIYMRTKDTELGEVLGERCMKEDYKAVAEESAYLYQKQAWGGLVRVLDGNDVRGEGKGSVGRVVSEKIEAFFKGLNEVCESHARGVYSIPDVDLREQMREATVRLVVPAYAEFLEGYSGLLQRKGYPSVERVKELVGKAFDWGKLKRRTSAASSDWNAARNSGSLERDVRSGNGGGDI

SEQ ID NO: 165081 - protein, 196 aa, Glycine max
  Coding DNA Sequence Number=SeqID_73396
MLFASLTSELPAAGHLFILKVYDEFGTTILYFNEGFVVSEKYVALQICDDEDVETMIESFQQQEQMSVLELYIEKDVVSGSMFHSANSVTSCENNLSNNESKPPRNVNNLHDDKDDDDDYFVSNSYVEESLDKDDSVDDISDTDDEVTNMIQLRIVHPTKGWCHSITWKQISGTTAHHATLSTKQIGGNTNITFVV

SEQ ID NO: 165082 - protein, 582 aa, Glycine max
  Coding DNA Sequence Number=SeqID_73397
  Gene Ontology: Mol. function=peptidyl-prolyl cis-trans isomerase activity; Cellular component=intracellular; Biological process =response to stress
  Homolog annotation: Hit_ID=A7NUA8; Match level="QueryCoverage=98%, HitCoverage=96%, E-value=0.0, Identity=58%"; Hit description =Chromosome chr18 scaffold_1, whole genome shotgun sequence
  Pfam annotation: Domain name=FKBP_C; Domain location=159-256; Score =63.1; E_value=9.7e-16; Accession=PF00254.19; Description=FKBP-type peptidyl-prolyl cis-trans is
  Pfam annotation: Domain name=FKBP_C; Domain location=278-376; Score =102.9; E_value=9.8e-28; Accession=PF00254.19; Description=FKBP-type peptidyl-prolyl cis-trans is
  Pfam annotation: Domain name=FKBP_C; Domain location=44-137; Score =57.1; E_value=6.2e-14; Accession=PF00254.19; Description=FKBP-type peptidyl-prolyl cis-trans is
  Pfam annotation: Domain name=TPR_1; Domain location=396-429; Score =3.0; E_value=2.3; Accession=PF00515.19; Description=Tetratricopeptide repeat
  Pfam annotation: Domain name=TPR_1; Domain location=445-478; Score =2.3; E_value=2.8; Accession=PF00515.19; Description=Tetratricopeptide repeat
  Pfam annotation: Domain name=TPR_1; Domain location=479-512; Score =27.2; E_value=5.9e-05; Accession=PF00515.19; Description =Tetratricopeptide repeat
  Pfam annotation: Domain name=TPR_2; Domain location=396-429; Score =15.3; E_value=0.23; Accession=PF07719.8; Description=Tetratricopeptid e repeat
  Pfam annotation: Domain name=TPR_2; Domain location=479-512; Score =24.2; E_value=0.00047; Accession=PF07719.8; Description =Tetratricopeptide repeat
  Pfam module annotation: Pfam domain module=FKBP_C::FKBP_C::FKBP _C::TPR_1::TPR_1::TPR_1::TPR_2::TPR_2; Domain location=159-256::278 -376::44-137::396-429::445-478::479-512::396-429::479-512
MVVVLSDQDEFDEEPGEVVDSAPPQKVGEERQFSGFKKKLLKRGQGWEFPNFDDVVTVRCVGIGTLLDGTTFDYTRERDRPRTFALGKDDVAAGLDRGICTMKKGEVALFTLPGDGGDGDFTRDSDGSVVRFEVELVSWITVVDVCKDGGVVKKIMEKGSGNERPGDLDEVLVKYQVVLDDGTVVVETPEGGVEFHVKDGHLFPILPKVIMTMTRGEKAELIVQPQYAFGEKGREAGSGLCSIPPNSVLHVNIELVSFKPVINVTGDSKVIKKILKEGEGVFTANEGANVTVRFTAMLEDGTVFEKRGIGETQPLEFITDEEQVITGLDRAVATMKKGERAIVSIHPDYAFGNVEVRRDLAIVPPGATVVYDVEMMDFIKEKAPWELNSKEKIEVAGRMKEEGNVLFKGGNYQRAGKKYEKAADFVEEDGSFGDDEQKQAQTLRVSCWLNGAACSLKLNDFPGAIKLCSQVLDVEFCNVKAFYRRAQAYIETGDYLLADVDIKKALVVDPQNREVKVIQKKLKQLQADSDKKDAKLYENMFARKTKDSPMAIKRLKVEKDERENEEVARMEIDEVADSPVIQ

SEQ ID NO: 165083 - protein, 65 aa, Glycine max
  Coding DNA Sequence Number=SeqID_73398
MTRQSCHQTTLKGLCHQTTKHPTLSDEAKRKCLCVVKYLVAPKRKKEMEVETRELPMQGTLSNRK

SEQ ID NO: 165084 - protein, 480 aa, Glycine max
  Coding DNA Sequence Number=SeqID_73399
  Gene Ontology: Mol. function=hydrolase activity; Cellular component =cytoplasm; Biological process=sporulation
  Homolog annotation: Hit_ID=A8AJB0; Match level="QueryCoverage=53%, HitCoverage=83%, E-value=1e-92, Identity=65%"; Hit description =Putative uncharacterized protein
  Pfam annotation: Domain name=AHS1; Domain location=10-208; Score =406.9; E_value=3e-119; Accession=PF02682.7; Description=Allophanate hydrolase subunit 1
  Pfam annotation: Domain name=AHS2; Domain location=231-480; Score =429.2; E_value=5.7e-126; Accession=PF02626.6; Description =Allophanate hydrolase subunit 2
  Pfam module annotation: Pfam domain module=AHS1::AHS2; Domain location=10-208::231-480
MTGRWVLQRARCYLLGERAVVLELEPPVSLVSQQRIWGLCQRLQQNEQIAEVIPGMNNLTLLLRDPQLKALDAIERLQRWWEESEVLLAEPRQVEIPVVYGGAGGPDLAEVARAAELTSQQVVELHSSADYVVYFIGFQPGFPYLGGLDERLHTPRRAEPRLVVPGGSVGIGGSQTGIYPLAAPGGWQLIGHTPLNLFDPQQQPPTLLRPGDSVRFVPQREGDRGRHGWRQYGISLSGALDEPSMRTANMLVGNAENSAVLEIVLGQFKAEFRRDGWFALTGASCSAELDGQPVWTGWRLPVKKGQVLSLSMPTRGMRSYLAVNGGFAIDAMLGSHSTDLKAAFGGWQGRKLQDGDQLPLGKPTRRFSHQAGVRQLLWGNRIRALPGPEYNEFTHDAQDAFWRNPWQLSPQSNRMGYRLQGSPLQRSVARELLSHGLVPGVVQVPPNGQPIVLMADAQTTGGYPRIACVIEADLYQLAQI

SEQ ID NO: 165085 - protein, 887 aa, Glycine max
  Coding DNA Sequence Number=SeqID_73400
  Gene Ontology: Mol. function=deoxyribodipyrimidine photo-lyase activity; Cellular component=mitochondrion; Biological process =response to DNA damage stimulus
  Homolog annotation: Hit_ID=A7MQW1; Match level="QueryCoverage=43%, HitCoverage=82%, E-value=1e-158, Identity=67%"; Hit description =Putative uncharacterized protein
  Pfam annotation: Domain name=DNA_photolyase; Domain location=404-566; Score=45.8; E_value=1.5e-10; Accession=PF00875.9; Description=DNA photolyase
  Pfam annotation: Domain name=DUF1722; Domain location=289-406; Score =220.2; E_value=5e-63; Accession=PF08349.2; Description=Protein of unknown function (DUF1722)
  Pfam annotation: Domain name=DUF523; Domain location=103-240; Score =160.5; E_value=4.6e-45; Accession=PF04463.3; Description=Protein of unknown function (DUF523)
  Pfam annotation: Domain name=FAD_binding_7; Domain location=592-863; Score=468.4; E_value=9.2e-138; Accession=PF03441.5; Description=FAD binding domain of DNA photolyase
  Pfam module annotation: Pfam domain module=DNA_photolyase::DUF1722::DU F523::FAD_binding_7; Domain location=404-566::289-406::103-240::592 -863
GIDVSGISTRQNCAAPCAGGIDWRTGAASDAVPPGSRALLQLSAPHVVQNQHQTGLAGAIGSGRRYLLWCDKRIVPVLSRGISATLKPLQDFGGCTSMSEKIPVGISACLLGDSVRFDGGHKRFAFATDELAPFVRFEPVCPEMAIGLPTPRPALRLVKQSDDQIHLCFSKDGGEELTDDMARWSAERVKSLHHLCGYILCAKSPSCGLERVRVYEPDTNNNRKAGTGVFTSFLQKELPWLPLEEDGRLHDDAIRENFMGRVYALHEFNDMWRSGLTRHKLIAFHSRYKLLLLSHAQDEYREMGRFVAAMEQWESLDAYAFEYRNRLMHLMSHQASRRNHTNVLMHVQGYFRPKLSSPQRQELAQLIDRYRRGVQPLLAPITMLKHYMAEFPHPWLAQQRYFDPYPEALRLRYGQPRCWRCSSPRPASGSNTAWPPNRRLLSIKTCACCSSRWQNAVFKLHFHQCDDFAASVDYLATFCQQHKVDALFYNYQYEINERQRDAAVEKQLDQQGVVCQGFDDSLLLPPGSVQTGSNSMFKVFTPFSKAFIRRLQQGLPECHHAPKARAGAPVAAGKKIAAFDYPVEKFDETWFPAGEEAALKQLRQFAQQRVEKYDQQRDIPAIDGTSRLSPYLAIGVLSPRQCLHRILKEHPQALNNGSALVWLNELVWREFYRHLMVAFPALCKHQPFVDWTRNVSWQQNKQHLTAWQQGKTGYPIVDAAMRQLNTLGWMHNRLRMITASFLVKDLLIDWREGERYFMQQLIDGDLAANNGGWQWAASTGTDAAPYFRIFNPTTQGERFDKQGEFIRRWLPELQDVPDSAIHQPHAWAEKNNKKLDYPAPIVEHKAARGHGAVMNNFELEQIVNQQLNTSAFSDYAPNGLQVEGREQ

SEQ ID NO: 165086 - protein, 84 aa, Glycine max
  Coding DNA Sequence Number=SeqID_73401
MEIYVSDRLGKSVCDDKKLKGQEHFMITKMMISRIKDEFKIESRTLQSSKRKFDFKNQESSFKIQVPRIKIKIQDSRIKNQKKT

SEQ ID NO: 165087 - protein, 204 aa, Glycine max
  Coding DNA Sequence Number=SeqID_73402
  Gene Ontology: Mol. function=motor activity; Cellular component=cell projection
  Homolog annotation: Hit_ID=UPI00016621D1; Match level="QueryCoverage =86%, HitCoverage=40%, E-value=8e-18, Identity=35%"; Hit description =UPI00016621D1 related cluster
MRGPLKESTSCFLVRLKSFGTCTYWLAFRGLHVLTFRGLHALAIRGLHVLTFRGLHVLTFVGLHALTFRGLHVLTFRGLHALAIRGLHVLTFRGLHVLTFVGLHTLAIRGLHVLTFRGLHALAIRGLHVLTFVGLHALTIGGLHVLANRGLHALTFRGLHVLAFRGLHVLAFKGSCTFTFVGLHALTFRGLHVPHFQRGTCLHL

SEQ ID NO: 165088 - protein, 117 aa, Glycine max
  Coding DNA Sequence Number=SeqID_73403
MPFCGRARRDSRVDKSGALALTYPPSKRKSDLRSSFGGESSDSFYLEGGHFKALDLKNDPFYLLSKKLRKLTDCVTILPFDFRHVTEFHGLRNNGCQVLRSGQSKVACHQAIVPGRN

SEQ ID NO: 165089 - protein, 91 aa, Glycine max
  Coding DNA Sequence Number=SeqID_73404
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSYVPIQRLIFAKSWPRASRYQQGHQDLFILRSDLPSQVLQWLLFLSAVPPVQLLTGWCVTAKAPPDISAGKCSGHAARNHHTRRA

SEQ ID NO: 165090 - protein, 434 aa, Glycine max
  Coding DNA Sequence Number=SeqID_73405
  Gene Ontology: Mol. function=cation transmembrane transporter activity; Cellular component=membrane; Biological process=cation transport
  Homolog annotation: Hit_ID=Q1H155; Match level="QueryCoverage=49%, HitCoverage=45%, E-value=9e-72, Identity=65%"; Hit description =Putative uncharacterized protein
  Pfam annotation: Domain name=Cation_efflux; Domain location=253-434; Score=-90.7; E_value=0.00026; Accession=PF01545.12; Description =Cation efflux family
MMMRSEAMVADAAMPTEQGLLEYHLYTLPRATTIAENQTKQVALLSAQHIPARKELVLAGADYYYQGQYRDIEKKQKVQVYVEFENKESSKLGLPLPKGTMRVYKKDSDGTAQFVGEDQIDHTPKNETVRLKLGNAFDVTAERVQTDFKNLSKQNQAQIYESAYTLTLHNAKKEAVTVTVQEPINGDWKILNESQPHKKTNAHQATWKINVPAEDSDIQLRLNRKPANMSAHCCPPPTPQPEHSPQKSYRRVLWIALIVNFSMFMIEVASGLHANSVSLLADSLDFFGDAANYGLSLWVLGMHVSVRARASLVKAISMGLFGLWVLGSAVSHFISGIVPSPETMSAIGLLALLANLGVAWLLYAYRHGDSNMRSVWLCTRNDAIGNVAVILAAAGVFGTGSAWPDLMVAVVMSCLALHAAWQVIAQAKSELHRH

SEQ ID NO: 165091 - protein, 64 aa, Glycine max
  Coding DNA Sequence Number=SeqID_73406
MYIKYGSKYIMKHGQQNMLSNETKTPTLIPKTIPKLQNSLRICELQYKERETRLKWAIKGIKSR

SEQ ID NO: 165092 - protein, 445 aa, Glycine max
  Coding DNA Sequence Number=SeqID_73407
  Gene Ontology: Mol. function=siderophore-iron transmembrane transporter activity; Cellular component=cell outer membrane; Biological process=siderophore transport
  Homolog annotation: Hit_ID=Q8ZQ10; Match level="QueryCoverage=86%, HitCoverage=53%, E-value=1e-143, Identity=61%"; Hit description =Outer membrane receptor for Fe(III)-coprogen
  Pfam annotation: Domain name=Plug; Domain location=73-176; Score =58.1; E_value=3.1e-14; Accession=PF07715.6; Description=TonB -dependent Receptor Plug Domain
MRVRDAGLAPQRALRLSLLAVLVASGVAQAADTQNSEATLTVDASASAEAQQTQAAADYSVPVTRAGTKMALTARDIPQSVTIVSKQRMQDQQLQSLNDVLSNTTGIHGVAADMDRINYYSRGFLIDNYMTDGIPTAFAQRWNLGDAQTDTALYERVEVVRGATGLLTGPGNPSAAINMVRKHADSKEFTGSLEAGYGSWNRQRYVADLSAPLSPEGNVRGRLVAGYEDKNSFIERYGADKKFIYGVVDADVTDATRLSVGYEFSQVNTDSPMWGGAPRWYTDGTQIHSRRGYNTAPEWAYNNKENKKVFVNLQQNFDNGWNITLNGTHNEMFLDSKQLYLDGYFDKTTGAGVSGYAGYPVVGGTGYNTGKRKVDAVDAFASGPYELLGRQHELMVGVNYSRQDNKYYSAWANISSAELGNFNQFNGDFPETDWNPREPAADTQL

SEQ ID NO: 165093 - protein, 83 aa, Glycine max
  Coding DNA Sequence Number=SeqID_73408
  Homolog annotation: Hit_ID=A2QN21; Match level="QueryCoverage=100%, HitCoverage=17%, E-value=2e-08, Identity=39%"; Hit description =Putative uncharacterized protein
MPRRYRAREYDEDMYEVERDHYHRKHQHRPRGGRHYKEEVICEQPRAPSPPPVEEFDRLRIRDDAGPELIREPPRETSKELRK

SEQ ID NO: 165094 - protein, 19 aa, Glycine max
  Coding DNA Sequence Number=SeqID_73409
PYLGIESNRAPLTQWRERH

SEQ ID NO: 165095 - protein, 483 aa, Glycine max
  Coding DNA Sequence Number=SeqID_73410
  Gene Ontology: Mol. function=nucleotide binding; Biological process =phosphonate transport
  Homolog annotation: Hit_ID=A4W5M1; Match level="QueryCoverage=99%, HitCoverage=61%, E-value=0.0, Identity=85%"; Hit description =Putative uncharacterized protein
  Pfam annotation: Domain name=Dynamin_N; Domain location=51-279; Score= 56.8; E_value=7.6e-14; Accession=PF00350.14; Description=Dynamin family
  Pfam annotation: Domain name=MMR_HSR1; Domain location=49-279; Score=- 12.6; E_value=0.015; Accession=PF01926.14; Description=GTPase of unknown function
  Pfam module annotation: Pfam domain module=Dynamin_N::MMR_HSR1; Domain location=51-279::49-279
MPTAMLESTTAAITGEKNNVLPLHFSARGVDAQQAMLNNELRKITRLEMVLAIVGTMKAGKSTTINAIVGTEVLPNRNRPMTALPTLIRHTPGQKEPVLHFSHASPIDELIQLLQKKLGDYDRAKLAQRLEIDKDMNTLLARIEKGEAFEKHHLGAQPIFHCLKSLNDLVRLSQALGVEFPFSEYAAIEHIPVIEVEFVHLAGLDAHLGQLTLLDTPGPNEAGQPHLQKMLSEQLSRASAVLAVMDYTQLKSISDEEVRQAISAAGKSVPLYALVNKFDQKDRNSDDEEQVRAMISGTLMKGNISPGQIYPVSSMWAYLANRARYEMNTHGQLPDHQEQPWVQDFAEAALGRRWRTADLDDIDHVRHSADLLWEDSLFEQPIRKLIYAAYANASLFALRSASHKLLNYAQNAREYLDFRYQGLTVAFEALELNIARLEEDMALLQTRQRVVSDEVKHEVEQALNATADFMVSQKTALYHAMGD

SEQ ID NO: 165096 - protein, 91 aa, Glycine max
  Coding DNA Sequence Number=SeqID_73411
MPKPRTEKQVRGFLGRIKWCLMNPPVLVPPVPGRPLIIYMRVLDESMGSPFEVVYAECRNLPFGGRVTHDSRVRVPRKEYARVATNVYLRK

SEQ ID NO: 165097 - protein, 134 aa, Glycine max
  Coding DNA Sequence Number=SeqID_73412
MGNLEEVQEQMKVNMSILKEQMASMMEAMLGMKRLMESNVATATTTSMAAEADPALSTVAQHPVPNIVGRGRSTLGHVNNPHLGYNRGAYLYGLPPNYTPLAMHEDAGHVTPFILEGEPPQHPDGVHEDPQEHT

SEQ ID NO: 165098 - protein, 17 aa, Glycine max
  Coding DNA Sequence Number=SeqID_73413
MAVIRGNSVVTIEVLQI

SEQ ID NO: 165099 - protein, 182 aa, Glycine max; identical to SEQ ID NO: 102302
  Coding DNA Sequence Number=SeqID_73414

SEQ ID NO: 165100 - protein, 135 aa, Glycine max
  Coding DNA Sequence Number=SeqID_73415
MDSSSSTENKKLEGKLDALVNLVTQPAMNQKYTLVARVYGLCSSADHHIDLFPSLQESGVNEQPKAYAANIYNRPPQHQNQQQQNNYDLSSNRYNPGWRNHPNLRWTSPPQQQQPVPPFQNVAGPSKPYVPPPMQ

SEQ ID NO: 165101 - protein, 221 aa, Glycine max
  Coding DNA Sequence Number=SeqID_73416
  Homolog annotation: Hit_ID=A5AKA6; Match level="QueryCoverage=93%, HitCoverage=22%, E-value=6e-09, Identity=20%"; Hit description =Putative uncharacterized protein
MSLKLPHYPELVKVFYYNLKIQDDIISSEVHSIPMIIDQSLFFSLTHLPSQGAHFEGTIVDDWKFDYSSHDARRMVCNDQAEMTGRLLAGSLTFDNRIMHYIIVRILLPRSSNLAQAFEEDLILMWAFLIGRQIDWAHLVRYRMHKALRANAPLPYPQLITLFLRHFQIPLDDEPFVQVKRSFAIDAGAVTSFGYRKDRNVQWLKKDALPPQDERTPSPPP

SEQ ID NO: 165102 - protein, 103 aa, Glycine max
  Coding DNA Sequence Number=SeqID_73417
MPFVKVKRSFSIGANVVSSFGYRKERDGSWVKKDAPAQAAEDPSPSPPPQRDDSSPLMQRILDRLDGLHTFVGECFDALESHIDAIDSRFVGMDTRITQLEED

SEQ ID NO: 165103 - protein, 103 aa, Glycine max
  Coding DNA Sequence Number=SeqID_73418
  Subcellular localization annotation: CTP_CleavageSite=57; ConfidenceScore=5.20e-01
MWTTTGEKLAAQLAQASKVASSRSKSLLEESSGGPKWACFRRSYGNSRIAQQHLLLVSATLPNFTDRVTLLPFDFRRVSRLTYCATKGAKYLETANQRLHVIK

SEQ ID NO: 165104 - protein, 81 aa, Glycine max
  Coding DNA Sequence Number=SeqID_73419
STLEDPTSKASARWIVVKCNRQKGSTECDYYVMRWMSTIILGTFRNNWEAYFNDPRPLELKRLKALRIQWARFYLRVGDQA

SEQ ID NO: 165105 - protein, 123 aa, Glycine max
  Coding DNA Sequence Number=SeqID_73420
MERSMIDVTSSGAIGDMTPVEARNLIEKMASNSQQFSARNDAIVIRGVHEVATNSSSSDETKKLEGKLDVLVNLVTQLAMNKKSAPIARLCGLCSSADYHTDLCPSVQQSEAIEQPGAYDANI

SEQ ID NO: 165106 - protein, 205 aa, Glycine max
  Coding DNA Sequence Number=SeqID_73421
  Subcellular localization annotation: CTP_CleavageSite=61; ConfidenceScore=5.58e-01
MTSKTQTSFSIKSQKQNNQKIYNNSFKKKTKQFLFKKKHTLSGRSGSSGTIPEEPLLPEISSENLKGHPEEVFRETSGRSVLPEDVWLLPEEHFFQKLSGTGSSGTFGTTPSGSSRSLRCEPFSPFFLVSPALVFYPKCIIKAKGRLGTPTSNRNGVQPKEAAVGLTVEEKARGRGKKRKKSRSKKKRLSDSGRGEGKLFKCQQN

SEQ ID NO: 165107 - protein, 52 aa, Glycine max
  Coding DNA Sequence Number=SeqID_73422
TRHVRIYMEKNEETIMEKVKLKINGGSMSTYLKLLCSDYHLMEACLRSFYGD

SEQ ID NO: 165108 - protein, 87 aa, Glycine max
  Coding DNA Sequence Number=SeqID_73423
  Subcellular localization annotation: CTP_CleavageSite=76; ConfidenceScore=5.23e-01
MARTCSPLKARMCSPLKARACSPLKVVRTRAHTTYLRLTISDLSHVAPLPPKKPSKSVISSSIQTPPLPGPRASLRAMRPQPQIAPE

SEQ ID NO: 165109 - protein, 239 aa, Glycine max
  Coding DNA Sequence Number=SeqID_73424
  Homolog annotation: Hit_ID=Q6WAY6; Match level="QueryCoverage=81%, HitCoverage=30%, E-value=5e-10, Identity=25%"; Hit description =Putative uncharacterized protein
MGMRDCINYNPMLAIRQLGYPMRGAPSEETITPFISRGFNETNTKKLQKIHKAWNKVGRKDKELRGRSNGVIGGYHKWLKSRMQGIAWLKKLKDLNGEEAKVLEESEKVQALKAELEKTKVAKEKLKVVVTRVRKEYDKLKDINMTTTEALDWEMKKARKEEWSRNKFRGALLGSSNELKLRKAERDKSRMENMMLEDKLRNFQRSKGCEGVGLAESQELPRLLARAKTVANTYSTLDE

SEQ ID NO: 165110 - protein, 198 aa, Glycine max
  Coding DNA Sequence Number=SeqID_73425
MGEVEEVQEQMKADMEAMKEQMTTMMEAMMSIKKIMEANAVAVVVTSIVAKVNLTPPSGLNQMNHPTSDMHAFPPYGLPPNYTPPNVAYTPSENVNNSTPILIESQQPQSDHAHVSQPMGETHEIPHHNLAELEPCLGYATEGQAVGGIPLQNTLEGPSISPLTITLLWENNGLHTFKLYGFGLRRRNDQSGSGKRQI

SEQ ID NO: 165111 - protein, 205 aa, Glycine max
  Coding DNA Sequence Number=SeqID_73426
MRQFGLQQIIPDDPPNLDQLHDKDMGGRANIFWPHHHRHWIVKWNHWNDYIIHGEMDQGFSGHASQGCQQNFQPVWLSSYMPQYSFQVPFTSNVFDDLSQMFPTTLNTTPSAYNLTPSTSCYRSSLSTQMRDMGHKDEEDDDDDNNNNNDDDDDDDNNNNNDDDDDDNGDDHVPQQQHIITREHPRTRGGRGRRPREQQTQTNPV

SEQ ID NO: 165112 - protein, 58 aa, Glycine max
  Coding DNA Sequence Number=SeqID_73427
MAGVWTSLYICMGRVLPIGCFTIVRSIWLFLEQRIAVREDAKANLAAALTFCCMVYNC

SEQ ID NO: 165113 - protein, 26 aa, Glycine max
  Coding DNA Sequence Number=SeqID_73428
MDPGRFQISIPSDDFPILSFAPIGLI

SEQ ID NO: 165114 - protein, 95 aa, Glycine max
  Coding DNA Sequence Number=SeqID_73429
MVRGSHSTRSMEFRLAQGTVTLFSNFTPQREECVTDSVESLGFRGVDESFGDTTHWFVFHSQTPPHAQINTPSCWTPIQVERRIEFNEHWKVGFD

SEQ ID NO: 165115 - protein, 72 aa, Glycine max
  Coding DNA Sequence Number=SeqID_73430
MRLSHQVLKVTVELSSLGNNNNKKKARVQNSIAHHSAYFEKRALEATRGAAFAERLRFCKLIILRVSSVMAG

SEQ ID NO: 165116 - protein, 370 aa, Glycine max
  Coding DNA Sequence Number=SeqID_73431
  Subcellular localization annotation: CTP_CleavageSite=33; ConfidenceScore=5.21e-01
AYKLQWSLHQMASKKRKTPSTPTQTKFDRSRFTSQEAWERYTDIVLPRKLLPERNVVIYYTEFDEFKEELERRHWDEKLTDFSNNNIDIAIVKEFYANLYDPEELAAKLCIPGRGFELNADGQPLKILRKNMNTLAQTWSVLSFSNLIPTSHTSDITLDRAALITALYKARGVISDSLTLESLDPAINVAYVKKNCWNLDDLSVTFRGPRKANGKRFEAPPSSEVPPSSAPAPIPSVPFASTSVFPAPLSAGPSEFIFTPQMSPAFSSGGGGASAAQEPASEEPTVVATEGEDELTPPEPSYFDAGIHMAKEEDASTDQIPEPSPTPIPDDATPFALAPDLEQPISQDSPTAQVLDLNDAQEQPQDEQDI

SEQ ID NO: 165117 - protein, 58 aa, Glycine max
  Coding DNA Sequence Number=SeqID_73432
MCFREEIPSRGASVTLLRRFREQIREHFPFFIRSSVFNRSKNPAFVGHPQEIINGPMP

SEQ ID NO: 165118 - protein, 154 aa, Glycine max
  Coding DNA Sequence Number=SeqID_73433
MWKQSFQAYFDDTKDSSQESRFKQVSRNQRVIQSRIKIQEKTQDMQELQEKHQDKEREESKEFSNCVVLNSLTREKGDTKEFRWLVLHSFGKGRRETQKEFKRLVLGEFFLAKGEENEKMNSTSFQGFENQKTSESFWYKEEEEVQRDLGLVKD

SEQ ID NO: 165119 - protein, 89 aa, Glycine max
  Coding DNA Sequence Number=SeqID_73434
  Homolog annotation: Hit_ID=A5CBU4; Match level="QueryCoverage=49%, HitCoverage=20%, E-value=5e-07, Identity=54%"; Hit description =Putative uncharacterized protein
MYHGIVTTLADVHHVPELKKNLVSVGVMDSKGFSSWVDGGVMQIRGKEKLCTLQRPYWTTSILNARGLREFHHWEGQGTSSPSSMITQG

SEQ ID NO: 165120 - protein, 48 aa, Glycine max
  Coding DNA Sequence Number=SeqID_73435
MTLKGEDESRISSPPYEAMDKSLKVEEHEWRQKPTNPRSSPRFSTKCA

SEQ ID NO: 165121 - protein, 84 aa, Glycine max
  Coding DNA Sequence Number=SeqID_73436
MDASEPYTEAMRATILKNPEWEPLLNQREEQCKQRMHEGELPGNHITSETSKRVGLRPQKETTPENLAFHGFKQKTQLKHEAET

SEQ ID NO: 165122 - protein, 141 aa, Glycine max
  Coding DNA Sequence Number=SeqID_73437
MASRKRARAEDIPSSSNPPPSIATMEPDAQQAPPIIPMLQSLFRRQLVAWLEAQFPLGRAPEVVPPSPIPTRTEPALAESQPPVVNPLASPEVEILSPPPAPPAPPLILIPDDSDAEVVAPPDSPTHYLEDGSDFSDWMDY

SEQ ID NO: 165123 - protein, 199 aa, Glycine max
  Coding DNA Sequence Number=SeqID_73438
  Homolog annotation: Hit_ID=A5AZ88; Match level="QueryCoverage=59%, HitCoverage=13%, E-value=4e-10, Identity=36%"; Hit description =Putative uncharacterized protein
MQQAFRRTATQISKLVDDMANPAVRQQEERAEIETHQESIFKVTSIHHQMTTEEKTSEVSSTPEYSCPAIASYVGGTEKGRLELSVEDQKVSFDLFEAMKHSDMGDACSDTTVIQQFPLEKELGDEIDNLVDNEECDDPKDNCVDHVVSEELEKMRPPENPKAELKTLPAHLKYVFLEDDETKPVIISNSLKKEEEDQQ

SEQ ID NO: 165124 - protein, 109 aa, Glycine max
  Coding DNA Sequence Number=SeqID_73439
MTRGNLGDLQSFDPKIDRTFHRLVRHSVHPDHFVHFEHCEHFEHSEYFVAGDSEYSDFEHSTTNFHTENMAQPPPRRGLLGRWLHLVSLMKACAFNILMRVFHIFSRLD

SEQ ID NO: 165125 - protein, 110 aa, Glycine max
  Coding DNA Sequence Number=SeqID_73440
MALEEGEVKIEKFDGRDFSFWKMQIEDYLYQKKRYQILSQPTLLRASKARLTGALSKGAKCAESPPTFICGKRQKNRRKPVIKNIPDSGVVFTFEEGISTSHVCPKGQQP

SEQ ID NO: 165126 - protein, 146 aa, Glycine max
  Coding DNA Sequence Number=SeqID_73441
  Homolog annotation: Hit_ID=A5AMK2; Match level="QueryCoverage=25%, HitCoverage=4%, E-value=2e-07, Identity=75%"; Hit description =Putative uncharacterized protein
MEVRDKVELLLYRDLDELKSLLQNLMAFTLIQGILGAAPSKPKEDKGKTIEKSTRKTSSQARTSNIKSSNVLGEEPTSFPSFSGSEDEVRGEESSEEVYPHEEGDLLMQGEMIVNQQVKVPSSIGTYKDEVNCDIVPMEAGHILLG

SEQ ID NO: 165127 - protein, 143 aa, Glycine max
  Coding DNA Sequence Number=SeqID_73442
MASKDGSWQSPGVNGSGGGALAFHLKEVSLAIRELISRFFRNLLKESSQGGELSYERASSSSFLSKAILGGEAHSSLSYSLVDGASHLLFSFAFRCISMDRFRAHGDAILPRKGLVTRVMSKRLQEDWASATKGGPRVLMNIR

SEQ ID NO: 165128 - protein, 53 aa, Glycine max
  Coding DNA Sequence Number=SeqID_73443
MWTTTGEELATQLAQATQLAQASKVASSRSNSLLEEESGRPKWARLLFVPFFY

SEQ ID NO: 165129 - protein, 122 aa, Glycine max
  Coding DNA Sequence Number=SeqID_73444
MTRGNPSDLQPFDLEIDRTFHRLVRHHFIPFEHPEHSVTGEFVHSVIGDFEHPDFEHYNFEHSDFEHSENMAKPPPRERTLREMAATDFTYECLCIQYPDEDVPYVLKTGLIHLLPKFHGLA

SEQ ID NO: 165130 - protein, 119 aa, Glycine max
  Coding DNA Sequence Number=SeqID_73445
  Subcellular localization annotation: CTP_CleavageSite=33; ConfidenceScore=5.50e-01
MRLHCYQASRRPSMTTNQPPLPMSHTDLGIGPSTSMRVQRSCRGELRLSPEVTSSPRRAGSLTLKLCGSLGEPEASLDKLESRKLKERTLLSPFFGIFHILDQTIERSFVLHGNWCQTT

SEQ ID NO: 165131 - protein, 47 aa, Glycine max
  Coding DNA Sequence Number=SeqID_73446
MGSKIYPKVNENPKAFFISSSPILLEPFAHGSGFLVWKAKSSVGSSL

SEQ ID NO: 165132 - protein, 257 aa, Glycine max
  Coding DNA Sequence Number=SeqID_73447
MTEYYPLGRRLSAVPLSSSLRSSGAIPRRLYDLGPWDFVLGLPSRSGTSSVGMVLGFSFELNTYPYTTKSAYSMLSQLGGVEEPVESFKLLWILKVPNKAKLLIWRALKYRLPTIDNLVERNGELSSFVGVLFLKVSKFTSRVANLGESSSMATFSGLQIQHLVFKDGWDKEIHFFGFDMYVGIGRPSHGVILMKGGVKRIHHSLRSLWEECMPKCDVAPCGACRPWIFFINGFLCFLRSNCSGMEKEKDEWRRHFK

SEQ ID NO: 165133 - protein, 141 aa, Glycine max
  Coding DNA Sequence Number=SeqID_73448
MPKYDPEVVMEFYANAWPTEEGVMDKRSKVRGQWIPYDTDAINQFLGNPLILEEGQQCEYTKRRSQFTGFNEEAIGQLLCFPGHDFVWSIAGKRFIMAQINVHVAQLISDAIHQFVGTEPPRHPVDPKKSNKALGFPELII

SEQ ID NO: 165134 - protein, 74 aa, Glycine max
  Coding DNA Sequence Number=SeqID_73449
  Subcellular localization annotation: CTP_CleavageSite=53; ConfidenceScore=5.76e-01
MTKEVIHGHNSAMPRLHFSSSSSSSSSMCFSTSFRLLRKLAQASCLLRAKDSSASTLTKLVMVQQTRLAPEDTT

SEQ ID NO: 165135 - protein, 103 aa, Glycine max
  Coding DNA Sequence Number=SeqID_73450
MEVKTATVIATSTATKVDPTHPSGLNQVNLPVLDMVGQGGKALGSTGGPHFVQVQNKNSFPPYGLPPNYTPPDVAHAPDENVNNFTPIHIESQQPQSDHVHVS

SEQ ID NO: 165136 - protein, 189 aa, Glycine max
  Coding DNA Sequence Number=SeqID_73451
MIMKGQDIYSSQEETTSSPSSSGSEDEVRGEKSSEKVYPHEEGDLLMCKERNHSLFRLGKQKIPKNKGKRVFSLSFLDPSSPRLAYGSSGPPNYFRVKELARLGKPVTSGVSISSPGRAAIAPSAYFPINRHAKEAERGFQHSVVKEIERIRREEEEMKLGRYQIVIVINPYFVSCSVFFVRPSVSFIF

SEQ ID NO: 165137 - protein, 108 aa, Glycine max
  Coding DNA Sequence Number=SeqID_73452
MRVHCYQASRRPSMTTDSPPLLMFPRTRKDKEKEQKGSHGKESTLIDLPNSLTKVPSAVANCHNLPFGGRATRGITGASSKKGKCTESPPTFIRGKRQKNRKGVLYEL

SEQ ID NO: 165138 - protein, 84 aa, Glycine max
  Coding DNA Sequence Number=SeqID_73453
  Homolog annotation: Hit_ID=Q2AA51; Match level="QueryCoverage=86%, HitCoverage=22%, E-value=8e-08, Identity=41%"; Hit description =Retrotransposon gag protein
  Pfam annotation: Domain name=Retrotrans_gag; Domain location=17-83; Score=10.6; E_value=0.005; Accession=PF03732.8; Description =Retrotransposon gag protein
MHETSGFSSPGDIIEHRNIVRSLAGEAKRWLHSFKGNNMKTWEEVVEKFLKKYFPESKTTEGKAAISSFHQFPDESLSEALERF

SEQ ID NO: 165139 - protein, 80 aa, Glycine max
  Coding DNA Sequence Number=SeqID_73454
MASPMTCGGASEPIDTQRLTSSSAPLSSTGGESDDMQGYLMVIRTFCRPEASEPIDTQRLTSSSAPFVNQRQASPLTRRD

SEQ ID NO: 165140 - protein, 91 aa, Glycine max
  Coding DNA Sequence Number=SeqID_73455
MFSPFGTSLSFEFAWKNRFREENLSRGASENASVSDSVEILHRSSPFFIRSSFVLRSSTGLISSSQLRICRSKSPAFVDHPQEIVNVPGIL

SEQ ID NO: 165141 - protein, 122 aa, Glycine max
  Coding DNA Sequence Number=SeqID_73456
  Subcellular localization annotation: CTP_CleavageSite=72; ConfidenceScore=5.35e-01
TYQGNPCGVCPDLSSFTGSGVYPDLSSFTGSGVYPDLSSFTGSGVYPDLSSFTGSGVIQNLRSLYQTIRPVRFTSYSPILFEKNDSRRRPGKRTDRGLKKKLHRMMPFEHFPIDIIQLLFRD

SEQ ID NO: 165142 - protein, 166 aa, Glycine max
  Coding DNA Sequence Number=SeqID_73457
MTHQQGNFEAWVQVPYIYVEKEQSQEEKKLLQDRTVASILEEETHFSDSSSSESPSSRESTTYLPETVSMANEHQQRVTRKDYSSNSVPQFFTSIARPEVQVHNINYPHSLIHLIQGNLFQGLPNEDPYAHLATFIEIYNTVKMHACQMKPLDSVYFHFPWQEKPR

SEQ ID NO: 165143 - protein, 68 aa, Glycine max
  Coding DNA Sequence Number=SeqID_73458
  Homolog annotation: Hit_ID=A5BKB8; Match level="QueryCoverage=48%, HitCoverage=9%, E-value=1e-10, Identity=93%"; Hit description =Putative uncharacterized protein
MGGGAWPFLVGGAICLVNSVNERDLSLLNSYVENPVNHRVFERKLRPKPLGRGHACLGVTHRFPNANM

SEQ ID NO: 165144 - protein, 45 aa, Glycine max
  Coding DNA Sequence Number=SeqID_73459
MPSFRDLEQKWAPKVEALLGNNGGGRKEKAIFSRFSASVGASFRK

SEQ ID NO: 165145 - protein, 116 aa, Glycine max
  Coding DNA Sequence Number=SeqID_73460
  Gene Ontology: Mol. function=binding; Cellular component=chloroplast; Biological process=photosynthesis
  Homolog annotation: Hit_ID=P61843; Match level="QueryCoverage=83%, HitCoverage=61%, E-value=8e-28, Identity=62%"; Hit description =Photosystem I assembly protein ycf3
  Pfam annotation: Domain name=TPR_1; Domain location=64-97; Score =34.3; E_value=4.3e-07; Accession=PF00515.19; Description =Tetratricopeptide repeat
  Pfam annotation: Domain name=TPR_2; Domain location=64-97; Score =20.7; E_value=0.0055; Accession=PF07719.8; Description =Tetratricopeptide repeat
  Pfam module annotation: Pfam domain module=TPR_1::TPR_2; Domain location=64-97::64-97
MDCEPYEIRKFSSTVLGKELTHLIPTEENSSSDRETMRKLRSLFTTEYYEAMRLETSLIPYDRSYILYNIGLIHTSNGEHTKALEYYFRALERNPFLPQAFNNMAVICHYVRLSPL

SEQ ID NO: 165146 - protein, 77 aa, Glycine max
  Coding DNA Sequence Number=SeqID_73461
MPISPCGSISWIAPTRHPVVPEKSNRALGFLALVTGLCQSYRVPVPPARSRHHDIESRPQDTQWTRRSPTGSWGFQL

SEQ ID NO: 165147 - protein, 242 aa, Glycine max
  Coding DNA Sequence Number=SeqID_73462
  Gene Ontology: Mol. function=beta-N-acetylhexosaminidase activity; Cellular component=membrane; Biological process=carbohydrate metabolic process
  Homolog annotation: Hit_ID=A8G954; Match level="QueryCoverage=100%, HitCoverage=30%, E-value=3e-88, Identity=64%"; Hit description=Beta -N-acetylhexosaminidase precursor
MPRLKGSAVQGSFTLIESKNGWRGFIDFSGKARRQVSDIRWLSPTQLTFSVDSWMGPFQPVVTMTRDSLTGYVLVGNVRYPTTGSRLAQIPAGIAPVLPTPAQLQRDLLGGEAALWAENVNSRVIDTRLWPRAFVVAERLWSAQDVTDSENMYQRLSAIDRWGTVSVGLQQHQQAEVQMMRLANSSDITPLRVLAEVLEPAQYYTRQHLKFQAGHYDYFEPLNRLADVLPAESEPVRLLDKQ

SEQ ID NO: 165148 - protein, 51 aa, Glycine max
  Coding DNA Sequence Number=SeqID_73463
MPCIIQHDEVDDVHAIRNDHDEGSWEHLQRPRRIPMVIRRLCLKRLDNPHN

SEQ ID NO: 165149 - protein, 43 aa, Glycine max
  Coding DNA Sequence Number=SeqID_73464
MAGTFFLLKQQNSLEIMSVTLLDIPGGGNRVVKSFKHLWRGMA

SEQ ID NO: 165150 - protein, 129 aa, Glycine max
  Coding DNA Sequence Number=SeqID_73465
MSKSYGFGMTGPLDESISCFLIRVDPWVLVPIAFRGLHILAFRGLHVLTLRGLHVLALRGLHVLTIRGLHTLTSRGLHVLALRGLPALALGTSYPHLQRTTRPHLQRDTRPRHQRTACPHLRRATRPRL

SEQ ID NO: 165151 - protein, 50 aa, Glycine max
  Coding DNA Sequence Number=SeqID_73466
MDKSLKEEKMRGGRSIEGAQNFVPQMSPLIQDQVLDSPLSVLRCHETCKA

SEQ ID NO: 165152 - protein, 237 aa, Glycine max
  Coding DNA Sequence Number=SeqID_73467
MTLYWHRISCFLGNLRFEQKHSVIHCTICGEAHEIGQCIPIEENTQEVHYMGNKQRQGYTQGGFSSFQQGPYNQQGQWRSHPGDQFNKDQGGSSNRPIQQGPNIFQRTTKLEETLTHFMQVGQLAKQIADKTSNSFVANTEKNPKEECKAVMTRSKRFVEAEDEDSVVSKKKASEKKDKVIGESNQEKEKQIMAKKKEDGHKAQKCGEEMLFSVNGDCLWQFYFILAVSCCALSVTT

SEQ ID NO: 165153 - protein, 69 aa, Glycine max
  Coding DNA Sequence Number=SeqID_73468
MNFAAKKPIEFTPIPVSYADLLPYSLDNSMVAITPAKVHKPPFFRGYNLNTTCAYHGGAPGHSIEHCRA

SEQ ID NO: 165154 - protein, 211 aa, Glycine max
  Coding DNA Sequence Number=SeqID_73469
  Gene Ontology: Mol. function=transcription factor activity; Cellular component=intracellular; Biological process=regulation of transcription, DNA-dependent
  Homolog annotation: Hit_ID=P0ACP3; Match level="QueryCoverage=100%, HitCoverage=63%, E-value=1e-88, Identity=76%"; Hit description =Fructose repressor
HLLQRQVDAIIVSTSLPPEHPFYQRWVNDPLPIIALDRALDREHFTSVVGADQDDAQALAAELRQLPVKNVLFLGALPELSVSFLREMGFREAWQGDERPIDFIYCNSFDRAAAATLFEKYLEDHAMPEALFTTSFGLLQGVMDVTLKRDGRLPTDLAIATFGDHELLDFLECPVLAVGQRHRDVAERVLELVLASLDEPRKPKPGLTRIR

SEQ ID NO: 165155 - protein, 157 aa, Glycine max
  Coding DNA Sequence Number=SeqID_73470
LQGVPFVVELTILAALSPMNNQLMKSIIWGISQDKISMQGQWRNHPGNQFNKDQGGPSIRPQQQGPSLYDQTTKLEETLAQFMQVSMSNNKSTESAIKNFEVQVGQLAKQLADRPSSNFSANTEKNTKEECKAVMTRSRMAIQADESRAEEKVEGYK

SEQ ID NO: 165156 - protein, 440 aa, Glycine max
  Coding DNA Sequence Number=SeqID_73471
  Gene Ontology: Mol. function=oxidoreductase activity; Cellular component=integral to membrane; Biological process=electron transport
  Homolog annotation: Hit_ID=A8GJ23; Match level="QueryCoverage=75%, HitCoverage=35%, E-value=1e-169, Identity=89%"; Hit description =Aldehyde oxidase and xanthine dehydrogenase molybdopterin binding precursor
  Pfam annotation: Domain name=Ald_Xan_dh_C2; Domain location=59-436; Score=-158.1; E_value=1.4e-07; Accession=PF02738.9; Description =Aldehyde oxidase and xanthine dehydrogenase, molybdopterin binding domain
PEGHADLPGVDEKTPAGVAGRARGRQAGSGRHALCGPDRRRDGQSAGRLAGDVAPLHHAVDRHLGAGAGQRQRLVRRRDANAASGGADPVAAGSGRRDAAHAGQAQPADHYNFPYYGAVAAMYGDGHPVRLANDRFEQFQTALKRHAFDMNYRIAVNKQTGVMQSFLGDMTADGGGRSNFTPSVVMVGATAAQSIYYFPKSDLSSVGLASRAIDAGSARGYGTLQSMAATEMMVDELAAELKIDPIEFRLRNVLKSGMKNTQGAIPAGAIRADEVLEKAAKHEMWLKRAERKAEFESRHPGKRYGVGFGCVQKDFGTGAETSFARVELSEDGRITLHHSGAEMGTGMSTSQSVLCAQWLGKPADEAHFSVTDWSVLPMVTSGDPYLMSHEEHDKLQTNPNWTPSYCSPSSASNSAYYFSHSTREAARLIFDHGIWPAAMR

SEQ ID NO: 165157 - protein, 114 aa, Glycine max
  Coding DNA Sequence Number=SeqID_73472
  Homolog annotation: Hit_ID=Q0WWS3; Match level="QueryCoverage=39%, HitCoverage=56%, E-value=5e-17, Identity=84%"; Hit description =Putative uncharacterized protein
MAQARGLLFIYRRRRHRDGDGHGALRASAPGAPASAVATPHSARLLKHGPRSLQICVRVNGETRRRKEAAKCDTWCELQNPVNHRVFERKLRPKPLGRGHACLGVTHRFPNANM

SEQ ID NO: 165158 - protein, 238 aa, Glycine max
  Coding DNA Sequence Number=SeqID_73473
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLVTSYDIIKIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 165159 - protein, 208 aa, Glycine max
  Coding DNA Sequence Number=SeqID_73474
  Homolog annotation: Hit_ID=Q6L477; Match level="QueryCoverage=34%, HitCoverage=11%, E-value=2e-09, Identity=35%"; Hit description =Putative uncharacterized protein OSJNBa0009L15.8
MVLHGKTIGVNVEDDDSYIDTYVSPLSTQMTPNIVGDEEVDDVHVNRNDHDEGELINIVKCNFLIMPMATPPGLPPPLFAPPPPPAIASQSPSTLKWTRKATRLRSLATRPLGAERPVVHVDPAIRKADGPNKKKLRTYLGIVARHKVDVTYETWKEVPATHKDFIWKDMQAEFDIPKASDGRTKKKILQTIGEQWRQFKSDLTRKWG

SEQ ID NO: 165160 - protein, 134 aa, Glycine max
  Coding DNA Sequence Number=SeqID_73475
  Subcellular localization annotation: CTP_CleavageSite=31; ConfidenceScore=5.12e-01
MTTLTQTWMTLLLSNIQPSDHNSRPPPAEVSAGMPPTRNPLDPDKSNMALGFLALITGLCQSFGVPVAPRKVIRPPITRAFIEKYCTARQAQGGDPQAPDAQPPPPQADPAGSFDTERYLRHLVHQQAANHRAH

SEQ ID NO: 165161 - protein, 109 aa, Glycine max
  Coding DNA Sequence Number=SeqID_73476
  Homolog annotation: Hit_ID=Q2HW89; Match level="QueryCoverage=28%, HitCoverage=3%, E-value=6e-08, Identity=80%"; Hit description =Integrase, catalytic region; Ribonuclease H
  Pfam annotation: Domain name=G-patch; Domain location=49-93; Score =31.7; E_value=2.7e-06; Accession=PF01585.14; Description=G-patch domain
MDPVKYIFKKPALTGRIAQWQVLLSEFDIVYYRNLLFGERARQPCLSDTAMMVARVMLGYGYEPEMGLGKNNGGITSLVSTRANRGKFGLGYKPMQADIRKSIVESVIP

SEQ ID NO: 165162 - protein, 110 aa, Glycine max
  Coding DNA Sequence Number=SeqID_73477
  Homolog annotation: Hit_ID=A5AIK3; Match level="QueryCoverage=83%, HitCoverage=11%, E-value=2e-08, Identity=33%"; Hit description =Putative uncharacterized protein
MANFLVEFARNDTTTPNWWNLFVDSASNVKGSRARIILEGPYNISLEQALKLNFRASNNQAEENNTRAYILSKLISTKKTGHLKTVIQETLQTPTIDTKEVMVGEKKELD

SEQ ID NO: 165163 - protein, 396 aa, Glycine max
  Coding DNA Sequence Number=SeqID_73478
MTSLATERYRSRGTPGQGRIKTGGATMYDSTFVGVGFNPPVSDHEAGELASAYPESTFFRVEAHISIVGAHSPFSIGIFDHDDVRKPSGVPDFSDKLDELFDGSWAFVRGVISRIYIEIIVLACLVLYIALSCLLLVCLDIYNLLGQGREFHFQRRRGDYGPKLVKRVHVASGLYSLAYKAKEWTVVRMDSVRGDLKSLESFSIQDISGIVLVDDDLGHHEVCNDDGDNHWVILVNGVDTLEVPIRESDKRETSLRWCIEKIDVDVPNGVKIVLSGLAGLFSLGKSAHNGVDYTSDLLGGFLPVLMEVVSHTAVAGLVLAWWLSDLLTNWASTRTWTLLEEANACLAYVSCPTCVRSMECNATSGLSFQIWTVMRPNLSMKFLRDSIVVCLSQTDQ

SEQ ID NO: 165164 - protein, 123 aa, Glycine max
  Coding DNA Sequence Number=SeqID_73479
MEMQRKTKEKSSTTFLEKQYDMMRETYKTSMPFLHYRNMVVLVPHRRRPNIYCHNLPFGGKARRNKMAHLLMKKMRGVATNVYLTENVRKTKKDEGDRCRTGCHDITLQNMQIICVRMNRLNK

SEQ ID NO: 165165 - protein, 95 aa, Glycine max
  Coding DNA Sequence Number=SeqID_73480
MACLLMKKTRGVATNIYLRENVRKTKNDEGLRILKIRVRELFTHGEGIRTGKGVALAPTYPQTLEPFTQPPSRLFIAKDSIRGHGSSPRRAVAST

SEQ ID NO: 165166 - protein, 132 aa, Glycine max
  Coding DNA Sequence Number=SeqID_73481
  Gene Ontology: Mol. function=isomerase activity; Cellular component =endoplasmic reticulum; Biological process=cell redox homeostasis
  Homolog annotation: Hit_ID=P38661; Match level="QueryCoverage=83%, HitCoverage=62%, E-value=3e-25, Identity=64%"; Hit description =Probable protein disulfide-isomerase A6 precursor
  Pfam annotation: Domain name=ERp29; Domain location=39-131; Score =114.6; E_value=2.9e-31; Accession=PF07749.3; Description=Endoplasmic reticulum protein ERp29, C-termi
  Pfam annotation: Domain name=Thioredoxin; Domain location=32-111; Score=-28.1; E_value=0.038; Accession=PF00085.11; Description =Thioredoxin
  Pfam module annotation: Pfam domain module=ERp29::Thioredoxin; Domain location=39-131::32-111
  Subcellular localization annotation: CTP_CleavageSite=45; ConfidenceScore=5.05e-01
MESLGTQQFSGFQKDLLNPKRTNVKIATAPSNVVVLTSENFNEVVLDETKDVLVEFYAPCLTRMEEEVEKLKGSASRHGKIYLKATKNYLEKGSDYANNEIHRLQRILDKSISPAKVDELTLKKNILSTYAA

SEQ ID NO: 165167 - protein, 61 aa, Glycine max
  Coding DNA Sequence Number=SeqID_73482
  Subcellular localization annotation: CTP_CleavageSite=63; ConfidenceScore=5.42e-01
MAVLSFAKNKFPKFLSLSNTATPSAPAKHKAKKVAKQSLTTVAKQGTRLKCKKERYTKQNN

SEQ ID NO: 165168 - protein, 94 aa, Glycine max
  Coding DNA Sequence Number=SeqID_73483
  Gene Ontology: Mol. function=iron ion binding; Biological process =oxygen transport
  Homolog annotation: Hit_ID=A7P5F9; Match level="QueryCoverage=81%, HitCoverage=45%, E-value=9e-27, Identity=71%"; Hit description =Chromosome chr4 scaffold_6, whole genome shotgun sequence
  Pfam annotation: Domain name=Bac_globin; Domain location=3-69; Score =8.4; E_value=0.00011; Accession=PF01152.12; Description=Bacterial -like globin
MKLILMIFSNLLSEGHPALIARHRPFPVTHQAAERWLHHMQHALDSTTDIDDDSKTKMMNFFRHTAYFLVAGDELKNQNQHIPCKHAAAKKDDS

SEQ ID NO: 165169 - protein, 104 aa, Glycine max
  Coding DNA Sequence Number=SeqID_73484
MAEHNTQSKTTDHLEEAITCLTQNQSTLTDAHHDLTLRLDSIQDQLLQFQLHLPPPPPPPPPPPSPPPSPTPTPHTHPYRHSLKLEVPHFDGQDAIVGLAASIT

SEQ ID NO: 165170 - protein, 372 aa, Glycine max
  Coding DNA Sequence Number=SeqID_73485
  Gene Ontology: Mol. function=DNA-directed DNA polymerase activity; Cellular component=intracellular; Biological process=DNA replication
  Homolog annotation: Hit_ID=Q588V7; Match level="QueryCoverage=90%, HitCoverage=15%, E-value=1e-129, Identity=69%"; Hit description =Helicase and polymerase containing protein TEBICHI
  Pfam annotation: Domain name=DNA_pol_A; Domain location=2-332; Score =6.1; E_value=7.9e-15; Accession=PF00476.11; Description=DNA polymerase family A
MAKLLNSTLGSICSLARLSVSTQKYTLHGHWLQTSTATGRLSMEEPNLQCVEHAVEFKMKDENEGDADESYCTINARDFFVPTQDNWLLLTADYSQIELRLMAHFSKDSSLVELLSKPDGDVFTMIAARWTGCPEVSVCSKEREQTKRMVYGILYGMGVNSLAEQLDCTSDEAAEKIANFKSSFPGVSSWLLEAVASCRSKGYVETLKGRKRFLSKIKYGSSTEKSKAQRQAVNSICQGSAADIIKIAMLRIYSAIVTGFDSPDSSSSLATKFHMLKDRCRILLQVHDELMLEVDPSVIKEAALLLQTSMENAFLCMSNLRLEEHGDLWSHIHPINSTMPLLWLNPEAQRFGVVGNYPNAQGKNYDEEAYGV

SEQ ID NO: 165171 - protein, 54 aa, Glycine max
  Coding DNA Sequence Number=SeqID_73486
MWFFMRKNPGAWGYFTRFGTSLRLIDAILPLQGNWIEDYKKIEPEMQEKALGAP

SEQ ID NO: 165172 - protein, 243 aa, Glycine max
  Coding DNA Sequence Number=SeqID_73487
MAEPSKKHKGSSSRSQRHSEVQDTPIPSSISSSSLFSSEEQHIRYTNLFSSPSIIDPKFIDMDFFSDESFECIQAFQNSNLIPFMSLKFPVYSKLSGILHQYQLLAKTPCPQGGNFHVMRPTVPTMFLPVVSRVIKPRPAKNRVYDLCDRVVMWFEDGTVKYIVNFGRNWESQTISHDTNSFSDLEGPIILFGKLVESGPGQGCLARAINKVQRSWRVVSMLSMASTCDDPGMYVVMESGALP

SEQ ID NO: 165173 - protein, 307 aa, Glycine max
  Coding DNA Sequence Number=SeqID_73488
MTMKTLFGKLLAYEHELTQQSYAEETKKKRKGIALKVKSSREEYKDNSSSEEDAKNFNLMVRKFGNFLRNSKDKKFSKSSKKIDNNNNYTCLLFEKKGKKGRKQKKFYIAREDSASTTFNSSSDEEISNICLMAKSMNDPSTSEEELLEEFNEMHEEAQRLVVLNKKLKSELKLHINKLASTQGELNVLKQENEKLVSRCKATACDNTSTSFNLDDYKCLQTKFDNFKKDHYAECIKLQTELSYFKDLFGKLNKGKSDLNHMLSVQKHTTDKTALGYNKQTSFSEKTQFVSSKGVNPNKVTKKRNMV

SEQ ID NO: 165174 - protein, 207 aa, Glycine max
  Coding DNA Sequence Number=SeqID_73489
  Gene Ontology: Mol. function=aspartic-type endopeptidase activity; Biological process=proteolysis
  Homolog annotation: Hit_ID=A5B7K1; Match level="QueryCoverage=90%, HitCoverage=43%, E-value=1e-25, Identity=35%"; Hit description =Putative uncharacterized protein
MEQANYTNKYLQILGETIKTKVVPKQKSVEEALVEGVGDNHSELPNKIGSLLKVILETPQTSENTSKMVTRSTSKLINVINEDSDQNLDNTTEIRSVSEKNINSINSKHWKTPSKLYYQRPTAPDLLLEERGENNFKSFSANNIYEWNIDAQTEYNIMNTLQHMTMVATAYQTSHECSEETIIDILVVGFSRQLKGWWDNYLTNEEK

SEQ ID NO: 165175 - protein, 113 aa, Glycine max
  Coding DNA Sequence Number=SeqID_73490
MQAEESTKAQRHKHKTSFGVKHNKRAKRTSKNSKIVRDWRLAHPTTKPNYESSIPELIWGLAQDSALSAATINFSREEVALSASSPLSPLLEGSKRLARASSGLVREDMALST

SEQ ID NO: 165176 - protein, 67 aa, Glycine max
  Coding DNA Sequence Number=SeqID_73491
MSYQAILSVDASLAEDELAQRSEDGALSELAFAQRLYTAHPSSRIVHALSHQMGRLADDAFSQMMSG

SEQ ID NO: 165177 - protein, 248 aa, Glycine max
  Coding DNA Sequence Number=SeqID_73492
  Homolog annotation: Hit_ID=Q2HW90; Match level="QueryCoverage=82%, HitCoverage=42%, E-value=1e-13, Identity=28%"; Hit description =Putative uncharacterized protein
MGTNQTGKRFYQVKIKGLDITSIKELGRLMGPLQMQAFRKAYRKILDLTIAKISSKVVISLTQYYDQPLRCFMTVKEFEEILGCPLGGRKRYHFSGFLLSLSKIVVVVRDSARGLDRVKQTRNGVVGLPQKYLEGKARDMANQEERVPFMDVLALLIFGVVLFPNVDGLVDLAAIDAFLAYHHSKEILVVAILADLLDTFDRKCEKSSARIICCLPTLSEAEQSTGFLDGRKEMREFSSHVGTTQTSH

SEQ ID NO: 165178 - protein, 165 aa, Glycine max
  Coding DNA Sequence Number=SeqID_73493
MTSKTLESWVGGILNHHILRQHNIPISPKIARQHDFGKILVESGSEKAIGSNLGYKSEIKQTLDQHIESASLSSEINSSASQVDSPQAIITSPGNANAVAAAALENKDLAFVVAQLGSNSHQSNNNNNTDGDDSQFYPLLPFNHSSLKDKSWKTKKMNREMGAAM

SEQ ID NO: 165179 - protein, 104 aa, Glycine max
  Coding DNA Sequence Number=SeqID_73494
MDKFDIFVPHPLTNASLLIQLSPECGCKPLVCLLKRPVLLSLDFQRPFNKRLLVLHVGGGAVKQQGQPFPCIQESSTTRDPRSLNPFSEIRRREEEVSLKRDRL

SEQ ID NO: 165180 - protein, 119 aa, Glycine max
  Coding DNA Sequence Number=SeqID_73495
DEIWGSAKQRTLTLKLVARVLKCVDRVEGSMKPVSDVQGSCLDKWRAKSLSSPQVWTSVCSMSGVTCQAPEPRQVFFGLLLSSCPGGTCLWRVKSSLLAVPHQRILAEVPLTASPPLRR

SEQ ID NO: 165181 - protein, 138 aa, Glycine max
  Coding DNA Sequence Number=SeqID_73496
MEAMKEQMTTMMEAMMTMRKMTEVNTAIFVVTSTATEVDLTHPSGLNQVNHPMSDMVGQGGRTLGSTSGPHFVQSRASIPSHHMACLPTIHHPMLHTLPIRMSITPLPYPLRANNPNLVMHKSLNPSGRRMKYPETTL

SEQ ID NO: 165182 - protein, 71 aa, Glycine max
  Coding DNA Sequence Number=SeqID_73497
MINDGTYGFGDPTVMWLRMPPDSWVTVTKGGVVDKSRAFAPTISFLNDHLEETLGPTKIGENHSKCINLTH

SEQ ID NO: 165183 - protein, 59 aa, Glycine max
  Coding DNA Sequence Number=SeqID_73498
MTAQWRRKRERRCHFKEKMSLEEAHHHRRPWIRAWRKKEMNEGRPTNPKSIPRFSTKCA

SEQ ID NO: 165184 - protein, 97 aa, Glycine max
  Coding DNA Sequence Number=SeqID_73499
RIQGTNHLRILCLNTLEDTSFVSQVEGTSTWVVILRTREGTSLVDQFKWKGHIVLNGMPRNSLMISTCQVGVVSSGKRRLRNLCWAYDCHCIIEQIG

SEQ ID NO: 165185 - protein, 168 aa, Glycine max
  Coding DNA Sequence Number=SeqID_73500
MSGKGLQHVRKSLSQYQRLRACLEIKWDTNWERGFVVYVKNSKTSTSLPSGTLERWQRHSKRHDFGYVAVVGAAGPLRLQVLHGGKQNVRVVAGWSSRRDEVVQAIAVALGFWRDGVPTSTVFYDFHQNYNDGVIDKCRCTTNAPHKNLYNYVNVTVLTTTTGSSTLT

SEQ ID NO: 165186 - protein, 82 aa, Glycine max
  Coding DNA Sequence Number=SeqID_73501
MHIDQNGLTLLKLSPVESPTVATYPSAGVATNIYSRKTLEKLEMCGLSTLSVKGSGVVFTHGEGCFPCSYVFLNCGEEIRPT

SEQ ID NO: 165187 - protein, 50 aa, Glycine max
  Coding DNA Sequence Number=SeqID_73502
MGTTKGKKREVVVVQLAQTSWVASTRRHRLLLEDPGRPSGPDCYLYTPVY

SEQ ID NO: 165188 - protein, 102 aa, Glycine max
  Coding DNA Sequence Number=SeqID_73503
  Homolog annotation: Hit_ID=A5AV98; Match level="QueryCoverage=91%, HitCoverage=12%, E-value=8e-18, Identity=51%"; Hit description =Putative uncharacterized protein
FLCIICANFNGLNFSDKNEQVQFHLSVLDHDLAMLEEKFVTIIDTSSNEEKVHYKAWERSNRLGLMLMRMTVADSIKTTLPKIESAKRFMGLAGEHSQTADK

SEQ ID NO: 165189 - protein, 166 aa, Glycine max
  Coding DNA Sequence Number=SeqID_73504
RGGRCKTQGASPGGAVVGADLGGTGEARLIALCARTPKGNRPAHPGNGSAGGRVQRLEEHRTSRGLQGEQPLVRWNNVGREVGKMDPYLRERIGSEGWARAASRESGRRVPVGGRIGNGPFGASSPGVEQSTQNCALNVKVKKFNQARVNGGSNYDSLKVAKCLVI

SEQ ID NO: 165190 - protein, 114 aa, Glycine max
  Coding DNA Sequence Number=SeqID_73505
MRDKDIKFMHIISIVTVVYSNDINLKILMSHWRHLTTTFKLLQASYKVLLDDIRTYERFSSSNLSQPASVRLCTLCFRVIQCSMECPVTPPCKHMSRWGCILWETEVEKSFLVL

SEQ ID NO: 165191 - protein, 129 aa, Glycine max
  Coding DNA Sequence Number=SeqID_73506
VDSRGSPKSIQGAFKSTKIQIGKLVEEVTQAMGRREEEFVEEEFNNVTECLVSENEGEELACIEELDGPEDKSAGHVMFGALENNRPMEKPKVELKTLLVHLKYVFLEDNETKPVIINSSLQKKEEDQL

SEQ ID NO: 165192 - protein, 151 aa, Glycine max
  Coding DNA Sequence Number=SeqID_73507
  Pfam annotation: Domain name=G-patch; Domain location=48-92; Score =21.5; E_value=0.00048; Accession=PF01585.14; Description=G-patch domain
GVTLVSCPSSAPYIEAAEESLETAFQSFEVVSCASVEPSPLLPSLSNAAIMVARVMLRNGFEPGMGLGKDGLGNADVADVKGNPYKYGLGYEPGMPGRRNVPSRFRADRVWPDRLSQSFTSAGMVSEEEVAAVGEEFPQDLSNFVHVHLKA

SEQ ID NO: 165193 - protein, 153 aa, Glycine max
  Coding DNA Sequence Number=SeqID_73508
  Homolog annotation: Hit_ID=A7UQU7; Match level="QueryCoverage=69%, HitCoverage=18%, E-value=5e-13, Identity=37%"; Hit description=IMP dehydrogenase/GMP reductase, putative
MLVELLEVSATKARAETIQCHGSYVRLSWLRDVYQMKIESGGYTWGAAALVHMYDNLNGTSKSTTRQLVGYITLLQCWIYEHFSSVGSVVPAENYDERRPHACRWASSKALPVSTYHRHLDRLSPDMVCWISYGDHRSFREFEVISLFSSHLR

SEQ ID NO: 165194 - protein, 258 aa, Glycine max
  Coding DNA Sequence Number=SeqID_73509
  Subcellular localization annotation: CTP_CleavageSite=62; ConfidenceScore=5.13e-01
MALRKLPTKRSRRTPPERAPTLPCKLTWTSTSTGSGAQNISSILRPSRDGKIARRHWAPLVTPMAKFDPRIIMEFYANAWPTKEGWIPLDADALSQFLGHPLILAEDQQCEYSQRRRQVSGFDEEAIAQLLCIPGQDFARTATGRRFESIAPTRHLMDPEKSNRALGFPALITGLCQSYEVPITPSKEDQQPATEDRTPDAQDPSPFPWPTPEQFKATVAWPGDETEFEMQAGPPGTFGGGDATHEDEDMADMLDFLL

SEQ ID NO: 165195 - protein, 152 aa, Glycine max
  Coding DNA Sequence Number=SeqID_73510
MGWESYAHQLSPLLAKSCTSTTFTDNRNKHNAEIQLKSSYLLLIELDGNTNMGMKSSILLLCYTTRSTILLSNLTRNRCISDIFSRNVSITIITAKHNARLCYTCKLDFMEISNMLTDHSDMSLKHGTTTLGKSVKQHMSKKNHWGDNRSDL

SEQ ID NO: 165196 - protein, 127 aa, Glycine max
  Coding DNA Sequence Number=SeqID_73511
MKILCENYTGEILVLFKDIMMQSYLPMTLDKMFQEDWVRNAGEDPRVFISLKGFIIDIFNHLSSISIPLPLIFKKQMTPLMKKIQGLQAPYGAKSCGIRACRPWIFFIKEKMSQEETYHHKKPWIRA

SEQ ID NO: 165197 - protein, 51 aa, Glycine max
  Coding DNA Sequence Number=SeqID_73512
IEEAKEHHLDEDALMPHNVAPCRACRPWIFFIYGGLCFLKINGKKMEKEEK

SEQ ID NO: 165198 - protein, 290 aa, Glycine max
  Coding DNA Sequence Number=SeqID_73513
  Gene Ontology: Mol. function=protein binding
  Homolog annotation: Hit_ID=A7R5W4; Match level="QueryCoverage=49%, HitCoverage=71%, E-value=3e-23, Identity=68%"; Hit description =Chromosome undetermined scaffold_1084, whole genome shotgun sequence
  Subcellular localization annotation: CTP_CleavageSite=75; ConfidenceScore=5.36e-01
MWMLNKLSSPYSDTDQKLASYFLQAFFNRITQVGDRTYKTLASASEKTCSFKSTRKTYSFVTVGANMQKVMKEIRARMEKEVDLDIGLEGFEFVKGFEECLRWFRVYFEALDGSFPRTSNEHLMLEREAGRAVVDLVACSLAESVERWGVWVFWGEWGWRNGQEGGVGEKVEIGKGEEERRRRGTNTKKKRNGREEEWTRDLEKSKEFSDCVVLNSLKREKGDTKEFRRLVLCYFGKGRRETQKEFRRLVLVEFFLAKGEERHKRIQAVSPLFFWKREKRDTKRIQAVSP

SEQ ID NO: 165199 - protein, 178 aa, Glycine max
  Coding DNA Sequence Number=SeqID_73514
MEEGCTSIAATMLLNQFAKEINRKKRKREKERERRINNSTMFRWTLRWDWFNNRYWKRKFHRMTTRPNSIGTKLRYYWVQICKMIGMKGTALGPEGRPIFMAIGVARAMAGNGFNGVADVDNFLNGIPPYQTKTIKWIVYSFGSNNSGQLGHGNIEENEYVQSKCMYEVGFGMDFLVL

SEQ ID NO: 165200 - protein, 124 aa, Glycine max
  Coding DNA Sequence Number=SeqID_73515
MVVAVELAVVHLWLAATGPPTATAMPDPIVVLLIGGRISFVGVIDTLENRQRLGIKARNPSALLDGEVRIMIVGDDVVEKQCHPYLRQGGHASAHDPHPSPRHTLCEVLSSNAQQLAYGLLIKS

SEQ ID NO: 165201 - protein, 101 aa, Glycine max
  Coding DNA Sequence Number=SeqID_73516
  Pfam annotation: Domain name=zf-RanBP; Domain location=63-94; Score =36.4; E_value=1e-07; Accession=PF00641.9; Description=Zn-finger in Ran binding protein and others
MNEQTVGLHSPLNKNQREEEEASTSFMSTCVGKGKFPYCGLWRACGWQRCGGRGGGSGGKSGRDGDWGCPNPSCGNLNFARRAECNKCGAPSPTVFIMLDA

SEQ ID NO: 165202 - protein, 76 aa, Glycine max
  Coding DNA Sequence Number=SeqID_73517
MAAEWRRKRKMRRHFKEKMSLEEVHHHRRPWIRAWRKKEMNEGRGREEHEILCSKGALKSEPTNPRSIPRFSTKCA

SEQ ID NO: 165203 - protein, 495 aa, Glycine max
  Coding DNA Sequence Number=SeqID_73518
  Gene Ontology: Mol. function=motor activity; Cellular component=cell projection
  Homolog annotation: Hit_ID=P15305; Match level="QueryCoverage=75%, HitCoverage=98%, E-value=4e-23, Identity=23%"; Hit description =Dynein heavy chain
MRGTMHEPQAKLGADQSSHSSIFPTSTVQSFEFGVIDPLDESISCFLIRVDPWVLVPIAFRGLHALDFRGLHVLTFRELHVLDFRGLHTLAFRGLHALDIRGLHVLDSRGLHTLTFRGSHVPTFRGLHALDFRGLHVLNFRGLHVLAFRGLHVLAFRGLHLLDFRELHVLAFRGLHTLAFRGLHVLDVRGMYILFFRGLHVLVFSGLHALAFRGLHVLAFRGLHVLAFKGLLVLAFKGLHVLAFRWLYDLAFSGLHVLTFRGLHVLAFRGLHLLDFRELHVLAFRGLHTLAFRGLHVLDVRGMYILFFRGLHVLIFSGLHALAFRGLHILAFRGLHVLAFKGLLVLAFRWLYDLSFSGLHVLTFRGLYVLDFRVLYVLAFRGIHVFTVRELKQHSAQQPQLRSPSTEVSVGLCRHDISRHKARHHNSLGMANSKQQMHCHHLQSSPQLIYKGWSVAYDLWPTSTRPSPKPKVRKSTRPVTDKSSRLQLKTLKKLY

SEQ ID NO: 165204 - protein, 58 aa, Glycine max
  Coding DNA Sequence Number=SeqID_73519
MATMMEAMMSIKEIMEVNVTAIASTGTIAEVYLTPQYGLNKINHPTSDMVGLEGKELG

SEQ ID NO: 165205 - protein, 206 aa, Glycine max
  Coding DNA Sequence Number=SeqID_73520
  Gene Ontology: Mol. function=aspartic-type endopeptidase activity; Biological process=DNA integration
  Homolog annotation: Hit_ID=A5B0G5; Match level="QueryCoverage=96%, HitCoverage=26%, E-value=1e-16, Identity=27%"; Hit description =Putative uncharacterized protein
MKSFSELIIDKIMCTLTQNFDHIVVAIEESKDVEIIRIEELQGFLEAQELKLIQSGKSSFASTECWHKKGKGKGKQKVKDQKINDAHEDFDSGPVLLMVTTNKGALSSEAWYLNTGLSNHMTRHKEWLIDLDTSRSRKVKLANSRTLNAEGVGNILIRRKDGKTTLIESVWFVHERLARTSYTPQHNGLAERRNRAVLDMARSLLK

SEQ ID NO: 165206 - protein, 63 aa, Glycine max
  Coding DNA Sequence Number=SeqID_73521
ALKGLDDTPQPKSKAAARWIVVKEQLEIVVDTVVQGQSWCGRQGTKFMNGWGNELEEHIGHSF

SEQ ID NO: 165207 - protein, 167 aa, Glycine max
  Coding DNA Sequence Number=SeqID_73522
MEKSDKMNFKEKKEKKGYITWEDNVINYSSNSKKKIISLVGSGSYWKLEVGNESNWKLKVESGGWKLEVGRGKLLKVEVGSWKGEVVVIIKKGENGENVNHASFDDVEKKSHVCHHQKGGECESLFQDSLKTKPCLKTKCFQDMQGSGNRLPGSVIDYQKTGLRNSC

SEQ ID NO: 165208 - protein, 64 aa, Glycine max
  Coding DNA Sequence Number=SeqID_73523
MAAEWRRKRERRRHFKEKMSLEEAHHHRRPWIRAWRKKEMNEGRGREDPLIQDSPLSVLRCHEA

SEQ ID NO: 165209 - protein, 187 aa, Glycine max
  Coding DNA Sequence Number=SeqID_73524
MSEIEEVQEQMKANMEAMKEQMAPMMEAMMSMKKMMEANAATIVATSTATEMDPPHPSGLNQVNPPVSDIVRQGGEALGRTHEAPRDHTLADFEPHHGCAIEGQAVVERVPPTMVEREKLDHIEERLRAIEGGGDYAFANMAELCLVPDVVIHPKFKVSDFDKYNGTTCPQESPEDVQQENGGICEE

SEQ ID NO: 165210 - protein, 111 aa, Glycine max
  Coding DNA Sequence Number=SeqID_73525
METISKRFEEFHFCGKVTLKSKLWEIVYPDLNSMCAPLEKSNVVHHHLTKLNQEGSYQCWINFIHAFMIPLKTLFMSKLMVWVKIHCLWFATICLKNLQNGLISISTYLVA

SEQ ID NO: 165211 - protein, 31 aa, Glycine max
  Coding DNA Sequence Number=SeqID_73526
MGEEVAAQLAKTSWWISLEETFSPRLCGNWL

SEQ ID NO: 165212 - protein, 364 aa, Glycine max
  Coding DNA Sequence Number=SeqID_73527
RKVEIYHTELDEFKAELERRNFHKRLTNLVDGSIDLALVKEFYANLYNSEDRPPKQSIVRGHLVKIDVDSLNTFLETPVGHPGKILRKDLTTLAQVWSVLSYSNLAPTSHTSDLTVDRARMIFGLVSRVDMNIGALISGQMTSIAQSNTSSLGFPALITALCRARGVVSNSLTFEQLSPIINLAYIRKNCWNPEYLIVSIRGVRRVRAKLAELPSTSAAPTPASMSASPSVPTQIDSQRLEAMLQRSIPSVEKFRELVAWLGTQSSLHREDEGPTTQVPQHMEDESYEATISEPFTIEEEADDTQTTQVAAATPERSLEAISEPPTPAVDPSSPRNRPFHSSSRDARGPDYTSPNYGDFSSSYS

SEQ ID NO: 165213 - protein, 88 aa, Glycine max
  Coding DNA Sequence Number=SeqID_73528
MKSDKASQDIHSISQACSELQNKERETRLKRAIKGINSRTHQQESSQGYCANNQWGKTHQMIIMMDGSNSHKGKIITFKLSFQNYHDM

SEQ ID NO: 165214 - protein, 460 aa, Glycine max
  Coding DNA Sequence Number=SeqID_73529
  Gene Ontology: Mol. function=motor activity; Cellular component=cell projection
  Homolog annotation: Hit_ID=P15305; Match level="QueryCoverage=99%, HitCoverage=98%, E-value=1e-35, Identity=22%"; Hit description =Dynein heavy chain
LHALAFRGLHVLAIGGLHVLTFRVLNVLAFRGLHILAFRGLHVLALRGLHVRTLRGLHVLAFRGLQYLAYRGLHVVAFRGLHVLTFRGLHALTFKGLHVLGFRGLHVLAFTGLHVHAFRGLHALTFRGLHVLTSRGLHALAFRGLHAVTFRVLHAVTFRGLHVFAFRGMHILAFKGVHALPIRGMHALTFRGLHVLAFKGLHVLAFRGLHVFAFRGLHVVAFRGLHVLPSKDYTSSRLEGYTVHALTFRGLHVLTMRGLRVLAFRGQHALAFRGLHVLGIRGVHALTFIGLHVLSFRGLNVLSFRGLHALTFRGLHVLAFRGLHALAFRGLHVLTFRGLHVLAFRGLHDLAFRGLHVLAFRGLHGLTFRGLHVFSLRGLHALTFRGLHILAFGGLHALTFRGLHVLAIGGLHALTFRGLRILTFRGLHVLTFRGLHVLTFRGLHILTFRGLHVLAFRGLD

SEQ ID NO: 165215 - protein, 159 aa, Glycine max
  Coding DNA Sequence Number=SeqID_73530
  Homolog annotation: Hit_ID=Q6L477; Match level="QueryCoverage=44%, HitCoverage=11%, E-value=1e-09, Identity=35%"; Hit description =Putative uncharacterized protein OSJNBa0009L15.8
  Subcellular localization annotation: CTP_CleavageSite=21; ConfidenceScore=5.21e-01
MASPPASLPPPPPPPPPAPSNASALPPLGAKRPIVHVDPATGKADGPHRKKLRTYLGIVVRDKVDVTYENWKEVPTAQKDLIWEDIQVEFEILEASDSRTKRKLLQTVGERWRQFKSDLMRKWALAADQDGVEDIVCEKYDISKENGPVLPDWQRPFLE

SEQ ID NO: 165216 - protein, 46 aa, Glycine max
  Coding DNA Sequence Number=SeqID_73531
MEIYVSDRLGKKVVIIKKGVIVEAKLHDESRMIQRYFDDNKDDNKR

SEQ ID NO: 165217 - protein, 27 aa, Glycine max
  Coding DNA Sequence Number=SeqID_73532
MADFSSLKRQRTAAIPSAPGIFHTKYG

SEQ ID NO: 165218 - protein, 58 aa, Glycine max
  Coding DNA Sequence Number=SeqID_73533
  Subcellular localization annotation: CTP_CleavageSite=38; ConfidenceScore=5.24e-01
MKLCFYSKMRGLPGTGGISTGSSNASGSLEPASRYGFMASQGWLSPFRGPPLSLSGLR

SEQ ID NO: 165219 - protein, 125 aa, Glycine max
  Coding DNA Sequence Number=SeqID_73534
MARVPRIRCTRTSSARRECPEFVARARGLCAAEFPRNPTFVHVTNIVAGGKNSRSARRECPEFVARARGVCAAEFPGKPTFVHVTNIVAEGKNSRSARRECPEFVARAGGLCAAEFPGNPTFVHV

SEQ ID NO: 165220 - protein, 171 aa, Glycine max
  Coding DNA Sequence Number=SeqID_73535
MGGNGLSLGDEICLTLSSLLKPNVWVSNSFGILKSLLKLYHLLGDCFGIGFLLRITYLGHKLRLTMISFPSVKAYLSPPLICSSHVVKSCLCGGNSIHGLGKIESSTIARWITFFSTQLQQEGRKSIEDGKYGGWLLQSQFGNSEMTWCFMISLLISLSWWTIQISSLGLG

SEQ ID NO: 165221 - protein, 106 aa, Glycine max
  Coding DNA Sequence Number=SeqID_73536
MYPKARKNPRAFSCISGPIFMESSIQCPWRYDCIIKDSIDEEDPRPTSSTWSYIRNTWRNPIKGEGRHKRIQAVSPLFFWKREKGDTKRIQAVSPWRIPFGKGRRE

SEQ ID NO: 165222 - protein, 272 aa, Glycine max
  Coding DNA Sequence Number=SeqID_73537
GCINYNPALAIRQLGYPMRGAPAEESLSPFFVRDCSAQSFKIIQRVHKAGESPLRKDKELRGIRNGIIGGYHEWLKVRTRGLDWLSKLKIINEDNFEAPEEDEEVRALKTKLGKARLAKEKFKARKEEHGRDNSVELCGAATMSSSFEGERDQSRAHSMVLKEELAACSRSKRSLSQCLCETETNMLAIVSKYQEELNLATAHKYKVVNEYARVYAEKEARGRVIDSLHQEETMWMDRFALTLNGSKELPQLLATAKAMADTYSAPKLLSSC

SEQ ID NO: 165223 - protein, 168 aa, Glycine max
  Coding DNA Sequence Number=SeqID_73538
MQNSGVTLRAESQHFASAHDDNPYVAFIPYFGHMATPPSSPPPPTEAISQSPSALKQTRKATRLRSLATRPVGADRPVVHVNPATGKANGPHKKKLRTYLGIVTHDKVDMTYKTWKQVPAAQKDLIWEDIQALAADKDSVDDTICKKYDISKEKWTQFCQSRRDPSWE

SEQ ID NO: 165224 - protein, 429 aa, Glycine max
  Coding DNA Sequence Number=SeqID_73539
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=6e-47, Identity=29%"; Hit description= UPI00006A17C9 related cluster
MLLSSNVIHICVGVVMLVCMIRTHVFVAARGGDQGTDKGKLLAPHPGAQVSARTCSPLKARACSPLKVRTCSPLKVRACSPLKARACSPQKARACSPLKATTSCPLKARAYSPLKVRMCSPLKARACSPLKARASSPRKARAYSPPMARACSPLKVRACSPLMERTCSPLKGMHAPLKARTCSPLKVRACSPLKTKTCSPLKVRKCDPLKARTCSPLKVRARSPWKVRACSPLKVRACNTLKARACNPLMARTRSPLKVRACRPLKARTRSPLKVRACSPQMARTCSPLKARVCNPLMARTCSPLKVRACSPLMASACSPLKVRAQSPLKVRACNPLKVRTCSLLKVRACSPVMSRMCSPLKARTYSPMKARTCSPLKARTCSPLKARMCSPLKARACSPLKVRTCSAPKVTACSFLKVRECSAQGQNV

SEQ ID NO: 165225 - protein, 107 aa, Glycine max
  Coding DNA Sequence Number=SeqID_73540
MQLSQEPMNKKPRRLARKSMAVTNFVELCGAATRLCETETNMLAIISKYQKELNLAMAHEHKVADEYAQVYAKKDARGRVIDALHLEATIWMDQFALTLNGSQELPR

SEQ ID NO: 165226 - protein, 368 aa, Glycine max
  Coding DNA Sequence Number=SeqID_73541
MGHRAGILGKLRAAHHAHIINTVDRARAEIGTELLIAEDRQTFFQAELEPVAAGHAVAGPVVEIFVTNHGFNAEIVFIGGGFRFGQHVFGVEDVEAFILHRAHVEEIHRDDHKDIEVIFEAETLFVLLHAGFERGHRPVRTVEVAAIDKNFQRHVTAGTGGKAVAQHIEITGDQRKQVAGFRERILPFHPVTPILVLTARQLVTVGQQVRIASRVGDQGSGEARQHVRAIEIPGDMPEAFGFTLGAERLAGFIQPFQRGVFIRMDFINDGQGKVVRQLADDQCALLFAVVRPRIAIHRQRQQRQRLTVQTQFSLLCAKAFYLTDGGDARGRRIKIKRQVDIGDGVVRRPVVVAIFNLRLLRHKSFSHR

SEQ ID NO: 165227 - protein, 73 aa, Glycine max
  Coding DNA Sequence Number=SeqID_73542
  Homolog annotation: Hit_ID=A9IMT1; Match level="QueryCoverage=100%, HitCoverage=15%, E-value=4e-09, Identity=38%"; Hit description =Putative uncharacterized protein
MPAQPDTLQQLCRYVGQFAQQGIENDGDHHHIGLQKLTGVHCQIANTGVGRDGFGHDQRQPHQTEGKAHANHN

SEQ ID NO: 165228 - protein, 64 aa, Glycine max
  Coding DNA Sequence Number=SeqID_73543
MEQRKQQATALLIILTLPVTEAANENPAICGDHAGYYAGGESAFSFTFHGAAECVPAGAGSAWR

SEQ ID NO: 165229 - protein, 207 aa, Glycine max
  Coding DNA Sequence Number=SeqID_73544
ADAEKLALHQPCAQLAARRGRYGGGNAGRQRRTGTAAGGRKRRECRALSAGAECADGGGQRDAARRCHQDHERSPAATVAGEQRALRPRAPSRHPTPALFCSCRRFRPDTNRECESPASPAVPRFHHLTGTVSARRLPFQHFNRIADAHDTAVKRNQIQAEIDITAAVLRAAKALQRGERFALRMLATAFGADGGKHAAAARLRHLE

SEQ ID NO: 165230 - protein, 96 aa, Glycine max
  Coding DNA Sequence Number=SeqID_73545
MVITKFKVPDFGKYKGTTRSKNHLKIVSTILIWLRIGCNYKKCAKRGLESFKEYAQRWRDLATQVAPPEAPGDGEEAHEDEEMADLLDFLGGSGDT

SEQ ID NO: 165231 - protein, 70 aa, Glycine max
  Coding DNA Sequence Number=SeqID_73546
MVNPPAKTGNDNTNNTAVITTDHTNNDTFDHFNPAIFILNTVVKKLIAPTNEEAPAICKLKIPTSTACPG

SEQ ID NO: 165232 - protein, 90 aa, Glycine max
  Coding DNA Sequence Number=SeqID_73547
ELKTYFDSKIQPQLSTTVATCPSRASEGEAHGKPVKMKILSSGVVFTLEEGISTSHVDKSGAFAPTYPTLERKSDLRSSSLSVNQAILFT

SEQ ID NO: 165233 - protein, 159 aa, Glycine max
  Coding DNA Sequence Number=SeqID_73548
MKVDMEAMKEQMTTMMEAMMSMRKMMEVNTAIVVATSTATEVNLTHPSGLNQVQSKHFFPPYGLPPKYTPPNVAHTPDNNIDNSAPIPIESQQPQSGHAPYTETTEGQAFGGIPLPNTLGGPQYRPQPQPLHFALERLPPAMVEREKFDHIEERMRAIE

SEQ ID NO: 165234 - protein, 221 aa, Glycine max
  Coding DNA Sequence Number=SeqID_73549
  Gene Ontology: Mol. function=transcription factor activity; Cellular component=nucleus; Biological process=regulation of transcription, DNA-dependent
  Homolog annotation: Hit_ID=Q5K6K2; Match level="QueryCoverage=94%, HitCoverage=88%, E-value=4e-87, Identity=77%"; Hit description=CBF -like protein
  Pfam annotation: Domain name=AP2; Domain location=50-101; Score=73.5; E_value=7.1e-19; Accession=PF00847.11; Description=AP2 domain
MVGIVTCGCGGGEAKQGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 165235 - protein, 59 aa, Glycine max
  Coding DNA Sequence Number=SeqID_73550
MTFPPKGTGITNLECVVLPPGSSNEAIPLEATVKTMPPLDRIADDKVFQTKVLLVPPYP

SEQ ID NO: 165236 - protein, 223 aa, Glycine max
  Coding DNA Sequence Number=SeqID_73551
  Subcellular localization annotation: CTP_CleavageSite=32; ConfidenceScore=5.61e-01
MGKTKSPFTCQNLHTLNPRPRCRTFKLFCRPSSSAVAHTLPCLSGDLDRYLRCSMPQNLSLRVTVLVSGGFDSSSLAAPRRRPLLHCFLPQDIVPNYAHQDTLLMEILQVDVPLEVVHLTDEYWNNVVIFLYFQCYSMFVVAHLLQIQMFVVPGSGGNILTKICLLPVCLSANTIGGIGLGRGGGGLSDHSLADPSVIGHHGGGGPDLAHQMDGVLTMVVSYL

SEQ ID NO: 165237 - protein, 213 aa, Glycine max
  Coding DNA Sequence Number=SeqID_73552
  Subcellular localization annotation: CTP_CleavageSite=86; ConfidenceScore=5.38e-01
MGKNKGRQSHLAVKQIMVKGTTSGSRKSQTSDTSGLAGFLDVVQANQNAYTASQNNLVGKVLVKKAGTSSAKTDDVAHQVFDNLSECNAKSESFPEVSCTLGDNDSTTDDDSSHSCGSKSSPQLDDNKTPTPWVNLFKDSRSPSKGFGMKFSPPPSDDEVLLEEIDLQPLEEAWGHSLIGYVAGHFLGKKALLDCCQKWGVKFSFSAHASGWL

SEQ ID NO: 165238 - protein, 75 aa, Glycine max
  Coding DNA Sequence Number=SeqID_73553
MTHSARQIRSASGIRLARHTTHLADWETLEEDKLEMCSPSVQPAHPARMLSFLALSVPYLAKPKFTYSHLASQSR

SEQ ID NO: 165239 - protein, 66 aa, Glycine max
  Coding DNA Sequence Number=SeqID_73554
  Gene Ontology: Mol. function=nucleic acid binding
  Homolog annotation: Hit_ID=Q9FNZ2; Match level="QueryCoverage=50%, HitCoverage=7%, E-value=3e-09, Identity=69%"; Hit description=Zfwd1 protein
GILTLCGMHDSQGKPILLCACNDNTVHLYDLPSCKKGIRADVGIEKRQKKRESELWKYPWHKAVLK

SEQ ID NO: 165240 - protein, 222 aa, Glycine max
  Coding DNA Sequence Number=SeqID_73555
MAEWVELSSPKTSKGRFVPKGHVGLFGLEVVRFEGSYPQKCGPHPRQEEKIEGHNVRRQTGRGGGLAEKGKRGRLGLLVETGAGKGGAKGVVEGGGAKDGPEDAKAKVGPGGGEAKLVFNEACKSRDMHKGKRLESLHLATDVGVEARDKAAEEKGRGQTNNPVGEGFEVVQDPRTASGQIGPQWLEGRKAKWALEASLATVSSKRSMFDLEHVVSAMRRRQ

SEQ ID NO: 165241 - protein, 43 aa, Glycine max
  Coding DNA Sequence Number=SeqID_73556
MGSERLSWTCGDEVELGEWHCGGKFDKVIIRTVGSHIWPSQLS

SEQ ID NO: 165242 - protein, 69 aa, Glycine max
  Coding DNA Sequence Number=SeqID_73557
MCRLVLRCDLGGGRGSTVPNLEALQQCIVVALIKSFLDKGLDDEEGRDSSGGEGASIEKIFHLKIRLCV

SEQ ID NO: 165243 - protein, 646 aa, Glycine max
  Coding DNA Sequence Number=SeqID_73558
  Gene Ontology: Mol. function=pyridoxal phosphate binding; Biological process=metabolic process
  Homolog annotation: Hit_ID=A7QKE0; Match level="QueryCoverage=95%, HitCoverage=95%, E-value=0.0, Identity=58%"; Hit description =Chromosome chr2 scaffold_112, whole genome shotgun sequence
  Subcellular localization annotation: CTP_CleavageSite=29; ConfidenceScore=5.53e-01
MQTLNEVSQTCPQCCCCSCTTPFFNSPTSQQHNTAPKIRNSSAEWRHSFAVTTTSSIFPNTQFTNHESLPSLHESFNEFTKAYTQYSETEQVDHVRAKDYSHLSLSNQTCLDYIGIGLFSYSQLQHHETSKGQVPSSSIPQTPPNYSDIPFFSLSCKTGSLKTLLLHGGQDTEFEAAMRKRIMSFLNVSENDYFMVFTANRTSAFKLVADSYQFQTSRRLLTVYDYESEAVEVMISSSEKRGARAMSAEFSWPRLRIQTTKLRKMIESKRKKKKKRKGLFVLPLSSRVTGAKYPYLWMSIAQEIGWHVLVDACALGPKDMDCFGLSLFQPDFLICSFYKVFGENPSGFGCLFIKKSAISSLESYPSAGIVNLVPEKQPHQLSDDSSGTDLELKNKPSPACLHEEKLFPLSYFSGPMQTKQSEIVEEGEPPDSKLKAPQCSEIEEVQQEAVQNLKKSSKVEETDIQCRCLDQVDSLGLILITNRSRYLINWLVNSMRKLKHPNTQGVHLVKIYGPKVKFDRGPALAFNIYDWKGERVEPALVQKLADRSNISISYAFLHHIWFADKYAEEKGKVLQTKVVGGQEGVMTTTNKKDSVGISVVTAALGFLANFEDVYKLWAFVARFLDADFVEKERWRYIAINQKIVEV

SEQ ID NO: 165244 - protein, 586 aa, Glycine max
  Coding DNA Sequence Number=SeqID_73559
  Gene Ontology: Mol. function=transferase activity; Cellular component= cytoplasm; Biological process=D-ribose metabolic process
  Homolog annotation: Hit_ID=Q8H277; Match level="QueryCoverage=55%, HitCoverage=86%, E-value=1e-132, Identity=72%"; Hit description =Fructokinase
  Pfam annotation: Domain name=PfkB; Domain location=90-400; Score =364.1; E_value=2.3e-106; Accession=PF00294.15; Description=pfkB family carbohydrate kinase
AANAAGIVVTMLLRRAVVFATILDIAENGNCRKMQLMRLQLQSRCCHREPNDLNFAAEKHGHRPLFKTLGYCLRAGQSNDLTKEDCKETSSVVVCFGEMLIDFVPMVGGVSLAEAPAFKKAPGGAPANVAVGISRLGSSSAFIGKVGADEFGYMLADILKQNNVETSGMRFDSNARTALAFVTLRADGEREFLFFRNPSADMLLQESELDKDLLKKARIFHYGSISLIDEPCKSAHLAAMSIAKNSGCILSYDPNLRLALWPSADAARKGIMDIWDQADVIKISEDEITFLTGGDDPYDDNVVLKKLFHPNLKLLIVTEGSQGCRYYTKAFKGRVSGVKVKPVDTTGAGDAFVSGILHCIASDQTIFQDEKRLRKALYFANVCGALTVTQRGAIPALPTKEAILQFLLEAARELANLGLEMKLTSGPKKAALEHMREKIEASTEKIRMTKINEEQARKVVARGGGDGASDGTTEEREDGRSSSSQDSAIQDGSTVSSTRESNGGTAGNVPYQNNGQKVPVTNEHKLQPPSEGEGRNKKKVNFRRGKGIGAVPKTRSSTPDMVPALMQMEEPESTMVIRYCTKYIFG

SEQ ID NO: 165245 - protein, 142 aa, Glycine max
  Coding DNA Sequence Number=SeqID_73560
  Gene Ontology: Mol. function=DNA binding; Cellular component=nucleus; Biological process=regulation of transcription
  Homolog annotation: Hit_ID=A5BM31; Match level="QueryCoverage=86%, HitCoverage=26%, E-value=1e-43, Identity=70%"; Hit description =Putative uncharacterized protein
  Pfam annotation: Domain name=Myb_DNA-binding; Domain location=7-56; Score=33.0; E_value=1.1e-06; Accession=PF00249.22; Description=Myb -like DNA-binding domain
MDEVGSSSEWSKEQDKAFENALAIHLEDASDRWEKIVADVPGKTLEEIKYHYELLVEDVNRIESGCVPLASYNSSPEGSTSQGAGKKGGHSWNSNNESNHGTKASRSDQEWRKGIAWTKDEHSICHFEQHKVGSIALWQRQF

SEQ ID NO: 165246 - protein, 289 aa, Glycine max
  Coding DNA Sequence Number=SeqID_73561
MDELSQRDGLGSVYGFLEPQAILNANDRRGQCQEYIEKWLKESNRHVYLGAYLNNAFKTLETNSEGKFGHSTPRWIELKSHVQSGAYECGYYVMHWMWNIIVGQLKTNWTLWLNDGTPLDIDTITTLRKKWVEYFVELVLAQFRRANGKVDEPAVRLSCLYYNSRSFNKPHVSDASLTLSTTLLFKGNIRHNSFCYYLTQIFYLWDTIPRQVLHKKPTTLLHSLEAWIVAFEIEYGQWVEEKERRNEELRHALAATMEKFKALEGFVNQLDFACMAPRHSNGTNLLIYI

SEQ ID NO: 165247 - protein, 68 aa, Glycine max
  Coding DNA Sequence Number=SeqID_73562
MDDDQWAYYSVMSEEVDMDFQNEEDCGVNETHVDCSDAFNTSQVFETREDVLEWARTVAHENGFVAVI

SEQ ID NO: 165248 - protein, 235 aa, Glycine max
  Coding DNA Sequence Number=SeqID_73563
GLTLPPEPEVGPSAARISTKESCVDPSGNDPNTGDSNKYELYIEENPPHLVALGRLYKGSITIHNIPLLHDQVKVGVEEVRDADAPIPVPTEEVKLVGQTLNIFLPWPTRLVKRLSEQGAMGPAKPADRPDHDVDDPLYLMTLTIPQVFLMLARLTGALSKGGKMRGVATNVYLGKRWENRRKPVKMKILSLGVVFTLKEGISTSHVDKSGAFAPTYPPLERKSDLRSSFLCVNQ

SEQ ID NO: 165249 - protein, 34 aa, Glycine max
  Coding DNA Sequence Number=SeqID_73564
IMVRTRGLGWALGRVIRRALGREVFQVDPTTHQL

SEQ ID NO: 165250 - protein, 80 aa, Glycine max
  Coding DNA Sequence Number=SeqID_73565
MGNKWEVRKSSKPQNQNYKLSFQKLIWLEAYNNKMPKSSPNMHVKQEVSTRVKPRLLCKQSMGQNTPNKIDDDGSDSHQG

SEQ ID NO: 165251 - protein, 191 aa, Glycine max
  Coding DNA Sequence Number=SeqID_73566
MAASDIAILRDRAHIPTKKRCAICGGAHNSGCCIPNEEPAHEVNYMGNQPRQNFNAGGYSGFQHGQPYNSQQGQWRNHPGNQFNKDQGSPSTRPQQQGPSLYDRTTKLEETLAQFMQVSMSNHKSTESAIKNLEVQVGQLAKQLADRPSSSFSANTEKNSKKECKAVMTRSRMAIQADESRAEEKVEGYKQ

SEQ ID NO: 165252 - protein, 172 aa, Glycine max
  Coding DNA Sequence Number=SeqID_73567
MEELFKRWNEYLDNTRSRVSQPPLINYDFCGREHYNDNCHLYSMNDSRWEQELSPYNQYEEERTPNLESVFEEFMAYHDISKANQNSMKNHEIHFGKSYSIEKFSRGPELQPYYQNEAERGSNLDNLLMQFKETTKSTQRAFQSAKIQVGELAEEVTQFMARREKDFVEVEA

SEQ ID NO: 165253 - protein, 90 aa, Glycine max
  Coding DNA Sequence Number=SeqID_73568
LQGGGPLYTVRHNIDGAPKKVENGELANSATAITSRGSRLEGGGHMNSALAITFMGLRKKWRMENWRTALRNNFRGSILEGGGHMNSARQ

SEQ ID NO: 165254 - protein, 53 aa, Glycine max
  Coding DNA Sequence Number=SeqID_73569
MVFHLRLVMSFKTKKGEHSLKGAIKGINSGKYQQESSQGYCASNQWDKTHRIK

SEQ ID NO: 165255 - protein, 80 aa, Glycine max
  Coding DNA Sequence Number=SeqID_73570
MSPDFTGQDFKGAEDDVMIEKDGAIDKSKAFAPTYPQFVMRNSNLRSSLESGVRLKESLLEDADISGDGADDHIGLCLSI

SEQ ID NO: 165256 - protein, 143 aa, Glycine max
  Coding DNA Sequence Number=SeqID_73571
MRVHCNQASRRPNDAILPRKGPVTRAMSKRLQEDWARVDKEGLRVLMNLRLSSSFSRKLLKEAHLGGEALFFHGLFLNGWRLLSPLLLCLPLHLHGEKSPLKDLIEAQRSSLHRSSTSKLPSEVELSAPCCAELNSLTAFEFL

SEQ ID NO: 165257 - protein, 78 aa, Glycine max
  Coding DNA Sequence Number=SeqID_73572
MRDGKKSLYVIGIRVNSGIGLEGKFLVALEPAPKLALPGGRVMVGAGAWGASLWMGVGALGCTGAKLEEFPTRVEKLK

SEQ ID NO: 165258 - protein, 53 aa, Glycine max
  Coding DNA Sequence Number=SeqID_73573
MESRITKVEEGKDILQATPRRHIIWGEIVEAKLHGESKVIQRCLDDNNDDNKR

SEQ ID NO: 165259 - protein, 92 aa, Glycine max
  Coding DNA Sequence Number=SeqID_73574
  Subcellular localization annotation: CTP_CleavageSite=44; ConfidenceScore=5.35e-01
MTLRRAQASASIGEGKQLMVAVFALMKLSCLSLKQNPIPKVFVSSNRAASMLQVMNSSRGGFQLMSLKIVEVCEIGLDSILMFLHSVKCCHD

SEQ ID NO: 165260 - protein, 94 aa, Glycine max
  Coding DNA Sequence Number=SeqID_73575
MKSLRGKEIALVKVQWGPDEGDSTWELEDRVRELYPRSHFEHFDISITYFRKRAPTGAEKREELEPERRHANRDRISASKKVQFFFFLMAEYDV

SEQ ID NO: 165261 - protein, 288 aa, Glycine max
  Coding DNA Sequence Number=SeqID_73576
  Gene Ontology: Mol. function=transferase activity, transferring acyl groups, acyl groups converted into alkyl on transfer; Cellular component=cytoplasm; Biological process=cellular carbohydrate metabolic process
  Homolog annotation: Hit_ID=O68883; Match level="QueryCoverage=100%, HitCoverage=67%, E-value=1e-148, Identity=88%"; Hit description =Citrate synthase
  Pfam annotation: Domain name=Citrate_synt; Domain location=46-288; Score=314.5; E_value=2e-91; Accession=PF00285.12; Description =Citrate synthase
MTDKKVTLTLQDNNSVELDVMQGTLGQDVVDVRALGSKGLFTFDPGFTSTASCESKITFIDGDEGILLHRGFPIDQLATHSNYLEVCYILLNGEAPTQAQYDEFRTTVTRHTMIHEQITRLFHGFRRDSHPMAVMCGVTGALAAFYHDSLDVNIERHREIAAFRLLSKMPTMAAMCYKYSIGQPFVYPRNDLSYAGNFLHMMFATPCEEYKVNPVLERAMDRILILHADHEQNASTSTVRTAGSSGANPFACIAAGIASLWGPAHGGANEATLRMLEEISTVDHIPEF

SEQ ID NO: 165262 - protein, 935 aa, Glycine max
  Coding DNA Sequence Number=SeqID_73577
  Gene Ontology: Mol. function=oxidoreductase activity, acting on the aldehyde or oxo group of donors, disulfide as acceptor; Cellular component=mitochondrial membrane; Biological process=metabolic process
  Homolog annotation: Hit_ID=P0AFG5; Match level="QueryCoverage=99%, HitCoverage=99%, E-value=0.0, Identity=88%"; Hit description=2 -oxoglutarate dehydrogenase E1 component
  Pfam annotation: Domain name=E1_dh; Domain location=207-531; Score =110.3; E_value=5.7e-30; Accession=PF00676.11; Description =Dehydrogenase E1 component
  Pfam annotation: Domain name=Transket_pyr; Domain location=591-787; Score=256.9; E_value=4.4e-74; Accession=PF02779.15; Description =Transketolase, pyrimidine binding dom
  Pfam module annotation: Pfam domain module=E1_dh::Transket_pyr; Domain location=207-531::591-787
MQNSAMKPWLDSSWLAGANQSYIEQLYEDFLTDPDSVDEVWRSMFQQLPGTGVKPEQFHSTTREYFRRLAKDATRYTSTVTDPAANSKQVKVLQLINAFRFRGHQHANLDPLGLWKQERVADLDPAFHDLTDADFQESFNVGSFAIGKETMKLADLYAALQQTYCGSIGAEYMHINNTEEKRWIQQRLESVVGHASFSADEKKGFLKELTAAEGLEKYLGAKFPGAKRFSLEGGDALVPMLREMIRHAGKSGTREVVLGMAHRGRLNVLINVLGKKPQDLFDEFSGKHKEHLGTGDVKYHMGFSSDVETEGGLVHLALAFNPSHLEIVSPVVMGSVRARLDRLAEPGSNKVLPITIHGDAAVIGQGVVQETLNMSQARGYEVGGTVRIVINNQVGFTTSNPKDARSTPYCTDIGKMVLAPIFHVNADDPEAVAFVTRLALDYRNTFKRDVFIDLVCYRRHGHNEADEPSATQPLMYQKIKKHPTPRKIYADQLESEGVATQEDATELVNLYRDALDEGECVVPEWRPMSLHSFTWSPYLNHEWDESYPETVDMKRLQELARRISSIPEAVEVQSRVAKIYNDRKEMAEGNKLFDWGGAENLAYATLVDEGIPVRLSGEDSGRGTFFHRHAVIHNQQNGSTYTPLHHIHNGQGQFKVWDSVLSEEAVLAFEYGYATAEPRVLTIWEAQFGDFANGAQVVIDQFISSGEQKWGRMCGLVMLLPHGYEGQGPEHSSARLERYLQLCAEQNMQVCVPSTPAQVYHMLRRQALRGMRRPLIVMSPKSLLRHPLAVSSLDELANGSFQPAIGEIDDLDPQQVKRVVLCSGKVYYDLLEQRRKNEQTDVAIVRIEQLYPFPHKAVQEALKNYAHVQDFVWCQEEPLNQGAWYCSQHHFREVVPFGASLRYAGRPASASPAVGYMSVHQQQQQDLVNDALNLG

SEQ ID NO: 165263 - protein, 128 aa, Glycine max
  Coding DNA Sequence Number=SeqID_73578
  Gene Ontology: Mol. function=structural constituent of ribosome; Cellular component=ribonucleoprotein complex; Biological process =translation
  Homolog annotation: Hit_ID=P56791; Match level="QueryCoverage=83%, HitCoverage=39%, E-value=3e-38, Identity=78%"; Hit description =Chloroplast 50S ribosomal protein L2
  Pfam annotation: Domain name=Ribosomal_L2_C; Domain location=34-128; Score=123.3; E_value=7.1e-34; Accession=PF03947.9; Description =Ribosomal Proteins L2, C-terminal domain
MSDSADLDSYIPTRAVLHFWEEVLIDQKEESTSTDMPLGTAIHNIEITLGKGGQLARAAGAVAKLIAKEGKSATLKLPSGEVRLISKNCSATVGQVGNVGVNQKNLGRAGSKCWLGKRPVVRGVVMTP

SEQ ID NO: 165264 - protein, 77 aa, Glycine max
  Coding DNA Sequence Number=SeqID_73579
MAANLFPSIRFNWSKRAWAYSASSNPDSARILKEGISTFNGSTTSIPYTKENGVALVDPQLPHLSWADKALNYGVGF

SEQ ID NO: 165265 - protein, 237 aa, Glycine max
  Coding DNA Sequence Number=SeqID_73580
  Gene Ontology: Mol. function=transcription termination factor activity; Cellular component=riboflavin synthase complex; Biological process=regulation of transcription, DNA-dependent
  Homolog annotation: Hit_ID=Q1H424; Match level="QueryCoverage=51%, HitCoverage=79%, E-value=5e-36, Identity=60%"; Hit description=N utilization substance protein B homolog
  Pfam annotation: Domain name=DMRL_synthase; Domain location=1-84; Score=22.4; E_value=1.1e-08; Accession=PF00885.10; Description=6,7 -dimethyl-8-ribityllumazine synthase
  Pfam annotation: Domain name=NusB; Domain location=96-223; Score =133.3; E_value=7e-37; Accession=PF01029.9; Description=NusB family
  Pfam module annotation: Pfam domain module=DMRL_synthase::NusB; Domain location=1-84::96-223
MALSEEFDALIALGAIIRGETYHFEVVSNESARGISEVQRDTGVPVANAILTTENDEQAEARVAVKGAEAAQVAIEMANLVSGAAPAKSKGSKNRRKSRELALKALYRNRMNAGDVKQLRLDSLDDPDYLKADETYFKQLLTGVLEHTEDIDAMISQFIDRQLDELSPIEHAILRISGYELMFDVSIPYRVAINEGVELAKTYGGIDGHKYINGVLDKIAAQGADGLCGISLICCPR

SEQ ID NO: 165266 - protein, 97 aa, Glycine max
  Coding DNA Sequence Number=SeqID_73581
MPQPFSTDTEISGYLFDFLFAAQDASTSSLLWAVALLELHAELLAKVIGVKLVVHIHPCRPLPERENDKEKGRYKATMREENERLGENEGSVVYPRR

SEQ ID NO: 165267 - protein, 66 aa, Glycine max
  Coding DNA Sequence Number=SeqID_73582
MKLEETLAQFMLVSMSNQKSTESAIKNLEVQGGWIFELQCGPLMVIFHHGDAAEDKGEEVRGGAIQ

SEQ ID NO: 165268 - protein, 106 aa, Glycine max
  Coding DNA Sequence Number=SeqID_73583
MWVCFSVCVCFCVCVCVCGCVAVYVCVYAARSQLQQGLKINYGKSSFGVLGQSEQWLIQRRFLWGGGLDQKKIAWVKWDYWLMEQEPLREKYPRLYNISCQHQKLI

SEQ ID NO: 165269 - protein, 85 aa, Glycine max
  Coding DNA Sequence Number=SeqID_73584
AANHRGQVQIHECLYQLSLSLQSQGFAPFACPTPDQFRAEVAWPRDWPEAQAGEAPAEAPGDAEEARMDEEMSDLLGFLGGSGAT

SEQ ID NO: 165270 - protein, 18 aa, Glycine max
  Coding DNA Sequence Number=SeqID_73585
MPYEDMNPTQAAFAVVNN

SEQ ID NO: 165271 - protein, 201 aa, Glycine max
  Coding DNA Sequence Number=SeqID_73586
MEMETDSEPRVSLVQVGFWEDGVWYWSFVWRRSWLLWEIPLLDEFMFAINLASLHPKEEDKILWRGTASSNNLVKDADHRIVQGLEGGVVGPFGVLETKWFLMGVFSISMLWLRSSSSKLGLGFQLSGESIVLLKIVEVTWAKVVVISDHAKHVVDCYKTTIHECDFRVEAHLRGTGANVPKISSKREIYNLAIGYNKWQY

SEQ ID NO: 165272 - protein, 520 aa, Glycine max
  Coding DNA Sequence Number=SeqID_73587
  Gene Ontology: Mol. function=aspartic-type endopeptidase activity; Biological process=proteolysis
  Homolog annotation: Hit_ID=Q9FSZ9; Match level="QueryCoverage=40%, HitCoverage=74%, E-value=8e-14, Identity=44%"; Hit description =Putative extracellular dermal glycoprotein
MLQPYEISIGLKEHSNPVTPKAYTPKSPSGPLPPDSAIATSLAIPGNSFNYSSDCSDRIPKHQRDGEEIETSTCTVFIRFLFLPPGILSRKSQRWKPLGFCGKEKGYNEKGFSLSSDMISKFPTDVLFFSQIQVSGIRSGCTNAHKFTSINLVGGLPKGSKGMLGLARSELAVPTQLALLKKLPQGHEHPRDVSKHVKTTPLVVNHFDTGPLFEEGRATGAPKLAPSLVLLNSKVLSISLLLKISLRRLNRVASVTPFEACFDSRSIGNSITGFVVPTIDLVRATRGSAMAKKNVACPAFVDRGTMATMSFFKASIVIGAHQLEENLLVFDVASSKLSFSSSLSLHNVITPCGPVVFVPDLRRIAEPSRIRYRVLTVSTGPTCLPSSAMPEHHTRQVTTDKLEEAVKTLSQDNSSLNNKIDTIHASLTAKIDALFDRFAAIAVNSPQPPPPTPVHSSSSSHRHHTKLEVPRFDGHDPLGAFQRTNGSPSHPSTWKDPRYPGISGCVATGSFRPGQRCYRP

SEQ ID NO: 165273 - protein, 337 aa, Glycine max
  Coding DNA Sequence Number=SeqID_73588
  Homolog annotation: Hit_ID=O64438; Match level="QueryCoverage=48%, HitCoverage=68%, E-value=5e-85, Identity=95%"; Hit description=ARG10
DGVIDIKQYFYAGNDRIAPLPSLYNETQTPCAVPIPFSVGERERENVGDLQQFSGVAAGGAGGRWQQNAVAEDDGGEAAEPVRGEQGVGGVAAVENGRSFAVKDEIFCLFEGALDNLGSLRQQYGLAKSANEVILVIEAYKALRDRAPYPANRVVCHLSGSFAFIVFDKSTSTLFVASDQAGKVPLYWGITADGYVAFADDADLLKGSCGKSLASFPQGCFYSTAVGGLRCYENPKNKITAVPAEEEEIWGAFFKNRESVISPHSNGRLMSVKTALGTKEKCKVTLELKILELNIRYVTRIASCNNFTEACMRGHVNNVNDDYDKSATGGRVYYGVH

SEQ ID NO: 165274 - protein, 422 aa, Glycine max
  Coding DNA Sequence Number=SeqID_73589
  Gene Ontology: Biological process=intracellular signaling cascade
  Homolog annotation: Hit_ID=A7NWH1; Match level="QueryCoverage=99%, HitCoverage=97%, E-value=1e-169, Identity=65%"; Hit description =Chromosome chr5 scaffold_2, whole genome shotgun sequence
  Pfam annotation: Domain name=DUF231; Domain location=276-412; Score =68.6; E_value=2e-17; Accession=PF03005.6; Description=Arabidopsis proteins of unknown function
MPVLETLRRVKRLRLFEPSVGVAGFILVSTFVICSFFYLDYSELAGKFGFSGQSERFTWSHEKRGSVEKRVHRVEFLGEKGGGGGGCDLFEGNWVWDESYPLYQSKDCSFLDGGFRCSENGRPDLFYTKWRWQPKACNLPSRSKPKIELLNKHRFNATIMLETLRNKRLVFAGDSIGRNQWESLLCMLSSGVPNKESIYEVNGSPITKHKGFLVFRFKDYNCTVEYYRAPFLVLQSRPPPRTDRKIRTTLKLDQMDWYSLKWRDADVLVLNTGHWWNYEKTIRGGCYFQEGAEVKLEMMVEEAYKRGGDWRKGGNCNLETLPELGSSLVPNDNWSQFKIANSVLLAHTNTSEVLKFKILNVTQMTSQRKDGHSSIYYLGPNAGPAPPHRQDCSHWCLPGVPDTWNELLYALLLKHETSHTWN

SEQ ID NO: 165275 - protein, 524 aa, Glycine max
  Coding DNA Sequence Number=SeqID_73590
  Gene Ontology: Mol. function=oxidoreductase activity; Cellular component=mitochondrial matrix; Biological process=response to stress
  Homolog annotation: Hit_ID=Q6KBB1; Match level="QueryCoverage=73%, HitCoverage=94%, E-value=7e-82, Identity=65%"; Hit description =Mitochondrial peroxiredoxin
  Pfam annotation: Domain name=AhpC-TSA; Domain location=35-176; Score =28.3; E_value=7.5e-06; Accession=PF00578.12; Description=AhpCTSA family
  Pfam annotation: Domain name=Redoxin; Domain location=28-210; Score =135.5; E_value=1.5e-37; Accession=PF08534.1; Description=Redoxin
  Pfam module annotation: Pfam domain module=AhpC-TSA::Redoxin; Domain location=35-176::28-210
  Subcellular localization annotation: CTP_CleavageSite=37; ConfidenceScore=5.06e-01
MASVMVNRGGSRIIKSVSAALGTRFFAKVATGTDIVSAAPNASLQKARTWDEGLASKFSTTPLKDIFKDKKVVIFGLPGAYTGVCSNKHVPPYKENIDKFKAKGIDSVICVAINDPYTMNAWAEKLQAKDAIEFYGDFDGSFHKSLELVTDLSGALLGTRSERWSAYVVDGKVKALNVEEAPSDVKEPRERERERSAEDRSQKGGLKDKTRMIGCAMESCMNPSHEAMTPGLVKRLTKSLSATLGFRSSSSVAKVTTGTDLLSIAHNVSLQKALTWDEGVASMPFSFSNHFYPFGSVTITNVLSPRCFSTRKWSYLESRYFHTPQSYHDHNADAFTGVCSEEHVPTYMDNIDKFKAKGIHAVIRVSINDPFTMNEWAEKLQGKDADLLSSNILKLNPNTEMVSDNNDNSGVVSNDGGKDTVMTMTVIVEVIFVVVAIGGGGDGSNNVNGNGGNSNISGVDNDGVDSNNSGGGGNNNNNTDRDNNGDSSGDDNNTNNASDIGDYNDDNESVSGGIKWNDIGGGNM

SEQ ID NO: 165276 - protein, 252 aa, Glycine max
  Coding DNA Sequence Number=SeqID_73591
  Gene Ontology: Mol. function=cobalt ion transmembrane transporter activity; Cellular component=integral to membrane; Biological process=cobalamin biosynthetic process
  Homolog annotation: Hit_ID=A2Y4G3; Match level="QueryCoverage=76%, HitCoverage=47%, E-value=5e-64, Identity=59%"; Hit description =Putative uncharacterized protein
  Pfam annotation: Domain name=CbiQ; Domain location=1-216; Score=6.7; E_value=0.00013; Accession=PF02361.7; Description=Cobalt transport protein
MAFSSGCSTGKVTHNYEICISSVPDFAFNLGSTKKCLDGLGSDGAPALVQLRTPPPAMMGLPNLPVSLTGYAYTIMKLGPLTFTRKGLSVASTIACLTFTVFQSASLCLTTTSPEQLAFALRWFMLPLKYIGVSVSEIVLTLLLSLRFISLVFDEVRNIALGIVSRRLNWKQLTVMETIDIFFNYFRRIFKNIFSHAEQISQAMIVRGFKGDCGTHKIYFLSESSFGMVDIICLLCLTLLIGAALLSEYYLV

SEQ ID NO: 165277 - protein, 297 aa, Glycine max
  Coding DNA Sequence Number=SeqID_73592
  Gene Ontology: Mol. function=kinase activity; Cellular component =cytoplasm; Biological process=purine nucleotide metabolic process
  Homolog annotation: Hit_ID=A7NWE1; Match level="QueryCoverage=96%, HitCoverage=98%, E-value=4e-85, Identity=58%"; Hit description =Chromosome chr5 scaffold_2, whole genome shotgun sequence
  Pfam annotation: Domain name=Guanylate_kin; Domain location=138-243; Score=98.0; E_value=3e-26; Accession=PF00625.12; Description =Guanylate kinase
  Subcellular localization annotation: CTP_CleavageSite=85; ConfidenceScore=5.54e-01
MWTSECSMFRRLLCTSLPRLSKPQSSSSLTILNSSLTQKQKQKPLSPQTIKSFSSSKMGDARRPLFVPIPTLEKAERSDLLRALEASMGSPFSSEPLSPNPNPLIIVISGPSGVGKDTLIARLRDSRRALHFVVTATTRPRRPAEVDGKDYIFVSKEEFLGMVEREELLEYALVYGDYKGVPKQQIRECLAQGCDVVLRVDIQGAATLKKALGKSAVFVFVAAESEMALVERLVDRKTETVESLLVRIGTAREEMKHVKNFDYVVVNAKGKLDNAVKLMESIIDAEKARVSQRTPHL

SEQ ID NO: 165278 - protein, 716 aa, Glycine max
  Coding DNA Sequence Number=SeqID_73593
  Gene Ontology: Mol. function=binding; Cellular component=nucleus; Biological process=mRNA modification
  Homolog annotation: Hit_ID=A2Q222; Match level="QueryCoverage=99%, HitCoverage=95%, E-value=0.0, Identity=74%"; Hit description =Tetratricopeptide-like helical
  Pfam annotation: Domain name=PPR; Domain location=109-143; Score=0.3; E_value=7.1; Accession=PF01535.11; Description=PPR repeat
  Pfam annotation: Domain name=PPR; Domain location=171-205; Score =50.3; E_value=6.5e-12; Accession=PF01535.11; Description=PPR repeat
  Pfam annotation: Domain name=PPR; Domain location=241-275; Score =10.1; E_value=0.49; Accession=PF01535.11; Description=PPR repeat
  Pfam annotation: Domain name=PPR; Domain location=303-337; Score =33.4; E_value=8.4e-07; Accession=PF01535.11; Description=PPR repeat
  Pfam annotation: Domain name=PPR; Domain location=435-469; Score =45.4; E_value=2e-10; Accession=PF01535.11; Description=PPR repeat
  Pfam annotation: Domain name=PPR; Domain location=538-572; Score =34.7; E_value=3.4e-07; Accession=PF01535.11; Description=PPR repeat
  Pfam annotation: Domain name=PPR; Domain location=573-607; Score=9.2; E_value=0.64; Accession=PF01535.11; Description=PPR repeat
  Pfam annotation: Domain name=PPR; Domain location=609-643; Score =13.6; E_value=0.19; Accession=PF01535.11; Description=PPR repeat
  Pfam module annotation: Pfam domain module=PPR::PPR::PPR::PPR::PPR::PP R::PPR::PPR; Domain location=109-143::171-205::241-275::303-337::435 -469::538-572::573-607::609-643
  Subcellular localization annotation: CTP_CleavageSite=76; ConfidenceScore=5.24e-01
MLLVFISASLRLKLKILPRSLPFSLSVELPSPNPILRSKWVSFSSSTNASPHVQDPQHFIGIFCNARLHQNHYECELALVSALKYCSSSSQGRQLHSLVLKLGLHSNTFIQNSLINMYAKRGSIKDAQLLFDACPTLNPISCNIMVCGYAKAGQLDNARKLFDIMPDKGCVSYTTMIMGLVQNECFREALEVFKDMRSDGVVPNDLTLVNVIYACSHFGEILNCRMIHAIAIKLFVEGLVLVSTNLMRAYCLCSGVGEARRLFDRMPEVNLVSWNVMLNGYAKAGLVDMARELFERVPDKDVISWGTMIDGYILMNRLHEALVMYRAMLRSGLALNEILVVNLVSACGRLNAIGDGWQLHGMVVKKGFDCYNFIQTTIIHFYAACGMMDLACLQFEVGAKDHLESWNALVSGFIKNRMVDQARKIFDDMPERDVFSWSTMISGYAQTDQSRIALELFHKMVASGIKPNEVTMVSVFSAIATLGTLKEGRWAHEYICNESIPLNDNLRAALIDMYAKCGSINSALQFFNQIRDKTFSVSPWNAIICGLASHGHASMCLDVFSDMQRYNIKPNPITFIGVLSACCHAGLVEPGRRIFRIMKSAYNVEPDIKHYGCMVDLLGRAGLLEEAEEMIRSMPMKADIVIWGTLLAACRTHGDVNIGERAAESLAGLAPSHGGGKVLLSNIYADAGRWEDVSLVRRAIQNQRMERMPGCSGVIR

SEQ ID NO: 165279 - protein, 130 aa, Glycine max
  Coding DNA Sequence Number=SeqID_73594
MSERKGRHGLENCEVDLAKSCVHGLRTTVLLIETVAGSSDSVEGVHRALDVEDCEAAARALKGGWCRIVAGTERRRGQEGHGGGHVMCMHTHGTPSHISKKSYIERTTLSSHDERHRVLSHASLRLKWIE

SEQ ID NO: 165280 - protein, 41 aa, Glycine max
  Coding DNA Sequence Number=SeqID_73595
MTKVVVVTKARCCGGCDNDNNNGDSNCSGMVVVEARVCWQL

SEQ ID NO: 165281 - protein, 102 aa, Glycine max
  Coding DNA Sequence Number=SeqID_73596
MIVDTLPVFYYEKMVGYTPSSFADLVFAYEKIEVGMKRGKFNHPAWTSEKTGANEEGENEEETHAATAIPIRPSFPPIQQCHYSANNNPSPYLPPIYPQGHP

SEQ ID NO: 165282 - protein, 126 aa, Glycine max
  Coding DNA Sequence Number=SeqID_73597
MSWMNIKGAFPFSPKQHFMQHISIHIEGLRAKRWRYWWLAVTWSIWKLKNRILFANAEFDTNRLFEDAIFIIWTWLRQFEKDFTVHYNQWSNRIPTKGNLRRRQLEKGFAQPYNYWSSNLSTTFFY

SEQ ID NO: 165283 - protein, 66 aa, Glycine max
  Coding DNA Sequence Number=SeqID_73598
MENWRTALCNNFPGAPVLEGGGAHEKCLAITFMGLRKKWRMENWRTALRNKFVGLQTRRWRMHEQR

SEQ ID NO: 165284 - protein, 153 aa, Glycine max
  Coding DNA Sequence Number=SeqID_73599
MAPTRHPLDPDKSNRALGFPTLIIGLCQSYGVPVTPSKAADAPPPPRQADRAGSLGVERYLQHLVRQQAAYHRGQVQIHECLYRFSLSQQGQGFAPFVCLTPEQFGAEVAWPRDWPDAQAREEPAGSLGEADESHMDEDMTDLLSFLGGRGAT

SEQ ID NO: 165285 - protein, 125 aa, Glycine max
  Coding DNA Sequence Number=SeqID_73600
MVDYTPSSFDDMVFTDEMIKGEDEVEAHAVTAIPIQPSFPPTQQCHYSANNKPSPYPPPTPGRSIEHCRALKRKVQGLIDMGWLKFEENRVIFNFHRKWVQAIGQFAQATYAPEFGTSKTVGGGA

SEQ ID NO: 165286 - protein, 245 aa, Glycine max
  Coding DNA Sequence Number=SeqID_73601
MEDAPVSPASPSRRRTWLLVKAFYANLYSSEDHPPKQSKVRGHLVKIQAESLNTLLETLVVLAEGETLPAYSRYCRLPIGYKEIEVALCIPGRGFIMNSEGHPGKILRKDLTTLAQVWRVLSYSKLAPTSHTSDLTVDRARLIFGLVSRMDMNIGALISGQMTSIAQSSTSRLEFPALITALCRDRGVVSDSLTFERLSPIINLAYIKKNCWNPEDLTVSIQGVRRARARPTELPSTSAAPTLAS

SEQ ID NO: 165287 - protein, 925 aa, Glycine max
  Coding DNA Sequence Number=SeqID_73602
  Gene Ontology: Mol. function=protein binding; Cellular component =periplasmic space; Biological process=cell wall catabolic process
  Homolog annotation: Hit_ID=Q2NU58; Match level="QueryCoverage=33%, HitCoverage=82%, E-value=1e-135, Identity=75%"; Hit description =Putative uncharacterized protein
  Pfam annotation: Domain name=ErfK_YbiS_YhnG; Domain location=104-241; Score=218.1; E_value=2.1e-62; Accession=PF03734.5; Description =ErfKYbiSYcfSYnhG
  Pfam annotation: Domain name=PHO4; Domain location=752-924; Score= -59.7; E_value=2e-08; Accession=PF01384.11; Description=Phosphate transporter family
  Pfam module annotation: Pfam domain module=ErfK_YbiS_YhnG::PHO4; Domain location=104-241::752-924
  Subcellular localization annotation: CTP_CleavageSite=6; ConfidenceScore=5.02e-01
MAITTCKNMKKSIRAFASLALVLAAFSQSAFAVVYPLPPANSRLIGENIEITVPDDSKLPLEAFAAQYQMGLSNMLEANPGVDVYLPKAGTKMVIPQQLILPDAPREGIVINSAEMRLYYYPKGTKTVVVLPIGIGELGKDTPVNWTTAVERKKNGPTWTPTKAMHAEYAARGESIPAVFPAGPDNPMGLYALYIGRLYAIHGTNANFGIGLRVSHGCVRLRADDIKWLFDNVPVGTRVQFIDQPVKATVEPDGSRYIEVHNPLSTTEEQFNSRELVPISLTSAVTKVVADASTNQDAVNNAIQARTGMPTKINGQPGEAQPEPVMVQESSDAMPKEEPMTPQGATAVAPQADAQQPAEAAPVEQAAPAQPASNGNSLRRAGFFIARSPGSLCGCVAVQLRAQSCGRRNASQPATRVNTSTTSTNSRKPCGLFASGMPPTFMPKKPATILMGSASTVIEAGSDLLLQQANALHQAGKIVKRYAELLGENPQLTERFPVEPVWRPVKQAKQRGRLRRQQPLDAQQHAAQMAQLAAVGFDRRAQQPLFYRIHRLAGAPHHLLQLRFLFAEQPQQHRIRRAEAQPINLLMHTFNHANRAIARADHHLRPAPDPQRRILCVALLFTKGDVIQHRQQRIVLLRQPARAGIIILSYKTRITLQLTGAIRASLIHPGGCVMAENSFPASSSDRGRPNLHPRSGRASRVLFLLLLVAGLVFTGINLFNDVEETGAVVTSYTPFLLLGVALLIALGFEFVNGFHDTANAVATVIYTHSLSPGVAVVWSGLCNFLGVLLSSGVVAFGIISLLPVELILQAGSGHGFAMVYALLCSAIVWNLGTWYFGLPSSSSHTLIGSIIGVGVANALLHGRSGTSGVDWDQAIKVGYALLLSPVIGFICAAVLLLAMKALVRNRQLYQAPEAISRRQRGFVAC

SEQ ID NO: 165288 - protein, 38 aa, Glycine max
  Coding DNA Sequence Number=SeqID_73603
MADTIGDQVQSQSRTHLVAHDPGNLNKTSASSEGRKIP

SEQ ID NO: 165289 - protein, 114 aa, Glycine max
  Coding DNA Sequence Number=SeqID_73604
MTKDKVDTSKPYIRAMRGTVHEPQANLGADQNTLTFRGLNALAFKGLHALAFRGLHALAFRGLHVLAFRGLHVLALRGLHALAFRGLHVLTFRGLNILAFKGLHVLPFRGGGIL

SEQ ID NO: 165290 - protein, 116 aa, Glycine max
  Coding DNA Sequence Number=SeqID_73605
MELDLRWEALNGNFYNVLLGTTFRLEPLSMSTLAITCSMHLTDTCKALLCPLPSAGISSSAKRNSPASSSDTSFLPQPSLPSAKSFIGTSSPTRGCEHANATGYAAQPSDIGHFGR

SEQ ID NO: 165291 - protein, 105 aa, Glycine max
  Coding DNA Sequence Number=SeqID_73606
MTKLGLCLSSGPPPLDDKRVRITVRMTKLGLCLSSGPPPLDDKRVRITIRVRITIRYLRVSWGRMTKLGLLLSSGLLSHGNKRRYGRQKRGSCSYVSSNEEFRPT

SEQ ID NO: 165292 - protein, 48 aa, Glycine max
  Coding DNA Sequence Number=SeqID_73607
MKVMLLSPIALKVVGSFLLDSNSSRDGTNPPSNSLYGNPQTRKQRDKQ

SEQ ID NO: 165293 - protein, 68 aa, Glycine max
  Coding DNA Sequence Number=SeqID_73608
MKPRHCQFGTVINLYIVPRSVFFVRLPGSPLLFCEYSSSPSIIINLNFFVKFNLKPITKCCKLVFEKI

SEQ ID NO: 165294 - protein, 176 aa, Glycine max
  Coding DNA Sequence Number=SeqID_73609
  Subcellular localization annotation: CTP_CleavageSite=65; ConfidenceScore=5.35e-01
MTQKLVARGHTLRLSAPRHSVTPSVIGEQRPMWSSAPFPEMSASSGGDFFKSNKLSRTTKRRRARSHAETNYGHSAHLLPFRHSRVRWHAETNNGHSAPFCHPEAAGPMTCGDKLWSFRTPFSIQTQSCPMARRDKLWSFYTLLSSRGGGPDDMRRQIMVIPHTFCHSDTVVSDGT

SEQ ID NO: 165295 - protein, 223 aa, Glycine max
  Coding DNA Sequence Number=SeqID_73610
  Subcellular localization annotation: CTP_CleavageSite=54; ConfidenceScore=5.58e-01
GITLSFCSSAIFAFPLAFAGCVGKSGGANTRPLRVTPLSPVILVTLADNEMMSVASSFLSLGGAYLHETAWLFWYGNGIGLTTEGYQGVWGVASLGLVDKPSGGLHILQRLGPARPTRLDSINRSPSMIGKRARHCSVEWPGVFPWYAQDGKRSSYVIGIGVNVVLGGKFLIALEPAPKWALPAGRVGVGAIAWGVFLWMGVGALVCTGAELEESPARAEKLE

SEQ ID NO: 165296 - protein, 404 aa, Glycine max
  Coding DNA Sequence Number=SeqID_73611
  Homolog annotation: Hit_ID=Q84VI1; Match level="QueryCoverage=100%, HitCoverage=59%, E-value=1e-167, Identity=74%"; Hit description =Envelope-like protein
MATSPKETSASGSPAVRSSPHQEQPEFNVQPIQIIPGQASVPEKLVPRRQQGVKIAENPSLATSPREVDTEMDKKIREKCSNIFHPNVSVPDVEKDVPTSSAPNAEVLPSPSEEESSEEEDQATEETPAPRAPEPAPRAPEPAPRAPEPAPGDLIDLEEVESDEEPIVNRLAPGIAERLQSRKGKTPVKRSGRIKTMAQKKSTPITPTTSRWSKVAIPSKKRKEISSSDSDDDVELDVSTSKRAKKSGKKVPENVPDAPLDNISFHSIGNVERWKYVYQRRIALERELGRNALDCKETMELIKAAGLLKTVTKLGDCYESLVREFIVNIPSDITNRKSDEYQKVFVRGKCIRFSPAVINKYLGRPTEGMVDIDVSEHQIAKEITAKRVQHWPKKGKLSAGKLSV

SEQ ID NO: 165297 - protein, 62 aa, Glycine max
  Coding DNA Sequence Number=SeqID_73612
MASQEALRQAFWILFGYVSGNMYLEVSKEYRYLTQAPVVLLRILSTGCMLVEIFLYKVIHES

SEQ ID NO: 165298 - protein, 182 aa, Glycine max
  Coding DNA Sequence Number=SeqID_73613
  Homolog annotation: Hit_ID=UPI00016621D1; Match level="QueryCoverage =91%, HitCoverage=40%, E-value=1e-17, Identity=35%"; Hit description =UPI00016621D1 related cluster
MRGIVHEPQGGPLGTSTLTFRGLHTLDFRGLHALAFRGLHVLAFRGLQVLAFRGLHVLTLRGLSTLTFRGQHALAFRGLHVLTLRGLCTLTFRGLHALAFRGLHVLTFRGLHALAFRGLHVLAFRGLHALAFRGLHALTFRGLHVLAFRRLHALAFRGLHALTFRGLHALTFRGLHVLTIRG

SEQ ID NO: 165299 - protein, 67 aa, Glycine max
  Coding DNA Sequence Number=SeqID_73614
MVIKSGDWVWIHLRKNRFTSKRKSKLQKSTFDINSRANSSQEGGYDRGLSKEEELCLGGLNMDGPIT

SEQ ID NO: 165300 - protein, 139 aa, Glycine max
  Coding DNA Sequence Number=SeqID_73615
  Homolog annotation: Hit_ID=Q2HTK5; Match level="QueryCoverage=79%, HitCoverage=44%, E-value=4e-10, Identity=29%"; Hit description=H+ -transporting two-sector ATPase, alpha/beta subunit, central region
MAGTFFLLKQQNSLEILSEEETVGHVMFSCTRTRSLWWEALRWVDRVGPFPTDPKDHFIQFSSWSSKRYIDNRWAVLWIALSMTIWKHKNSMVFNNQIFNSEKVMDEALFHTWAWLKCMDKDFHIHFNQWSTSLREELS

SEQ ID NO: 165301 - protein, 28 aa, Glycine max
  Coding DNA Sequence Number=SeqID_73616
MSMTEGNLVQRDLGFGKDCRGKGYGGKP

SEQ ID NO: 165302 - protein, 177 aa, Glycine max
  Coding DNA Sequence Number=SeqID_73617
MVVRNMFGLPLVEGLANQSRDSLSANLGFDEPLEKRPENCPSRVFGGIHQQAWCVQCVCRALAYIHGAFAYVLLVRWHILETWCRALAYMTLVKWHVLEIGMYWRHGALAYVSLVKFHVLETWCSCIHVPYEVARTRDLILEGRLTKHVPWVLRACVAMTMDAPVLTTQENYEKEGM

SEQ ID NO: 165303 - protein, 243 aa, Glycine max
  Coding DNA Sequence Number=SeqID_73618
MLWKLGRIDGDPVLRETRIWATWEYVSSVGGGQQGMVEWYLEICRGGQETLGTSGGVLLPKTKLDQSRPNPGIVGQLKNEVRKLREPLRDGSLVIDYQIVMAAQLIRDRVEMECLEGAWETLEGNTRCRFRGTIRFTATSLVHPDEPARTLQRTVEWILPTPTPYRLVEPVQVIEVTSSEEDPEEDPEDLPPELVVDALDFLEGDEDPLLEVDSPEEVMSASEADSTEDSGPGEMAISGGSSS

SEQ ID NO: 165304 - protein, 204 aa, Glycine max
  Coding DNA Sequence Number=SeqID_73619
MSCSRDAISEATSSRLCPLCTLCCMQCHQRHVYKLIIAPLSRVYKSWCCIDPMVLLMERSLIVALSLIMLLPRPWWRDNRWWLKPTGSPGLPPGSDQPNPRSTLSPSPVLKSGRAKRADEGPKAYRVERHNNCSRIVSKTTSSSGVRSTKDKLELAAKGWEQEKIRKHNTRKHQLATNKRKSWWEHPFLGCSTDQHDLGLGTIT

SEQ ID NO: 165305 - protein, 141 aa, Glycine max
  Coding DNA Sequence Number=SeqID_73620
  Gene Ontology: Mol. function=oxidoreductase activity; Biological process=metabolic process
  Homolog annotation: Hit_ID=A7PKL2; Match level="QueryCoverage=81%, HitCoverage=27%, E-value=6e-18, Identity=48%"; Hit description =Chromosome chr7 scaffold_20, whole genome shotgun sequence
MGGLVEYYVVPANGLFVLPDSLPYTEYAILGCVVFTAYGATAHVAQVCPSDSVAVIGTRGGSDMFSEKDGFPRKPFLNGWKGENGFYAVSFTKQGFTKHGLLGASIDAKRIDEDIEHSWKAESNHVMEFPCPLSKIIDLYI

SEQ ID NO: 165306 - protein, 102 aa, Glycine max
  Coding DNA Sequence Number=SeqID_73621
MDPEKSNRVLGFPALITGLCQFYGVPVAHSKVIRPPTNRAFIKKYCAPRQAQDETPQHPGDGRQGATDAPSPSPKPLSSSTKAGVLPMTRGQPEGDQVQSQR

SEQ ID NO: 165307 - protein, 42 aa, Glycine max
  Coding DNA Sequence Number=SeqID_73622
MRDNDLVTNHKIRGTRVKDSRFSSRGLRDKGYRITILSHSGN

SEQ ID NO: 165308 - protein, 131 aa, Glycine max
  Coding DNA Sequence Number=SeqID_73623
MDIIEDLEIPLILGRPFMLTAECVVDMGRKKMEMGFEDQKINFDLFEEDKPATNQNVCLQVKKFHSLSASILCAKRALLALSAQPLSFKLIGHAKRALCELSPIRFDLNWAKRAFTRLANNSCLLSTDNLR

SEQ ID NO: 165309 - protein, 231 aa, Glycine max
  Coding DNA Sequence Number=SeqID_73624
LVMRMDMNIGALISGQISLIAQSNSSRLGFPALITALCKAKGVISYSLSYESLSPTINLAYIMKNCWNLDETSVYFPRTRKARARAAEIPSSSTPQDLLSGAQPYPIGEGEASVAQEPQPHQDESSLSSESETVPPEPFIYEADPGTTLEETQEAATPKITPQQATEPSIPVLDLSSPQLSQEPSTPILGLSSPTTSPAGTPVLHLTDEEEDTMDQDQLKDQRHDFYAPVF

SEQ ID NO: 165310 - protein, 386 aa, Glycine max
  Coding DNA Sequence Number=SeqID_73625
MTFPSTLKRTRKATRLRSLATRPVGEERPLVHMDLAMGKADGPHRKKLRTYLGIVSRDKVDVTYENWKQVSTTQKDLIWEDIQVFNLNVASDKDGVDDTICEKYDISQEKWTRFYQSRRDPSWKDEQKKAQAIQKQNTAPHVLSRGGYELLEKKVMDEKKKKQLKEDAQSRSTDTVIDPPSPIRRHVKWKMTRTKKTGQMTSEAAKEIANKISLGEQASQGAGAIGRLEHPGRVCAAGAGVMIKQYFGLAPRTSCTSSSMTLEDLEQLTQKIRDQLEESITKKVTRQLMLSFSQMQSQFQSQMQSQGLTLPPEPEVGPLAAHVSTKESCVDPSGNYPDMDDSEKYGFALKGLDDTPQSKSKTAARWIVVKYNRQKGSTECGYYVMH

SEQ ID NO: 165311 - protein, 139 aa, Glycine max
  Coding DNA Sequence Number=SeqID_73626
FPVVGSTCTTGLSALGGLVDNDRRREALRVRFTADSEADASEGGEGGGGGGGGGVEAVNVCLMEYKYWKDIELVDEEEAQIGVDRSSATSNKSKIYKEEARNATQKHKPKRVESVNADAEALGDDWKIQIALCILKLNH

SEQ ID NO: 165312 - protein, 74 aa, Glycine max
  Coding DNA Sequence Number=SeqID_73627
MKTQLSIKDERDPVELCSHRTQSSEGHTCGCCTTNEWVPSTRRSITVDWVCGKVDTTVSVSVTAVWVRVLADTG

SEQ ID NO: 165313 - protein, 81 aa, Glycine max
  Coding DNA Sequence Number=SeqID_73628
  Subcellular localization annotation: CTP_CleavageSite=49; ConfidenceScore=5.14e-01
MERTRKRQPMMKPMAEPTTPSLRALRLMWARKALSTSLLLSRFRASFIPCATSDDKRKKLNNTTTKTRSFFATSILASQEE

SEQ ID NO: 165314 - protein, 272 aa, Glycine max
  Coding DNA Sequence Number=SeqID_73629
MPYPLCITRTDSITYKMCSNVIQRLSSTIQTFNRWTEVYSTNVWCIFFRKLQEIFNPILILVTYARSFHPTSIHLWCTVIRASRFGLQVMEVDNTDDHPTGPPLELVACNNAAPAGSVDNTVENDFQDHQLMADLLSDNGELKTEQISMQESVFHGTCNASAASQGHSICQERSNSKDVPTGLGLQHAEKGQWSRSETKRSHIIGKKKNRRIEVVHNCFIPQQPQGHRRDNEDPVDTLDKAYASKTNSSRLAPRAFTGKGMDNFPIPPKNRK

SEQ ID NO: 165315 - protein, 115 aa, Glycine max
  Coding DNA Sequence Number=SeqID_73630
  Homolog annotation: Hit_ID=A5BEV8; Match level="QueryCoverage=87%, HitCoverage=12%, E-value=6e-10, Identity=36%"; Hit description =Putative uncharacterized protein
MPMLDQFHLCIHDSIENIVDVKAGDKYGYRAIVALLGMCEDSWSLVHNHLLKELSKWSDEYINLLGGIDRFEELKRSLLVDGLSMEFAMDKWMNIIDIEYVIASRYNVILVSLSL

SEQ ID NO: 165316 - protein, 395 aa, Glycine max
  Coding DNA Sequence Number=SeqID_73631
  Homolog annotation: Hit_ID=A7PJZ4; Match level="QueryCoverage=33%, HitCoverage=31%, E-value=1e-12, Identity=31%"; Hit description =Chromosome chr12 scaffold_18, whole genome shotgun sequence
  Subcellular localization annotation: CTP_CleavageSite=79; ConfidenceScore=5.11e-01
MHEKGVQHWPIVEVFQTKPLSSCSYNPAIPSFFLLHLSVFSITALLPSSVSIAAVQVVSTIDVPFPLLRQGYRKNPGVRTFARRQLEAIPIAENVHHVDDAVDEVHKQPQEAAIDDKVVDAQGFLGGPHDTLVLTAYVDHAAVIVWNEEERPELKLSSHGRKVQKFGRATVEIEGLVAAIGLSPLIACAFHSFETLHVDEAVLLLVELLKVSADEARAKTIQCHEAYVRLSWLATHMHVVFLDTFRDLDQSGSYAWGTAALMHMYGNLNDASKSSDKQLLEYIILLQCWIYEHFPFVVEAITVEDYHERKPCACCWTSGKALPVSTYRKRLDRLTSDGVCWMPYDIPQYSVDATTVEEAPADAPSHVEQPRHAVDACQEIAERLKRLLNLRIMTE

SEQ ID NO: 165317 - protein, 43 aa, Glycine max
  Coding DNA Sequence Number=SeqID_73632
CELSQPAVLLPKEKGKIVLVDELEDNPSCNSCYLGHEASLFSF

SEQ ID NO: 165318 - protein, 96 aa, Glycine max
  Coding DNA Sequence Number=SeqID_73633
  Subcellular localization annotation: CTP_CleavageSite=34; ConfidenceScore=5.06e-01
MKLKDKSRTCYRKALSAQFRKLPSGVGAKRPLVRAKGASSIVGKCVESPPMYIRGKRRKTQKDDGLHILKMRVQKLFKHEKVDKGVSLAPTYPQLR

SEQ ID NO: 165319 - protein, 460 aa, Glycine max
  Coding DNA Sequence Number=SeqID_73634
  Homolog annotation: Hit_ID=A5AWV0; Match level="QueryCoverage=86%, HitCoverage=27%, E-value=9e-11, Identity=20%"; Hit description =Putative uncharacterized protein
  Pfam annotation: Domain name=Transposase_23; Domain location=144-214; Score=-7.4; E_value=0.0076; Accession=PF03017.5; Description =TNP1ENSPM transposase
MDKQTLKSIGCLKFVHWKQTDAHDFSTFAIGRPEHPSRVRAVGAGVTIKQYFGSASRMSRSSSSMPPEDLEQLTQQIRDQLEESITEKVTRKMMESFSQMQSQFHSQMQSQGLALPPEPEVGPSGPRVSTKESCVAPSGNDPGTSDSDKCGLYIEENPSRLVALGRLYEGSTIVHNIPLLHGQVKVGVEEVKDAEALVPVPIVEVTLVGQTLNTFLAWSTHLVKRLSEHATVSPAKPPKSPDEEVDDPLYLMTLTIPQLFLKPLQVMWDATIFRVFNQNFPLYIKHEDLSEIAHGGQCLSISVIQLWILHLTETSVRAGNSDVYGLLEPQSIQRSGQSQFESESYIKSWIQSSKRDIYLGAYLNGGHWQMVVILPKENLVVWFCSLHNRPDNYLKGIINRQKGITECGYYVMHWMSTIILGSFRNNWETYFNEVRPLEAESFKALRIQWAQYYLKVRNQT

SEQ ID NO: 165320 - protein, 127 aa, Glycine max
  Coding DNA Sequence Number=SeqID_73635
MEAWGSLVDCPSEEEFDVCLKKYALNQIDIEYEHVSYAGIDSSHCGCVMRATHGLPCECKIVRYVVGSIPLELDVCGKVTLKSKLREIVYPNQNSMCAPPEKVKTKGAYKKPMTKHQRSTKCDPSYW

SEQ ID NO: 165321 - protein, 90 aa, Glycine max
  Coding DNA Sequence Number=SeqID_73636
MWRTSGIGYKMGQAHTQLLRHTRQYMHRGSVCLRCYQWLNLSTVLHESTAVNFRNHLGTLSDKEEYKLHIMVVAKAQGTKVLVHIRAVYI

SEQ ID NO: 165322 - protein, 151 aa, Glycine max
  Coding DNA Sequence Number=SeqID_73637
  Subcellular localization annotation: CTP_CleavageSite=44; ConfidenceScore=5.52e-01
MVEPSKKRKGVATSSVVSGTRSHGTSKAQTSQIAPFISSPTLISSEEQRTRYNSLFSSRSIIDPKFVDLAFFDDEFISMKLPFYPELVKFFYSNLEIQEDSLIFEVYGIIMVIDQSLFFDLTQLSSDGVPFEGSLDDELKFNFSVSDARRM

SEQ ID NO: 165323 - protein, 36 aa, Glycine max
  Coding DNA Sequence Number=SeqID_73638
MEVGSWKWKLKVENGSWRLEVGRGSGCHHQKGGECK

SEQ ID NO: 165324 - protein, 132 aa, Glycine max
  Coding DNA Sequence Number=SeqID_73639
MALQTGRQIDWAHLVHFRMHKALRANASLPYPHLVTLIQQHFDIPLANEPFVKVKCSFAIGATAVASFGYRKDLDGQWVRKQDLPTNALDKRIPSPPPRDPSSSLLNDALSELRYLHAFVRERFDSMDSHIT

SEQ ID NO: 165325 - protein, 890 aa, Glycine max
  Coding DNA Sequence Number=SeqID_73640
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=100%, HitCoverage=84%, E-value=0.0, Identity=67%"; Hit description =Functional candidate resistance protein KR1
  Pfam annotation: Domain name=LRR_1; Domain location=583-608; Score =7.3; E_value=14; Accession=PF00560.24; Description=Leucine Rich Repeat
  Pfam annotation: Domain name=LRR_1; Domain location=647-669; Score =8.2; E_value=9.4; Accession=PF00560.24; Description=Leucine Rich Repeat
  Pfam annotation: Domain name=LRR_1; Domain location=671-692; Score =9.5; E_value=5.3; Accession=PF00560.24; Description=Leucine Rich Repeat
  Pfam annotation: Domain name=LRR_1; Domain location=694-716; Score =5.7; E_value=27; Accession=PF00560.24; Description=Leucine Rich Repeat
  Pfam annotation: Domain name=LRR_1; Domain location=749-770; Score =1.5; E_value=1.6e+02; Accession=PF00560.24; Description=Leucine Rich Repeat
  Pfam annotation: Domain name=LRR_1; Domain location=774-795; Score =9.1; E_value=6.3; Accession=PF00560.24; Description=Leucine Rich Repeat
  Pfam annotation: Domain name=LRR_1; Domain location=797-822; Score =7.4; E_value=13; Accession=PF00560.24; Description=Leucine Rich Repeat
  Pfam annotation: Domain name=MotA_activ; Domain location=440-529; Score=-7.1; E_value=0.052; Accession=PF09114.1; Description =Transcription factor MotA, activation
  Pfam annotation: Domain name=NACHT; Domain location=237-388; Score =9.1; E_value=1.2e-05; Accession=PF05729.3; Description=NACHT domain
  Pfam annotation: Domain name=NB-ARC; Domain location=198-492; Score =144.8; E_value=2.3e-40; Accession=PF00931.13; Description=NB-ARC domain
  Pfam annotation: Domain name=TIR; Domain location=18-158; Score =136.1; E_value=9.9e-38; Accession=PF01582.11; Description=TIR domain
  Pfam module annotation: Pfam domain module=LRR_1::LRR_1::LRR_1::LRR _1::LRR_1::LRR_1::LRR_1::MotA_activ::NACHT::NB-ARC::TIR; Domain location=583-608::647-669::671-692::694-716::749-770::774-795::797 -822::440-529::237-388::198-492::18-158
MAMQSSSSSFSYRFSNDVFLSFRGEDTRHSFTGNLYKALSDRGIHTFIDDKKLPRGDQISSALEKAIEESRIFIIVLSENYASSSFCLNELGYILKFIKGKGLLVLPVFYKVDPSDVRNHAGSFGESLAHHEKKFNADKETFKCNLVKLETWKMALHQVANLSAIKTVTNVADSILAMTATKIWEEYEYKFIQRIVELVSKKINRVPLHVADYPVGLESRMQEVKALLDVGSDDVVHMLGIHGLGGVGKTTLAAAVYNSIADHFEALCFLENVRETSKKHGIQHLQSNLLSETVGEHKLIGVKQGISIIQHRLQQQKILLILDDVDKREQLQALAGRPDLFGLGSRVIITTRDKQLLACHGVERTYEVNELNEEHALELLSWKAFKLEKVDPFYKDVLNRAATYASGLPLALEVIGSNLYGRNIEQWISALDRYKRIPNKEIQEILKVSYDALEEDEQSVFLDIACCFKKYGLVEVEDILHAHHGHCMKHHIGVLVEKSLIKISCDGNVTLHDLIEDMGKEIVRQESVKEPGKRSRLWFPKDIVQVLEENKGTSQIEIICMDFPIFQEIQIEWDGYAFKKMKKLKTLNIRNGHFSKGPKHLPNTLRVLEWKRYPTQNFPYDFYPKKLAICKLPYSGLKSFPAMKLTSLEQFKLRYCHSLESFPEILGRMESIKELDLKETPVKKFPLSFGNLTRLQKLQLSLTGVNGIPLSSLGMMPDLVSIIGWRWELSPFPEDDDGAEKVSSTLSSNIQYLQFRCCNLTDDFFRIVLPWFANVKNLDLPGNSFTVIPECIKECHFLTRLNLNYCEFLREIRGIPPNLKYFSAIECRSLTSSCRSKLLNQDLHEGGSTFFYLPGANIPEWFEFQTSELPISFWFRNKLPAIAICLVMEQ

SEQ ID NO: 165326 - protein, 557 aa, Glycine max
  Coding DNA Sequence Number=SeqID_73641
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=100%, HitCoverage=90%, E-value=1e-109, Identity=75%"; Hit description =Functional candidate resistance protein KR1
  Pfam annotation: Domain name=NB-ARC; Domain location=196-490; Score= -77.4; E_value=2.5e-05; Accession=PF00931.13; Description=NB-ARC domain
  Pfam annotation: Domain name=TIR; Domain location=18-147; Score=97.6; E_value=3.8e-26; Accession=PF01582.11; Description=TIR domain
  Pfam module annotation: Pfam domain module=NB-ARC::TIR; Domain location=196-490::18-147
MAMQSSSSSFSYRFSNDLFLSFRGEDTRCSFTGNLYKALSDRGIHTFMDDKKIPRGDQITSGLEKAIEESRIFIIVLSENYASSSFCLNELDYILKFIKGKGLLVLPVFYKVDPSDVRNHTADPTGSGPVAMPNADKETFKCNLVKLETWKMALHQVANLSAIKTVTNVADSILVLTATKIWEEYEYKFIQRIVELVSKKINRAPLHVADYPVGLESRMQEVKELLDVGSDDVIHMLGIHGLGGVGKTTLAAAVYNSIVDHFEALCFLENVRETSKIMDYNISKETFFLKQLERIKPGKRSRLWLLTDIVQVLEENKGTSQIEIICMNFSSFEEVEIVWGGDALKKMKNLKTLIIRSGYFSKGVGWEGCLFRKEDDGAENVSSTTSSKVQYLDLRNCNLSDEFFPIALPCFANHLREIRGIPPNLKHFFARECLSLTSSCRSMLLNQELHEAGRTCYLLPRAKIPEWFEFQTSEFPISFWFHNKLPAIAICHVIEQVAEFSSSRGWTSRPSIITNMIINGNANLFYSMDLGSDCSVLFDPQDDKVTDNLDEALLENE

SEQ ID NO: 165327 - protein, 85 aa, Glycine max
  Coding DNA Sequence Number=SeqID_73642
MAVEWRRKRERRCHFKEKMSLEEAHHHRRSWISGLILSPRARNLSYEKPRAFSCISSPIFFESSMQCPCGIGLHQEIYMSRNGVQ

SEQ ID NO: 165328 - protein, 168 aa, Glycine max
  Coding DNA Sequence Number=SeqID_73643
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=45%, HitCoverage=6%, E-value=5e-33, Identity=88%"; Hit description =Functional candidate resistance protein KR1
MEKLETWKMALNQVANFSGYHHFKHREEYKYEFIQRIIELVSKEINRAPLHVADYPVGLESQMQEVKELLDVGSDDVVHMLGIHGLGGVGLGSYSSIDSIASWKMNGSGIEKEKRERRRHFKEKMSLEEAHHHRRPWIRAWRKKEINEGRGREEHKIFCSTRALKSEV

SEQ ID NO: 165329 - protein, 143 aa, Glycine max
  Coding DNA Sequence Number=SeqID_73644
MMGDASNFIHISLKNSEHVTYGHNSKGFDDAKVLPIDGSYYQKWGECECISCRSKLHDESRLIQRSFDDNKGDDKKLKDQEQLHDNKDDDLKNQRMSSRCSRLNQEHFKVQEEIQFQESRIKIQGSSFKESRSRCKTQDSRIK

SEQ ID NO: 165330 - protein, 135 aa, Glycine max
  Coding DNA Sequence Number=SeqID_73645
MSVHVAQVIADAIYLFAGMPPTRHPLDPDKSNRALGFPTLIMGLCQSFEVPVTPSKVIRQPITRAFIEKYCTPRQAQGDAHQATDAQPPPHQADPAGSLGMEHYLQHLVRQQAANHRGQMQIHECLYRFSLSQLG

SEQ ID NO: 165331 - protein, 53 aa, Glycine max
  Coding DNA Sequence Number=SeqID_73646
MTQLLDGILIDMPYANLMICLRKLRSAIKMKHSECERDGNLEAEENRKNSRNF

SEQ ID NO: 165332 - protein, 48 aa, Glycine max
  Coding DNA Sequence Number=SeqID_73647
MGKVWILMVFMLVRMVSNVEGARKHPSSAKRIHTLFSVECQNYFDWQT

SEQ ID NO: 165333 - protein, 387 aa, Glycine max
  Coding DNA Sequence Number=SeqID_73648
  Homolog annotation: Hit_ID=A5BP71; Match level="QueryCoverage=12%, HitCoverage=12%, E-value=6e-10, Identity=61%"; Hit description =Putative uncharacterized protein
  Pfam annotation: Domain name=zf-CCHC; Domain location=360-377; Score =18.9; E_value=0.0021; Accession=PF00098.14; Description=Zinc knuckle
MLYYNSKWKIPRQDDFLGYSFTGTNPIRFQIPLGYSIEKLKDVIKQVAPIGVSSYEILESQLVYDEFGYNNLVFQWKGFLVSGKYVALQICDDKDVETMIESFHRQDQMSVLELYIEKNVAGGSMFHYANSLTSCGNNLSNNEAEPPRNVSNLHGDEDDDDEDYLVSNSYVEESLDEDDSVDDISDIDDEVTNMIQPIRIVHPAEGVEKIQNLFWNDALHYNNINWSHPDQEDICGLEMPSSFNVGQQLYVGIDFNSKDAVKNALKQYVMKVHQSFKVVESKSNKYIVCCSNKSEECPCPFYTREILSKKTYSWNEAAIPPSDDARTLIPDPTTIRAKGRPKSTRIRNEMDWLEPSEHRQKCSRCGAEGHNRRRCPMQYDRGSCSFN

SEQ ID NO: 165334 - protein, 304 aa, Glycine max
  Coding DNA Sequence Number=SeqID_73649
  Gene Ontology: Mol. function=phosphoprotein phosphatase activity
  Homolog annotation: Hit_ID=A5APQ3; Match level="QueryCoverage=33%, HitCoverage=6%, E-value=4e-14, Identity=36%"; Hit description =Putative uncharacterized protein
MARPRWCRLQSRAHRGAGCPKRKKTHIHLFLVAVTLWLIARRFPSILHLLFFNSLKLAWCAVVPLMCFQVVEWHQPDRVLRQFGLKQPILGCPSQSLNLHGITLKGKQDENWGQLFAPMISQWNNRVDFRVNGYPRQEGLLSFNSDYMAKVAETLQYMVSPQGRNTWTVDDLVPYVEKITILSEEQERIVEPVSHGPATEHQFPAQQFHILHSSVETQGIGRRREQHDAPIPTPNVPLGMQWNVPRAIPDMGDLLGVDLRHQFSAEADQVEVGRHWGRRNPDRQARRWDRPCGTSSRHHGQHNE

SEQ ID NO: 165335 - protein, 135 aa, Glycine max
  Coding DNA Sequence Number=SeqID_73650
MTRGNPGDLQPFDPEIDRAFHRLVRHSVHLDYPEHFVPFEHPEHFVIGESEHSVVGNFEHLDFEHYNFEHFDFEHSEFEYSENMAQPPPRERTLREMAAPDFTYESLCIQYPDEDVPYVLKTRLIHLLSKFHGFA

SEQ ID NO: 165336 - protein, 122 aa, Glycine max
  Coding DNA Sequence Number=SeqID_73651
  Pfam annotation: Domain name=G-patch; Domain location=1-42; Score =6.6; E_value=0.03; Accession=PF01585.14; Description=G-patch domain
MVAHVMLGHDYEPRMGLGKNNDGMASLVDIKENRKKFGLGYKPTRTDVRRSIVERRNRGTSPQLRPQARKDPPCHISKSFVSAGLRHKEQVTMIHDKAPQERSDWVRPCLPDFQLGNGQAVE

SEQ ID NO: 165337 - protein, 178 aa, Glycine max
  Coding DNA Sequence Number=SeqID_73652
MMDIPGGGNKVADHHRGGGRVACARQGDLDTYCLVFLSESVMWTHSGYFLMNGFNNEEDAKRVLLDDSFIPERWRSFNGLEEEGFVVRNLFDEVGLIHSFLFNMVMPILGSIDYVSAFKDRFNPKVKKNHVPYGILFNQIMRDVGVDVFGMAPSGGATQHKEITFVKMEITDNFQEYA

SEQ ID NO: 165338 - protein, 103 aa, Glycine max
  Coding DNA Sequence Number=SeqID_73653
MMNIDRKPILEEVVLEFVIAHSEDKQRRAKLEELERIQIVDEDMEPKECEHYEEALLHFVIEASLKEVEDDIVEIDPKVTLVQQRPVSNKQAINVVLCEEMDA

SEQ ID NO: 165339 - protein, 55 aa, Glycine max
  Coding DNA Sequence Number=SeqID_73654
  Homolog annotation: Hit_ID=A5BEV8; Match level="QueryCoverage=83%, HitCoverage=5%, E-value=6e-07, Identity=54%"; Hit description =Putative uncharacterized protein
MTCSPWPMFVDYVCQTWVILHKEKFVKARTNKVMHLGNTTTNRVESAHRSLKRLL

SEQ ID NO: 165340 - protein, 496 aa, Glycine max
  Coding DNA Sequence Number=SeqID_73655
  Gene Ontology: Mol. function=phosphoprotein phosphatase activity
  Homolog annotation: Hit_ID=Q2HTA0; Match level="QueryCoverage=59%, HitCoverage=55%, E-value=2e-35, Identity=31%"; Hit description=IMP dehydrogenase/GMP reductase, related
  Pfam annotation: Domain name=DUF1723; Domain location=269-318; Score =68.2; E_value=2.8e-17; Accession=PF08330.1; Description=Protein of unknown function (DUF1723)
MGGLKIVAVGTTSNNVSSKRKTLDEAPLSSSESETQHDHRSTSTSYASMDPATGVKQLNSASKNQKVSKRSSPDEIKVGFNPNTLETQSNIIGSSWDCARAAEEGPRVLMNLRVDFRARGPRVPYKLRVQVKVLGGPGGEGGVFEDEDFVALVFDDERTKGEGMITLSTPVKARVVEDPQTAVEDLNEKQQQPPIEEGVTDVEGFSGGPHDSSVLRDFENHIALRVWNGKLKLSSHGRNMAKFGRSAPEIEGHVAASGLSPLITCSLDTNDRGLMSAFVERWHKETSSFHLPVGEATITLDDVAPLLHLPILGAFHSFEQIHVDDSVNMLVESFKVSAAEGRAETIQCHGSYVRLSWLATHLHVVFLEALCDLTQSGTYAWDTATLVHMYDNSNEASKSMRRQLAGYITLLQALPVSMYRMRLDRLTPDIVCWIPYGDHRSFREFEVISLFFGHLRWGPLMIIHRPERVVRKFGYIQTIPPHLTVPSISVEEMDAR

SEQ ID NO: 165341 - protein, 122 aa, Glycine max
  Coding DNA Sequence Number=SeqID_73656
MGPKQVPRGFMGSNSELKLRRDKRDKSRVESMILEDKLKACQRSKRSLTEQLSRTEENIWTIVDQYKGKLNQAVSHEQRLEDEHAKVSALQAEREARERVIESLHGEAMKWMDKFAFTLNGS

SEQ ID NO: 165342 - protein, 106 aa, Glycine max
  Coding DNA Sequence Number=SeqID_73657
MSYISIEPKLDGINCSLSAPEVEQPPTNFESTPTPNVESALAPTSTTTQSVSTPSVVIIYNYCREQASYLDRGLSKEEELGLSGHNMDGPITRARSKRFQEKLARD

SEQ ID NO: 165343 - protein, 125 aa, Glycine max
  Coding DNA Sequence Number=SeqID_73658
MTGEGISPYIWAILLKCCIGVVPSREGRLVDLLGVHYSHLVGDQGWLLCWKIPSRIGVCAGVGVADGTRLCGKRVLWGRPLWLSGKSLLDGRWIERGHVGAEVTAWVSPSFFLAPPTLNLLLLCG

SEQ ID NO: 165344 - protein, 70 aa, Glycine max
  Coding DNA Sequence Number=SeqID_73659
MAIVAWPGDRPNFQAGAGPTGTPGDEDRAQEDDDMADGFRLSTLKGFSEIKEKKEKEEEKRGRGASESQS

SEQ ID NO: 165345 - protein, 250 aa, Glycine max
  Coding DNA Sequence Number=SeqID_73660
  Gene Ontology: Mol. function=transferase activity
  Homolog annotation: Hit_ID=Q9LTY5; Match level="QueryCoverage=95%, HitCoverage=85%, E-value=4e-81, Identity=61%"; Hit description =Arabidopsis thaliana genomic DNA, chromosome 3, TAC clone:K1G2
  Pfam annotation: Domain name=DUF1325; Domain location=8-246; Score =251.5; E_value=1.8e-72; Accession=PF07039.2; Description=Protein of unknown function (DUF1325)
MSSPDIVSILDNSKELDRVRKEQEDILSEINKLHKKLQATPEVVEKPGDNSLARLKFLYTQAKELSESEASISNLLINQIDALLPTGPQGQTRRRIGKADSTCVTEGNEQKRKRVKTESDISRLTPSMRGQLEACANLKGEQVAARVTPRNADKDEWFVVKVIHFDKESKEFEVLDEEPGDDEESSGQRQYKLPMANIIPFPKSNDPSSAQDFPPGRHVLAVYPGTTALYKATVVQGHRRVIILSFSLVE

SEQ ID NO: 165346 - protein, 57 aa, Glycine max
  Coding DNA Sequence Number=SeqID_73661
MDGRLRILGQDCCRSCVVRNGEGERRMETPLQLEDESRRRSPPWEAMDKSLKVEEDE

SEQ ID NO: 165347 - protein, 120 aa, Glycine max
  Coding DNA Sequence Number=SeqID_73662
MLTSPRKVQVTMLVTACYRALSLTIVEGGVVDKSGAFAPTYPQFEMRNSDLRSSCESGVRLKESLSEDVDISGKGADDHIGADNRKVSPHDIGLSGRWIAKGVCGLPSGVSACHQTLGSR

SEQ ID NO: 165348 - protein, 117 aa, Glycine max
  Coding DNA Sequence Number=SeqID_73663
MRIAENQFMLGRFTTRRGTYLDNVDARTQQHHRQHPQKTNEARNWKVTKKTSEGDKEDAKEAFSRGRRRIRRRMRRSPMKVTKKQQWQGRRGMARKRKKQHKWRRRRNGGNEPLFLN

SEQ ID NO: 165349 - protein, 313 aa, Glycine max
  Coding DNA Sequence Number=SeqID_73664
  Gene Ontology: Mol. function=binding; Cellular component=integral to membrane; Biological process=transport
  Homolog annotation: Hit_ID=A7QFW7; Match level="QueryCoverage=30%, HitCoverage=20%, E-value=1e-27, Identity=61%"; Hit description =Chromosome undetermined scaffold_89, whole genome shotgun sequence
  Pfam annotation: Domain name=ABC_tran; Domain location=204-313; Score= -58.7; E_value=0.05; Accession=PF00005.18; Description=ABC transporter
MATMMWSLERSDWDSVETRSDDAEVELALRVLEGCFLLHPQSTALAHQHNAIQVLMNILSTRGVLEQGACLDALISLIVDSSSNQMDVLIDVPLDAYEIVCLRVGVAVHNLGQFYLGQRKLEEAPYVAVSRSGQENLLQAPLLSRSNSMEASLAKDTSSNDVKNGQGFKGHSMLAPFTAGWQTTNLHSLVIEKSEGSYVYDINGKKYLDALAGLWATSLGSKNECNFYFKVVIYRLHVFKDAEWTDLWGTLIINCSGQKQRVSMARAVYSNSHVYIFDDPLSALDAHVARQVTFMPTNFSIASVISILALNEI

SEQ ID NO: 165350 - protein, 36 aa, Glycine max
  Coding DNA Sequence Number=SeqID_73665
MQCDRVLVACCCEGAGGEAGGAAVAVVSQDGVSIEQ

SEQ ID NO: 165351 - protein, 282 aa, Glycine max
  Coding DNA Sequence Number=SeqID_73666
  Homolog annotation: Hit_ID=A5AZG1; Match level="QueryCoverage=30%, HitCoverage=27%, E-value=6e-08, Identity=36%"; Hit description =Putative uncharacterized protein
  Pfam annotation: Domain name=zf-CCHC; Domain location=132-149; Score =21.5; E_value=0.00084; Accession=PF00098.14; Description=Zinc knuckle
MKREKHVSYSSHNSCKSLSEELRDYYEGRHRSHLRPHSHRRENERKPQEVNIKLPYFHGKDNVEANFDWEIRVEQQLKRKSTSKSYGSHSYPKNDQGQGILGVRPYKPKDDKGKTIEKQPLKASMQEKTSSMKCFKCLGRGHITSQCPTKKTMIMRGQDIYSSQDEATTSPSSSKSEEAKVEESSEEIYPQEEGQPLMVKKECKETLVSIATSLRLEFIPQVKELLDDGVPMNPKRIKVIPEWPAPPSVEEKSPEFQEPRDLRSNPFQGGGNDAILPRKGIG

SEQ ID NO: 165352 - protein, 59 aa, Glycine max
  Coding DNA Sequence Number=SeqID_73667
MELTSCAEGRRKRERRRHFKEKMSLEEAHHHRRPWIRAWRKKEMNEGRGREEHEILCSK

SEQ ID NO: 165353 - protein, 108 aa, Glycine max
  Coding DNA Sequence Number=SeqID_73668
  Subcellular localization annotation: CTP_CleavageSite=4; ConfidenceScore=5.08e-01
MLIRSNLLKHRLRLLPSPWMTTLLMRSLLISLTLVTWTRPQPHSKLLKLMRPSFNQKNPRPSVDVAPTPPIVALTIVQPPPPAIEPSLSSSIPSFVEQTSPPLPQVQV

SEQ ID NO: 165354 - protein, 143 aa, Glycine max
  Coding DNA Sequence Number=SeqID_73669
MAVQLIHDHVVMECLEGVWETLEGNERCRFRGTIRLTATSLVHPEQPARILQQPVEWILPIPTPYRLVEPVQVIEVSSSEEDLEEDPEELPPEPTVDAPDFPKDDEDPLPDVDSPKDIMSVSEADSTEESGPGGTANSDDSSS

SEQ ID NO: 165355 - protein, 76 aa, Glycine max
  Coding DNA Sequence Number=SeqID_73670
  Subcellular localization annotation: CTP_CleavageSite=7; ConfidenceScore=5.14e-01
MACISSSSSMVNSSYLRANKLSLLCFTYDDPSHVRARTFVFEWSVQEVLGTSFKLSYLTPLNSGGLYVKYPSSISI

SEQ ID NO: 165356 - protein, 179 aa, Glycine max
  Coding DNA Sequence Number=SeqID_73671
  Homolog annotation: Hit_ID=A5B5G7; Match level="QueryCoverage=91%, HitCoverage=11%, E-value=6e-07, Identity=30%"; Hit description =Putative uncharacterized protein
MDSRKRKAPSTPTQVRFDRSIFTSQEAWERYTDVIVPMKLLPERNVVVYTTEFDEFLDELARRHWDEELTDFIDVSIDVAIVKEFYANLYDPEDKSPKQVRVRGHLIKFDEDTLNTFLKTLVIVEEGESLCAYSRFALRRPDPQELAAKLCIPGRGFKLNVDGYPVKILRKNMTALTQT

SEQ ID NO: 165357 - protein, 136 aa, Glycine max
  Coding DNA Sequence Number=SeqID_73672
MPRRCGIATVINLYVVPCSLFFVQPLWMYPPLELIHKRCTPSCSQSTTQVDVRSTCTTKDVLSNVLRQSSQAVKPLKLCEWGYKRILRREKGDTKEFRQLVVCSSEKGRRETQKEFRRLVLGEFFLAKGEGNEKDE

SEQ ID NO: 165358 - protein, 341 aa, Glycine max
  Coding DNA Sequence Number=SeqID_73673
MLDAWFTDENKKNNFKIIYTTKNVRIPKFLDLEWFSQQGFNFPNLLEAQGLPKLVQMKGTFYPELVKIFYTCARADMEEMVIDDTVWKVVAGLDMGGVCKFEESVDGYNKMQTYRAMLLDPARNLRNHLSVGGLTARDRMLVYLITDILTPRSNNHAQVTNNDLQIVYGLKSGIQMNWVLLIEDIMLKSCRLVDYKFLYAVLASRFIHYFNVDVSNEIVDFTKASNEITKRHIKNLGMRFVEYKWIMAGESPTTNMDQMEEEAEDEAQQELMHQWSPLESLMIQKMDAMLHLHQEHSVDVHNTLENITTRLENIETRLTLSNLNWMRMKRSYVLVLGFAVC

SEQ ID NO: 165359 - protein, 292 aa, Glycine max
  Coding DNA Sequence Number=SeqID_73674
MASKKRRASSSRPHEPYDTSRFVSEVAWERNMEIAYSHYDEFLQELERRQWHRNLTRQMENHIDLALGKMIKFDAATLNAFLETSVVLEPGERARMVYGLVMKMDMDLGSIILGQISQMAQSNASRLGFPALITALCIAKEVVSNSLTFEAPSDASALASVPALTPAPAPPLSAPTLAPAGPSMYSTDAIVLMLQSLLQAFGCIEDFMAQVAWPGVPPFFLGAGEALVAQEPYIQVPEDPEDTLVEAAADDTPEAKAEAEETLVDTPMEAAEEGGTTEAGIDEDYVVYVTAA

SEQ ID NO: 165360 - protein, 203 aa, Glycine max
  Coding DNA Sequence Number=SeqID_73675
  Homolog annotation: Hit_ID=A5C7C5; Match level="QueryCoverage=64%, HitCoverage=20%, E-value=3e-19, Identity=36%"; Hit description =Putative uncharacterized protein
  Pfam annotation: Domain name=zf-CCHC; Domain location=97-114; Score =22.3; E_value=0.00064; Accession=PF00098.14; Description=Zinc knuckle
MWDTLQVTHEGTTNVKRSRINILTHEYELFRMNQYDTIQDMQKRFTHIVNHLASLGKIFPNEDLINKRFNKFQRNKGNQRISNINPKKKGEDSSLAPKCYECDQPGHRRFNCPIFKRRMEKSDKRNFKEKKAYITWEDNNMDSSSDSENEIINMGLMVKDYESEEEIMSSNYDLSISFDELQDALNDLYKESIKLSKLVSYSK

SEQ ID NO: 165361 - protein, 50 aa, Glycine max
  Coding DNA Sequence Number=SeqID_73676
MTVRALASRPRAKCEISALSTTGVFSQAQRTIGAKLEGGAKRNIANLEPI

SEQ ID NO: 165362 - protein, 134 aa, Glycine max
  Coding DNA Sequence Number=SeqID_73677
MHYIIVRILLPRSSNLAQASEEDLILMWAFQTSRQIDWAHLVRYRMHKALRANAPLPYLHLVTLFLHHFNFPLDYEPFVKVKRSFSIGAGVVTSFGYRKDVDGQWYSQSFATFEILWVSASMPWTPGLLGLQMI

SEQ ID NO: 165363 - protein, 238 aa, Glycine max
  Coding DNA Sequence Number=SeqID_73678
  Gene Ontology: Mol. function=phosphoglycerate kinase activity; Cellular component=cytoplasm; Biological process=glycolysis
  Homolog annotation: Hit_ID=A7PT69; Match level="QueryCoverage=96%, HitCoverage=81%, E-value=8e-45, Identity=64%"; Hit description =Phosphoglycerate kinase
MNGLEKENIHLLENLSNIKEEVANCVEFARVLSSGVDIFVNYSFSNSHKVLASTVGVTRFWYACIAGFYFEERLCLLKNLAEASRKPYVAIIGGGNLYDKAASFQFLASRCQWFVFVGMMPFQVMHALGVSVPRNLVDHKAFNEALDTCPNPDFNKPEHRWRMLQRSLIEAVVDLLAPNGKTIDIDQIFLQSDVEAVAIRMKEQFLTYGKGKLDMEHGQSEWLEENPFGLDQIGKGMF

SEQ ID NO: 165364 - protein, 106 aa, Glycine max
  Coding DNA Sequence Number=SeqID_73679
MKNNGKPSRIRTRKRLRSVTEAPRLGFSSRKQFFHPKQLKCIARGIEDIWNSPLSLIYRKKGEEVATQLAQASREFYGSITEASEAPKTLFHQNVEDLDKFTPPLF

SEQ ID NO: 165365 - protein, 44 aa, Glycine max
  Coding DNA Sequence Number=SeqID_73680
MWEEAYGKLHEVGDVEDVDFYKRGNFLYHIRLKETDTRCGVFIR

SEQ ID NO: 165366 - protein, 19 aa, Glycine max
  Coding DNA Sequence Number=SeqID_73681
ECKRLSMGGFDVPSFPSIF

SEQ ID NO: 165367 - protein, 221 aa, Glycine max
  Coding DNA Sequence Number=SeqID_73682
MEKCKEASTPMTTSIYLDLEVKSVDESKYRELFKVFYTCALADLQGNLFSTINGVDMVIDVIVWKKVASLGMGGVRKFNETLDGYNKMQTYKGMLLDPARNLRNHLRVGGLTAEDKILVYLITYILIPRSSNHAQVTDDNLHIVYDLKSGIKINWVLLIEDIMLKSPHLVDYEFLYVVISSRFIDYFNLDVSNEIVDFTKASSEITERNLKKLGMRIVDHE

SEQ ID NO: 165368 - protein, 229 aa, Glycine max
  Coding DNA Sequence Number=SeqID_73683
  Pfam annotation: Domain name=zf-CCHC; Domain location=189-206; Score =20.5; E_value=0.0012; Accession=PF00098.14; Description=Zinc knuckle
MGLNKSLSKRVHLLNDLYCLRENIFHFVKNKWKSLFSQLILVHGELVPKELVEMKDDEKRKVQDDQKAKNILTSGLSSNDFFLSRNHSLVFEYEAFQMKNGETISELQTRFTHIVNHLLGLGKKFEEKKRKGVILKVKYLKEDYKESSSDDKDVENLSLMVKKFGKFLKRTKDKKISKLSKKIESNNTFTCFECEKQGHIKFECPIYPKKQLPGKKGKKDRKQKKAFIA

SEQ ID NO: 165369 - protein, 77 aa, Glycine max
  Coding DNA Sequence Number=SeqID_73684
MDKFKIIIAQSAALALTIVNFCNPSDLLGVGSILSFGARSDAILPRKGPITRPMSKRFQEDWARAVEEGPRVLMNLR

SEQ ID NO: 165370 - protein, 72 aa, Glycine max
  Coding DNA Sequence Number=SeqID_73685
MAAEWRRKRERRCHFKEKMSLEEAHHHRRPWIRAWRKKEMNEGRGREEHEIFPLIQDQFQDSPLSVLRCHEA

SEQ ID NO: 165371 - protein, 30 aa, Glycine max
  Coding DNA Sequence Number=SeqID_73686
MGGAVTMMDIPGGGIEWLESFKHLWSEGVT

SEQ ID NO: 165372 - protein, 76 aa, Glycine max
  Coding DNA Sequence Number=SeqID_73687
MQHGQTDILIARFPDPNYDVKMVNFILTPLTYRELPVDSSLRHLEVPLSFALVDPTQVSITPKRKEFNMNFNNKVK

SEQ ID NO: 165373 - protein, 268 aa, Glycine max
  Coding DNA Sequence Number=SeqID_73688
  Homolog annotation: Hit_ID=A5BZH4; Match level="QueryCoverage=31%, HitCoverage=13%, E-value=2e-08, Identity=40%"; Hit description =Putative uncharacterized protein
  Pfam annotation: Domain name=zf-CCHC; Domain location=177-194; Score =22.4; E_value=0.00062; Accession=PF00098.14; Description=Zinc knuckle
MSHHSSSVNGKEKLERKEKGKERVKINQDEREQIREEERRKILKELRKEKHASYSSHNSCKSLSEELRDYYEGRHRLHLRPHSHMREKERKPQEANINLPYFHGKDNVEANLDWEIRVEKQLKRKSTSKSYGSHSYPKKNQGQGILGVTPSKPKDDKGKTIERQPLKASMQENTRFIKCFKCLGRGHINSQCPTKKTMIMRGQDIYSSQDEATTFPSSSESEEAKEEESSEEIYPQEEGQPLMVKEECKEASVSSKRLAKKERKGILK

SEQ ID NO: 165374 - protein, 216 aa, Glycine max
  Coding DNA Sequence Number=SeqID_73689
  Homolog annotation: Hit_ID=A7Q5Q6; Match level="QueryCoverage=55%, HitCoverage=39%, E-value=2e-12, Identity=28%"; Hit description =Chromosome chr14 scaffold_54, whole genome shotgun sequence
VEKHLKVHQTTIKKGRRINTYIYDRTMLISIMKKFIIGRDLTRPEWKTSKFRTSQEGRKVQNMALDSRFWKKVTMCLKVATHLMVVLRLLDSGIFSMEEPKDTRKVMQPGEWWEMFGDGTLELRRFAIRIEYDNEWITKEGYNDEDEQPPGEGDGANVELVGDVGGSSNDPVVEAFGLDNLILVEPNDDAHLRKTLMMMEMMMKLMIFMEMILLED

SEQ ID NO: 165375 - protein, 123 aa, Glycine max
  Coding DNA Sequence Number=SeqID_73690
MPKHYTAPPTMETQTTGREKRAYLDNADELKKKTPRDDAAMLKNEKEAEEEGSCDAEEEVLGAPASALGAPSISLACFSYVTDSEDCGRSFKEFILKSLCDQHGDMANILRDTCHTPWISLTS

SEQ ID NO: 165376 - protein, 206 aa, Glycine max
  Coding DNA Sequence Number=SeqID_73691
  Homolog annotation: Hit_ID=Q2HSV3; Match level="QueryCoverage=62%, HitCoverage=19%, E-value=3e-10, Identity=32%"; Hit description=IMP dehydrogenase/GMP reductase, putative
MPMDCYEGNCEVHIYSEVQAASGSTQDSCWMPFREHRVIREFDMISCFSGQLCWGPVAVRHRLERVMRQFGYVQSIPARPVDSWVSFEEIDDGRMHYSDHLAPAGEICLVPSQCAPEYMDWFFVISHPLTITAQPSDLPQDPPATHDASFIEPYIPQVPELVATSIHARSNVDEPRHAVEACHAIPERLERHFNLRIVTPGTKTHE

SEQ ID NO: 165377 - protein, 143 aa, Glycine max
  Coding DNA Sequence Number=SeqID_73692
MHYSDHLAPAGEICLVPSQCAPEYMDWFFVISHPLTITAQPSDLPQDPPATHDASFIEPYIPQVPELVATSIHARSNVDEPRHAVEACHAIPERLERHFNLRIVTPGTKTHEVMEQCLRIVRGVTEDRIVYVRSRRRWRTDQL

SEQ ID NO: 165378 - protein, 345 aa, Glycine max
  Coding DNA Sequence Number=SeqID_73693
  Gene Ontology: Mol. function=methyltransferase activity; Cellular component=nucleus; Biological process=rRNA processing
  Homolog annotation: Hit_ID=A7PM19; Match level="QueryCoverage=31%, HitCoverage=67%, E-value=2e-24, Identity=69%"; Hit description =Chromosome chr14 scaffold_21, whole genome shotgun sequence
  Pfam annotation: Domain name=Methyltransf_11; Domain location=24-100; Score=5.6; E_value=0.025; Accession=PF08241.3; Description =Methyltransferase domain
  Pfam annotation: Domain name=Methyltransf_8; Domain location=19-155; Score=18.2; E_value=9.1e-12; Accession=PF05148.6; Description =Hypothetical methyltransferase
  Pfam module annotation: Pfam domain module=Methyltransf _11::Methyltransf_8; Domain location=24-100::19-155
MGESKKRKRHRNKRGGKEEQPMRARLSGGHFRMINEKLYTCTGEEALDYFKEEPSLFDVTPLDSSSVDVAIFCLSLMGTNYQSYLEESYRLLKPGGWLLIAEVKSRFDPNTGGADPKKFSNAISELGFSSVKQCFVVFSSFSYDWLASVKVKMSVFIVAVVGSSLATYEMDEDQWMYDTIMSEEVDMNDQNEQECDVFDSRDDVLHWARSVAHENRFVTVIIRSDTNTGVTSIGVGRKNLLEEILGLGNVGVPSSFMANQWLEDKGERLNNVIWALERFRDIFLRRDALPGLIVTDRDLALMNYVMDTWGSLVDCPSEQQFDECLKKFEMACSPWPMFVDYVNET

SEQ ID NO: 165379 - protein, 339 aa, Glycine max
  Coding DNA Sequence Number=SeqID_73694
MEAMKEQMTTMMEVMMDMTKIMEVNIVAAATASTVTERDPTHPLIFNQESHLVTDVEGQGGVMRVAAYGPQYTHSHNRYTFPPYGLPPNYTPPMAVPVPVKNVTNPIPVCTKNHPTQPNQNQAYNFNAREEAREAPVDHTVIGFGPHPGYTTEGHVFSGVLVLNAPGASQYRPLSQALHFVRGEGPPSVFEKKKIEHMEERLRAIKGGGELWFCRHVRAMFRTRCDYSPEVQGEKIEVGLKKGKFDYAASTNFGSRRPEMNGVKKKEGKDHVVDTFPTWPNFPQTPYNPMYQYPPHQYHYSANISPPPPAQYPFNQEHPINHRDHPKITHKIHPLYNLD

SEQ ID NO: 165380 - protein, 163 aa, Glycine max
  Coding DNA Sequence Number=SeqID_73695
MDDEIVKPQPQQWHPAIKTFKKRSWEDGYIAHAPKKLTCKRARKTTAREGSSIALLVEIEFDGHHFRTEIARRCWTQLAEPMPKYDPEIVMEFYVNAWPTEEGVVDKRSKVQGQWIPYDIDAINQFLGNPLILEEGEQREYIARRSQTTSFDEDPMDMILYGA

SEQ ID NO: 165381 - protein, 47 aa, Glycine max
  Coding DNA Sequence Number=SeqID_73696
  Homolog annotation: Hit_ID=A7Q772; Match level="QueryCoverage=61%, HitCoverage=13%, E-value=6e-07, Identity=82%"; Hit description =Chromosome chr18 scaffold_59, whole genome shotgun sequence
EKLYQWILRQQEGGSRVATVDILNYIQRETKSGWGIIAVEVSEKKAS

SEQ ID NO: 165382 - protein, 119 aa, Glycine max
  Coding DNA Sequence Number=SeqID_73697
MGKFTNDGGGLFLGVTRHCHWWQRWREAGIVTGSGDIGGERLLHDTQRMKLQMLSLFMMRLNIRSEIGFKASCRCSQVAHALLVHDETKHKSTCNDIEYLQNFILKESKKLKRGRKTFV

SEQ ID NO: 165383 - protein, 108 aa, Glycine max
  Coding DNA Sequence Number=SeqID_73698
MEVMMSMEKIMDVNVAVIAATCTIAEVEPTPPFGLNQINHPTSDRVGQGSKELVGTSGPHYVQIQNKHAFSPYGLPPNYAPPNGKSETTLVSLPSSRDYLSLTSIIQR

SEQ ID NO: 165384 - protein, 236 aa, Glycine max
  Coding DNA Sequence Number=SeqID_73699
DSTISPKKVVEPVDGVKDVVVHDLLRELIKCLIDIYNNPVQFVWDGSKFGIPNVESTLFLTYVDVNEITTGDKWLNIAILQLWTIAFKALKTTHDDKLPQSTPQWIEVKSHVQREGYECGYYVMHWMWNIIGAGLKTDWSLWFGDATPHDTKTMTTLRQKWAKYFFKVRNSQSGPNSWQLFLFQIALDGKNSSSLNLKETELRLNLPGCESPERKSGSALCLQSNFCKVFDPSLIV

SEQ ID NO: 165385 - protein, 190 aa, Glycine max
  Coding DNA Sequence Number=SeqID_73700
  Gene Ontology: Mol. function=nucleotidyltransferase activity; Cellular component=cytoplasm; Biological process=biosynthetic process
  Homolog annotation: Hit_ID=A6MUT4; Match level="QueryCoverage=87%, HitCoverage=70%, E-value=3e-72, Identity=68%"; Hit description=GDP -mannose pyrophosphorylase
  Pfam annotation: Domain name=NTP_transferase; Domain location=8-185; Score=-36.9; E_value=3.6e-05; Accession=PF00483.14; Description =Nucleotidyl transferase
MENSEKVVAVIMVGGPTKGTRFRPLSFNIPKPLFPLAGQPMVHHPISACKKIPNLAQIFLLGFYEEREFALYVSSISNELKLPVSFPLPSMLDAHKRYGGMGTMLVIKVSAESANQFGELVSDPTTNELLHYTEKPETFVSDLINCGVYVFTPDIFTAIHDVYINQEGRGWSLSITFEKAQITKGLCYMN

SEQ ID NO: 165386 - protein, 142 aa, Glycine max
  Coding DNA Sequence Number=SeqID_73701
NVHSRNLLPERNVNLYITEYDEFRRELERRRWHKALTRQPDDRIDMAWVKEFYANLYDPEEKSPWQVRVRGRLIKFDGEMLNAFLETPVVLEPGEQYTTYSRSTLEAPEEGPHHSGVDLECPLLLQPRPHLSHVQSEHGQGE

SEQ ID NO: 165387 - protein, 657 aa, Glycine max
  Coding DNA Sequence Number=SeqID_73702
  Gene Ontology: Mol. function=sugar:hydrogen symporter activity; Cellular component=integral to membrane; Biological process =carbohydrate transport
  Homolog annotation: Hit_ID=Q539E7; Match level="QueryCoverage=99%, HitCoverage=99%, E-value=0.0, Identity=58%"; Hit description=Plastid hexose transporter
  Pfam annotation: Domain name=MFS_1; Domain location=141-604; Score =53.8; E_value=5.8e-13; Accession=PF07690.7; Description=Major Facilitator Superfamily
  Pfam annotation: Domain name=Sugar_tr; Domain location=137-653; Score= 310.8; E_value=2.6e-90; Accession=PF00083.15; Description=Sugar (and other) transporter
  Pfam module annotation: Pfam domain module=MFS_1::Sugar_tr; Domain location=141-604::137-653
  Subcellular localization annotation: CTP_CleavageSite=38; ConfidenceScore=5.09e-01
MQASTFGVEEATFGVQSRRGLVGFREFRNGSVLRPRRVCMANNNIDLCGLRLGSVTMETELTNARVGFGGIFGPSVKPRSVRVMASGLYAVAGGFDLFGLLAIVNFSGLHLPMMYGKIEDVVPATPQGKSSGDVLPYVGVACLGAILFGYHLGVVNGALNTLLRILQSLKILFYKATKTVDIRRCNFLFNTLIKGKFSVCMSVHVNGWIVSTLLAGATVGSFTGGSLADQFGRTRTFQLASIPLAIGAFLGATAQSVQPMIIGRLLAGIGIGVTSAIVPLYISEISPTEIRGALGSVNQLFICIGILLALVAGLPLAGNPIWWRSMFGIAVVPSVLLALGMAISPESPRWLVQQGKISEAEKAIKTLYGQERVAAVMHDLTTASQGSSEPEAGWFDLFSSRYWKVVSVGAALFLFQQLAGINAVVYYSTSVFRSAGIASDVAASALVGASNVFGTCIASSLMDKQGRKSLLITSFSGMFLLISVLVIDCNLQISFLLKPVNDKNVAMQYIFEKSLNKGLNFIPFLKEGKAASMLLLSLSFTWKVLAPYSGTLAVLGTVLYVLSFSLGAGPVPALLLPEIFASRIRAKAVSLSLGTHWISNFVIGLYFLSVVNKFGISSVYLGFSAVCVLAVLYIAGNVVETKGRSLEEIERALSASA

SEQ ID NO: 165388 - protein, 56 aa, Glycine max
  Coding DNA Sequence Number=SeqID_73703
MERCHISNSQVPIVNITSYHCLDMNDDVLEDSGAANLSPCQQGRVNIRISKACYAT

SEQ ID NO: 165389 - protein, 121 aa, Glycine max
  Coding DNA Sequence Number=SeqID_73704
MHKALRLNAPLPYPHLVTLILQQFSIPLPNEPFVKVKCSFAIGATAVESFGYRKDLDGQWVRKQDLPTNARNECIPSPPPRDPSSSLLNDVLSELQDLHAFVGERLPCSLAFQTSWLWLFV

SEQ ID NO: 165390 - protein, 34 aa, Glycine max
  Coding DNA Sequence Number=SeqID_73705
MPEVSHQEGEMPNLRYIGKKSVHPSSGGNVMDKS

SEQ ID NO: 165391 - protein, 81 aa, Glycine max
  Coding DNA Sequence Number=SeqID_73706
  Subcellular localization annotation: CTP_CleavageSite=62; ConfidenceScore=5.30e-01
MPHAYTKIVMCCHVPPLRSLHDAVEVGLAFALTLTRTKRQWSPSSSTSPFSNKMSSSETPTSQETFTQNSRRNIRGKTDIA

SEQ ID NO: 165392 - protein, 91 aa, Glycine max
  Coding DNA Sequence Number=SeqID_73707
MEDSPTFLTNEEVGALRKNLANMTIQPLSNDIGPLILDDDDVAEAQDTHMENMNLNESNVDYEVTMGDSSEFYNEEGVPKNDNDLVYVPWT

SEQ ID NO: 165393 - protein, 122 aa, Glycine max
  Coding DNA Sequence Number=SeqID_73708
STLEDPLEKMVLGGNVESLATEKEGLVEAGGVRVAGYQGEGDQHDLNLGLFDPFKDVKDGVLHDEEEGACAHMSLVMGGMYWSHQVIMLEEGRTLGFKSLEAEVELQVGSFMGLLCHPTLVA

SEQ ID NO: 165394 - protein, 122 aa, Glycine max
  Coding DNA Sequence Number=SeqID_73709
MTSQKNQVSATDDMSLSARRKFSAICRSAVALSDFFGIVTLLYEGEECGVGGGVRRRGADLDDARLGVAGEVHGVEVVNGAASGLKEHGDELAGGGEGAEVGLREELEEDVRGRPRKGSHRW

SEQ ID NO: 165395 - protein, 383 aa, Glycine max
  Coding DNA Sequence Number=SeqID_73710
  Gene Ontology: Mol. function=hydrolase activity, acting on ester bonds; Cellular component=extracellular region; Biological process =lipid metabolic process
  Homolog annotation: Hit_ID=A7PZ35; Match level="QueryCoverage=88%, HitCoverage=93%, E-value=1e-151, Identity=75%"; Hit description =Chromosome chr4 scaffold_39, whole genome shotgun sequence
  Pfam annotation: Domain name=COX5C; Domain location=2-66; Score=24.9; E_value=2.2e-05; Accession=PF05799.3; Description=Cytochrome c oxidase subunit Vc (COX5C)
  Pfam annotation: Domain name=Lipase_GDSL; Domain location=47-360; Score=182.5; E_value=1.1e-51; Accession=PF00657.13; Description=GDSL- like LipaseAcylhydrolase
  Pfam module annotation: Pfam domain module=COX5C::Lipase_GDSL; Domain location=2-66::47-360
MAGPRVAHATLKGLSVVKDIIIGITLGLAAGVVGVIVSGAEARPRAFFVFGDSLVDSGNNNYLATTARADAPPYGIDYPPSHRPTGRFSNGYNIPDLISQRLGAESTLPYLSPELSGNKLLVGANFASAGIGILNDTGIQFVNVIRMYRQLHYFKEYQNRVRALIGASQAKSLVNKALVLITVGGNDFVNNYFLVPNSARSQQYPLPAYVKYLISEYQKLLKKLYDLGARRVLVTGTGPLGCVPSELAQRGRNGQCAPELQQAATLFNPQLEKMLLRLNRKIGKDIFIAANTGKTHNDFVSNPQQFGFFTSQVACCGQGPYNGLGLCTALSNLCTNREQYAFWDAFHPSEKANRLIVEEIMSGSKAYMNPMNLSTILALDANT

SEQ ID NO: 165396 - protein, 81 aa, Glycine max
  Coding DNA Sequence Number=SeqID_73711
MAVMDLSFGDPLYRKSSWRRAMQEDMQSLHENNTYELVEWRIVMQEEMESLHENNTYELVEWRRVMQEEKQSLHDDQSTLT

SEQ ID NO: 165397 - protein, 106 aa, Glycine max
  Coding DNA Sequence Number=SeqID_73712
MWTVEVTQSMLAAPYPLKLPTSVAPHVDACGQHMTILRRFGSPLQWNVIVLDTGIGDKYIVQPWYQFLANNDLSHGDEVAFYYRRYDKIWEIVIRRQKDWEDSATD

SEQ ID NO: 165398 - protein, 258 aa, Glycine max
  Coding DNA Sequence Number=SeqID_73713
  Gene Ontology: Mol. function=helicase activity; Biological process =viral genome replication
  Homolog annotation: Hit_ID=Q2R1R7; Match level="QueryCoverage=73%, HitCoverage=13%, E-value=1e-41, Identity=44%"; Hit description=AT hook motif-containing protein, putative
MNRKHIMHQKQHAQAQPPLHATVDPTSQYTKDHKDLNSESTQGFDSISFVGDEHCQSPANNPTINTEADSKNYQQNIHTYNMMFAFTSAGIKLDKLINHSRGSPTIKIQGQPCHQIGSLLPMPGKEPKFAQLYIFDTDNEVQNRINAMSQHVEIKAHIVSNLSQMLDEHNAHAKSFRMARDRLADSEVHNFRLKLIANRQKDGRTYNVPTVSEVDALIAGLQYPPLFPYGEDGYRADILHRATSGGKKGKRNRLTMRE

SEQ ID NO: 165399 - protein, 170 aa, Glycine max
  Coding DNA Sequence Number=SeqID_73714
  Gene Ontology: Mol. function=L-ascorbate peroxidase activity; Cellular component=cytoplasm; Biological process=hydrogen peroxide catabolic process
  Homolog annotation: Hit_ID=Q76LA8; Match level="QueryCoverage=62%, HitCoverage=42%, E-value=3e-24, Identity=60%"; Hit description =Cytosolic ascorbate peroxidase 1
MDLWKAVEKAKKLRGFIAEKRSLLFTIEFMDYRFDAFWCVSCADGTLLEPLTRAQTLVDPSDIAIRLLEPLKAEFPILSYADFYPLAGVVAVEVTGGPEVPFHPGRESFTGLSTRYYVPRHYYSIAFCCCRYYIPRHYYVLLHWSEIVPLEEVFQTLRCDSNGLTIASAE

SEQ ID NO: 165400 - protein, 1093 aa, Glycine max
  Coding DNA Sequence Number=SeqID_73715
  Subcellular localization annotation: CTP_CleavageSite=71; ConfidenceScore=5.37e-01
MASPSVRLSHSVRSPSSLLPLLALNGSDDFPFLRAVSVSLNNVSKKLFDIDSNVFRRFKDHFFKVLTTDIVANGLSLMFNQDREPRFPFFWQFDHTRLTSFDEDLLTLVERVNKAILEQLSALLDARTIFSLPSMDDPFVALDGWTCWWGCAPYAAIPPIGEGGQPVVGVTEERDDGTAVSCRKKSRAPFSLRALRQASRLTLDSGILSSLQDLPPAPSIFMASTPAIVVVVAPTVEVSALAASAGSVMSPSSTVAPPLLSAGVVTMSALVMPPPPSSASPVPPSAVLVSVSTSTSSHPRVSLDHIYTSSGLPPMKFGNLGREWAKALRGAKVNACTVWRTEHPKVVNAIVTFNEAVKSNQQLSSKVGSALAKVENTAAKKDELAKVVVDLEVRLKESESRLEESMLWVSKEREVNKELEEELLMYKKEAMEQHEKDFHKAISVLLDEEDIVAEEEAGEEQEVEEQGNDANFPRGELTKGMPWVFIGVRTNGAPWAFVPRADLGFLYQGRTLGSPRADLGIKELWTRDAFILGFGEAHQRWTLDSPRENLGFDEPLEKKDSPRANLRADNGFDEPMEKSHTHQGQTFDLTSLWRSETHQGWIFDLRAFGEARLTKGGPWVWQVFGEGDSPRAVDLRFEEPLEKRDSPRVDFGFDEPLEKRDSARVDLGFDEPLEKQDSPKADLGFDESVELGPGMRLWVAFNVLGIALPSNSCNRYAPLSRLDTTLNGPSQLHPSFPAQGSFLALPRTRHTSLLINGSPTSMGIMAFVPYTLCLTIGLRMFDRGNKAIVAYKVFPGELLHLIGCNFSYWSCLDPLGPMRAHVVKIVRRAEMHHFGCKGASPGRETIDTFMKLSNGMICLLAIQAFHYNFLSVYGGSLEGLLDDSLEVPGLFAIGQLGEQVCFGVALPGYVVHLKAFKVVNKSYSNVVVLEYHCFLGLVSVGNLSLDKLQALKLSLRACSRMTLSGTSRIILASLPFMLDAPSTYRLNRVELTASSTIERYRRRGTPGLGPLRTGVVAMVILKACSQLLDFLDVGRTVHLQYDCAFVRVGFYSPMKAGVAAHDVQRYVKESDRAAQCTRQDKMSNEELKLQDPR

SEQ ID NO: 165401 - protein, 531 aa, Glycine max
  Coding DNA Sequence Number=SeqID_73716
MASKVLAKLCTLLGFGSKLQLDEFFNRLRASIRSVIYCHPLWGEAWQAPWWEDKVGNFILRCGVKTMIPSSLSVFLPMKAKKEVDIASSLYYFSCEANEWIGVSLDDVSGATLVDEDLGHHEVSHYDGDNDKVVLVDRVDTFEVSIIDVDVPDGMEVTLMGLAGLPFVRESPCNGVDYTSDLLGGLVFPFLRRLSLTSLMVVSLSSLIFCFVSSFSAIAVFMVILLVSFGSHSYCMTYLVLFNPGLGRSGKGSFIGTSALKASSRIVVRLIVRVGLVTSFSLVVLLSRLSDLVLEPGHLFHLDVAFGSFVQLVHATRAPDVIQCDWVVAYYALKRSTRVSKLSMDLGGSPPYQVNVAPLRDVGKTRHRIASSLGVNFHDAIDKGVSTSRPPCRTVYVRETWIILSVNYVLGLFELFLIASLHLRNVVLELLESINIHHGYERRIGAFERDLESKAKLSANHGVGTKCTYRNPKLSHVKVDVNKESMSEYEKSEMEPGTYRAERKLRALVYRGCYGDIIALANNYRLVDNSR

SEQ ID NO: 165402 - protein, 127 aa, Glycine max
  Coding DNA Sequence Number=SeqID_73717
  Gene Ontology: Mol. function=DNA binding
  Homolog annotation: Hit_ID=Q9XG69; Match level="QueryCoverage=46%, HitCoverage=30%, E-value=5e-10, Identity=50%"; Hit description =Putative uncharacterized protein
  Pfam annotation: Domain name=zf-C2HC_plant; Domain location=64-118; Score=74.7; E_value=3e-19; Accession=PF07567.3; Description=Protein of unknown function, DUF1544
MPMIREDILIVIKLPTAPTPCLIKECPIGCMSGSGNESNSSNTNIGTSIGAASRSKNAPRNRIDIGWKHGTNVLGNGKKVKCNYCSKINNGGIFRFKHHLAGTRWDSEPCASLPEEVKMLMMKVIAE

SEQ ID NO: 165403 - protein, 150 aa, Glycine max
  Coding DNA Sequence Number=SeqID_73718
MIMRGQDIYSNQDEATTSPSSSESEEAKGEGSSKEIYPKNKNNLEWLRRSVKRNNQHENKGKGMFYSITFLNFLTSDQGVPTDPKRIKVIPEWPTPPIVEERIPEFQEPLDLRSNPFQEEGMMQSYPQGHWIEDSKKIGPKRQEKAQGFS

SEQ ID NO: 165404 - protein, 274 aa, Glycine max
  Coding DNA Sequence Number=SeqID_73719
  Homolog annotation: Hit_ID=A7PLZ7; Match level="QueryCoverage=46%, HitCoverage=28%, E-value=1e-35, Identity=60%"; Hit description =Chromosome chr14 scaffold_21, whole genome shotgun sequence
MTRAMLCRMDLYGVGGLTTVGCTNLAATILGLDVGVGGQQKGDEVASVTQIDNANAWNSTLCMQSGGVGMGEGWPDGSRFGLGLGTPSPGLEFSQSTNKPKPEQEKQSKKQKSNKGFRRKQEKQSVSEELFCSEVIHSTAMKFLQSLIAQSRYAARAGSLNRVSGLRFFSVSTEEYSKRNYANNVAEYNTVLGSLTAQRRNFLLRDVYDDMMLDGVKPTRDTFHSLAVGTMKAARMQDAFYFADQMKIMGLLPDLACITFCCGDVWNDASDKDH

SEQ ID NO: 165405 - protein, 351 aa, Glycine max
  Coding DNA Sequence Number=SeqID_73720
  Gene Ontology: Mol. function=nucleotide binding; Cellular component =ER-Golgi intermediate compartment membrane; Biological process=small GTPase mediated signal transduction
  Homolog annotation: Hit_ID=Q38922; Match level="QueryCoverage=51%, HitCoverage=85%, E-value=4e-94, Identity=93%"; Hit description=ATGB2
  Pfam annotation: Domain name=Arf; Domain location=7-167; Score=-74.2; E_value=0.00069; Accession=PF00025.12; Description=ADP-ribosylation factor family
  Pfam annotation: Domain name=GTP_EFTU; Domain location=8-166; Score= -82.3; E_value=0.049; Accession=PF00009.18; Description=Elongation factor Tu GTP binding domain
  Pfam annotation: Domain name=MMR_HSR1; Domain location=7-122; Score =9.7; E_value=0.00014; Accession=PF01926.14; Description=GTPase of unknown function
  Pfam annotation: Domain name=Miro; Domain location=8-122; Score=64.9; E_value=2.7e-16; Accession=PF08477.4; Description=Miro-like protein
  Pfam annotation: Domain name=Ras; Domain location=8-169; Score=329.1; E_value=8.1e-96; Accession=PF00071.13; Description=Ras family
  Pfam module annotation: Pfam domain module=Arf::GTP_EFTU::MMR _HSR1::Miro::Ras; Domain location=7-167::8-166::7-122::8-122::8-169
MSYDYLFKYIIIGDTGVGKSCLLLQFTDKRFQPVHDLTIGVEFGARMVTIDSRPIKLQIWDTAGQESFRSITRSYYRGAAGALLVYDITRRDTFNHLASWLEDARQHANPNMTIMLIGNKCDLSHRRAVSKEEGEQFAKENGLLFLEASARTAQNVEEAFIRTAGKILQNIQEGVFDVSNELAMDVPKVNQVPEMELFQPELVNWRVSIVARESPESLEYLGKLCILSVHQQQYVLSALNPNQFLSTEQYFGVRRVPEEMKLSWIVAFAFEKKALKWWVSCSTQEIPTRSFVFKIQKLRSKNVDAEMKFKRKSKNQWSGRHKVMTKGSKKTNKDEEWERRESAAQGRETRK

SEQ ID NO: 165406 - protein, 247 aa, Glycine max
  Coding DNA Sequence Number=SeqID_73721
MTLRRGVAFEDRPNNLARGAMWPKREWKLIWARVGFGSSGGSGGCSRLKHKPLSRREAISADERQLRRIRLRDSNFKGVGSNDGLGVEHLGVSFLVSAPTPPPEPSLRVGELGLPGVSVGTISRRSNTREREMASQQYDSQGPQTQRGANRDCRAWIKSDQDVNWSLLVLHWNHAKRQAFMLQCRMIFEELIDLKDPTKREKSQKREWRMKMKGDGELRDSVLQKIGVGFGSRGLCHGYLSMKAPKR

SEQ ID NO: 165407 - protein, 66 aa, Glycine max
  Coding DNA Sequence Number=SeqID_73722
  Homolog annotation: Hit_ID=A5AMN2; Match level="QueryCoverage=68%, HitCoverage=3%, E-value=2e-07, Identity=57%"; Hit description =Putative uncharacterized protein
MHGIIHEVTLSYAPQSNGIVERKNHTLLDMVIAMLMILKLMVRPWGLLRPWGLLRHLFGKKLIMMK

SEQ ID NO: 165408 - protein, 380 aa, Glycine max
  Coding DNA Sequence Number=SeqID_73723
MAVFTTTTSIIVIVAMTMIIIINMISIDGGGYNESDRDHGGSNDDGHDDNYGDSSCYEKREGGAESRGGTAGGGTTDGGKNGKASRVARALALCGLGKTMEGSIGFRDSNVRVLEMTPLASQRDAIKPINQSGTVHVQIRGGGGRLKYNKTLDVCARVVGVHKLRESGQALPLQNDDWCLHEGIQCHSVEIDELLADFALLRGAILKIINLLRKFAVLGGGKLHVPLRKNVPEVNVVRVMVPGDLYDKASGGEDKLKTKPGKHEHYMKNMKPRFAKCDMLAYRVHHNKPRNSYKSPERMNLLSAQFRVSEFIKNFQKCKLYPKHMNLLSHRCRLSELGKNFQKQMQHRHIDRCGTKVDAQEGRRRLEAALEWKMGRLRTG

SEQ ID NO: 165409 - protein, 115 aa, Glycine max
  Coding DNA Sequence Number=SeqID_73724
  Gene Ontology: Mol. function=metal ion binding; Biological process =metabolic process
  Homolog annotation: Hit_ID=A7PSR4; Match level="QueryCoverage=72%, HitCoverage=11%, E-value=5e-26, Identity=68%"; Hit description =Chromosome chr8 scaffold_29, whole genome shotgun sequence
MASYLVVSAGLLRIFGRNVAELPLVATSRAHQGKGYFEVLFSCIERLLSSLNVEKLVLPAARDAESIWTMKLGFRKMSEDQILATIGLIPYCKTGKLVAVNYVQWHKFCEEKRPT

SEQ ID NO: 165410 - protein, 152 aa, Glycine max
  Coding DNA Sequence Number=SeqID_73725
MKRSEFEFPATVFPSAVSDDVVLFGKLITRRTGEPGPAPCEKSENRVLLRSESSSGGTNGFVAWLRSPSGRESRYRKSESCRSRYKMVLKFPLQMELSDIKMRQERREPMPQPPPPPRVTAKDDGESCWELVRPLRRRGALKNALFGCLPIV

SEQ ID NO: 165411 - protein, 290 aa, Glycine max
  Coding DNA Sequence Number=SeqID_73726
MTMIMISRIDDVDGDDTQVDHQRGAGVAYARRGYLDTCCLIFLSESVAWTRLGYFLMNDTTLHLRVEGLFGDSIGHPIDEFYDLTRGQNNAFQPAPEPHSRRRIETLSKREHREIITRGNDSKLNKGCPYSLFDRDSIIEYIEAFLANLDKIKNPSGAGETSTMTRNSLKRNKNVKDEHAFAVVLSTMSERKVLGIKFTLDSGAIGLLLKESCDINVVGAHKGGNIDNIGEERSNLTPNAWAFEIAFELGSFSDVYEDFNNEYKESYFILKTLDEQGIVDDCHEADVERE

SEQ ID NO: 165412 - protein, 326 aa, Glycine max
  Coding DNA Sequence Number=SeqID_73727
  Homolog annotation: Hit_ID=Q2HS67; Match level="QueryCoverage=79%, HitCoverage=86%, E-value=3e-31, Identity=32%"; Hit description =Cyclin-like F-box; F-box protein interaction domain
  Pfam annotation: Domain name=FBA_1; Domain location=141-282; Score= -47.0; E_value=0.039; Accession=PF07734.4; Description=F-box associated
MAMAQLPQDLIEEILSWLPVKSLMRFRDLPGIAPCSICSLLENPSSTVDNGCHQLDNRYLFIGSCNGLVCLINLVARGEFSEYRCGFGYDDRSDTYKVVLVLSNIKSQNREVRVHRLGDTHWRKVLTCPAFPILGEKCGQPVSGTVNWFAIRKLGFDYEWETVTVDQLVIFSYDLNKETFKYLLMPNGLSEVPRGPELGVLKGCLCLSHVHRRTHFVVWLMREFGVENSWTQLLNVTLELLQAPLPCVILKLLCISENGNIKGDIGAVESLAFCSIHALLENPSSTVDALSAITPVEAKLHDESRLIQRCFDDNKDDHKGDDKNLK

SEQ ID NO: 165413 - protein, 124 aa, Glycine max
  Coding DNA Sequence Number=SeqID_73728
MQGLRGSRQIKGQLRVSNTGKDLNLSALYQKAMSVMKNKYQVLKKLMRRCTRSNLRKRIMYLPGLDSSIEEKELALVGSPEGSTYISKFFFLVKILLLKLLALSPKSLIDSTTTKGVRDVQKNA

SEQ ID NO: 165414 - protein, 25 aa, Glycine max
  Coding DNA Sequence Number=SeqID_73729
MELFVFAKNGKGKTEESESEGKNIR

SEQ ID NO: 165415 - protein, 74 aa, Glycine max
  Coding DNA Sequence Number=SeqID_73730
  Gene Ontology: Mol. function=nucleotide binding; Biological process =response to stress
  Homolog annotation: Hit_ID=A2Q406; Match level="QueryCoverage=93%, HitCoverage=18%, E-value=2e-18, Identity=44%"; Hit description=Heat shock protein Hsp70
MLWPFKVVAGINDKPMIIVKYKGQEKHLCVEEVSSMQKPTAAAIAYGLVKRTNCVGEQNIFIFDLGGGTSHDQG

SEQ ID NO: 165416 - protein, 107 aa, Glycine max
  Coding DNA Sequence Number=SeqID_73731
  Subcellular localization annotation: CTP_CleavageSite=52; ConfidenceScore=5.63e-01
MATPTSSPSLPPPPTGVASQFPSILKRTRNATRLRSLATRLVGVERPLVHVDPATGKADDPHNKKLRTYLGIVTRYKVNVTYKNWKQVPAAQKDLIWEDIQDVRKKA

SEQ ID NO: 165417 - protein, 528 aa, Glycine max
  Coding DNA Sequence Number=SeqID_73732
  Gene Ontology: Mol. function=oxidoreductase activity, acting on the CH-OH group of donors, NAD or NADP as acceptor; Cellular component =glycerol-3-phosphate dehydrogenase complex; Biological process =glycerol-3-phosphate catabolic process
  Homolog annotation: Hit_ID=P52425; Match level="QueryCoverage=67%, HitCoverage=92%, E-value=1e-172, Identity=85%"; Hit description =Glycerol-3-phosphate dehydrogenase [NAD+]
  Pfam annotation: Domain name=NAD_Gly3P_dh_C; Domain location=222-382; Score=262.9; E_value=6.7e-76; Accession=PF07479.5; Description=NAD -dependent glycerol-3-phosphate deh
  Pfam annotation: Domain name=NAD_Gly3P_dh_N; Domain location=32-205; Score=241.8; E_value=1.5e-69; Accession=PF01210.14; Description=NAD -dependent glycerol-3-phosphate de
  Pfam module annotation: Pfam domain module=NAD_Gly3P_dh_C::NAD_Gly3P _dh_N; Domain location=222-382::32-205
MAPALEEGGERETSVAQNNSLNSVVNDATHRSKVTVIGSGNWGSVAAKLIASNTLRLSSFHDEVRMWVYEETLLSGEKLTDVINRTNENVKYLPGIKLGKNVVADPDLESAVKDSNMLVFVTPHQFMEGICKRLVGKIREDAEAISLVKGMEVKMEGPCMISSLISQQLGINCSVLMGANIANEIAVEKFSEATVGYRLNREVAERWVQLFYTHYFIVTAVQDVEGVELCGTLKNVVAIAAGFVDGLEMGNNTKAAIMRLGLREMKAFSKLLFPSVKDSTFFESCGVADLITTCLGGRNRKVAEAYARNGGKRSFDELEAEMLQGQKLQALIKAENRKGVSTASEVYEVLSHRGWLELFPLFSTVHEISTGLLPPSAIVEYSEKLPRVCHKEISSSTPKITSYTFLERCLYLLDWPIRNVKGVTNPACNWPIGKPKTGAASNCLITIEEVCEALGIVLGFVSFCYFLSLNLDGLLIHAPPKLLLTPLFWLLEWSIQNVNLHYKIHPFFGFRMTNLEGSNLEVQEVTTI

SEQ ID NO: 165418 - protein, 121 aa, Glycine max
  Coding DNA Sequence Number=SeqID_73733
MHKALRVNAPLPYPHLVTLILQHFSIPLANEPFVKVKCSFAIGATAVESFGYRKDLDGQWVRKQDLPTNAPNECIPSPPPRDPSSSLLNDVLSELWDLHAFVGERLPCSLAFQTSWLWLFV

SEQ ID NO: 165419 - protein, 412 aa, Glycine max
  Coding DNA Sequence Number=SeqID_73734
  Homolog annotation: Hit_ID=Q2HS67; Match level="QueryCoverage=67%, HitCoverage=91%, E-value=8e-29, Identity=30%"; Hit description =Cyclin-like F-box; F-box protein interaction domain
MAMAQLPQDLIEEILSWLPVKSLMRFRDLPGIAPCSICSLPENPSSTVDNGCHQLDNRYLFIGSCNGLVCLINLVARGEFSEYWCGFGYDDRSDTYKVVLVLSNIKSQNREVRVHRLGDTHWRKVLTCPAFPISGEKCGQPVSGIVNWFAIRKLGFDYEWETVTVDQLVIFSYDLNKEIFKYLLMPNGLSQVPRGPELGVLKGCLCLSHVHRRTHFVVWLMREFGVENSWTQLLNVTLELLQAPLPCVILKLLCISENDMNDDVLEDSGAANLSPCQHGNIKDDIGAVESLAFCSIHALLENPSSTVDALSAITPVEAKLHDESRFIQRCFDDNKDDHKGDDKNLKGYIYLGLIENKRGYISYGSVLVEGTSTRLFKENKGGYIPCGSLFVKGFFTRLKRNLKDRRSLGDWM

SEQ ID NO: 165420 - protein, 232 aa, Glycine max
  Coding DNA Sequence Number=SeqID_73735
  Homolog annotation: Hit_ID=A5ADP2; Match level="QueryCoverage=94%, HitCoverage=52%, E-value=2e-11, Identity=25%"; Hit description =Putative uncharacterized protein
MREFLLRIKCIVDALGSCRDPVLMHEHLDAILKGLPEEYSPVNSMIESKFEPLLIGEVEALLHTHEARMKKFQKHFADSPSINVAQVATVMEAVILTAVVATGAEAMALAVLEVIVVAVEATVVMQIFSAKFAFNLVIQQRNSSNTFDSEQNQGTNFHKDSQPSAMMVNSESQDPNSTTWILDSGASFHVIEESQNIQQHGPFEGPNQIYIGSDGLYIFPHLALKDSASVTC

SEQ ID NO: 165421 - protein, 147 aa, Glycine max
  Coding DNA Sequence Number=SeqID_73736
MEIPQKTTQSWIMRSILNQRVHINNMQSDLGQKDRRKFGMKTLYLKMRCEGSNEVKHHPQEWNEELKWIIRHGKGKGHKAYILKLAVTETVYDIWKYHNLPLIQSSLSPLTFQLSHSHPNHHDITTNHSETHHVATNNHDAAAHNHD

SEQ ID NO: 165422 - protein, 114 aa, Glycine max
  Coding DNA Sequence Number=SeqID_73737
  Homolog annotation: Hit_ID=A2Q246; Match level="QueryCoverage=85%, HitCoverage=39%, E-value=8e-42, Identity=88%"; Hit description=CENP -B protein
MDIDNLMNYPGENEACSEVQSLEDIVGTIIENNAEDDGEDDTVSLEPVTQKEALMASNTLHNFMIQYKNTTLELLDAIRKVRDELQIDLNFKETQVSFMGDNLDRVRWIQYYDV

SEQ ID NO: 165423 - protein, 48 aa, Glycine max
  Coding DNA Sequence Number=SeqID_73738
KRESYDAKVNEFEIIVFLRRVLWAAGKRKGFGEEKGKNENEAKKRHLT

SEQ ID NO: 165424 - protein, 217 aa, Glycine max
  Coding DNA Sequence Number=SeqID_73739
  Homolog annotation: Hit_ID=A5C169; Match level="QueryCoverage=56%, HitCoverage=10%, E-value=9e-07, Identity=29%"; Hit description =Putative uncharacterized protein
MVCTNQADMTGRLLAGSLTFECHIMHYLILRILLPQSSNLAQVSKEDLIVMWVFLTGRQIDWVHLVRYRMHKALRSNAPLPYPHLIILFLHHFDVPLDSEPFVQVMRSFSIGVGVVTSFGYRKERDGSWVKKDAPAQAAEDRSPSPPPQRDDSSSLMQIVLDRLDGLYIFVGERFDSLDSRIDAIDARFAGMDTRITQLEEDMSFICQCFNLPLPSL

SEQ ID NO: 165425 - protein, 112 aa, Glycine max
  Coding DNA Sequence Number=SeqID_73740
MATTAVEIKGFEKPMSSGLKNMEPQDPLEEINLGTEENQKPTYVRKLVDTRLRENIVFLLQEEKTNEASTKEIFYLCHGGHQSRDKKAIEDQFHLNYKYPRALGTYEWMVSS

SEQ ID NO: 165426 - protein, 88 aa, Glycine max
  Coding DNA Sequence Number=SeqID_73741
  Subcellular localization annotation: CTP_CleavageSite=36; ConfidenceScore=5.04e-01
MKKPTRLGELIASKLSFNSPGRAAFAPSAHFPINRRAREAEGRFQGSEGEGIERREKEEEKTRLRRYRIATAIIPYIVPCSMFFVRPS

SEQ ID NO: 165427 - protein, 17 aa, Glycine max
  Coding DNA Sequence Number=SeqID_73742
VEINGVDQLRLSDIGVD

SEQ ID NO: 165428 - protein, 123 aa, Glycine max
  Coding DNA Sequence Number=SeqID_73743
  Gene Ontology: Mol. function=oxidoreductase activity, acting on the CH-NH2 group of donors, NAD or NADP as acceptor; Cellular component =chloroplast; Biological process=nitrogen compound metabolic process
  Homolog annotation: Hit_ID=Q93WZ8; Match level="QueryCoverage=38%, HitCoverage=2%, E-value=1e-12, Identity=76%"; Hit description=NADH glutamate synthase precursor
MDTRLRVIGDPMNGVQRDSPSECGGGAATVRYGLISKGHSRNKIQAQGRVTDALEMMVRITHRGACGCGCEANTGDGAGIMVALPHQFYEWPSDLEDVYPRWTANSHYTLVPILEGQQLDDSR

SEQ ID NO: 165429 - protein, 111 aa, Glycine max
  Coding DNA Sequence Number=SeqID_73744
  Homolog annotation: Hit_ID=A7Q8F8; Match level="QueryCoverage=67%, HitCoverage=11%, E-value=3e-19, Identity=64%"; Hit description =Chromosome chr5 scaffold_64, whole genome shotgun sequence
MTQGLGVVWNKEEGFVEDDFVVDFLGENALLASIAENEKQTEMAARVSTWKQRIENNLEEQESHPPFDIQDYGERVLHKFFVLSLEASSSGVLSFSNLVKGQACTYAFQLL

SEQ ID NO: 165430 - protein, 215 aa, Glycine max
  Coding DNA Sequence Number=SeqID_73745
  Homolog annotation: Hit_ID=A7QN80; Match level="QueryCoverage=69%, HitCoverage=35%, E-value=2e-10, Identity=34%"; Hit description =Chromosome undetermined scaffold_131, whole genome shotgun sequence
MYEESSCYDDPNAMVSQSEGVMSATQTHNHNHNNNTAFAYSYSSGEDAANANANAAIAMEIIAEHPQQNQYNYSNTPLENHHQLPYPTPTVPDLLNLLHFPNPIPGDNSTNVSSVSYDPYLHLNLQQQQQQPTLRDLLPHMPALSNDFPFAGHAVEGEGIQGFGNGVVDFTQDVGKKRGGKRTKQFTSTITEKQRRVDLSSKFDALKELIPNPSK

SEQ ID NO: 165431 - protein, 245 aa, Glycine max
  Coding DNA Sequence Number=SeqID_73746
  Gene Ontology: Mol. function=strictosidine synthase activity; Biological process=biosynthetic process
  Homolog annotation: Hit_ID=A7QQ16; Match level="QueryCoverage=34%, HitCoverage=23%, E-value=3e-14, Identity=46%"; Hit description =Chromosome undetermined scaffold_139, whole genome shotgun sequence
VDTVATRRVVTADDWATPPPYINLGATKRITLGHEDEGHFAFLSMKDGVSSLWGKDFIPRAFIPSSMLSQSNYDMLREATLRTSMDSIGQVECAKAEQALLKVTKANETLFQSAKDSWKYLKDMKTKLKEVVSREEALKTKLATVKNFAKTLHEEIERLNKEFDLFKALGIALLDKLDKCSAAYIRDGLKSYSQLDLPHSVFGSESVAFDCHGKGPYVGVSDGRILKWQETKREWIDFAVTSPHR

SEQ ID NO: 165432 - protein, 98 aa, Glycine max
  Coding DNA Sequence Number=SeqID_73747
MLPNHVSNVLVGDIVPVGGVAHLDTGVSASIGGIITTKVGLRPYSTIRPNPREDKAEFLLSNPPYNVIAPHLFIPPPLPRKLSKEKREYPPITLPGSS

SEQ ID NO: 165433 - protein, 212 aa, Glycine max
  Coding DNA Sequence Number=SeqID_73748
MDFPVEALARVALGWSQFQEGLDARLEARFSHQDSCMDKLQQMVDRLVSTLSGKGSRTGDPRVETGGGDEGEFGGNVQTESGKALKETNEEFKTALIERLQLVMMSDSFESLLTLKQEQTLAKFDTQFERLARAVKGGRLVFDGNIQWVEGKESKLHKRKSLLEMMNKALTMEEKNISTARCNNILGSNLERRANNCAHSFTGTRTSRECQP

SEQ ID NO: 165434 - protein, 133 aa, Glycine max
  Coding DNA Sequence Number=SeqID_73749
MEAEWRKKRENRHHFKEKMSLEEAHHHRRLWIRAWRKKEMNEGREREEHEILCSKRVLKSKIIGPNLGPWAQKSILRFMKTLRPSSVALAQSSWSLLLMALVTGPFLGRIASEQHPWECFNLLSTQLPPNELK

SEQ ID NO: 165435 - protein, 60 aa, Glycine max
  Coding DNA Sequence Number=SeqID_73750
MVNARVVVNHKGRGQPYGGVSLQNRTSLNASYRGEHTVDDKLVAAMDEINFVKGRDNYDN

SEQ ID NO: 165436 - protein, 266 aa, Glycine max
  Coding DNA Sequence Number=SeqID_73751
  Homolog annotation: Hit_ID=A2Q6B4; Match level="QueryCoverage=71%, HitCoverage=88%, E-value=8e-09, Identity=26%"; Hit description =Ribosomal protein L33; Nucleic acid-binding, OB-fold
MARFPNKIKSIDGSKETLKLSVRISDLWFIGTPNKSEQAEMVFVDPDIYYLLFRPLCCNFNAIQGDEIHAVCKQDQLKVTVVRECVLEDIPFRKYRFAGFADVVAGQFEPRLLVDVIGVVEEVVFRQVSGKGRWVVFKLKDLSQQLLSCTLWDDYCLQFLKFLDDYKGDGPITVLLTHGRIKEAQGLHSWALRPNQVLNPMVKGVHSFQDDDVDLNVSPQALDKLLGYELAFKIKVQPKFRNFAVLKCSADSSLINDVMDMLVNAE

SEQ ID NO: 165437 - protein, 91 aa, Glycine max
  Coding DNA Sequence Number=SeqID_73752
MKTKARSRITDNIVSETKQEAPYQDDELVGLQKVLEVDPDVINESFADVDGGGEEIDADLLKQLDLVEPDEDECILSENEIESDFDDVDTS

SEQ ID NO: 165438 - protein, 24 aa, Glycine max
  Coding DNA Sequence Number=SeqID_73753
MKKKCPKYAVWRVKKGLPVEPTTK

SEQ ID NO: 165439 - protein, 209 aa, Glycine max
  Coding DNA Sequence Number=SeqID_73754
MDMGLMSRNQFGPLGDNGNPNRENEGPIRKKAIWLRKVIKSIVRDHCQIPLRVNQTLWIQNKVGSCYVHPALLLGHPANSEVAKLPFSNYSSGRRFSQKSSGNNFFGKFPEESSSGRIICVFRKYSQTTSGRTSSGMFPEESSSGRIPLSSGRSFFRKHRRRKVRNDHFRKKVFRKLRRPIPEEVLPEDLLPELAFTTSGRPSSVMLNY

SEQ ID NO: 165440 - protein, 86 aa, Glycine max
  Coding DNA Sequence Number=SeqID_73755
MERRCKYRISLVFPPIEFFPTLVDSRSPTKQLTKNIKLVLEISEHLEAEASQEKGLRGNLTAEGRPSGGGGGGGGGGGSVNRDGGQ

SEQ ID NO: 165441 - protein, 79 aa, Glycine max
  Coding DNA Sequence Number=SeqID_73756
  Subcellular localization annotation: CTP_CleavageSite=19; ConfidenceScore=5.03e-01
MALCSVNMHNSSFFQVLPRAQPRSVALSGLLAQPTGIMFQDITTLLPDPKHLRTQQTTNLFIERYYVPGHYYVLMSYTL

SEQ ID NO: 165442 - protein, 145 aa, Glycine max
  Coding DNA Sequence Number=SeqID_73757
MLHLQHQMILLHPSTHQIPNCEHIVDQRTFIHAYKGEFQPTYGCSNIISNIIRAKCDEPAASWLKVSVDHHDRWFGEFKFLFPILCRKSIGGTHKKSEPLELFLRQKSKEFQRPPTAWEVMEKTTKLKSGKWINVKSHEFVWQIL

SEQ ID NO: 165443 - protein, 623 aa, Glycine max
  Coding DNA Sequence Number=SeqID_73758
  Gene Ontology: Mol. function=oxidoreductase activity, acting on single donors with incorporation of molecular oxygen, incorporation of two atoms of oxygen; Cellular component=plasma membrane; Biological process=electron transport
  Homolog annotation: Hit_ID=P37610; Match level="QueryCoverage=39%, HitCoverage=96%, E-value=1e-101, Identity=67%"; Hit description =Alpha-ketoglutarate-dependent taurine dioxygenase
  Pfam annotation: Domain name=ABC_tran; Domain location=1-151; Score =89.0; E_value=1.5e-23; Accession=PF00005.18; Description=ABC transporter
  Pfam annotation: Domain name=TauD; Domain location=385-623; Score =227.4; E_value=3.2e-65; Accession=PF02668.7; Description=Taurine catabolism dioxygenase TauD, TfdA family
  Pfam module annotation: Pfam domain module=ABC_tran::TauD; Domain location=1-151::385-623
PGSITLDGKPVRGPGAERGVVFQNEGLLPWRNVIDNVAFGLQLAGMAKAERHAIARRLIRKVGLEGAEKRFIWQLSGGQRQRVGIARALAADPQLLLLDEPFGALDAFTREQMQTLLLTLWRDTGKQILLITHDIEEAVFLASELVLLSPGPGRVVERLKLDFGQRFAAGEPCRSIKSDPAFIERPPDVPRSSPALAVFPPAVAEPAERSRAAAAVVGRDRAGADCALVPAATTAGLYGCHAMAAPWCQPDAHAGGAVLCRADRHSDFTDLSGNFRSGDFVHPGRREEYAAGADPCRSGAGGDARAAAAFCHSARSVAGDSHRPAHRSWRGLVHAGGGRTDCRDARAGLYGAVGWGVSRHRCGAGGHRAPTDALEWRTAMNERVNFTALGPYIGAQVSDVDLSHPLSDAQFEQLYHGLLRHQVLFLRDQRITPEQQRALAIRFGDLHIHPVYPHAEGVEEIIVLDTHQDNPPDNDNWHTDVTFIQTPPAIAILASKLLPESGGDTLWTSGIAAYEALSEPFKQLLSGLQAEHDFKKSFQEYKYRKTEEEHQRWQQAVAKHPPVQHPVIRTHPVLPPAAGRKREGERGAAGLSPNDVAIWDNRVTLHYANADYYPARRVMHRAT

SEQ ID NO: 165444 - protein, 134 aa, Glycine max
  Coding DNA Sequence Number=SeqID_73759
  Gene Ontology: Biological process=response to stress
  Homolog annotation: Hit_ID=Q6CZT8; Match level="QueryCoverage=97%, HitCoverage=97%, E-value=8e-63, Identity=89%"; Hit description =Putative uncharacterized protein
  Pfam annotation: Domain name=OsmC; Domain location=15-128; Score =103.5; E_value=6.5e-28; Accession=PF02566.10; Description=OsmC-like protein
MQARVKWVEGLTFLGESASGHQVLMDGNSGDKAPSPMEMVLMAAGGCSAIDVVSILQKGRNDVADCEVKLTSERREEAPRIFTHINLHFIVSGKALSDKAVARAVDLSAEKYCSVAIMLGKGVEITHSYEVVEL

SEQ ID NO: 165445 - protein, 187 aa, Glycine max
  Coding DNA Sequence Number=SeqID_73760
MGDQEETQEQMKANMSALKEQMASMMKAMLGMRQLMEKNVATAATVSSAAKADPTLLATAHHPPPNTVGRERSTLGHSSNPHLGYNRVAYAYGLPPNYTPPVMHDDVGHVSSPILEGESPRHPNEVHEDHREYAQGDVDFYPPIPVEGPAPNTLPQHNLTHAYAYTCIFCDDRSRIVLGSGQMSGWG

SEQ ID NO: 165446 - protein, 103 aa, Glycine max
  Coding DNA Sequence Number=SeqID_73761
MKLASVEFSDYALVWWNKNQREMMREEGQEIDTWIEMRRQNHAIETPEAILGKSDYGGVLQRDGDDTRVCGLDDLLHKAVRVEQQIKRKIAARRNSSNTFNQN

SEQ ID NO: 165447 - protein, 100 aa, Glycine max
  Coding DNA Sequence Number=SeqID_73762
  Subcellular localization annotation: CTP_CleavageSite=59; ConfidenceScore=5.73e-01
MYTQSFTIPQFPKIGLTHKNSPQWSRQLSQPTLLRASRVRLKGASSNGGKCAESPPTFSCGKRRKNRRKTVMKNIPDSGVVFTFEEGINTSHICPKGQQP

SEQ ID NO: 165448 - protein, 100 aa, Glycine max
  Coding DNA Sequence Number=SeqID_73763
MLVRMIRTRLFVAARVKSCPGMHSRCVIVSLSGCTRTVGCPPISRGGPGTDKGNYWPLNRERKSRTLKMRTRNPLKARACSPLQARMCSPLMARTYSPLK

SEQ ID NO: 165449 - protein, 307 aa, Glycine max
  Coding DNA Sequence Number=SeqID_73764
  Gene Ontology: Mol. function=transporter activity; Cellular component= integral to membrane; Biological process=transport
  Homolog annotation: Hit_ID=Q7NZY6; Match level="QueryCoverage=98%, HitCoverage=71%, E-value=1e-114, Identity=65%"; Hit description=MFS family, muropeptide transporter
MVALLATLVALFSASQDIVIDAYRRETLSDEELGLGNSLYVNAYRIAGLVPGSLALILADHMAWPQVFLIVGLFMLPGIGFTLWAKEPVITSVPKTLLASVVEPFKEFMQRSGWQHALWVLLFILLYKLGDSMATALATPFYIDMGFSKTDIGAIAKGSGLVMQIAGAFIGGLWMLKLGINRGLWVFGVVQALSILGFAWLATSGPFTDIGATERGMLAIVIGFEAFGVGLGTAAYVAYMARETNPAYTATQLALFTSLSAVPRSVFNALTGGMVEALGWQQFFYVCTLLAIPGMLLLFKVAPWREK

SEQ ID NO: 165450 - protein, 104 aa, Glycine max
  Coding DNA Sequence Number=SeqID_73765
MVEYNGNKGDQCPLHPGEFHDVETCPVSKELLQGLIDGGRIEIGRVRREEGEVFMQSSDSNLGKPKPLEIHFTRDVTTQVPRGFQPAVVRTPSPFPYKSDKEVP

SEQ ID NO: 165451 - protein, 266 aa, Glycine max
  Coding DNA Sequence Number=SeqID_73766
  Homolog annotation: Hit_ID=A5BSR3; Match level="QueryCoverage=28%, HitCoverage=24%, E-value=4e-11, Identity=48%"; Hit description =Putative uncharacterized protein
  Pfam annotation: Domain name=Transposase_23; Domain location=182-252; Score=-3.8; E_value=0.0031; Accession=PF03017.5; Description =TNP1ENSPM transposase
MEDTVFEKYDIRKNRPSFARLAETLLGRYQKLLAEKTKKKLEEAAQSGSVDGIIDPPSPVRRHVKWKMARTKKTREMMTEAAKEITEKIDSFEEQVTQGSLVPHGRQDVLTTAIGRPEHPGRVRAAGAATDPANQGPARGVHHRKSDVAAHGILQPDAPDSVLVAISGTYTASRASGNDPEMGDSDRCGLYIEADPARLVTLGGVYEGSTVVHNTPLLPGQVKVGVEEVTDVDASVPVPTDEVSLVGQALHTFLAWPIHLVKSLSQ

SEQ ID NO: 165452 - protein, 370 aa, Glycine max
  Coding DNA Sequence Number=SeqID_73767
VGFRPCGRQPGAAPHLGQAIKQQADIEIADAVANKQHGVTHNIMGQFDIQRRVKIEPLEVTALIQHDGGIIVKIAMKFNNMALIFGQRHQIGGISDLAIRHIVRFMRHLQPAVVIGGIDAREIALGDHGVDFRAAHVDVRTVPLAIHPAAQRAERAFALFVILRQRQMGAVGIEDLRIVAQLISQMCNQLVPLRQSEIAFQKGGKAIQRQAAHRDFVFQFAHFSECLVAEDGFGGHARAVQPIHQFGKAFRVQPAPEDARQSGGQAIEPIQIQTGFSQFVTNQLHLIFGLNLFNTARNGHHFDTHRLKDVQPGDAYPAAVPAVIVRHAVAAPRGHSTLRRRHWRGTIGSRCARLRRYSASLIAGGVKYCA

SEQ ID NO: 165453 - protein, 74 aa, Glycine max
  Coding DNA Sequence Number=SeqID_73768
MPIVVLVKEKHPLGSSEFTILGQRKIQTKLLKFSRDLDSSEFTILIQCIGYHQSSSKEQKEIKCKATKWYSLLI

SEQ ID NO: 165454 - protein, 287 aa, Glycine max
  Coding DNA Sequence Number=SeqID_73769
  Gene Ontology: Mol. function=nucleoside-triphosphatase activity; Cellular component=integral to membrane; Biological process=cell division
  Homolog annotation: Hit_ID=A2YED4; Match level="QueryCoverage=66%, HitCoverage=29%, E-value=5e-85, Identity=85%"; Hit description =Putative uncharacterized protein
  Pfam annotation: Domain name=ABC_tran; Domain location=3-102; Score= -4.1; E_value=1.6e-06; Accession=PF00005.18; Description=ABC transporter
MPLIIAGASTEDIRRRVSAALDKVGLLDKAKNFPIQLSGGEQQRVGIARAVVNKPAVLLADEPTGNLDDALSEGILRLAACKGALTMANNAKTAKSKALRGGWREQWRYAWMNAIKDMLRQPLATLLTVMVIAISLTLPSVCYIVWKNVSTAASQWYPTPQLTVYLDKSLDDDAALKVLDAIKAEAGVEKVNYLSREEARGEFRNWSGFGGALDMLEENPLPAVAIVTPKMSFQSSDTLNTLRDRVAACAWMTAGLPPGGADRVGGPDRGDHRRADDRGGVPGDRQQ

SEQ ID NO: 165455 - protein, 233 aa, Glycine max
  Coding DNA Sequence Number=SeqID_73770
MLIIIDQYKEKVNLAASHGHMLEDEQAKVLALRVEREAREGVIELLHKEAMKWMDRFALTLNESPELPRLLARAKAVANTYSTPDKVHSLFNYCQHMNEHALGHPYQTRAKARIMSEIEEVQEQMKADMEAMKDQMTTMMEAMMSMRKMMEVNTAAVAATSAATKGGKALGSTDGPHFVQVQSKHPLPPYGLPSNYTLPNVEHAPDENVHNSTPIPIEIQQPQFGHAHVPQPI

SEQ ID NO: 165456 - protein, 55 aa, Glycine max
  Coding DNA Sequence Number=SeqID_73771
MGRCSGNGFSNLTLLQLPKHHEYEKSQEFQEPRDLRSNPFQGGGNDAILPRKGIG

SEQ ID NO: 165457 - protein, 58 aa, Glycine max
  Coding DNA Sequence Number=SeqID_73772
MASPMTCRGGRRRYPSGYPYKHTSVNPDPRSQVACGGTLWLSAPFVNQRQASPLTRRD

SEQ ID NO: 165458 - protein, 189 aa, Glycine max
  Coding DNA Sequence Number=SeqID_73773
  Homolog annotation: Hit_ID=Q84VH5; Match level="QueryCoverage=100%, HitCoverage=28%, E-value=2e-83, Identity=82%"; Hit description =Envelope-like protein
MATSPKETSAPGSPSAPSNQERPEFNIQPIQMIPGQAPVPEKLVPKRQQGVKISENPSLATSPREVDPEMDKKIRSIVSSILKDASVPDAEKDVPTSSTPDVAVPDAEKDVPTSSTPNTEVLSSPSKEESTEEDDQATKETPAPRAPEPAPGDLIDLEEVASDEEPIANKLAPGIAERLQSRKGKTPIK

SEQ ID NO: 165459 - protein, 241 aa, Glycine max
  Coding DNA Sequence Number=SeqID_73774
MRRSSVGELVPLDLEIEATFRRNNAERKRKLLHNITVASILEEAHFYESSSSNSPTSKESQTTEFEAEVMAEEQPRRVTLEDYSSTSVPQYFSSATWPKSKQLLDTSAGGKIKLKTPEEAMVTGCTLCGGAYGSGLCIPTEETSHEVNYMGNQPRQNFNADGFFGFQHGQPYQQHNQWRNRPGNQFNKDQSVEAMTSKIILMMPKNQESSKIQRFKNQVSRFKNNQDQDSRIKRRLNQDKY

SEQ ID NO: 165460 - protein, 173 aa, Glycine max
  Coding DNA Sequence Number=SeqID_73775
MGWLEYQGNVWKQKQESWQAAIDAFLAFHDRKESPVVAIVADLYDTFDRRCEKNSARMVCCTPALYVWGCINYNPILAIRQLGYPMRGAPLEEDLTPIIARGFNSTNAEALQKVRKAWEMVQKKDKELRGSSNGPIGGYHRWLKAYTQGLDWLPNLRTTKGVEVEALEEDEEV

SEQ ID NO: 165461 - protein, 152 aa, Glycine max
  Coding DNA Sequence Number=SeqID_73776
MRARARVMGEIHEVQERMKADMEAMKKQMAIMMEAIMSMKKITEVNAAAVAATNVIVEVDPTPPSGLNQINHPTLDMVGQGGKKLGSMGGPLFVQIQNKHAFPPYGLPPNYTPPDVAHTPDENVNNSTHILIESQNLNLIMHVVSQPMGEDT

SEQ ID NO: 165462 - protein, 279 aa, Glycine max
  Coding DNA Sequence Number=SeqID_73777
  Homolog annotation: Hit_ID=A5ASB9; Match level="QueryCoverage=91%, HitCoverage=79%, E-value=4e-46, Identity=45%"; Hit description =Putative uncharacterized protein
MVSLEPIEGNLRSSDPPSSPRISFSAEFLDENNFISISPNAEYERDQEKERERARNAAEFEFLSNNTSSNNTVLTADELFFEGKLLPFWQMQHLEKLSKINLKTKEGEEEELEEEVIVVSNNNKEDSNSNSNSRVNWFVDDDPSPRPPKCTVLWKELLRLKKQRASSLSPSSSSSSSSSSASSLGDVAAKEGKEGSRSSNKEQHVKRVKKGLERARSATIRIRPMINVPICTQVKSSALPPLFPLKKGKLERSNVPDSQMLSEFLNVRVPHGHLSAAYI

SEQ ID NO: 165463 - protein, 510 aa, Glycine max
  Coding DNA Sequence Number=SeqID_73778
  Gene Ontology: Mol. function=protein binding; Cellular component =integral to membrane; Biological process=protein amino acid phosphorylation
  Homolog annotation: Hit_ID=A7NWJ5; Match level="QueryCoverage=80%, HitCoverage=100%, E-value=1e-168, Identity=71%"; Hit description =Chromosome chr5 scaffold_2, whole genome shotgun sequence
  Pfam annotation: Domain name=LRRNT_2; Domain location=354-393; Score =26.3; E_value=0.00011; Accession=PF08263.3; Description=Leucine rich repeat N-terminal domain
  Pfam annotation: Domain name=LRR_1; Domain location=399-421; Score =3.8; E_value=62; Accession=PF00560.24; Description=Leucine Rich Repeat
  Pfam annotation: Domain name=LRR_1; Domain location=423-444; Score =12.1; E_value=1.7; Accession=PF00560.24; Description=Leucine Rich Repeat
  Pfam annotation: Domain name=LRR_1; Domain location=446-468; Score =8.9; E_value=6.8; Accession=PF00560.24; Description=Leucine Rich Repeat
  Pfam annotation: Domain name=LRR_1; Domain location=470-489; Score =13.5; E_value=0.79; Accession=PF00560.24; Description=Leucine Rich Repeat
  Pfam module annotation: Pfam domain module=LRRNT_2::LRR_1::LRR_1::LRR_ 1::LRR_1; Domain location=354-393::399-421::423-444::446-468::470-489
  Subcellular localization annotation: CTP_CleavageSite=27; ConfidenceScore=5.23e-01
MSLSFFLLLLFFPFSLSQTPPRGLLINCGAHSAAQFDNRTWLPDSGFISSGSPKTVTTPVLFPTLHTLRSFPRQVKKHCYNIPVYRGAKYLVRTTYFYAGVNGADHPSPPVFDQILDGTLWSVVNTTRDYSDGNSSFYEGLFLAQGKIMSLCIGSNTYTDSDPFISALEFLILEGSLYNTSDFTKYGLALVARHSFGYSGPPIRYPDDLFDRVWEPFGQSNSTQASTDNVSVSGFWNLPPAKIFETRIGSDQLETLQLRWPTASLPSSNSKYYYIALYFADDTAGSRIFNISVNGITYYHNLNVIPSGVVVFASQWPLSGPTTITLTPAASSSLGPLINAGEVFDVLPLGGRTLTRDVIALEKVKQSLRNPPLDWNGDPCMPRQYSWTGISCSEGPRIRVVTLNLTSMDLSGSLSPFVANMTALTNIWLGNNSLSGQIPDLSSLKILETLHLEDNQFSGEIPSSLGDISSLQEVFLQNNNLTGQIPANLIGKPGLDIRTSGNNFLSPPAS

SEQ ID NO: 165464 - protein, 317 aa, Glycine max
  Coding DNA Sequence Number=SeqID_73779
  Gene Ontology: Mol. function=protein binding; Cellular component =nucleus; Biological process=cell division
  Homolog annotation: Hit_ID=Q6EEW1; Match level="QueryCoverage=100%, HitCoverage=84%, E-value=1e-111, Identity=66%"; Hit description =Cyclin T1
  Pfam annotation: Domain name=Cyclin_N; Domain location=140-284; Score= 24.0; E_value=8.9e-07; Accession=PF00134.14; Description=Cyclin, N -terminal domain
MSFVRNYQAEDCSLHSGYWSTFDGNNFGNSNRKRSRNNYYNRNCNIYNDNRTKFGDHGCNFNFYTADHANYVRYDAVPSSLKRRKYSVPAWQESQQYYVPPMVHDNIPSSYNFQGPPTRSDGDASTSASCKRDCSIFEDDKPVFMSRDEIDRHSPSRKDGIDVHHETHLRYSYCAFLQNLGMRLELPQNIIGTAMVLCHRFFVRQSHACHDRFLIATAALFLTAKSEEAPRPLNNILRTSSEILHKQDFALLSYRFPVDWFEQYRERVLEAEQLILTTLNFELNVQHPYVPLTSVLNKLGLSKTVLVNLALNLVSEG

SEQ ID NO: 165465 - protein, 168 aa, Glycine max
  Coding DNA Sequence Number=SeqID_73780
  Gene Ontology: Mol. function=hydrolase activity; Cellular component =nucleus; Biological process=metabolic process
  Homolog annotation: Hit_ID=Q5NUF4; Match level="QueryCoverage=79%, HitCoverage=51%, E-value=8e-45, Identity=58%"; Hit description=2 -Hydroxyisoflavanone dehydratase
  Pfam annotation: Domain name=Abhydrolase_3; Domain location=7-164; Score=3.2; E_value=1e-07; Accession=PF07859.4; Description=alphabeta hydrolase fold
MSSSALLNSHRLAPENPLPAAYEDSWEALKWHGDFNRFYIGGDTAGANIAHNAVLRAGVESESVSLLGGMEITGAVLAFPLFWSSEPVEGFEESSAMQVALINPLASGAPSLASLGCHKVLIFVAGKDDLRDRGIWYCDAVKESGWEGGGTASSGGRGTLLSDLPSSN

SEQ ID NO: 165466 - protein, 15 aa, Glycine max
  Coding DNA Sequence Number=SeqID_73781
MEREESKRGKKALTI

SEQ ID NO: 165467 - protein, 124 aa, Glycine max
  Coding DNA Sequence Number=SeqID_73782
  Gene Ontology: Mol. function=nutrient reservoir activity; Cellular component=vacuole; Biological process=defense response to bacterium
  Homolog annotation: Hit_ID=P25974; Match level="QueryCoverage=76%, HitCoverage=21%, E-value=1e-47, Identity=100%"; Hit description=Beta- conglycinin, beta chain precursor
  Subcellular localization annotation: CTP_CleavageSite=49; ConfidenceScore=5.09e-01
MKEMQTLNLLALKNNNRSRNRKRNLWKCKAYPFVVNATSNLNFLAFGINAENNQRNFLAGEKDNVVRQIERQVQELAFPGSAQDVERLLKKQRESYFVDAQPQQKEEGSKGRKGPFPSILGALY

SEQ ID NO: 165468 - protein, 235 aa, Glycine max
  Coding DNA Sequence Number=SeqID_73783
  Homolog annotation: Hit_ID=A1YL93; Match level="QueryCoverage=100%, HitCoverage=93%, E-value=6e-85, Identity=72%"; Hit description =Proline-rich protein
  Pfam annotation: Domain name=Frigida; Domain location=1-123; Score= -113.4; E_value=0.014; Accession=PF07899.2; Description=Frigida-like protein
MIEELISKGQQLDAVHFTYEVGLVEKFPPVPLLKSFLKDAKKVAASILEDPNNAGRAAIFFPMVNEIWQYLAARKEQSALRAVIKCIEEYKLEDEFPPENLKKRLDQLEKVKTEKRKPVAVPANKRTRASNGNGGPMPPAKAGRLTNAYVSSFPAAPTFVRSPSHGQYPAALPPYPSPPHMYGSRSPPANPYAAYSPEPAPAIAGSYPAAPMNYPHAYGGYGNVLAPTYQQAYYR

SEQ ID NO: 165469 - protein, 280 aa, Glycine max
  Coding DNA Sequence Number=SeqID_73784
  Homolog annotation: Hit_ID=Q9LUV6; Match level="QueryCoverage=60%, HitCoverage=50%, E-value=1e-25, Identity=43%"; Hit description =Genomic DNA, chromosome 3, P1 clone: MCB17
  Subcellular localization annotation: CTP_CleavageSite=31; ConfidenceScore=5.70e-01
MVGGNHPKSSHHKKPPPSASHRKSRWEPNSSSSAKSPADPKSSTAPSPKPNPNSNPNPSPKHLPFPFPFPDPAPAPLGTPPPPAYGFHMLERRTIVLADGSVRSYFALPSDYQDFAPRPLDLPPRFPPPLSPGRFRLPDYSHAAAAAAAKRKYGDDNGGPRDDLARQREQLLRNANGLSREQFSAGPSELRPSKHSRLDGSNSTRHSQVDQDALKKAFCNFAKLISENASQKRTYLEDGKQGRLHCLVCGTGTGSLFIDNFKSKLQARCTKKLDEQEQEG

SEQ ID NO: 165470 - protein, 616 aa, Glycine max
  Coding DNA Sequence Number=SeqID_73785
  Gene Ontology: Mol. function=oxidoreductase activity; Cellular component=periplasmic space; Biological process=amine metabolic process
  Homolog annotation: Hit_ID=A7NWL6; Match level="QueryCoverage=98%, HitCoverage=95%, E-value=0.0, Identity=61%"; Hit description=Copper amine oxidase
  Pfam annotation: Domain name=Cu_amine_oxid; Domain location=239-616; Score=559.1; E_value=4.5e-165; Accession=PF01179.11; Description =Copper amine oxidase, enzyme domain
  Pfam annotation: Domain name=Cu_amine_oxidN2; Domain location=27-118; Score=116.6; E_value=7.5e-32; Accession=PF02727.7; Description=Copper amine oxidase, N2 domain
  Pfam annotation: Domain name=Cu_amine_oxidN3; Domain location=124 -221; Score=127.6; E_value=3.7e-35; Accession=PF02728.7; Description =Copper amine oxidase, N3 domain
  Pfam module annotation: Pfam domain module=Cu_amine_oxid::Cu_amine _oxidN2::Cu_amine_oxidN3; Domain location=239-616::27-118::124-221
MDATTKVTLFSILMLFWSHAECNHLLHPLDPLTPSELNLVRTIVQNFYPTSQNLTFHYVGLDEPNKPEILKWLSSNNSKIKPKPRPPRRAFAVVRFQKQSHEITVDLSTHSIVSTKDCEGNGNPMLTFGEQAVASQLPFSYEPFKESLKKRGLNTSQVVCACFTIGWFGEGKTKRNVKVKCYYANDTANLYARPLEGVAAVVDLDDMKIVGYNDRYVVPVPKAEGTEYRASKLKPPFGPKHKGIAVTQDGGPGFTKDGHSVRHRRVLYKGFIPELFVPYQDPTEEWYYTTYFDSGEYGFGQSMSSLQPLNDCPPNAAFIDAYYAGSDGTPVKIANAFCIFEKYAGDIMWRHTEISIPNEVITEARSDVSLVVRIVSTVGNYDYVIDWEFKPNGCIKIGAGTYTNTDQIKEDIYGTLIADNTIGIYHDHFFTYYLDLDIDGEANSFVKSNLETVRVKDDTTPRKSYWTVVSETAKTEADAKINLGSKPSELLVVNPNKKTKQGNKIGYRLLPGPVAHPLLLNDDYPQIRAAFTNYNVWVTPYNKSEKWVGGSYVDRSRGDDTIAIWSLRDREIENKDIVLWYTMGFHHVPSQEDYPIMPTLSGGFELRPTNFFERNP

SEQ ID NO: 165471 - protein, 270 aa, Glycine max
  Coding DNA Sequence Number=SeqID_73786
  Homolog annotation: Hit_ID=Q2HTA0; Match level="QueryCoverage=76%, HitCoverage=34%, E-value=5e-20, Identity=31%"; Hit description=IMP dehydrogenase/GMP reductase, related
  Pfam annotation: Domain name=DUF1723; Domain location=131-180; Score =44.4; E_value=4e-10; Accession=PF08330.1; Description=Protein of unknown function (DUF1723)
MVMILRVPVIFADDVPVVPAVPQAEPAVAGDEPMVDVDAQDTNAETDAQDTDAEDAADEAEGFPSGLRDPSVLTEYAEHVVASVWSGQEQPELKLSSNGRKVHKLGRPLPAIEEMVAGTRLSPLIACSIDTGDQRSISSFVERWHQETSTFHLPVGEVSITLDDIASLLHLPIVGDFHAFQPLHINEAVLMLVELLMVSPEVAMAEIGHCCGPYVRLHWLRDVYQRRCQTQHWTAAARAYHLHLLDCTLFANKSATRVHVVHLDALRDLT

SEQ ID NO: 165472 - protein, 1552 aa, Glycine max
  Coding DNA Sequence Number=SeqID_73787
  Homolog annotation: Hit_ID=A7NWK5; Match level="QueryCoverage=56%, HitCoverage=91%, E-value=0.0, Identity=48%"; Hit description =Chromosome chr5 scaffold_2, whole genome shotgun sequence
MDRIREARRSTMAANGLTRRRHRTNNSLRDSPEEDGAMELQEPSRLRDRGGSGKKDRDRERERERERDRLGRSKKRRGDRLMHSSREDGGEDTSEESINDEDDDDDEDGGGGGSGSGSASVRMLPLNPSSLSNQHHRKSFPPAKVLRPTPPTTWKAADEMIGVSVPRKARSASTKRSHECWASSGGGIVAEQNHRQPSTSPVRAAAPASPSSSNASVRKKIKQNGGAKFRPPKTTTSSSSKPSSSAQDEIEIEIAEVLYGMMRQPQGPSKQEIIANDSTKFDSRESNKSSTDAKSPISNPQNSSSSATPMSAVAPKRKRPRPVKHEDENPASLIVRSSPISSTTKAESDQPSKMETCSSNLDKNNVGSVSENLAHSQTVQIMPEPVKPENNEFKPAATEEAEKQKDVGLSEVVVSPQLPKKESPVRQVADDDREDVKATKANHSISESDNQREEKFQIDLMAPPPPSRSSPERDVENNNNMVIDAEKEVKPMTKEDEKVLRMNKEVAMVIEMEKVKAKAEETDSQKPSFVQKERGIDLQLDLEKVDRVDTSGNVGSMVNKKQQHQNVQRQQTNSEKNVQSNSLPLPLSVPSWPGGLPPMGYMTPLQGVVSMDGTPVTSAAIPPPHLLFNQPRPKRCATHCYIARNILCHQQIARMNSFWPAAAGSASLYGAKPSNLNVVPSTELHGNVPGRAANSSQDKGHGIAMFPGHIGKDKASQPAIVDNSSRKQILLQQALPPGAAPSNILHGPAFIFPLNQQQAAAAASVRPRSVKSLPVSSNGAPSSVSNSAPSNASGTGTVAVAAAAAAAAPTMSFSYPNMPGNETPYLAILQNNAYSFPIPAHVGGPPGYRGTPHAQAFPFFNGSFYSSQMLHPSQIQQQQLPAQSQQQNQQGHQNTSMSSGSSSSQKQHAQNQQQKPNNNATGSNGGASLQGFPVTKTPPSQPLQLQQQQPQQRQNHHTSHPARQVESEMGGEDSPSTADSRLARATMNIYGQNFTMPMQSPNFALMTPASIGAGGSNGSHSEKKQPQQHPGPKAGGETAPAFAMSFASMNGATGASGLDLSSIAQNNHSIMQSNHNYHIMAAQAASAQLKKSYHAAEEGKSVVNPSNLDEDRKAISAGKIPATMGQSIAFGRPDVSDPSLASLSGGNNVIDTSGRNLNLGSASSRASASVMPAAISTNAASSQQQMQRNQQQQILQHQKQNQFAAAAAAAAARNKTPSTSNGSVYSDNLPSTSSMANKFPSAVSAFPQNLVQSSNTVAQSPSQWKNSLRATTTSQSPPSMASTTPSSSVKSHPQQQARSQQPHTQISFATNPKSSAAQVQPASSTQSPSPPVMVGSPTTSSISKNTGSPRTTSASTTNNKISQSSSLSSQQAKNSSAVPARKSSPVGSRNVPSILNVPQLTPPSSTGSKSQLPQQQQKQQQQIPKQALPQAQLFFSNPYMHPQSNSSTSTTTVPSGYYLQHQHHHQQHQQRRGPEQMQRPGSSGTSPAVNNVKGSSALPTQGLLHPAQVAAMQPSGSHPQFVPTGFSYASYHVHSVPSVQVKPAEQKQPAGE

SEQ ID NO: 165473 - protein, 27 aa, Glycine max
  Coding DNA Sequence Number=SeqID_73788
MAEINQGKRMTGHDWPRIVCLLLAGTA

SEQ ID NO: 165474 - protein, 101 aa, Glycine max
  Coding DNA Sequence Number=SeqID_73789
MDYLLWMLWSMECNICGVKIKSVRPTERGAGSGICEGAGGITGISVEEVTQALQGSRVRLNSPSLTQSCNQGWESKSGCVMLSSEGGLVGDEVPHVHVPSS

SEQ ID NO: 165475 - protein, 74 aa, Glycine max
  Coding DNA Sequence Number=SeqID_73790
MSVKNLVGRLGVHDKTNHTLASQLGSQCFARMLQPYGINIGLKEHSNRVTPKAYTTKSPSGPLLPDSGPTQKTL

SEQ ID NO: 165476 - protein, 339 aa, Glycine max
  Coding DNA Sequence Number=SeqID_73791
  Gene Ontology: Mol. function=oligopeptide transporter activity; Cellular component=periplasmic space; Biological process =oligopeptide transport
  Homolog annotation: Hit_ID=Q8CW38; Match level="QueryCoverage=53%, HitCoverage=36%, E-value=2e-74, Identity=70%"; Hit description =Periplasmic murein peptide-binding protein
MEHDRRIIAEKVLGTGEKPAWHFTPDVTAGFTPQQSYLQQHSQQELNAQAKALLTAAGYGPAKPLHLTLLYNTSESHQKIAIAEWKTYIDSRNSGNFDVIRASWVGDYNEPSTFLSLLTASHSGNISRFSNAEYDAVLSKASNETSVAARNADYNKAEQIIADQVPIAPIYQYTNGRLIKPWGGERPGEYVNVIEGKALQVSDAIVACQFDGKGGVIAIEDKDVINCERHCWLHLNYTQRQSADWLQHTPLIPDAVRDALAGDSMRPRVTRLGDGFMIVLRSVNHNADSRPDQLVAMRVFINDKLIVSTRRRKVYAIDEVLTDLQNGNGPVDGGSWLVD

SEQ ID NO: 165477 - protein, 97 aa, Glycine max
  Coding DNA Sequence Number=SeqID_73792
MNLIVIIKKEKKHALRRPYQFRARARVMGEVEKVQEQMKADMEAMKEQMATMMEAIISMKKIREVDMVAVAATNAVAKVNPMPPSGLNQMNQPTSNM

SEQ ID NO: 165478 - protein, 87 aa, Glycine max
  Coding DNA Sequence Number=SeqID_73793
  Subcellular localization annotation: CTP_CleavageSite=56; ConfidenceScore=5.13e-01
MTIQNMQFQQETRASIQSLSNQMGQMATQLNQAQSQNSDKLPSQIVSGNQIQVPPSVAALAPKPVKLPSTPEKEDEIVTDRGRTQIK

SEQ ID NO: 165479 - protein, 283 aa, Glycine max
  Coding DNA Sequence Number=SeqID_73794
  Homolog annotation: Hit_ID=Q6WAY6; Match level="QueryCoverage=72%, HitCoverage=44%, E-value=4e-23, Identity=31%"; Hit description =Putative uncharacterized protein
MEPIASLSQYYDQPPRCFTFEDFQLVPTVKEFEEILGCPLGGRKPYLFSRNGVVGVPRKCLEKGQRPWQIKANGLSFIDILALLIFGVVLFPNMEGLVDLAAIDAFLAFHHGKESPVVAILAMYDTFDRDVKRAAQELFVVHWLSMCGWFHTFFLQEGRPVYPLQGHRSILSSCEGCPNVPLMGTRGCINYNPVLAIRPLGYPMRGVPSGESITPFIARGFSDHNARDRELRGSSNGIIGGYHKWLRVRTQGLDWLPNLKTVRDNEVKASEESDEVQALKARA

SEQ ID NO: 165480 - protein, 307 aa, Glycine max
  Coding DNA Sequence Number=SeqID_73795
  Gene Ontology: Mol. function=catalytic activity; Biological process =metabolic process
  Homolog annotation: Hit_ID=A8GIR0; Match level="QueryCoverage=66%, HitCoverage=76%, E-value=7e-48, Identity=55%"; Hit description =Putative uncharacterized protein precursor
PYWGTETSYTKTWHENGYLEIAVKFHTHFSSGDRRMHLRFTTDSQAAPVLDVDIKQLVIAGWVGRDQAAVLHHIRELEALGVPAPGAVPLFYRVATQQLAQHSPLEVVGEQTSGEAEPFVFFHRGEYWVSLISDHTDRHLETFSVALSKQACVKPVAGHAWRMAEVEPHWDRLELRAWIKVNRRLGDLSAGHARLSAHAEGSAGALLRRSPGQRRLCDVMRHVERDRRHPSGQRVPHGAARSAAESHAGTPLCHRRAAGDCLRRRASQQLRAGDLTASAATQQALRAAEQPSGEGARVFTRTYADRA

SEQ ID NO: 165481 - protein, 432 aa, Glycine max
  Coding DNA Sequence Number=SeqID_73796
  Gene Ontology: Mol. function=transporter activity; Cellular component= integral to membrane; Biological process=transport
  Homolog annotation: Hit_ID=A1HKV5; Match level="QueryCoverage=95%, HitCoverage=97%, E-value=1e-104, Identity=46%"; Hit description =Major facilitator superfamily MFS_1
  Pfam annotation: Domain name=MFS_1; Domain location=30-378; Score =63.8; E_value=5.6e-16; Accession=PF07690.7; Description=Major Facilitator Superfamily
  Pfam annotation: Domain name=Sugar_tr; Domain location=33-428; Score=- 161.8; E_value=0.012; Accession=PF00083.15; Description=Sugar (and other) transporter
  Pfam module annotation: Pfam domain module=MFS_1::Sugar_tr; Domain location=30-378::33-428
MSDKITRAAAVPDIEQQTVKRVIWRILPFLIVCYLIAIIDRGNIGMASLQMNEDLGLSKAVFGLASSLFFVGYFLFEVPSNLAMQKIGAKIWISRIMQCGNAVRAALSVGRRRSRLLSGRDPLSDLLDSGEISRARDCDFMVAIPAANFIGSPISGAILTMDGWFGLRGWHWLFIIEGFPAIVLGVLAFFLLSNRPENAHWLTSEQRNWLSGKLAEENAQRKAIGHITLWQLLRHKHIWVMALIYAGASAAGSTLSVWSPQLLKSFGLDNFTTGLMNAIPYGLASILMIVWGRSSDRSGERRWHTALTLFLIAGGLLAAFLTDTLAGSVVILSLVLIGAYSMKGPFWALASGWMSSTTAAAGLAAIGAMANLIGGGLMVNVYGIINEKTGSHAMAMIPLALLCAAGGIAVLLMGRSKKLHVEAEQPVASTGK

SEQ ID NO: 165482 - protein, 186 aa, Glycine max
  Coding DNA Sequence Number=SeqID_73797
  Gene Ontology: Mol. function=tetracycline:hydrogen antiporter activity; Cellular component=integral to membrane; Biological process=response to antibiotic
  Homolog annotation: Hit_ID=A4Q7Q3; Match level="QueryCoverage=48%, HitCoverage=18%, E-value=9e-35, Identity=66%"; Hit description=Sugar transporter superfamily
MGERIWAPWFIKFIQSRGYFNIYTNLLHERALSVSHRDAGVNYGKTAGPDSKLLEEKEVHPGKVVTNLEELGSLLHSLQKQSSVFLVNLFGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 165483 - protein, 56 aa, Glycine max
  Coding DNA Sequence Number=SeqID_73798
  Gene Ontology: Mol. function=RNA-directed DNA polymerase activity
  Homolog annotation: Hit_ID=Q2HSQ4; Match level="QueryCoverage=94%, HitCoverage=55%, E-value=1e-14, Identity=67%"; Hit description=RNA -directed DNA polymerase ; Zinc finger, CCHC-type; Peptidase aspartic, catalytic, putative
MTEIKSQEATMARYLHGLNREIQDIVELHHYASLKDLIHQAIKVEQQVKRKQTCKR

SEQ ID NO: 165484 - protein, 42 aa, Glycine max
  Coding DNA Sequence Number=SeqID_73799
MKGKGDAILPRKGPVTRAMSKRLQEDWARADKEGLRVLMNLR

SEQ ID NO: 165485 - protein, 121 aa, Glycine max
  Coding DNA Sequence Number=SeqID_73800
MARHKVTRTHTHTHSRRHKGEEGLGRFVGDLEGRDESKRQGLNLSGSCSKATLPLTYPSRIKSSAKDSTRRSMELRFKASRRANPPHEGHQRHVPLGGRGPYCWSANGRRAHASLLARILT

SEQ ID NO: 165486 - protein, 65 aa, Glycine max
  Coding DNA Sequence Number=SeqID_73801
MPFCGRAKARLTGALSEGGKIHGVTTNVYLWKTSGKTEGNRSTIAGLLLLLTLYRRGNQTYVVLS

SEQ ID NO: 165487 - protein, 59 aa, Glycine max
  Coding DNA Sequence Number=SeqID_73802
MDKSLKVGEDERRGMMQSYPPRALDRRLREYWAKNAKEGPRVLMSLRVGYPRNIGFFSL

SEQ ID NO: 165488 - protein, 55 aa, Glycine max
  Coding DNA Sequence Number=SeqID_73803
MSLHVLYLYAFSGFPPGISRLLYLSLRSFNEMNGQDHLELPSGVRTKCGQQKPIK

SEQ ID NO: 165489 - protein, 23 aa, Glycine max
  Coding DNA Sequence Number=SeqID_73804
MARLVQCVKLGKELEGMDFPPYP

SEQ ID NO: 165490 - protein, 386 aa, Glycine max
  Coding DNA Sequence Number=SeqID_73805
  Gene Ontology: Mol. function=transporter activity; Cellular component= cell outer membrane; Biological process=transport
  Homolog annotation: Hit_ID=Q1H532; Match level="QueryCoverage=100%, HitCoverage=57%, E-value=1e-113, Identity=53%"; Hit description=TonB- dependent receptor
  Pfam annotation: Domain name=TonB_dep_Rec; Domain location=140-386; Score=78.8; E_value=1.8e-20; Accession=PF00593.15; Description=TonB dependent receptor
MDQDRWELAGEVRELRGPLQKLKLRMAHTDYQHVEIEGGQVGTTFKNRGMEGSLEATHVPWAGVNGVVGYQFQNTKFQALGEEAFVPSVVTQTQALYLYEELPIDKHKITFGGRVGETTVNSSADAIFTQAFNNRFNPNSLALGGLYTINDTWSATANLSHNERAPSYFELYANGEHVATGQFEVGNANLNKEISNGLDAQLKWKENGHSITLGAYATRFQNFIGLFNSGATDPGTGLAIANFAAVPALFKGLELEGKFALNDEWTLKMRGDYVHAKDTRNNQYLPRISPLRLGGGLDYRLGNWNARVDVLHAFKQNDVAENELKTNGYTNLSALVAYKLPVKYHVELFAKANNLLNDEIREHASFLKDISPAGARSVLVGARADF

SEQ ID NO: 165491 - protein, 90 aa, Glycine max
  Coding DNA Sequence Number=SeqID_73806
MSIDRDCKKVSPLLSRDNRVQYNAETPHGYPHLCHPETASPMTCGDTSRLSVPCHPEALNLMTSKDTSCLSAPFIIQRQVSHDRGHTRIK

SEQ ID NO: 165492 - protein, 94 aa, Glycine max
  Coding DNA Sequence Number=SeqID_73807
MAIQVEESKADQKVEGLKQQLADELALEPVDDLVELEEIFEEAEDEKKKEATLTECKEVPYPFVPSWKDKERHLARFLDIFKKLEITLPFGEAL

SEQ ID NO: 165493 - protein, 78 aa, Glycine max
  Coding DNA Sequence Number=SeqID_73808
MKSDMEAMKEQMTTMMEAMMSMRRMVEVNADAVYVASTATELDPTHPRGFNHVNHPASDMVGQGGESLGSVGGPHFVQ

SEQ ID NO: 165494 - protein, 143 aa, Glycine max
  Coding DNA Sequence Number=SeqID_73809
  Homolog annotation: Hit_ID=UPI0000ECAFAB; Match level="QueryCoverage =53%, HitCoverage=93%, E-value=4e-26, Identity=77%"; Hit description =UPI0000ECAFAB related cluster
MTIEGGKILECIRRRREEVYFVSTTLVKSIGRGPKGLHYNTNKLFGGIPGYRARIRPIVSRITIHWPSFYNVVTGKTLALPNLIALQHIPLSPAGVIAKRPAPIALPNSCAAEWRMAPDAVFSPYASVRYFTPHMVHSQYNLL

SEQ ID NO: 165495 - protein, 91 aa, Glycine max
  Coding DNA Sequence Number=SeqID_73810
MGANDIIIDKQKGLLAAEEKIDPPLERVDLGWWPRMMHPIPAEVPKHWDPHLLLREGKVPGQDTFSKNYSTNIMDPKGATTCKLCINFIYP

SEQ ID NO: 165496 - protein, 143 aa, Glycine max
  Coding DNA Sequence Number=SeqID_73811
MAAQLKHDRVEMECLEGVWETLEGNARCRFRGTIRLMTTSLVHPKEPARTLQRTVEWILPTPTPYRLVEPVQVIEVLSSEEDPEEDPEELPPEPVVDALDFPEGDEDPLPDVDSLENVMSASKADSTEESGPRGIVTSGDSSS

SEQ ID NO: 165497 - protein, 154 aa, Glycine max
  Coding DNA Sequence Number=SeqID_73812
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
GTSTWVVVIENKRGYISCGSVLVEGTSTRLLKENKGGPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 165498 - protein, 55 aa, Glycine max
  Coding DNA Sequence Number=SeqID_73813
  Subcellular localization annotation: CTP_CleavageSite=24; ConfidenceScore=5.06e-01
MRMRSPLKARACSPLQARMCSPLNARTYSPLKVIGTSTQGSTFMRKQEIDSLRGP

SEQ ID NO: 165499 - protein, 138 aa, Glycine max
  Coding DNA Sequence Number=SeqID_73814
MRGALSEEGLTPFIARGFSIPNTGVLQGVRKAWEMVQKKDKELRGSSNRTISGYHRWLKAYAQAAKGEEVEAPEESEEVQALKVELEKAQAIKEKFKSTTIRIQRENAKLRDVNIATTNALEQETKRACKEEHGRNKF

SEQ ID NO: 165500 - protein, 56 aa, Glycine max
  Coding DNA Sequence Number=SeqID_73815
MVNNPSEFTYIGRLKYPEEKGERELEGGLVPSLEEFESRSKGPTTLRAIGLRSTPN

SEQ ID NO: 165501 - protein, 183 aa, Glycine max
  Coding DNA Sequence Number=SeqID_73816
  Gene Ontology: Mol. function=aspartic-type endopeptidase activity; Biological process=RNA-dependent DNA replication
  Homolog annotation: Hit_ID=Q6WAY3; Match level="QueryCoverage=51%, HitCoverage=7%, E-value=6e-12, Identity=31%"; Hit description =Gag/pol polyprotein
MGCMLGQQDDSEKRERVVYYLSKKFIACEMNYSLLMDPVKYIFKKLALIGRIDGDIMALFGEKVKDEDRDKWIVWFDGASNALGHGVGVALVSPDNQFAKVDVSLSELYALSEFHPLSEASTRLADRRNLEGNQSRRHALNASSACSPSHLSPSRLSASLALSENSLTLAKRENGTKRDVGIL

SEQ ID NO: 165502 - protein, 209 aa, Glycine max
  Coding DNA Sequence Number=SeqID_73817
SEDHPPKQSRVRGHLVKIDANSLNTFLETPAVLAEGETLSAYSRYCRLPTDYREIEAAVWSVLSYSNLAPTSHTSDLTVDRARLIFGLVSRLDMNIGALISGQMTSIAQSNTSRLRFPTLITALCRARGVVSDSLTFERLSPVINLTYIKKNYWNPEDLTVSIRGARRVRARPVELPFTSAAPTSASTSVPVQIDSQCFEAMLQSIHQG

SEQ ID NO: 165503 - protein, 173 aa, Glycine max
  Coding DNA Sequence Number=SeqID_73818
  Gene Ontology: Mol. function=structural constituent of ribosome; Cellular component=ribonucleoprotein complex; Biological process =translation
  Homolog annotation: Hit_ID=A4GYN8; Match level="QueryCoverage=51%, HitCoverage=65%, E-value=5e-43, Identity=98%"; Hit description =Chloroplast 30S ribosomal protein S12 B
  Pfam annotation: Domain name=Ribosomal_S12; Domain location=54-172; Score=151.7; E_value=2e-42; Accession=PF00164.16; Description =Ribosomal protein S12
  Subcellular localization annotation: CTP_CleavageSite=36; ConfidenceScore=5.11e-01
MDKLLFLGTHIRYHKKDNDIPSTQHRSSKGSRRPTNARKPGSFRKWIPIRRVHNRMDKLTLTRQFGIQFGSLGGIGKEFWNSGSKGDLSVNFSTITPKKPNSALRKVARVRLTSGFEITAYIPGIGHNLQEHSVVLVRGGRVKDLPGVRYHIVRGTLDAVGVKDRQQGRSSAL

SEQ ID NO: 165504 - protein, 94 aa, Glycine max
  Coding DNA Sequence Number=SeqID_73819
  Subcellular localization annotation: CTP_CleavageSite=31; ConfidenceScore=5.10e-01
GLRNRRKRWHIRGITVAGNRRTTTASRIHLTSSTKARALPTTRGRPTGTQPPEQHFEAIKGWLFLRQRHGQLRDDEFPHFLGGGGAIQPGSPNL

SEQ ID NO: 165505 - protein, 85 aa, Glycine max
  Coding DNA Sequence Number=SeqID_73820
  Subcellular localization annotation: CTP_CleavageSite=56; ConfidenceScore=5.18e-01
MLATHSGYQSMAKKLALNCFFTSSFIFRDISGFILLNFCFTGEHSGFRGPSEDFLVVFEQSYQFILDVRGHAYANLDLLSFFANT

SEQ ID NO: 165506 - protein, 129 aa, Glycine max
  Coding DNA Sequence Number=SeqID_73821
  Subcellular localization annotation: CTP_CleavageSite=48; ConfidenceScore=5.42e-01
MDVWGANTFPMRKYNSRTFHLKVRRSRLFRFFRRFSQINVGGDSARIPFMEHASRESRVALPPKGRLRQPVHEREADPPTHIMEMLEDPTMPVLRLSSTPLATPVLHLTDEEDMQDQDTQGTQDHSQEF

SEQ ID NO: 165507 - protein, 235 aa, Glycine max
  Coding DNA Sequence Number=SeqID_73822
MASRKRKSTTYKPQAHPKDQSPKQVRVRGHLIKIDANSLNTFLETPVVLEKGETLPTYSRFTRMRIDPQEFSGHLCIPGRGFVLNAEGNPWKLLRKDLTTLAQTWSVLSYSNLTPTSPPLILIWTKPALISGQISTIAQSNSSRLEFTTLITALCGARGVTSNSLTYESLILAINLAYIKKNCWNVDDLTINFRGARKVRARPADIPSSFAPPTPPTSTTPTLAAPTSTTPTPAA

SEQ ID NO: 165508 - protein, 82 aa, Glycine max
  Coding DNA Sequence Number=SeqID_73823
MSNHKSTELALKNLEIHVGQLAKQLAEKSSNNFGENNEKNPKEECKVFVTRSRKLVVAEDDDVVALKEQVALKDTTVKKKNK

SEQ ID NO: 165509 - protein, 321 aa, Glycine max
  Coding DNA Sequence Number=SeqID_73824
MVIYPFVEDSMSFDRDYYSLFSFVIQTQLSLMARRGKYGHLPFFRRLNVFRSRLLQSPLPSIDNQVRWHAETNMVIYPFARDLMSFNRDYYSLLFRLKTIKSDGTQRQICSSALLLETQCLLTETITVYFVVQRQSSPMARRDKYGHLPLWSETQCLSTKTITVSFAIQRQSSSMARRDKYGHLPFYQRLNVFQPRLLQSPFTIQRQLSPMACRDHHGPSLLLFPETILVSFTIQRQSSPMIISILFVFQRQASPLACRDYQCLLLFIFFNVYQSPLSRLRCLPYFVRLQGLFLIYLMPLMLFLLTGFADRASGRLAGAIA

SEQ ID NO: 165510 - protein, 83 aa, Glycine max
  Coding DNA Sequence Number=SeqID_73825
  Subcellular localization annotation: CTP_CleavageSite=53; ConfidenceScore=5.06e-01
MLATHYGYRATAKKPASNCFFTSSFIFKDISGFILHSFCFTGEQPGFKGNLCCTMSGFKPGISWYDQVIKVVPESNKHEKCSI

SEQ ID NO: 165511 - protein, 38 aa, Glycine max
  Coding DNA Sequence Number=SeqID_73826
MPSMEMALKKLPAKRSRKGITEEGSNVVPQADTDFNRH

SEQ ID NO: 165512 - protein, 93 aa, Glycine max
  Coding DNA Sequence Number=SeqID_73827
METPHAFVNQRQVSPLVETTLVSPSSSRDGKFNDMRRPIMVIRWLHQPEASEPIDRDYFSLTFIIQRQQADDTRRPIMVICHLCQPEANELVD

SEQ ID NO: 165513 - protein, 251 aa, Glycine max
  Coding DNA Sequence Number=SeqID_73828
MPISPCESIGWYVPSRHSSGYGPLSVLQGARITPAGHPVDPKKSNRVLGFPALITSLCQFYGVPVTPSKVIRPPTNRAFIKKYCAPMQAEDNKCTAATSRPPQLIHKKVRDRQVIMRPAQDVKEAILGGNLTQEPERPSLLTHNALGIMVHLQSLPWCPMHAFKKEANELAKHTSKYKELKVKKHEYKEPNVATQDVPTVDWGYESGVDGFLLKCVNMTAALRVMREVHEGICGSQRLGPKILPRILADCV

SEQ ID NO: 165514 - protein, 318 aa, Glycine max
  Coding DNA Sequence Number=SeqID_73829
MDHVALSAFIPADEQKLSANMLLLVSPLNKAKRSCCAKPLLCVEKVELSVPCGAKLNSLTVFEFTSPKAWERYTNIIVPRKLLLERNVVIYDIEFHEFKEELERRRWDEELTSFEEGSIDVAIVKEFYANLYDPEDKSTMQVRVRELAAKLCIPGRGFELNVDGQPLKILKKNMTTLAHTWSVLSYSNLIPTSHTSDIPLDRTKLIYGIIMKMDMNLSYLISHQISIIAQHDSSRLGFPALITTLCKSRGVTIRLLASAPDRANTLAHPEGEDGALGKLAFAQHLYTTHPSSRIVHALSHQMGCLADDALSQKMSGFA

SEQ ID NO: 165515 - protein, 64 aa, Glycine max
  Coding DNA Sequence Number=SeqID_73830
MVCKGWSFDGASMVRKKKGIATNFQDVTLSERISRLACSLDIDALLDSSASLSTLKLRLAMDAR

SEQ ID NO: 165516 - protein, 103 aa, Glycine max
  Coding DNA Sequence Number=SeqID_73831
  Subcellular localization annotation: CTP_CleavageSite=33; ConfidenceScore=5.54e-01
MVEGGWIYKERPFLFSHNSFFLSFFLSFFFSPRAPSSSSPSSSTLPSQGALSSLELELFMVDDYISFLLLSFNGRKSLGWSLGSCYSIFFFEKPSSFLLVMEG

SEQ ID NO: 165517 - protein, 53 aa, Glycine max
  Coding DNA Sequence Number=SeqID_73832
MCWWGLGGRLFAFGAHEDPATTFSSSSLSSSRLQILPSSETGLGIRLPNETID

SEQ ID NO: 165518 - protein, 120 aa, Glycine max
  Coding DNA Sequence Number=SeqID_73833
MGASGNRLPACVIDYTEEWVTDEPARTLQRTVEWILPTPTPYRLVEPAQVIEVTSSEEDPEEDLEELPPEPAVDALDFLEGDEDPLLEVDSPEEVMSASEADSTEDSGPREMAISGGSSS

SEQ ID NO: 165519 - protein, 122 aa, Glycine max
  Coding DNA Sequence Number=SeqID_73834
  Homolog annotation: Hit_ID=A5AWL4; Match level="QueryCoverage=89%, HitCoverage=16%, E-value=2e-12, Identity=37%"; Hit description =Putative uncharacterized protein
MNSFILQGAKVQRKYGKCLKSVMKAQWITWEPKITVIKESKDLTSMSMEALFGKLLAYEHELIQQSRAEETEKKRKGIALKENSSKEDYKENSSDGEDAENFSLMVEKFGKFLKKSYKEDRK

SEQ ID NO: 165520 - protein, 88 aa, Glycine max
  Coding DNA Sequence Number=SeqID_73835
MEAMKEKMITMMEAMMSMRKMMEVNMATIVAASTATKVDPTHPSGLNHIKHSFPPYGLPPNHTPPNVAHTTDEIVDNSAPIPIESQHP

SEQ ID NO: 165521 - protein, 353 aa, Glycine max
  Coding DNA Sequence Number=SeqID_73836
  Homolog annotation: Hit_ID=A7UQU7; Match level="QueryCoverage=71%, HitCoverage=55%, E-value=1e-29, Identity=31%"; Hit description=IMP dehydrogenase/GMP reductase, putative
  Pfam annotation: Domain name=DUF1723; Domain location=84-133; Score =46.3; E_value=1e-10; Accession=PF08330.1; Description=Protein of unknown function (DUF1723)
MIRTRGLCQALVVVEDVEHEDHAVDKVHEEPKETVTDHVGIDIKGFSGGPYDTSVLASYVDHVTTKVWAGEERTELKLGLSWEEGDRGILSTFVERWHKETSSFHLPIEELTITLDDVLSLLHLPITGVFHTFDAIDVEEVVDFKCDARQWIIAAQAYLLLLVGCTLFANKSATHISVAFLDAFHDLNQYGGYSWGAVSLVHMYENMNVASKHTTKHLAGYITILQIYGHFPKIVSIIADEDYHERKPHACCWKSGKALPVTTYHKRLDRLTLDAVCWISYGDHRAFREFELVSLFSEHIRWVSVVGPCQKIAESLEHMINIRIVTAGTDAYTFTEHCLRLARSVTDQGNVYV

SEQ ID NO: 165522 - protein, 414 aa, Glycine max
  Coding DNA Sequence Number=SeqID_73837
  Gene Ontology: Mol. function=voltage-gated potassium channel activity; Cellular component=integral to membrane; Biological process=potassium ion transport
  Homolog annotation: Hit_ID=A7QJQ9; Match level="QueryCoverage=35%, HitCoverage=26%, E-value=3e-41, Identity=51%"; Hit description =Chromosome undetermined scaffold_107, whole genome shotgun sequence
MPAIEDEELLTSTMSTWRENTTLKMPGLLNTNEHHDRRTQTPGAEEEDDAHGGNAARRTEGSNSSFLFPMELKKGKLARFYTDGKKHKQSFWGARATEPPALKPSNLLPLGKNRIAETFRIGGSKVFPEDHEPWRKRILDPGSDIVLKWNRVFIVSCLVALFVDPLYFYLPSVIENTGTAYVAPSSRVFGRGELVMDPKKIARRYIRSDFFIDFIATLPLPQLFFLASASNNPPPPPPVTTEVAVHNETPVNVDAATLVELVIKVHRLHYLLTNPQIPPRYASLADRNTGNVSSEFLLWEQQAQLLSWLQSTISGEVLPHLIVSTEHVDNILDGLPDEFESLVTLISCRFESLTIDEVETLLAPNVAQANTDSTYYNYNGGNRFPNNGRGGGHNFSPGGRGDSRGYGDGCGGCG

SEQ ID NO: 165523 - protein, 817 aa, Glycine max
  Coding DNA Sequence Number=SeqID_73838
  Gene Ontology: Mol. function=transcription regulator activity; Cellular component=transcription factor complex; Biological process =regulation of transcription, DNA-dependent
  Homolog annotation: Hit_ID=A7QDL2; Match level="QueryCoverage=55%, HitCoverage=95%, E-value=1e-90, Identity=39%"; Hit description =Chromosome chr10 scaffold_81, whole genome shotgun sequence
  Pfam annotation: Domain name=Enolase_N; Domain location=485-620; Score=69.3; E_value=1.3e-17; Accession=PF03952.7; Description =Enolase, N-terminal domain
  Pfam annotation: Domain name=TFIIB_Zn_Ribbon; Domain location=5-38; Score=6.4; E_value=0.067; Accession=PF08271.3; Description=TFIIB zinc-binding
  Pfam module annotation: Pfam domain module=Enolase_N::TFIIB_Zn _Ribbon; Domain location=485-620::5-38
MSKSSPCTYCGEASFIHDDISSELICSSCGGVQQFDQFDGPQGTFIHIAPSSDVRSMISTITEGEFGQGEWFKVLIGACIYVVMRKEDRPLPMAEVASTIGIDVYEISRMILRVVDFLNLRPDFPEFDIVHLLERMIRNCSGCASAERNLIERMRKQGMFLIQCAVKWYLSIEWRPVPLVVAVLVFMVELNGVGVGMEELAKEVHARVSTCRARYKELLETLVKGAQVLPWGKDVTVKNIIKNALVGIQYMERNAMLKHGEKREEGLDQATVDLKDVVVECLRNDGEFEYGVDGMSKRKDSRYFMLESNAGRVGGGDSERQQISLECLSVLYKKFLDENNCAESLRGSGKGKSEMSKKLLLKYLLEKDVEVDTMSPSFVNGQLKCKMRRERINASMVRIKRIMHQSNADLADAEIPGTLDGSYPESRRKKRKGMVVDDVDWEDLIIETLVLHQALCEKFQIYYPLTFLSQLLGAKKKNLVGFSIATSQFRVARVDSIRGDPSGKIGRAFKEEIHKKLRSVPDSKPKKKRGGFPLWKKKERYAITDMRKLANRMQFGVPEESSLGKEKKECRNQTNVDAIMLEIDGTPNKSKLGANAILGVSLSVCRAGAGAKGLPLYRHIQEISITKELVMPVPAFNVINGGNHVGNNMAMQETLESDQFPLLNDPNKACIYVIKSGNLLYNKEKNKMKDCKNTSGEDVSFTSRISQSLTNSSQALITASASNSHLCRSSHSKISQNSLELGPFSLLNFLNIQKLQAKARLSCMQRLLQEKCQTPFANLISSLNRWPSEAVCLMTWSGALSEPDSSSSSGFFLALSH

SEQ ID NO: 165524 - protein, 380 aa, Glycine max
  Coding DNA Sequence Number=SeqID_73839
  Gene Ontology: Mol. function=phosphopyruvate hydratase activity; Cellular component=phosphopyruvate hydratase complex; Biological process=glycolysis
  Homolog annotation: Hit_ID=A9P745; Match level="QueryCoverage=62%, HitCoverage=48%, E-value=1e-115, Identity=87%"; Hit description =Plastid enolase
  Pfam annotation: Domain name=Enolase_C; Domain location=102-380; Score=447.4; E_value=1.9e-131; Accession=PF00113.13; Description =Enolase, C-terminal TIM barrel domain
MDGKSKREIHYTISLQWMRKIAVEGIQDQAFEELWKLKELPILYKHGRGGRTYVLPLQKSHTYLVGNTILGEEFYSSVGTRANRWKCWWLAVTWTIWQQRNKMIFSNESFDNNKVMEDATFLLWTWLRYLEKDFSMHFNQWTSNLRAKYGQDACNVGDEGGFAPSVQDNREGFVLLVDAIEKAGYTGKIKIGMDVAASEFYTKDGKYDLNFMKQPNDGAHVHSTQSLGQLYKNYVKEFPIVSIKDPFDQDDWGSWASLLASVDIQLVDDLLVTNPKRIAEAIKKKACNGLLLKVNQIGTVTESIQAALDSKAAGWGVVVSHRSGETEDNFIADLSVGLASGQTKTGAPCRSERLAKYNQLLRIEEELGSVQYAGETFRSP

SEQ ID NO: 165525 - protein, 301 aa, Glycine max
  Coding DNA Sequence Number=SeqID_73840
  Gene Ontology: Mol. function=hydrolase activity
  Homolog annotation: Hit_ID=A7PGJ7; Match level="QueryCoverage=85%, HitCoverage=85%, E-value=4e-81, Identity=58%"; Hit description =Chromosome chr17 scaffold_16, whole genome shotgun sequence
  Pfam annotation: Domain name=DUF1637; Domain location=18-299; Score =298.0; E_value=1.8e-86; Accession=PF07847.3; Description=Protein of unknown function (DUF1637)
MIAKLKGCFEELICGNLACCWILMSLILSNYSMNIEKYDSGQLLSDTIQPADVGLKEEIADDDRGHGFFGANALSRLARWAQPITYVDIHECDSFTVSFTIYYTPVTPLLPLHCCKLHVYARVCLLKYVSFLSSEYWYQMCIFCFPTSSVIPLHDHPGMTVFSKLLYGSLHVKAYDWVEPPCIIESKEPGYAQVRLAKLAVDKVLNAPCDTSVLYPKHGGNLHCFTAVTPCAMLDILTPPYREEEGRRCTYYHDYPYSAFSVANAPICDGEEEEYAWLTELESPSDLYMRQGVYAGPAIQL

SEQ ID NO: 165526 - protein, 61 aa, Glycine max
  Coding DNA Sequence Number=SeqID_73841
MVNIDTKVEFGTKAQTEQNNPTQLTLCCSKLSNATITSVAMNLTRIARLSNDSLSHPYSKT

SEQ ID NO: 165527 - protein, 92 aa, Glycine max
  Coding DNA Sequence Number=SeqID_73842
GSCLQDTQWTRRSPTWSWSCQALITGLCQFYGVSVTSNKVIRPPTNRAFIKKYCVPRQVQDKTPQQPRDGRQRATDAPPSPLEFTSAHPEKG

SEQ ID NO: 165528 - protein, 143 aa, Glycine max
  Coding DNA Sequence Number=SeqID_73843
MVAQLIHDRVVMECLEGVWETLEGNERCRFHGTIRLTATSLVHPEEPARTLQQPVEWILPTPTPYRLVEPVQVIEVSSSEEDLEEDPEELPPKPAVDAPDFPEDDEDPLTDVDSPEDVMSASEADSTEESGPGGTANSDDSSA

SEQ ID NO: 165529 - protein, 48 aa, Glycine max
  Coding DNA Sequence Number=SeqID_73844
MEASIPSPLSNAWKSYQNNERKSLRNLRKLFEMPLSLLEYTWVLKGSN

SEQ ID NO: 165530 - protein, 52 aa, Glycine max
  Coding DNA Sequence Number=SeqID_73845
MFYKSSHYPDLHFAIRVLWSSRPRCWHSQASEIGASVFASERDTMRSQASEA

SEQ ID NO: 165531 - protein, 34 aa, Glycine max
  Coding DNA Sequence Number=SeqID_73846
MAAPFFSTPFQPYVYQKKISNSRIKLDQASWARA

SEQ ID NO: 165532 - protein, 271 aa, Glycine max
  Coding DNA Sequence Number=SeqID_73847
  Homolog annotation: Hit_ID=A5BU47; Match level="QueryCoverage=36%, HitCoverage=5%, E-value=7e-08, Identity=34%"; Hit description =Putative uncharacterized protein
MIHSSWQCKLDRCFMSKIHDSRWSVVLQGRTTCIDDLIDGSTLDVNEMSAFCEQMPFINGEDQEDDVHANRNDHDEGLWENIRILMATPKRSPPHPSEAMSRKTRQSSRLRRLIVRSLDQPQPMINVNPTTGRGSGPHKEKFHSYLGVLAREKIPILHSNWNDVPESLKNLGNFDILEGDNAKKKVMSTVATRWRKFKSSLTTKYVYVDNDDQQKDDPFVKYVIDAATWAEFAKSHQTPNWQTCEVEDGPHKAIWADDLYNSPRNIRQHCE

SEQ ID NO: 165533 - protein, 30 aa, Glycine max
  Coding DNA Sequence Number=SeqID_73848
MAFGGPVARPSELRLSHEVIGSPRWARGSG

SEQ ID NO: 165534 - protein, 188 aa, Glycine max
  Coding DNA Sequence Number=SeqID_73849
  Gene Ontology: Mol. function=nucleic acid binding
  Homolog annotation: Hit_ID=Q2AA09; Match level="QueryCoverage=96%, HitCoverage=60%, E-value=1e-09, Identity=29%"; Hit description =Retrotransposon gag protein
MERSMIDAASGGALGDMTPAEARNLIKKMASNSQQFSARNDAIVLRGVHEVALDSSSSTENKKLEGKLDALVNLVTQLAMNQKSTPAVTVSGLCSSADHHSDLCPSLQQSEVNEQPEAYATNINNRLPQQQNQQQQNHYDLSSNRYNPGWRNHPNLRWTSPPQQQQSIPPFQGAAGPSKPYVPPPMQQ

SEQ ID NO: 165535 - protein, 177 aa, Glycine max
  Coding DNA Sequence Number=SeqID_73850
MGEAREEPWDHALGDFELYPTYAVEGPAFGGIPQPNVVGAPQHHPLQPLHFSIGRLPPTMEERDKFDLIEERLKVIEGIGDYPLADMAELCLVPNVIIPTNIPRINQITQPTSETLPIRHLCPIKIAHSTTKASPTKFVSHTVSTHQKLQSQHKHKPEEEFPGKKALGVHSDTNALC

SEQ ID NO: 165536 - protein, 177 aa, Glycine max
  Coding DNA Sequence Number=SeqID_73851
MTLLLSNIPLGDRNADLPLRKHQLDHTRKTPSGPGEVQQGPGVSSSSYGPLSVLQGARSPQQGHAILGVAPTRHLVDPKEPNRALGFPALVTGLCQTYRAPVPPASSSHRDIGTAPARHPVDLKKSNRVLGFLALITGLFQFYEAPVAPNKVIRPPINRAFIKKYCAPRQAQGETPQ

SEQ ID NO: 165537 - protein, 166 aa, Glycine max
  Coding DNA Sequence Number=SeqID_73852
MLQSIHQGQIILLQSLQLVAPPDSIPMVEQFIEWVAWPGTQPPLHREHEDPATQVPHQSEDESSDSSTPEPLIRKRRVVVTHEAASTFEKSLEASPELPALVADTTSPQQAAEPSTPKDQTTPVLSPNTSPVATPVLHLLEEEEGQTWTSCPTWTSRFFNADLVLL

SEQ ID NO: 165538 - protein, 156 aa, Glycine max
  Coding DNA Sequence Number=SeqID_73853
  Subcellular localization annotation: CTP_CleavageSite=16; ConfidenceScore=5.01e-01
MSLPSAVHVSSIIKRRASAKKEGVETRVVVTERAGRTESMSYLFFPLISDERKSKPRRFRNVSVSLAFARPVESPTVTTCPFAGERRRGSRVHFPEEERCAESPPTFICGKRRKNRRKPVKMKILSSGVVFTFEEGRQKRGFCSYVLSIEEEIRPT

SEQ ID NO: 165539 - protein, 261 aa, Glycine max
  Coding DNA Sequence Number=SeqID_73854
  Homolog annotation: Hit_ID=Q9AVH2; Match level="QueryCoverage=18%, HitCoverage=16%, E-value=1e-19, Identity=97%"; Hit description =Putative senescence-associated protein
MCPVVGFGPWLGLGKPLVEILPPGQLRGFCPLLAWLGSAVLGYGPVLSFGLVGPLLPPVISFVARILPTLACAPLAKSVPRVVGSSCHNMARHKVTRTHTHTHSRRHKGEEGAWSSVRPGTHLVSTRQAKRERADERGGTNQATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 165540 - protein, 144 aa, Glycine max
  Coding DNA Sequence Number=SeqID_73855
GHHDLLICEVISVTGIYSEQSASAVPPVQLLTGWCVTAKAPPDISAGKCSGHAARRVPFAIQAAQLLGRAIGAGLFAITPAGERGMCCKAIKLVGKPVVPAALMNRPTRGERRVAYCALAECILSYYVGTDDGVSEVLLVAREY

SEQ ID NO: 165541 - protein, 58 aa, Glycine max
  Coding DNA Sequence Number=SeqID_73856
MEKSDKRNFKEKKTYITWEDNDMDSSSDSENEIINLGLMAKDDYERREKIKINVLQNA

SEQ ID NO: 165542 - protein, 102 aa, Glycine max
  Coding DNA Sequence Number=SeqID_73857
MFKIESRTLQGSRGKLKNTSRFKRKVEFKNQESRIKIQGSSFKNQDQDSRLKIQESREDLIKISMKRIFQKVSSTWIFLKTCLPKSFYSLVIDYQIIVIDYQ

SEQ ID NO: 165543 - protein, 109 aa, Glycine max
  Coding DNA Sequence Number=SeqID_73858
MEENSESALSTNKEAISNATRNLMESSILAQDERWRHALHMQVGREVVFPVADGWSERMISHTGTETRPRLLRRQQWGIFRNGRKPDGAMPREGRRPTGHELLFPEKKQ

SEQ ID NO: 165544 - protein, 156 aa, Glycine max
  Coding DNA Sequence Number=SeqID_73859
LPEGLSDPINCVSRSALARVLFLYERDSIQICHSLGDALFSMNTPPLNDELCQSSPPTRPGENTESSQALTRQNGIHISFVCQPQNARIKGSGKKHWLRLSRRWGIQGNSRALIEEVAQPFFIYAKRNYFLFYSTGNGASRSIPKAGNAESRIRQY

SEQ ID NO: 165545 - protein, 154 aa, Glycine max
  Coding DNA Sequence Number=SeqID_73860
MASRKRARTDDIPSSSNPAPPTPAMELDVQHSHTGQLTIMYNQQELAHNRPIISMEHFLEKVAWPEAQLPLEKFHEVVPPEPAPARTEPIPAEPQPPVVDAPPSLELEILSPPPAPAPPLIIISDLSSDEDAAPLDSPSCNIDDGSDFSDWMNC

SEQ ID NO: 165546 - protein, 70 aa, Glycine max
  Coding DNA Sequence Number=SeqID_73861
MVYYVDDVVNEGWSVVVHIKPRDLYDMGEEVEENAYENEPYQEQQLEQFSRLDDQYVQLATNHLNDDIVD

SEQ ID NO: 165547 - protein, 102 aa, Glycine max
  Coding DNA Sequence Number=SeqID_73862
  Gene Ontology: Mol. function=chitin binding; Cellular component =extracellular region; Biological process=chitin metabolic process
  Homolog annotation: Hit_ID=UPI000069F178; Match level="QueryCoverage =89%, HitCoverage=22%, E-value=5e-09, Identity=37%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
  Subcellular localization annotation: CTP_CleavageSite=93; ConfidenceScore=5.33e-01
MARTCSPLKVRTCSPLKVRACSPTKVKAHDPLTARTCSPLKLKVRACSPLKARTYSPLEVRACSPLVVRTCSPLKARTCSPLKARTCSPLTVRVTSTQGEGV

SEQ ID NO: 165548 - protein, 64 aa, Glycine max
  Coding DNA Sequence Number=SeqID_73863
MLSFDFRHVTELHELPNDGCQALDLKTVLSYPNFVRGPLFGGVRLSFDHFEVLCTHCCTIREVS

SEQ ID NO: 165549 - protein, 95 aa, Glycine max
  Coding DNA Sequence Number=SeqID_73864
MPFTVYRDRARKTPSGLEEVQQGPRVLALITGLCWFYGVTTTPISPCRSVSYSDYEPPSILRSARRPQQGHQAPINRAFIEKYCAPWQAQGEASQ

SEQ ID NO: 165550 - protein, 152 aa, Glycine max
  Coding DNA Sequence Number=SeqID_73865
  Homolog annotation: Hit_ID=A6NQ44; Match level="QueryCoverage=28%, HitCoverage=44%, E-value=6e-11, Identity=81%"; Hit description =Putative uncharacterized protein
PVERSKDLLEILFSARNLLLANKKTTATSGGLFAGSRATNSFSEGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFE

SEQ ID NO: 165551 - protein, 94 aa, Glycine max
  Coding DNA Sequence Number=SeqID_73866
MKVDDREKEDIQDEDVIVEEIAREPIKTKSQLIQEAKQAIIREKLYPHKPTKQDKERFLMMPKYNKTRLLQEIFKVKQTEIASRLIQGQANKIK

SEQ ID NO: 165552 - protein, 177 aa, Glycine max
  Coding DNA Sequence Number=SeqID_73867
  Homolog annotation: Hit_ID=A6FJQ2; Match level="QueryCoverage=21%, HitCoverage=84%, E-value=4e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARLGHHFKNSVAPPTYLALLILLPVAAASGDKSCLTGATLPEGRKADRYPVSGRVGTGERTRELPGGNAWGAEPMENASNAAFLRFLAFCWPFAH

SEQ ID NO: 165553 - protein, 49 aa, Glycine max
  Coding DNA Sequence Number=SeqID_73868
MSLSLEDKLIMQVLEKRASAKRNTPELSARKNPEEDELYKFAKHTASSL

SEQ ID NO: 165554 - protein, 137 aa, Glycine max
  Coding DNA Sequence Number=SeqID_73869
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MGVVDALVARSAGNKLMSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 165555 - protein, 377 aa, Glycine max
  Coding DNA Sequence Number=SeqID_73870
  Gene Ontology: Mol. function=4-alpha-glucanotransferase activity; Cellular component=cytoplasm; Biological process=carbohydrate metabolic process
  Homolog annotation: Hit_ID=A6TF39; Match level="QueryCoverage=71%, HitCoverage=49%, E-value=1e-76, Identity=62%"; Hit description=4 -alpha-glucanotransferase
  Pfam annotation: Domain name=Glyco_hydro_77; Domain location=2-294; Score=-44.6; E_value=1.2e-09; Accession=PF02446.8; Description=4 -alpha-glucanotransferase
MAGNTGRPNGSSATVQQCWRFALSTATSVRFYMWLQWLAAEQFAACWQLCQQQQMAIGLYRDLAVGVAADMDESAAHGAYVHYPVDDLLAILALESQRHRCMVIGEDLGTVPEAIVDKLRDAGVYSYKVLYFEQESQRHFRAPATWPRQAMAVTTTHDMPTLRGWWQSDDLRLGSALGLYPDRAILAGLYRDRRLAKQALLRTLLRSGDLPPRRRFRRASVRMSHQLSQAIHRYLARSQCALLGLQPEEWLDMALPVNVPGTVDQYPNWRRKLSVTLEAIAEDDRIDALLTAVGQLSTVGAVSPLAFNTADKGLPRRCRSQTLRFIQQLQRFIDIALLHRLTNALIEIAFRLIYQWCRFRRWRARRRGGHGRPGAAN

SEQ ID NO: 165556 - protein, 363 aa, Glycine max
  Coding DNA Sequence Number=SeqID_73871
  Gene Ontology: Mol. function=maltose transmembrane transporter activity; Cellular component=periplasmic space; Biological process =carbohydrate transport
  Homolog annotation: Hit_ID=P0AEY0; Match level="QueryCoverage=100%, HitCoverage=91%, E-value=1e-175, Identity=80%"; Hit description =Maltose-binding periplasmic protein precursor
  Pfam annotation: Domain name=SBP_bac_1; Domain location=7-314; Score =174.7; E_value=2.4e-49; Accession=PF01547.16; Description=Bacterial extracellular solute-binding protein
MKTGARVLALSALTAVLFSASAVAKIEEGKLVIWINGDKGYNGLAEVGKKFKQDTGISVTVEHPDKMEEKYPQVAATGDGPDIIFWAHDRFGGYAQSGLLAEVTPDQNFQQKLFPFTWDAVRFNGKLIGYPVSVESLSLIYNKDLLPTPPKSWEEMAALDKQLRAKGKSAIMFNLQEPYFTWPLLAAGGAYAFKKTDSGYDVKDTGVDNAGAKAGMQFLVDQVKAKILNADTDYSIAEAAFNKGQTAMTINGPWAWSNIDKSGINYGVTLLPTLNGKPTKTFVGVLSAGINAASPNKELAKEFLENYLLTDAGLNAVNKDKPLGAVTLKSFQQTLEKDARIAATMSNARNGDIMPNIPQMAAF

SEQ ID NO: 165557 - protein, 165 aa, Glycine max
  Coding DNA Sequence Number=SeqID_73872
  Gene Ontology: Mol. function=quinoprotein glucose dehydrogenase activity; Cellular component=outer membrane-bounded periplasmic space; Biological process=electron transport
  Homolog annotation: Hit_ID=Q1R174; Match level="QueryCoverage=71%, HitCoverage=17%, E-value=6e-57, Identity=83%"; Hit description =Quinoprotein glucose dehydrogenase precursor
  Pfam annotation: Domain name=PQQ; Domain location=63-101; Score=31.4; E_value=3.2e-06; Accession=PF01011.12; Description=PQQ enzyme repeat
  Pfam annotation: Domain name=PQQ; Domain location=7-45; Score=12.1; E_ value=0.36; Accession=PF01011.12; Description=PQQ enzyme repeat
  Pfam module annotation: Pfam domain module=PQQ::PQQ; Domain location =63-101::7-45
MVANNWLGMPCWQPPFGEIVALDMHTGDVKWRRPVGASQQYGFFMPESWGSPTIGGPAVTAGGVIFIGASMDAKVRAYSLDSGEELWSDQVEAPAVANPSVYEYKGRQYVAFVAGGGGLRTAGIIQRSQQTQWGHSAPLFYACIKTAAIGRQNLNRWLPLRKQWY

SEQ ID NO: 165558 - protein, 175 aa, Glycine max
  Coding DNA Sequence Number=SeqID_73873
MARKDKLWSFCTLLSSRGGGPDDMRRQNLVIPHPFAIKTQSCPMARRDKIWSFCTLCHPEAAGPMTCGDKIWSFRTPLPFRHSPCPMARRDKIWSFCTLLSSRGGGPDDMRRQNLVIPHPFAIQTQSCPMARRDKIWSFCTLLSSRGGGPDDMRRQNLVIPHPFAIHSLSWQLTF

SEQ ID NO: 165559 - protein, 99 aa, Glycine max
  Coding DNA Sequence Number=SeqID_73874
  Subcellular localization annotation: CTP_CleavageSite=59; ConfidenceScore=5.02e-01
MLVRTIRICLFAVAQVKSCPGMHSSYVIASLSGCIRTVGPLQYQGMWSPLKARTRSPLKARACSTLKLRTCRLLKARTCSPLKVRTCSPLKARTCSPLK

SEQ ID NO: 165560 - protein, 329 aa, Glycine max
  Coding DNA Sequence Number=SeqID_73875
  Gene Ontology: Mol. function=DNA binding; Cellular component =chromatin; Biological process=regulation of transcription, DNA -dependent
  Homolog annotation: Hit_ID=A7NX44; Match level="QueryCoverage=69%, HitCoverage=52%, E-value=3e-48, Identity=53%"; Hit description =Chromosome chr5 scaffold_2, whole genome shotgun sequence
  Pfam annotation: Domain name=DUF296; Domain location=127-244; Score =199.6; E_value=7.5e-57; Accession=PF03479.6; Description=Domain of unknown function (DUF296)
STQFRVGKASDLLVLERKHSQHSTEILANPWWTGHQVGLGVGVDPAATNSPSSNLNKRHMDLSINERSLVRERQEEEEEEEDERDNGDEPKEGAVEAGTRRPRGRPPGSKNKPKPPIFVTRDSPNSLRSHVMEVAGGADVAESVAQFARRRQRGVCVLSGSGSVANVTLRQPSAPGAVVALHGRFEILSLTGAFLPGPAPPGATGLTVYLAGGQGQVVGGSVVGSLVAAGPVMVIAATFANATYERLPLEEEEDDGGGSVQGGSTLGGSPHGIGSSGGGGGSGGGHLPGGIPGPSSLPLYNLPPNLLPNGGQVGHEAFAWAHGHGRPPY

SEQ ID NO: 165561 - protein, 175 aa, Glycine max
  Coding DNA Sequence Number=SeqID_73876
  Gene Ontology: Mol. function=transition metal ion binding; Cellular component=nucleus; Biological process=transcription initiation from RNA polymerase II promoter
  Homolog annotation: Hit_ID=A5BA15; Match level="QueryCoverage=42%, HitCoverage=74%, E-value=1e-28, Identity=79%"; Hit description =Putative uncharacterized protein
  Pfam annotation: Domain name=Cyt-b5; Domain location=88-174; Score =19.6; E_value=0.0013; Accession=PF00173.19; Description=Cytochrome b5-like HemeSteroid binding
MADTIHGEELIEGEEILVKKKIKFSHASCARRREAQNSKDLEADIPCAGSMFSHASCARRREAQNSKDLEADIPYAGSMLLYEKQRVTRKVKWFDDQKGVGRVYDVSTGKSFYGPGGPYAMFAGKDTSRALAKMSKNNDDISPSLVDLSNKEIGVLNDWENKFQAKYPVVARVLN

SEQ ID NO: 165562 - protein, 389 aa, Glycine max
  Coding DNA Sequence Number=SeqID_73877
  Gene Ontology: Mol. function=protein serine/threonine kinase activity; Cellular component=phragmoplast; Biological process =protein amino acid phosphorylation
  Homolog annotation: Hit_ID=Q53VE2; Match level="QueryCoverage=99%, HitCoverage=54%, E-value=1e-80, Identity=82%"; Hit description =Ser/Thr protein kinase
  Pfam annotation: Domain name=Pkinase; Domain location=216-382; Score=- 5.3; E_value=2.6e-08; Accession=PF00069.16; Description=Protein kinase domain
  Pfam annotation: Domain name=Pkinase_Tyr; Domain location=213-389; Score=-125.2; E_value=9.6e-05; Accession=PF07714.8; Description =Protein tyrosine kinase
  Pfam module annotation: Pfam domain module=Pkinase::Pkinase_Tyr; Domain location=216-382::213-389
MKSEKNKETTGVTKEGSRPPTNEEAPSNVTKQRVEAAKQYIENHYKKQMQSLQERKERRNMLEKKLADAEVSEEEQHNLLQHLEKKEREIMRLQRHKMGADDFEPLTMIGKGAFGEFWPLERANSKPELEPGQITSRSRSWLWNCKINDPEEPLLSGLRWVSGSAWTDPVEELDLLSLLERAASFYPSALCWNPALTAAMATVVFILDYFAVVITIQVVVAIAFGIRAVRICREKATGHVYAMKKLKKSEMLRRGQVEHVKAERNLLAEVDSNCIVKLYCSFQDEEYLYLIMEYLPGGDMMTLLMRKDILTEDEARDIKPDNLLLDRNGHMKLSDFGLCKPLDCSNLQEKDFSVGMNRSGALQSDGRPVAPKRTQQEQLQHWQKNRRML

SEQ ID NO: 165563 - protein, 86 aa, Glycine max
  Coding DNA Sequence Number=SeqID_73878
  Gene Ontology: Mol. function=cyanate hydratase activity; Biological process=cyanate metabolic process
  Homolog annotation: Hit_ID=A5BJL8; Match level="QueryCoverage=69%, HitCoverage=36%, E-value=7e-19, Identity=76%"; Hit description =Putative uncharacterized protein
  Pfam annotation: Domain name=Cyanate_lyase; Domain location=8-61; Score=47.8; E_value=3.9e-11; Accession=PF02560.5; Description =Cyanate lyase C-terminal domain
MEQDYYSELMRLMLEAIKNAIPKAAMSAIDFYCSVDKIKGVDGKDRVVLTFDGKYLPHSEQKSEHMVSRTRPLGKQKTLEEKNKSV

SEQ ID NO: 165564 - protein, 68 aa, Glycine max
  Coding DNA Sequence Number=SeqID_73879
MLEEVPAKRTQTIKSVKPKVFCASMYGVIENGASGHQALSSLRVIESYVSSDHDGDLGLMITCRVHRL

SEQ ID NO: 165565 - protein, 169 aa, Glycine max
  Coding DNA Sequence Number=SeqID_73880
MGLNAGNNLFVCWVPRGSSLCESMREGYCTQPYPCICKEAVSGFEPMTNKGCSENDIIYIKKDVGRVIAIVQQQQWAVPPWAAPWQPWATPPCPYPTTPNWQHQSTPRQQGILGPKPPQAHMAATSANNAQPSYASTDIQAAMHTLSMAPPDDQWYMDTGATSHMTANG

SEQ ID NO: 165566 - protein, 602 aa, Glycine max
  Coding DNA Sequence Number=SeqID_73881
  Gene Ontology: Mol. function=receptor activity; Cellular component =mitochondrion
  Homolog annotation: Hit_ID=A5C6D9; Match level="QueryCoverage=99%, HitCoverage=99%, E-value=0.0, Identity=61%"; Hit description =Putative uncharacterized protein
  Pfam annotation: Domain name=DUF668; Domain location=432-521; Score =194.1; E_value=3.5e-55; Accession=PF05003.3; Description=Protein of unknown function (DUF668)
MVAEAWIVKMGNQVSSNLKHALLLETLTKRKPNHKRSDTKETIGILSFEVANVMSKTVHLHRSLSESEISKLRNEILDSEGVRNLVSSDEDYLLELALAEKLEELNRVASVVSRLGKKCSEPALQGFEHVYGDIVGGVIDVKELGFLVKHMEGMVRKMDRYVTVTRNLYSEMVVLNELEQAVKKFQHNQHEESRRAFEQKLIWQKQDVRHLKDVSLWNQNFDKVVELLARTVCTIYARISVIFGESALRNNALGPGVGGGSPGTQNESGFVSGHVNAHTSSERLKRNQSKGNGFHPGSVGRMAVAERRGATSRPQIDLRRGELVPIRLEDFGFPCGTSAGRLFMECLSLSSSVSKFDDADDVNREDHHSSCCSVGIGNNSMKMEHACHSGILSHSRSGVPFTGDLRQAKSGVQSCSTLGPKSRLAVYAPPSTLGGCALALHYANVIIVIEKLLRYPHLVGEEARDDLYQMLPMSLRLSLKAKLKSYVKSLAIYDAPLAHDWKENLDGILKWLAPLGHNMIRWQSERNFEQHQIVSRTNVLLLQTLYFADREKTEESICELLVGLNYICRYEHQQNALLDCASSFDFEDCVEWQLQCGDSFLN

SEQ ID NO: 165567 - protein, 43 aa, Glycine max
  Coding DNA Sequence Number=SeqID_73882
MHAAEKNGGFLRGGGSGSLYWDEDASELFPKGVRYERDVRGCI

SEQ ID NO: 165568 - protein, 101 aa, Glycine max
  Coding DNA Sequence Number=SeqID_73883
  Subcellular localization annotation: CTP_CleavageSite=48; ConfidenceScore=5.20e-01
MEVGGSPPRAYYYQLCSNHFHAPTTPTPANSYYTDSTTSACTPTRTTRAATPAPLSSSLTTTELVLDSDEGWDWLLIWLAGGVLSLLPAPVTTIIWVMNYY

SEQ ID NO: 165569 - protein, 153 aa, Glycine max
  Coding DNA Sequence Number=SeqID_73884
  Gene Ontology: Biological process=transposition, DNA-mediated
  Homolog annotation: Hit_ID=Q1J7G7; Match level="QueryCoverage=21%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSGSPVAGSGGSSYRRTGNGELPPPPFFFRPTLCS

SEQ ID NO: 165570 - protein, 656 aa, Glycine max
  Coding DNA Sequence Number=SeqID_73885
  Gene Ontology: Mol. function=transferase activity, transferring nitrogenous groups; Cellular component=cytoplasm; Biological process= biosynthetic process
  Homolog annotation: Hit_ID=A8GFK0; Match level="QueryCoverage=57%, HitCoverage=99%, E-value=1e-170, Identity=76%"; Hit description =Aminotransferase class I and II
  Pfam annotation: Domain name=Aminotran_1_2; Domain location=299-647; Score=74.8; E_value=2.8e-19; Accession=PF00155.12; Description =Aminotransferase class I and II
MGGSATEKQRETGTASSQDIKKAPAKRRGLGINQGQRVFHRLHHFAIHAIMAKFVKLVIGAHGDARLAVTHGRRHQVTGRTVQFMQANIDKLVQIAEAHAGTRHDYRALTGLAQIAQQRQAQFGALLLAGGQNARHAQLAQLLQRHHRVLAHIERAMERHRHALAQPHHFAHARQIDVPFFVQHANHYAGEPHLADLAEILFDHLEIHRAVAEIATARANDRMHRDRNPLARQTQRAIARRQSPLALAGAQLNAIGARPFGRSCIGINRLRVVTMAFNFDQWVDRSHSDSVKWDKYRGSDIIPLWVADSDFTSPPAVIEALQRRVAHGVFGYTHPSPDLIEVFTRRMVERYGWHIKPEWIIFLPGLVCGLNLCVRACTEEHQSTLAPSPIYPPFRKAAKFAGREHLAVPLKATGQRWVLDFSSLHDRLSGNEKLLLLCNPQNPGGTVYRRDELLQHHQFAREHDLIVCSDEIHCELLLEPGVRHIPFATLNDDAAQRSVTLMSPSKTFNLAGLGASLAIVPNEALRQKLKRARSGIVPEVNLLALVAAQAAYQYGQPWLDEQLIYLRANRDRLIKRINAMPGLTLLPVEATYLAWIDCSALPVDNPHQFFERAGVGLSAGLDFGDRRFVRLNFGCRWALLDEALDRMARACAALPG

SEQ ID NO: 165571 - protein, 373 aa, Glycine max
  Coding DNA Sequence Number=SeqID_73886
  Gene Ontology: Mol. function=peptidyl-prolyl cis-trans isomerase activity; Cellular component=periplasmic space; Biological process =protein folding
  Homolog annotation: Hit_ID=A8GJF6; Match level="QueryCoverage=73%, HitCoverage=51%, E-value=1e-64, Identity=47%"; Hit description=FKBP -type peptidyl-prolyl isomerase domain protein precursor
  Pfam annotation: Domain name=FKBP_C; Domain location=276-368; Score =5.8; E_value=0.001; Accession=PF00254.19; Description=FKBP-type peptidyl-prolyl cis-trans is
  Pfam annotation: Domain name=FKBP_N; Domain location=150-274; Score =56.2; E_value=1.1e-13; Accession=PF01346.9; Description=Domain amino terminal to FKBP-type peptidyl-prolyl isomerase
  Pfam module annotation: Pfam domain module=FKBP_C::FKBP_N; Domain location=276-368::150-274
KLTAAQTANDKARQRYEQDKQAAAAELAQQKAEAAKATGELQQQLALRQKELDEQRQQAERQEKSLKTALEQQKAEAAKATGELQQQLAQLQEKNKTQTEQAKALAQRLATAVAESEKSTLQLAKTTEQVKKNALALADANQTQQALREELDGLRSRAKWLPDAQALEKKPAQQSYAAGVALGRDIQTMLAERKNWGINPDKTVLLAGVIDTFNGHYQLSDAQLTRALAESEKAVNDARNQAAKVQTSKGEAFVTEFKKKKGTQKSPSGFWYRIDYAGDEAIKENARVDIVVKESLTDGSVIQDMDRSGKVMSQPLSAYPPLFREAIGHLKNHGSLTMVVPPALAYGETGYAPQIPPNATMVYELRIVDVNNG

SEQ ID NO: 165572 - protein, 172 aa, Glycine max
  Coding DNA Sequence Number=SeqID_73887
  Gene Ontology: Mol. function=endonuclease activity; Cellular component=integral to membrane; Biological process=sodium ion transport
  Homolog annotation: Hit_ID=Q9AY32; Match level="QueryCoverage=31%, HitCoverage=81%, E-value=6e-22, Identity=96%"; Hit description=RRNA intron-encoded homing endonuclease
MVVTVKKLVVGPWVGSIGPPPVCTGRLVPSAGDALLSLTGRVVPPHGITPQDSDPIVLAFGIGVMINRDSRGHSYFIVRGEILGFMKDEQLRKHLPRMFSLIKNESWGSKTIRYRPSLTINDADQGSADVAFRTPLAPYEKSKSLGSGGSMVARLKLKGIDGRAPPGVEPAA

SEQ ID NO: 165573 - protein, 189 aa, Glycine max
  Coding DNA Sequence Number=SeqID_73888
DSFEEQATQGSFVPHGCQDVLAATIRCPEHPGRVCAAGAGVTIKQYFGSSPWTSRSASSLPPDELQQLTQQIRDQLEESITEKVTRQVMASFSHMQSQLQSQMQSQDLAVPPEPLGSCVDPSGNDPETGDSDSKGECGGGYACRCSNSCTTDEVVVSPAKPPPKPDSEVDDPLYLMTLTIPELFLRPYQ

SEQ ID NO: 165574 - protein, 317 aa, Glycine max
  Coding DNA Sequence Number=SeqID_73889
MAKFDPDVVLEFNANAWPTEEGVRDMRSWVRGQWIPFDADALSQFLGDPLVLEEGQECEYSQRRNRANGFDEEAIAQLLSISGQDFARTTARRQVRIMRTSMTTLTQMWMTLLLSNVLPSDHNSDLPLPKCQLVYAILTRMSVHVAQLIADAIYLFVGMPPTRHPLDPYKSNRALGFPALITGLCQSNGVPVTPSKVIRPPITRAFIEKYCTPRQAQGDAPPPPHQADPAGSFGMEQGQVQTHECLYHLSLSLQSQRFAPFPCPTPDQFRAEVTWPGDWPEDQTEEAPVEAPGDPEDARMDEEMTDLLGFLGGSRAT

SEQ ID NO: 165575 - protein, 386 aa, Glycine max
  Coding DNA Sequence Number=SeqID_73890
  Homolog annotation: Hit_ID=Q84VH5; Match level="QueryCoverage=100%, HitCoverage=63%, E-value=1e-165, Identity=72%"; Hit description =Envelope-like protein
  Subcellular localization annotation: CTP_CleavageSite=21; ConfidenceScore=5.08e-01
MATSPKETSSPGSPSVPSSPSATKAPSNQEQPEFNIQPIQMIPGQALIPEKLVPKRQQGVKISENPSLATSPREVDTEMDKKIRSIVSSILKNASVPDADKDVPTSSTPNAEVLSSSSKEESTEEEDQATEETPAPRAPEPAPGDLIDLEEVESDEEPIANKLAPGIAERLQSRKGKTPITRNSSSDSDDDVELDVPDIKRAKKSGKKVPGNVPDAPLDNISFHSIGNVERWKFVYQRRLALERELGRDALDCKEIMDLIKAAGLLKTVTKLGDCYESLVREFIVNIPSDITNRKSDEYQKVFVRGKCVRFSPAVINKYPGRPTEGVVDIAVSEHQIAKEITAKQVQHWPKKGKLSAGKLSVKYAILHRIGTANWVPTNHTSTIAT

SEQ ID NO: 165576 - protein, 177 aa, Glycine max
  Coding DNA Sequence Number=SeqID_73891
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=79%, HitCoverage=27%, E-value=8e-48, Identity=76%"; Hit description=ATP synthase subunit alpha
  Pfam annotation: Domain name=ATP-synt_ab_C; Domain location=44-144; Score=128.1; E_value=2.5e-35; Accession=PF00306.18; Description=ATP synthase alphabeta chain, C terminal domain
MGDGLMIQEGSSVKATGRIAQIPVSISVSRVGSAAQTGLIKAMKQVAGKLKLELAQFAELEAFAQFASDLDKATQNQLARGQRLRELLKQSQSAPLTVEEQIITIYTGTNGYLDSLEIGQVRKFLVELRAYLNTNKPQFKEIISSTKTFTGEAEVLLKEAIQEQMELFLLQEQVEKN

SEQ ID NO: 165577 - protein, 60 aa, Glycine max
  Coding DNA Sequence Number=SeqID_73892
MGISACHWTSRVTIAKGGAVDKSEAFAPTYPPFVMRNSDLRVDNRKVSPHAIGLLGHDSK

SEQ ID NO: 165578 - protein, 104 aa, Glycine max
  Coding DNA Sequence Number=SeqID_73893
MGQNTPNDYDDGWLKFSQSVIKAKKEIGKEELPKLWWRKSRVVATYPSAGGRRVTRGMRVPRKECAQSRHQRLFEENVGKTGKDAIYELLSERFGSCIYARGRC

SEQ ID NO: 165579 - protein, 116 aa, Glycine max
  Coding DNA Sequence Number=SeqID_73894
MPISPCKRIAPTKTPSGPEEVQQGPEVSSSGYGPLSALQGARSPQQGSCPQNTVDPEKSNGVLGLPALITGLCRFYGVPVAPSKVIRPPINQAFIKKYCAPRQAQGETPQQHWDGR

SEQ ID NO: 165580 - protein, 116 aa, Glycine max
  Coding DNA Sequence Number=SeqID_73895
MGLYVVGDQCTQLVALGKVYDSSSTIHNVPYADDVVRVSFFKVYHGDTQLPFSTSELQFVSQGVGTFVGWPTHLVKLVSTEDSHKHLPKPVASSEMDNVVAAVDPLGELVTNLYDV

SEQ ID NO: 165581 - protein, 258 aa, Glycine max
  Coding DNA Sequence Number=SeqID_73896
  Homolog annotation: Hit_ID=Q6UUU1; Match level="QueryCoverage=29%, HitCoverage=51%, E-value=6e-23, Identity=73%"; Hit description =Putative uncharacterized protein
  Subcellular localization annotation: CTP_CleavageSite=42; ConfidenceScore=5.15e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSITTYDWKKLGGKLPNKNIARLHSKAWTLELDCYQKHYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTERGGDFLEDARKILNRE

SEQ ID NO: 165582 - protein, 117 aa, Glycine max
  Coding DNA Sequence Number=SeqID_73897
  Subcellular localization annotation: CTP_CleavageSite=79; ConfidenceScore=5.70e-01
MVFLRCSSGFCFLSSCPSCSATDGGGCVTAKSTRRTSALASVAVTLRVTTTPAALNAPLQGASHSPFRLRNCWEGRSVRASSLLRQLAKGGCAARRLSWVTPGFSQSRRCKTTASEL

SEQ ID NO: 165583 - protein, 193 aa, Glycine max
  Coding DNA Sequence Number=SeqID_73898
MLTNLMEGSIDVALVKEFYAYLYDLEDKSPKQGKVGLWISDEDGHEEELLELGRPHGQLSRTRKARARGSEGPSSAALQPSIVPAPIPSTPPVPANFGPSAQSIDLMMAMLQSIHQGQILVMQSLHNLGGLVAWPGVQPSSHGGGEAFAAQEPQPDPEITPPAQEDDSEATPPESFVPETDPEADPVIMEASP

SEQ ID NO: 165584 - protein, 98 aa, Glycine max
  Coding DNA Sequence Number=SeqID_73899
MKHLMLFANLPKLFKIVEASFMMNEDDSKSFDDNKDDDKKLKKSKNEFKIESRTLQGSRGNLISRINNQVSRFKFQESRSRFKTKDSRIKRRLNQDKY

SEQ ID NO: 165585 - protein, 320 aa, Glycine max
  Coding DNA Sequence Number=SeqID_73900
  Homolog annotation: Hit_ID=Q6WAY6; Match level="QueryCoverage=90%, HitCoverage=48%, E-value=8e-37, Identity=34%"; Hit description =Putative uncharacterized protein
MGQLQRQVFRKAYGKIWDLAMVEVSTEAIASLAQYYDQPLRCFTFGDFQLSPMVEEFEEILGCPLGGRKPYLFSGFYPSLARISKIVQISVQELDHRKQVENGVVGIPRKCLEAKARILAGRGEWAPFIDILVLLIFGGVLFPNVDGLVDLAAIDDFLAYHDRKESPVVAILADLHDTFDRRCEKSSTRIVCCTSALYVWLVSHLFRQEVSHACPLESHRSCTEKRGANWDRLLASKEGASVNWFPRWKEGRIGILTSCGGFPNFPLMGTRGCISYNPVLAIRQLGYHMRGAPLEEELAPIIARGFNKTNVEALQKVRKA

SEQ ID NO: 165586 - protein, 112 aa, Glycine max
  Coding DNA Sequence Number=SeqID_73901
  Homolog annotation: Hit_ID=A5C3T2; Match level="QueryCoverage=94%, HitCoverage=13%, E-value=2e-07, Identity=34%"; Hit description =Putative uncharacterized protein
MGVRQPVIKVPQAVESDHVDQVVCEEQHDDIEQTGEEPVEQVPQQDDQTTLRRSTRIKMTAIPSDYPSDVDGSSKQRKTQKATLRDIRQDLLLKDSLKEKGIDYRETFFPCI

SEQ ID NO: 165587 - protein, 38 aa, Glycine max
  Coding DNA Sequence Number=SeqID_73902
MASIKFGDVVGEQCPKCFATDLATTFTDLGNRAVVQIH

SEQ ID NO: 165588 - protein, 119 aa, Glycine max
  Coding DNA Sequence Number=SeqID_73903
MKTKIPEYPVNHEDFDDIKKNLLEKEGDVNHASFDGVEKKSHVCHHQKGGECEYFDDIKKNLLEKEGDVNHASFDGVEKKSHVCHHQKGENVNVCIHDLDDVKEESNKVASNDKHLLQE

SEQ ID NO: 165589 - protein, 209 aa, Glycine max
  Coding DNA Sequence Number=SeqID_73904
  Gene Ontology: Mol. function=protein dimerization activity; Biological process=DNA integration
  Homolog annotation: Hit_ID=A3BRV8; Match level="QueryCoverage=81%, HitCoverage=23%, E-value=1e-33, Identity=43%"; Hit description =Putative uncharacterized protein
  Pfam annotation: Domain name=zf-C2HC_plant; Domain location=44-101; Score=7.0; E_value=0.0063; Accession=PF07567.3; Description=Protein of unknown function, DUF1544
MENSNTNNNGALKYNTKIIIIQVRVEMSASSPSQAKKQDDDTKPLWTYVTKIKSVGDGGNYEIKCNICDFTFNGSYTRVRAHLLKVTGKVVRVCQKVTIDRLIDLKKIDNEATLKVEKSKTKSVSLPLVSTQHQMDTNTLGVDPKKRKTSTAENAFNLQARETLDHEIARMFYSSGLPFHLARNPHYRKAFAYAANNQISGYQPPGYNN

SEQ ID NO: 165590 - protein, 89 aa, Glycine max
  Coding DNA Sequence Number=SeqID_73905
  Homolog annotation: Hit_ID=A5AEB7; Match level="QueryCoverage=100%, HitCoverage=8%, E-value=2e-22, Identity=61%"; Hit description =Putative uncharacterized protein
MCVQEEERLVMEMGESALLTTTCGKNKATKSQANQKGKVSVNINTWWIDSGSTIHIANSLQGMQNLRKPVGSEQNILLGNKLGSPVEAI

SEQ ID NO: 165591 - protein, 93 aa, Glycine max
  Coding DNA Sequence Number=SeqID_73906
MTKSKGKDPLEGLGGPIDEDMTKSKGKDPLEGLGGPMTRARARKAKEALQQVLSILFEYKPKFQGEKSKVGPIGNLGISLLGDQMVADLLAVG

SEQ ID NO: 165592 - protein, 123 aa, Glycine max
  Coding DNA Sequence Number=SeqID_73907
MAHQWSKWLVPHWDIPYKGDCLCLGNHIIVPAMNPTKNVHDEKASQIAMLVRRDGNRVPKRVSEWVATIGTWGMEVRTRMMQAPLELVGLGSSSSMDSFASWKMNGSGMEKGRERGDATSRGR

SEQ ID NO: 165593 - protein, 76 aa, Glycine max
  Coding DNA Sequence Number=SeqID_73908
MAAEWRRKRERRRHFKEKMTLEEAHHHRRPWIRAWRKKEMNEGRGREEHEILCSKRALKSEPTNPRSIPRFSTKCA

SEQ ID NO: 165594 - protein, 100 aa, Glycine max
  Coding DNA Sequence Number=SeqID_73909
MASANAIDLNLLKFETEEDLNQVLSEGPYFIFQRPLLLKVMHAFFDFGNEELSKIPPQKKGKKAQIQQTQRTEERQFDSKKGKLQKSSIHVGEGPSRPKL

SEQ ID NO: 165595 - protein, 135 aa, Glycine max
  Coding DNA Sequence Number=SeqID_73910
  Pfam annotation: Domain name=zf-C2HC_plant; Domain location=28-80; Score=6.6; E_value=0.007; Accession=PF07567.3; Description=Protein of unknown function, DUF1544
MASSDQQKNTNLEGSSTGMFKPTGDNVDVFWNWNSLKDKNNRKSVTCDFCQNTSTGGICRAKRHQLQIKVETATYMEAMQEEDDEEEDGIQEITRLKSGKRPPTTSNEAFSSTSKKRTTNKKGPLDFLFSKQLEE

SEQ ID NO: 165596 - protein, 226 aa, Glycine max
  Coding DNA Sequence Number=SeqID_73911
  Homolog annotation: Hit_ID=A5C5Q3; Match level="QueryCoverage=94%, HitCoverage=64%, E-value=1e-10, Identity=25%"; Hit description =Putative uncharacterized protein
MANVRAIKVMLRSFKLVSGLKINFSKSSFWAIGMTEQWMNNAAPKIVVDRLVRLQRWFLWGGHSDQKKITWVNWGFSLSTKGKRWLRHQGFDEIQLCTAWKMVLEFVSSPRRIMATSFGIQIWRVEEFGCDKKDIQRVPLVLFWEDGWKDDGGEMDMTAKFMEDIEGLIIQLQRQDTWNWEGDSSRGYTVGNAYMLLDRDSTNENQVGVFTALWKLKIPSKASFFA

SEQ ID NO: 165597 - protein, 43 aa, Glycine max
  Coding DNA Sequence Number=SeqID_73912
IAKESFYGKPLGYLRMSRDSSVSMTEIVGAADKSEAVAPVNPQ

SEQ ID NO: 165598 - protein, 592 aa, Glycine max
  Coding DNA Sequence Number=SeqID_73913
  Homolog annotation: Hit_ID=Q6WAY6; Match level="QueryCoverage=82%, HitCoverage=86%, E-value=8e-42, Identity=28%"; Hit description =Putative uncharacterized protein
MGPLQMQAFRKAYGKILDLTIVEISTEAIASLTQYYDQPLRCFTFEDFQLVPTVEEFEEILGCPLRGRKPYLFSGFLPSLSKIAVVVRDLARGLDRVKQTRNGIVGLPRKYLEGKARDMTNQEEWVPFMDVLALLIFRVVLFPNMDGLVDLAAIDAFLAYHHIKESPVVAILADLFDTFDRRCEKSSARIICCLPALCVWLVSHLLQQDVRHPCLLRSHCSCVEKRRVDWNQLLAGIGGRIVNWFPRWKEGNEGFLFSCGSYPNIPLIGTRGCINYNPALAIRQLGYPMRGAPTEEGLSPFLVRDFGAQSFKVIQRVHKAWENPLRKDKELRGIRNGIIGGYHEWLKVYTRGLDWLAKLKIINEENFEALEEDEEVRALKTELGKTRLAKEKFKLVATDVRKECAGLREENAATAKALEQETKRARKEEHGRDKFRGALWGSNSELKLRREEKDRSRAHSMVVKEELAACSRSKRNLTQHLCETETNMLAIITKYQEELSLATAHEHRVADEYAQVYAKKEARRRVIDSLHQEATMWMDRFALTLNGSQELPRLLAKAKAMANTYSAPEEIHKLLDYCQHMIDLMAHIIRNC

SEQ ID NO: 165599 - protein, 117 aa, Glycine max
  Coding DNA Sequence Number=SeqID_73914
RQAQGDAPQAADVPLPHQAGLAGSFDTEQYLQHLVRQQVANHRAHVQTHDCLYQLSLSLQSQGFTSFPCPTSDQFRAEVAWPGDWPEALAGEAPAEAPDKEDEAREDEEMTDLLDFL

SEQ ID NO: 165600 - protein, 152 aa, Glycine max
  Coding DNA Sequence Number=SeqID_73915
  Homolog annotation: Hit_ID=Q69F85; Match level="QueryCoverage=33%, HitCoverage=2%, E-value=3e-08, Identity=49%"; Hit description=Gag -pol polyprotein
MEVNIPFGWKPLNIEQYDGTIDLDEHLGTTVVHIRNLNPKVALHSMLLALCPNKFIDSLCKKPPSSMDELCERAKGYIQLEEMSKVWNEVYEAKKKHEKHETHTKLDSHKLDLCKTATSSSFSYSKPLPTPLSFFSTTHDHWWPPRAAVVCH

SEQ ID NO: 165601 - protein, 377 aa, Glycine max
  Coding DNA Sequence Number=SeqID_73916
MVKWDPELHTSTSRDAFNFVNSSLWPLSIFTIRSDQVLTMDECERIDERPQGLLPCAECVNRSWSSVHAPVTGLTWRVDTCLRVPHRRPHRFCEPKTVHKPPKIKVNLREKEVVLCQSRLSHFEGVCQIPGVNVACQAWTCVVRAASVKLSMMAMSLACQACTTHVQYSCICVSRVVLLHTCLYTVLVDMVLPSSSSHPRVSLDHLYTSSDADSLWAFNKNLIGSAGVAKWRVAARTLWQVDRPKVANATVAFTNIVRANRQLSPKVKKINLGGKVESMAAENDRLAKRITELETPLRESKSRLEESEQCASKEREANKELEEELIMYKKEDLDLGLFDPFKDVKEGVLLDEEEIDAKEEVVGEGQGVAEQGDDACV

SEQ ID NO: 165602 - protein, 285 aa, Glycine max
  Coding DNA Sequence Number=SeqID_73917
MTFIHISKMTMSSVIAWLSKGDDDLHPHVEDDNVFSHCMLSKGNNDLHPYFEDDNVFSHCMLSKGDNDLHPHVEDDNVFSHCMLSKGDNAFIYISKTTMSSVIACFQKATMTFIHMSKKTMSSVIACFQKATMSSFTLLKTTMSSSQGLQCLLSLCFMEFDPLGSLDDLGEKQPARLGEQVASGERSLKFPEVQRSRKKKKKEKTWPKRFQITSMIDSYTVRCSFFVRSSFFIQLVLAFKDLNLIYGPLGVPFFVFASSSPSSTIDDLFLGLKRVLTDCSYRNLV

SEQ ID NO: 165603 - protein, 273 aa, Glycine max
  Coding DNA Sequence Number=SeqID_73918
MVIPHTFCHPDTVVFDGTKRQIIVILRLLSSRGGGPHDMREPFGPALFHLSSSRGGGPDDMREPFGPAHFHLLSSRGGGPDDMRRQIMAAGPMACEEPFGPAPFHLLSSRGGEPDDMRRQIIVIRLTFFHPDIVVSDSMQRQIMVIMRLLSSRGGGPDDMREPFGDRPDDMRGTIGPALFTLCHPEAAGQMTCGEPVGPALFHLLSSRGGGLDDMRGTIWSRTFYLLSSRGGRPDDMREPFGPALFHLLSSRGGGPDDMRGTIWSRTFSPFVI

SEQ ID NO: 165604 - protein, 90 aa, Glycine max
  Coding DNA Sequence Number=SeqID_73919
  Subcellular localization annotation: CTP_CleavageSite=39; ConfidenceScore=5.29e-01
MASRKRARTDDIPSSSTPAPSSVTIGQDVQSSQTLVPMLQSLFRGQFLIMHSLQELAHNTPIIPMEHFLEQVAWPEAQLPLVRPNEAAPP

SEQ ID NO: 165605 - protein, 103 aa, Glycine max
  Coding DNA Sequence Number=SeqID_73920
  Subcellular localization annotation: CTP_CleavageSite=35; ConfidenceScore=5.32e-01
MSPPPLEPHNHSQTHLNLSEQLPFHARFSAGGFVRACTLSAILNRLALISGFRLSACFSRSADGLKWCASLDDPLLSANAQLILLPDSSLCSAEECCTQRMAR

SEQ ID NO: 165606 - protein, 220 aa, Glycine max
  Coding DNA Sequence Number=SeqID_73921
MVFQLRLVMSFETKKGEHRLKGAIKGINSRKHQQESSQGYCASNQWGKTHQKIMMMDGSNSHKGTRGIAQAERHPPIGKSAKGTGECGLFLILRSNSDLHITRKTIKETVVRFTCQAFKHLVNEWKGKMVLFGNLVQPPIVDADSLTVLHPSRNKLLLLIFYHNEADFLWNYLDGTHPLAVRDRINDSSLQKLGYLLLHYINNHRVESSLWLSYWFSPIF

SEQ ID NO: 165607 - protein, 160 aa, Glycine max
  Coding DNA Sequence Number=SeqID_73922
MVTLGTFSSPWAHLGPLENLKVKQPAQLGEQVTSKGSNQLAWASCHTTSSPHERVERKDKELKGSSNDIISSYHKLLKSRTQGITWLPKLKGLSGEEAKIAEESEEVQALKAELKKTRVVKEKLETTITRVRKDCDELKDINMTTVKALERETKRARREE

SEQ ID NO: 165608 - protein, 75 aa, Glycine max
  Coding DNA Sequence Number=SeqID_73923
MNETSRFGSSGDNIEHKSIFRSPTGNLVPLDLEIEATLRRNRAERRRKLLQDRAIAFILEEEAQSSDSTSSDSLS

SEQ ID NO: 165609 - protein, 88 aa, Glycine max
  Coding DNA Sequence Number=SeqID_73924
  Homolog annotation: Hit_ID=A5AV98; Match level="QueryCoverage=86%, HitCoverage=9%, E-value=1e-18, Identity=60%"; Hit description =Putative uncharacterized protein
MEKESKIPLCRHNEQVQFHLDVLDLDLAILKEKSPAITNASSNEDKTHYKAWERSNKLNLMFMRMTVADNITTTFPKNDSAKEFMGLV

SEQ ID NO: 165610 - protein, 142 aa, Glycine max
  Coding DNA Sequence Number=SeqID_73925
MQYTIVSKGDFKDEDEKTKELKYLRISYRQLIETTESFTASSLIRVLSSNTRIAVKVLDTTKTGKFSYVGIARLVKSDDNMPTSVLSFSATHGLLCGSLGYIAPGLPIQILHLYAYGLLENVKLDYTLFRTEATFFLIYKFV

SEQ ID NO: 165611 - protein, 158 aa, Glycine max
  Coding DNA Sequence Number=SeqID_73926
MAHLELSIPWRGSQSSRHRPTYLNYPEGNFGGNQLLDGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 165612 - protein, 66 aa, Glycine max
  Coding DNA Sequence Number=SeqID_73927
MALVLSHLMGLGSSSSMDSFASWKMNGSGMEKEETEDKPLQGEDESRRSSPPQEAMDKSLEEEGDE

SEQ ID NO: 165613 - protein, 44 aa, Glycine max
  Coding DNA Sequence Number=SeqID_73928
MLATGNRLLPSAEWRTRRVERRHHFKEKMSQEEAHHHRKPWIRA

SEQ ID NO: 165614 - protein, 196 aa, Glycine max
  Coding DNA Sequence Number=SeqID_73929
  Gene Ontology: Cellular component=mitochondrion
  Homolog annotation: Hit_ID=Q6R9L5; Match level="QueryCoverage=51%, HitCoverage=80%, E-value=2e-32, Identity=74%"; Hit description =Putative uncharacterized protein orf121-a-ct
MSAVRVRLSPTRELSRYKLYDSTSIFPIRQFDLCYDLSFMDVDKILPSSSTLGWHSLKVKGEVQTKKGLWWIPRHPETRKGVVSDEMLRGVENKRRSGDSRYRGKESKSDSRSSGERNGSSLNRENGVVGELYKCRAARRSSRECCTLDGESPVAESITSLRSDPSSMGHVESRVNQQGPPCKAKYSWVTDSEVVP

SEQ ID NO: 165615 - protein, 204 aa, Glycine max
  Coding DNA Sequence Number=SeqID_73930
  Subcellular localization annotation: CTP_CleavageSite=31; ConfidenceScore=5.06e-01
YYPGHHQHQSYAEPNVPPVHVLGFMSQHHPSQAQYQSTSFSGHASQGCQQSFQPLGFSSYIPQYSFQVPSTSNVFYGSSQMFATTFNTPPSAYNLAPSSSCYPLSLPIQIRDISHEDEDGDEDEDEDNNNNNDDDDDGDGVDDDDNSGHHVHQQQRTITRQHPRTRGGRGRRLRGQQTQTNLVQQDERPRRISRRTRCGISSHY

SEQ ID NO: 165616 - protein, 44 aa, Glycine max
  Coding DNA Sequence Number=SeqID_73931
MGVCERKRNKKGNYSDDVDSNSVEKDSAVAMSRFCRLMAGYYHS

SEQ ID NO: 165617 - protein, 203 aa, Glycine max
  Coding DNA Sequence Number=SeqID_73932
LHVLTFVGLHALTFRGLHALAIRGLHVLTFRGLQALTLRGLHVLANKGGHALTFRGLHVLAIIGLHSLAFERRHVLNFRGLHALAFRGLRVLTFRTSSFLLTVPGPPPDIGGGPTVRAQPEREAITQLLCILGQDFTRAAAKEDDRNVNLPLRKYHGLCRPDMGIAPARHPVDPKKSNRVLELSSSNYGAKHHSSIGMAGSGQ

SEQ ID NO: 165618 - protein, 146 aa, Glycine max
  Coding DNA Sequence Number=SeqID_73933
MSIGSRPTAQYDTRRFHSLDAWNRYTDNVLGRNILQERKVEIYHTEFDDFKTELERHNLHKHLINLVDGSIDVALVKEFYANLYNSKGPSPKQAMVRGHLVKINIDNLNTFLETLVVLAEGETLPTHSRYCRMPSDPREIEAALCI

SEQ ID NO: 165619 - protein, 71 aa, Glycine max
  Coding DNA Sequence Number=SeqID_73934
MKNPGEWRIALEGPHQSIMKYGSKLFGWRTHERTCNSWGSEKKARMEDCTRGSSLVNHEAWLQTLWWRMHE

SEQ ID NO: 165620 - protein, 206 aa, Glycine max
  Coding DNA Sequence Number=SeqID_73935
SKKNVYTDNHSGISARQRDSNVSMTDLVSAEDDTAKKNVYTDNHSGISARQRDSNVSMTDLVSAEDDTAKKNVYTDNHSGISARQRDSNVRMTDLVSAEDDINLRVLFVLQTAKKNVYTDNHSGISARQRDSNVSMTVLVSAEDDVTLRVSMGLSAAIDEGRRRRHLKKYPPEDADISEKGADDHIGLFSSITLGVTECRGADNRK

SEQ ID NO: 165621 - protein, 146 aa, Glycine max
  Coding DNA Sequence Number=SeqID_73936
  Pfam annotation: Domain name=DUF1723; Domain location=30-79; Score =47.5; E_value=4.6e-11; Accession=PF08330.1; Description=Protein of unknown function (DUF1723)
VHHLGRPVPAIADMVAGTRLSPLIACSIDTEDHGLISSFVDRWHRETSSFHLPVGEISITLDDVATLLLLLIVGALHDFQPLCIDEVGLLLVELLMVSSEVAMAETGQCGGPYALRDLTLAGQYAWGAAGLVHMFDQLNDVSLSTS

SEQ ID NO: 165622 - protein, 96 aa, Glycine max
  Coding DNA Sequence Number=SeqID_73937
MVFLTILEESIKGTSFVVQVEGTFTWVVVTENKRGYISCGSVLVEGTSTRLFKENKGGYIPCGSLLVKEFTRLKRNLKDCKSLGDWMQAQVVAEPV

SEQ ID NO: 165623 - protein, 63 aa, Glycine max
  Coding DNA Sequence Number=SeqID_73938
MIMRGQDIYSSQDEATTSPSSSESEETKGEEYSEEIYPQEEGQPLMATEIWMTPLPVKEDKSG

SEQ ID NO: 165624 - protein, 138 aa, Glycine max
  Coding DNA Sequence Number=SeqID_73939
MTFLGETSSQTIVNSTLGFVFPNGLIIHNDSGVYFQTSTPVLIRVPNACDIATLKTRIHNTLQLTDKQYLDEIYYRQPFTDTGGTCHANTTLSVTHSLEKNPKKVDIPSGCTIDELKDLIKQVAPQGIPPDGIHESQT

SEQ ID NO: 165625 - protein, 108 aa, Glycine max
  Coding DNA Sequence Number=SeqID_73940
MKVYLRMNALLEPKLLNPRKTTICWQPNPITSLECPSDSFCVFIAVKKRLSHEVLKHSFSVLSATEESSRASISRPRAKHEISALSTAAVFSQAQRMIGAKLKSTYLR

SEQ ID NO: 165626 - protein, 229 aa, Glycine max
  Coding DNA Sequence Number=SeqID_73941
  Pfam annotation: Domain name=Sigma70_r4_2; Domain location=18-63; Score=28.0; E_value=3.5e-05; Accession=PF08281.3; Description=Sigma -70, region 4
VEISDDFSDDDFEEGLEEINLEEIFSKMPPGYRIIFNLYVFEEKKHQEIAEILNISEGTKMEIKPSHDLWNKIEAGLDEADISVENLAVSSPYKWWKYAAIILFLLSSGILVYFNIDRIKTAHIIAHDKSNEKTETLDNNPELAFRNEHLDHSAISSDIVDRSIATNGKEKERVDSITSNRDHNRAITKDIKVSNYEADHDLHPIASGVQIKPVDLVIPEEEKISENKL

SEQ ID NO: 165627 - protein, 615 aa, Glycine max
  Coding DNA Sequence Number=SeqID_73942
  Homolog annotation: Hit_ID=Q2HUJ3; Match level="QueryCoverage=28%, HitCoverage=39%, E-value=2e-13, Identity=31%"; Hit description =Putative uncharacterized protein
MVTFQSRRNTDRKNEEVFRYHHTKPTSYADALTRNIRRPVYQRTANTIANYRSSSSSVHIEVAPEDTLWLKDAWVGRLKNQALFERLEDEFRWGMGLEIVPRYMGDDQVLLLGLTDADADKLINGGTTGESMMFSSIERWNPSLRAGNRLTWIHCWGIPIQAWNQKYISHIVAAMGELMDLDDSTEEKRRMDRARVLIKTPWKPIIQHTVEVTIGEDKFTIQIVEECCGGCQDGFRSGRNVRGSSEDINSDDSFLDSSSFANWGFGDDASIVPESDFRSAHTSTAATTANGAGNHGEQQPPLLHASELHIASPGAVAENDVGAEDQQSPTASNGPSDNGYPLDNVNNHRVDSGNQWVNTHGPNSNFMQATVTYNPEDSAKRRAMKWEPVPNIDDTLQSYHQLGNEAQGESSGLETGQKMDIAVGGDVERINDSLMTRGTGEYKEVEAIIVDTEARAILTDQNSNSTPSDKRSKLGLNPLTGGGATSCQVYSRQRRCKKKITSGLIPLGSGDETHKGLSQPPNTQPSSLHNEPYNDKLETPFQLQVYNGNMETTSDSDKTFNPDALQMWSMAKQLGLTGEGSKESVIQKFQNMEERDRAEATRRVSATAINENNLL

SEQ ID NO: 165628 - protein, 159 aa, Glycine max
  Coding DNA Sequence Number=SeqID_73943
  Homolog annotation: Hit_ID=A7UQU7; Match level="QueryCoverage=51%, HitCoverage=13%, E-value=3e-09, Identity=37%"; Hit description=IMP dehydrogenase/GMP reductase, putative
  Pfam annotation: Domain name=DUF1723; Domain location=1-38; Score =12.5; E_value=0.018; Accession=PF08330.1; Description=Protein of unknown function (DUF1723)
RWHKETSSFHLPVGELTITLDYVVSLLHLLIIGAFHSFEPLHVDKVIIMLVELLEVSGEEARAETAQCYGAYSTGRQLAGYITLLQCWIYEHFPSVHESMTDDGYDEMSPRACRWLTMKAYMKGLTTLPYRTHLDALTIPDVCWMPYGDHRGVRAFDLI

SEQ ID NO: 165629 - protein, 64 aa, Glycine max
  Coding DNA Sequence Number=SeqID_73944
MMSNFGALMEASMERKKKRKATWEVPCVSQHPSGPVFESRQYIYQNAQNEALSVVQSYGLLFAN

SEQ ID NO: 165630 - protein, 44 aa, Glycine max
  Coding DNA Sequence Number=SeqID_73945
METGGKADVTILLSPLQILLCLITLIMKVADPTCMTARTCSGSV

SEQ ID NO: 165631 - protein, 354 aa, Glycine max
  Coding DNA Sequence Number=SeqID_73946
  Homolog annotation: Hit_ID=Q6WAY6; Match level="QueryCoverage=77%, HitCoverage=47%, E-value=6e-12, Identity=23%"; Hit description =Putative uncharacterized protein
MDWDQLLAGVGSRTISWFPRWKEGREGVLFSCGRYPNIPLVGTRGCINYNPTLAIRQLGYPMRGAPTEESMSPFLVRDLGAQNSKTIQRIHKAWETPLRKDQELRGIRNGIIGGYREWLRVRIRAKRILKHRKRTRKSKLSKSELEKAKLAKEKFKLAATHVRKECAGLREENAITARALERETKRARKEEYGRNKFRGALRGSNSELKLRREERDQSRAHSMVLKEELIACSRSKRSLSQRLCETETNMLAIIAKYEEELGLATAHEHRITDEYAQVYAEKEARGRVIDSLHQEATMWMDRFALTLNGSQELPRLLAKAKAMADTHSTPEEIHGLLGYCQHMIDLMAHIIRNR

SEQ ID NO: 165632 - protein, 300 aa, Glycine max
  Coding DNA Sequence Number=SeqID_73947
  Gene Ontology: Mol. function=transferase activity; Biological process= penicillin biosynthetic process
  Homolog annotation: Hit_ID=A9ILH0; Match level="QueryCoverage=93%, HitCoverage=82%, E-value=2e-73, Identity=49%"; Hit description =Putative uncharacterized protein
  Pfam annotation: Domain name=AAT; Domain location=61-294; Score =128.2; E_value=2.3e-35; Accession=PF03417.7; Description=Acyl -coenzyme A:6-aminopenicillanic acid acyl-transferase
MKDAQQARSMRARVQRQFPLIWQELEGLAEGLQVPIDEVFAWNCRGDLVRSTSDGCTTVAGKSASGELIIAHNEDGFPQLRDDCALVTVTPDDGLAFTSFAYPASLCGHTFAVNEKGIVNTVNNIRAQHRPDGVPRQIIARASLNATTLDEAIAILSATPRAGAFHHTLGQQGDSRLFSIEATGSGCSVIPLTAPFGHANHLIHPQLAAVEQVVTASSGSRQQRLETWLTTQTALDGAAAKAILSDQQDAALPIYRLSPQDPDEENTLATAIFTLSDDAMTWQIFTRDRQRAALQSAGRQ

SEQ ID NO: 165633 - protein, 146 aa, Glycine max
  Coding DNA Sequence Number=SeqID_73948
  Homolog annotation: Hit_ID=Q6UUU1; Match level="QueryCoverage=41%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPVTIVLSPTRKTCKAPLAAAT

SEQ ID NO: 165634 - protein, 51 aa, Glycine max
  Coding DNA Sequence Number=SeqID_73949
MVPTESARRRCYACVKTWAWSACLAIPTGEITTSHSRWRNSHFAIATCGIH

SEQ ID NO: 165635 - protein, 33 aa, Glycine max
  Coding DNA Sequence Number=SeqID_73950
MKQNLENEVKRHMLDILKELSASESPINSCAQD

SEQ ID NO: 165636 - protein, 138 aa, Glycine max
  Coding DNA Sequence Number=SeqID_73951
  Homolog annotation: Hit_ID=Q69SJ2; Match level="QueryCoverage=75%, HitCoverage=76%, E-value=1e-35, Identity=67%"; Hit description =Vacuolar protein sorting 55 protein-like
  Pfam annotation: Domain name=Vps55; Domain location=17-134; Score =166.5; E_value=7.1e-47; Accession=PF04133.5; Description=Vacuolar protein sorting 55
MAELPGYFRYCLNTGKLVLLGILVSGGVVLQILACALYNNWWPMLTAITYVLLPMPLLFLVGSGRSSLFSESDSSWVNATKFLTGASAVGSIAIPAILKHSGVIGWGAFAMELSSFFVFVFAILCYIRINDEDDYSSL

SEQ ID NO: 165637 - protein, 66 aa, Glycine max
  Coding DNA Sequence Number=SeqID_73952
MEVQVGQLAKQMVERPTGTFKANTEKNPKEECKCSDLEETTTQAQRSKKRDHPMLHWGGIRREDSH

SEQ ID NO: 165638 - protein, 193 aa, Glycine max
  Coding DNA Sequence Number=SeqID_73953
MTRSPKTASEGGANIGPLQIHIRGGLAQITRQRSPPEHPSRKECGGRPFHRIDVALVHKFYTNAYDPEDGSPKYCRVQGKVIRFDVETFNDFMETSVIILEGEEYPNYSQYLHSYPNHQVIMAKLCTPGDKFILNTNGAPWKLLRKDLTTLAQTWSVLSYFNLAPTSHISDLNWTRLASSMGWCHRWTWTWAT

SEQ ID NO: 165639 - protein, 124 aa, Glycine max
  Coding DNA Sequence Number=SeqID_73954
MVNGGNNGGDNDDVNNSDIDRDINNGHGGSGGGDDDGGGIIDGDNDDVVGGDSDRGDINSGGNGGCSDIGGSCGDGDKGGSGGGGDNDDESDTNDGGDGNIVGTVSYGNDNASDSDDGVVVAMT

SEQ ID NO: 165640 - protein, 486 aa, Glycine max
  Coding DNA Sequence Number=SeqID_73955
  Gene Ontology: Mol. function=inositol or phosphatidylinositol phosphatase activity; Cellular component=intracellular; Biological process=abscisic acid mediated signaling
  Homolog annotation: Hit_ID=A7PCE3; Match level="QueryCoverage=100%, HitCoverage=73%, E-value=1e-116, Identity=46%"; Hit description =Chromosome chr2 scaffold_11, whole genome shotgun sequence
MKTRRGKRSEAFWPSLVMKKWLNIKPKVYDFSEDEVDTETESEDDDTPCKGYNTKHRRGKSETLRVQYINTKELRVTIGTWNVAGRAPSKDLDIEDWLCTNEPADIYIIGEKKREKVQSLRRVETLKIVYKIGLLMPFVRLASTLITSLNNSFQEVVPLSAGNVLGAEDNTPIRKWEAIIRRTLNKSSEPESKHKSYSAPHSPVQKTSSSASVNALADSVDVNPLDMMNEEYLGTFDNDDLEQEEVKSSIFGIGKNLQLRKIHDIDLQTILDWPERPLDATPHTDSSPKLRRVLSSSERTGFSWTDTASKYSNAMKRSHHSSGNLGLLWKEQKVMPEEVIDIIDDLSDMLSDEEDDDDYFEVANDKEVNGISKVKSHRKYVRIVSKQMVGIYVSVWVQRRLRRHINNLKVSPVGVGLMGYMGNKGSVSVSMSLFQSRLCFVCSHLTSGQKDGAEIRRNADVHEILRRTCFSSVFDTDQPQTIPSHE

SEQ ID NO: 165641 - protein, 119 aa, Glycine max
  Coding DNA Sequence Number=SeqID_73956
MDWFYMISHSFISPTQPGDPPRVSLVQQYDTFVEPNVHQQPVATATPHEADVDVHHLGHAVDGYVAIANKLERLLNLRILNEGTKAYTAAEECLSIARSYISQSTVGHRSRRRRRTDGH

SEQ ID NO: 165642 - protein, 933 aa, Glycine max
  Coding DNA Sequence Number=SeqID_73957
  Gene Ontology: Mol. function=nucleoside-triphosphatase activity; Cellular component=mitochondrial matrix; Biological process=ATP -dependent proteolysis
  Homolog annotation: Hit_ID=A5BU86; Match level="QueryCoverage=100%, HitCoverage=98%, E-value=0.0, Identity=72%"; Hit description=Lon protease homolog
  Pfam annotation: Domain name=AAA; Domain location=402-599; Score =133.6; E_value=5.6e-37; Accession=PF00004.20; Description=ATPase family associated with various cellular activities (AAA)
  Pfam annotation: Domain name=AAA_3; Domain location=402-541; Score= -2.2; E_value=0.00059; Accession=PF07726.2; Description=ATPase family associated with various
  Pfam annotation: Domain name=AAA_5; Domain location=402-547; Score =17.4; E_value=0.00014; Accession=PF07728.5; Description=ATPase family associated with various
  Pfam annotation: Domain name=Lon_C; Domain location=669-933; Score =274.0; E_value=3e-79; Accession=PF05362.4; Description=Lon protease (S16) C-terminal proteolytic domain
  Pfam annotation: Domain name=MMR_HSR1; Domain location=401-515; Score= -21.5; E_value=0.098; Accession=PF01926.14; Description=GTPase of unknown function
  Pfam annotation: Domain name=NACHT; Domain location=401-563; Score= -34.9; E_value=0.032; Accession=PF05729.3; Description=NACHT domain
  Pfam module annotation: Pfam domain module=AAA::AAA_3::AAA_5::Lon _C::MMR_HSR1::NACHT; Domain location=402-599::402-541::402-547::669 -933::401-515::401-563
MAESVELPSRLAILPFRNKVLLPGAIIRIRCTSPTSVKLVEQELWQREEKGLIGILPVRDVVEIKPVGPTVSEGADSTNQNSKVQGGSLDSRKLDTKKQNDVVHWHNRGVAARPLHLSRGVEKPSGRVTYTVVLEGLCRFSVQELSTRGIYHTARITSLEMTKTELEQVEQDPDFIMLSRQFKATAMELISILELKQKTGGRTKVLLDNVPVHKLADIFVASFEISFEEQLSMLDSVDPKVRLSKATELVDRHLQSIRVAEKITQKVEGQLSKSQKEFLLRQQIRAIKEELGDNDDDEDDLAALERKMQSAGMPQNIWKHAHRELRRLKKMQPQQPGYNSSRVYLELISDLPWQKASEEIELDLRAAQKRLDSDHYGLVKVKQRIIEYLAVRKLKPDARGPVLCFVGPPGVGKTSLASSIAAALGRKFVRISLGGVKDEADIRGHRRTYVGSMPGRLIDGLKRVAVCNPVMLLDEVDKTGSDIRGDPASALLEVLDPEQNKSFNDQYPLLLKMCSLNLLFSPVGSNRLQPIPPPLRDRMEIIELPGYTPEEKLHIAMRHLIPRVLDQHGLSSEFLQIPEAMVKLVIQRYTREAGVRNLERNLAALARAAAVIVLEQEQVVPLNKGMQGLATPLVENRLADGTEVEMEVIPMGVNSRDISSTFRIASPLVVDETMLEKVLGPPRFDGREAAERVATPGVSVGLVWTAFGGEVQFVEATAMVGKGELHLTGQLGDVIKESAQIALTWLQMSGMGGEANIAVFVETSQRVNAWLAHMGAGVIECGGMLGSNCKAALYVCRYTLAVMARATDLRLAATEGFNILEGRDVHIHFPAGAVPKDGPSAGVTLVTALVSLFSQQRVRSDTAMTGEMTLRGLVLPVGGVKDKILAAHRYGIKRVILPERNLKDLVEVPSSVLSNLEVLLAKRVEDVLEHAFD

SEQ ID NO: 165643 - protein, 241 aa, Glycine max
  Coding DNA Sequence Number=SeqID_73958
  Gene Ontology: Mol. function=glutamate-1-semialdehyde 2,1-aminomutase activity; Cellular component=cytoplasm; Biological process =tetrapyrrole biosynthetic process
  Homolog annotation: Hit_ID=A7FM09; Match level="QueryCoverage=77%, HitCoverage=43%, E-value=6e-82, Identity=80%"; Hit description =Glutamate-1-semialdehyde 2,1-aminomutase
MTGFRVALGGAQAYYDVTPDLTCLGKIIGGGMPVGAFGGRREVMAALAPTGPVYQAGTLSGNPIAMAAGFACLSQIAQPGTHATLTALTDQLCAGLLAAAEAENIPLVVNHVGGMFGIFFTDADSVTCYADVTKCDVERFKRFFHLMLQEGVYLAPSAYEAGFMSLAHSQEDIQRTVDAARRCFAQLSPSGLPGFDPGRPACGRTSRRTPAGPRRAGQPSAIAAARDGSRAYAQYVAPSGQ

SEQ ID NO: 165644 - protein, 347 aa, Glycine max
  Coding DNA Sequence Number=SeqID_73959
  Gene Ontology: Mol. function=motor activity; Cellular component=cell projection
  Homolog annotation: Hit_ID=UPI00016621D1; Match level="QueryCoverage =98%, HitCoverage=40%, E-value=3e-17, Identity=30%"; Hit description =UPI00016621D1 related cluster
AFRGLHVLTIRGLHVLAFRRLHILAISGLHVLTFIGLHVLAFIGLHVLAFRGLHHLAIRGLHVLGFRGLYILTIIGLHDLTFRGLHALAFRGQHILNIRGLHLLAIRGLHALALKGLHILTIIRLHIFAFRGLHVFAFRGLHVLANRGLHALTFRGRHVLTFRGLHVLTFRGLHVLTFRGLHALIIRGLHGPAFRGLHVLTFIGLDVLAFRGVHVLAIRALHTLAFSGLHALTIIGLHALTFRGLEFLTLRGPDVLAFKGVHALAFRGLHVLPFRGMHAFAIRRLHALAFRGLHALAFRGLHVLVIRGLHVLHFRGLHVLTFIGQHVLTFRGLHAFAFRGLHVLAIR

SEQ ID NO: 165645 - protein, 16 aa, Glycine max
  Coding DNA Sequence Number=SeqID_73960
LPFWDYTPRVDYQSLA

SEQ ID NO: 165646 - protein, 48 aa, Glycine max
  Coding DNA Sequence Number=SeqID_73961
MTVILLLGRYHRICTFLFSARHYCGLSAIQCSLDLAKRDPVVLSHCVK

SEQ ID NO: 165647 - protein, 136 aa, Glycine max
  Coding DNA Sequence Number=SeqID_73962
  Homolog annotation: Hit_ID=A5ATL8; Match level="QueryCoverage=41%, HitCoverage=45%, E-value=3e-19, Identity=82%"; Hit description =Putative uncharacterized protein
TKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSREGELLQKPVLSRIVGCNSPA

SEQ ID NO: 165648 - protein, 64 aa, Glycine max
  Coding DNA Sequence Number=SeqID_73963
VKRSFSIGAGAVTSFGYRKDVDGQWVLKQDLPSPIPDERILSPPPQRYASSSLLTEVLIELHDL

SEQ ID NO: 165649 - protein, 246 aa, Glycine max
  Coding DNA Sequence Number=SeqID_73964
MIMKGQDIYSSQDEATTSPSSSKSEDAKREESSEEMYPQEEGDLLMVRRLLRGQSYDLTQSQRENIFHTRSKDKVEITLKWDEENNRKRKEEQTLIVKEECKEVSVSSKRLAKKDNHFAIKTNIKETSLLRQPPHLLLCKRSLVSTTIPLQLEVIPQVKELLDEGLGHKSLNPCALLVTKIGLMRHQIPMISGMMNVLSGATLLCKITHASNIFMIRIHRDSLGSDQGIPTGPKRIKVIREWLTPP

SEQ ID NO: 165650 - protein, 80 aa, Glycine max
  Coding DNA Sequence Number=SeqID_73965
  Subcellular localization annotation: CTP_CleavageSite=68; ConfidenceScore=5.21e-01
MALVRCIGGNSVPRRLSNVALRFASMNSLSRKAQSLLLVHLISPCLQVAVVVHFLVVSFGNATMEDVKLFELQEQGGTQE

SEQ ID NO: 165651 - protein, 66 aa, Glycine max
  Coding DNA Sequence Number=SeqID_73966
  Subcellular localization annotation: CTP_CleavageSite=33; ConfidenceScore=5.30e-01
MEANAVAVAATSVVAKVNLMPPSGLKQMNHPTSDMMGKDLGSTNGPMMCKFKTSTPSRHMARFPRR

SEQ ID NO: 165652 - protein, 33 aa, Glycine max
  Coding DNA Sequence Number=SeqID_73967
MAVVLYHGCGNHNSHDKIIVAIKISTYQSITTM

SEQ ID NO: 165653 - protein, 21 aa, Glycine max
  Coding DNA Sequence Number=SeqID_73968
MAWAKSCPVGPPPRSGGWPRN

SEQ ID NO: 165654 - protein, 70 aa, Glycine max
  Coding DNA Sequence Number=SeqID_73969
MWYHVSEKPPWGTYEYITRHTTPWVCQGTLTNIGLKEHSNPVTPKAYTPKSPLGPLPPDSGPTPKIIFCM

SEQ ID NO: 165655 - protein, 109 aa, Glycine max
  Coding DNA Sequence Number=SeqID_73970
MGDQEETQEQMKGGMSALKEQMASMMEAMLGMRQLMEKNVATAAAVSSAAEADPTLLATAHHPPPNAVGRERRTLRHNSNPHLGYNWVAYLTLTDYHLITRRQSCMTMR

SEQ ID NO: 165656 - protein, 99 aa, Glycine max
  Coding DNA Sequence Number=SeqID_73971
NHETGQYRLKAQVEKNEGQVEKDKAPEWRRMKAQVEKDEGPEAETLSRLLITYQGNPCDVYPDLSSFTGSGVYPDLSSFTGSGVIQTFVACIKRSAPTQ

SEQ ID NO: 165657 - protein, 126 aa, Glycine max
  Coding DNA Sequence Number=SeqID_73972
  Homolog annotation: Hit_ID=A5ATK3; Match level="QueryCoverage=85%, HitCoverage=30%, E-value=6e-08, Identity=30%"; Hit description =Putative uncharacterized protein
VGSGERIKFWTDKWLGTDYTLEQKYNQLSRISRQQSSLISSMGNFNNDSWEWDLTWRRNLFDHENDIVVQFMEEISFIPIQRHSKDSMVWLAEHHGHYTTKSAYKFTQSATLLNSVKALGTLYIRT

SEQ ID NO: 165658 - protein, 172 aa, Glycine max
  Coding DNA Sequence Number=SeqID_73973
  Homolog annotation: Hit_ID=Q6UUU1; Match level="QueryCoverage=34%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNSLQAGLYARTPRSVRPLRLIRGVSLEVMRRLRLKLKGQVLVTALLQASYLGSKSWVAQRTFRKTALQG

SEQ ID NO: 165659 - protein, 125 aa, Glycine max
  Coding DNA Sequence Number=SeqID_73974
MTTLTQIWMALLLSNILPSDHISDLPLPKCQLVYAILTQGLRLRDTQWTRRSPTGPWDFLLSAARGGPAATRCSCTTVASIGGTISGVHLRSPTEAKVLDAQVHAACDWQQAANHRGQVQLNEAS

SEQ ID NO: 165660 - protein, 132 aa, Glycine max
  Coding DNA Sequence Number=SeqID_73975
  Homolog annotation: Hit_ID=A8P6U5; Match level="QueryCoverage=18%, HitCoverage=40%, E-value=2e-07, Identity=96%"; Hit description =Putative uncharacterized protein
MKYECPDCPVNHYSIRRPTHRIRILCTGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 165661 - protein, 256 aa, Glycine max
  Coding DNA Sequence Number=SeqID_73976
MAEPSKKRKGTSSRSQRHSESQETLIPSSIPSGSLFSSDEQRIREGVPFEDTLIDDWKFDFSVHDARRLVCTNQADMTGRLLAGSLAFESLILHYLIVGILLPRSSNLSQVSEEDLIVMWAFHKGLQIDWAHLVRYRMHKALRLNAPLPYPHLVTLFLQHFNIPLDSEPYVPIKRSFLIGASVIASFGYQKEHDGSWVKKGARHVGEEGHDGEESSLLSKILDRFDGFQTFVGERFDTLELQVEMRFNEMESIITK

SEQ ID NO: 165662 - protein, 142 aa, Glycine max
  Coding DNA Sequence Number=SeqID_73977
RTLRHPYQMRAKARIISEIEEVHEQMKADMEAMKEQMTMMMEAMMSMRKMMEDNTATVVVASTATKMDPIHLTSFNQVNRPVLDVVGYTTKGGERPSTVLEKERIEHMEERLRVVEGEGNYAFADMAELCLVSDMVISPKFK

SEQ ID NO: 165663 - protein, 117 aa, Glycine max
  Coding DNA Sequence Number=SeqID_73978
MPQNVLYDAIGYINGVGTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTL

SEQ ID NO: 165664 - protein, 186 aa, Glycine max
  Coding DNA Sequence Number=SeqID_73979
MAPEKLSAKRSRRDTAAEGTSATPEFDSHRCKSAEHQQRFEGIKGWSFHRERCVQLRDDEYTDFQEEIARRHWASLVPPMAKFDPDIVLEFYANAWPTEEGVRDMRSWVRGQWIPFDTDALGKFLGDPLVLEEGQECEFSQRRNKADGFDEEAIAQLLCTPGADHAHQHEHLDPDVDDIAAQQCLA

SEQ ID NO: 165665 - protein, 715 aa, Glycine max
  Coding DNA Sequence Number=SeqID_73980
  Homolog annotation: Hit_ID=Q949M4; Match level="QueryCoverage=90%, HitCoverage=68%, E-value=1e-119, Identity=43%"; Hit description =Putative uncharacterized protein At4g28760
MPPSPATALALQLTDLAVEMNGVQNRRVHNVEKPFPGCLGRMVNLFDLTGDVNGNKLLTDRPHRDASSLSRSQSDVARIMSPTLGDQIEDKLIVSDSMRATNKKINGTPIKMLIDQEMSKEVVSKHNSPPNVVAKLMGLEAFPQGEPNLSVERSHRGDYSQHMCGQSGTPFNHWHLEDRFMDKEMLHEVHPNTEQIAYKDIYEIWLQSQRTSNVRDKTPEREKWTEDVNGKKMALIRQKFMEAKRLSTDERLRQSKEFEEALEVLSSNNDLLVRLLDSQNLYELQSTPVAETKRITVLKPSKMVDNENSGGKGKKNDKQIKKTANVGAGWEKYSPAYSPASQKIDKFPVQPTRIVVLKPSPGKTHEIKAVASPTMPSPQNLQSGNFYQEPEDDDVLESRKVPSEITQQMHENLRSHQRDETLYSSVFSNGYTGDESSFNKSDHEYTAGNFSDLEVMSPSPRHSWDYVNRCGSPFSSSSFSRASCSPESSVCREAKKRLSERWAMMSSSKGSQEQRHVRRSSTLGEMLALSDIKKSVISEFEGIHKEQEPSESASCSRNFSAETCVDGSPRNLSRSKSVPTSSTVYENGLNVEVCDNDAGKAHGSGELTKSKSMKSSFKGKVTSFFFSRNKKPSREKSCLSQSKIESQSTVIEASDSPVNLSRVLTDDVSQSFNSGSIGQCSLPAPYESSGKILADSNSNGQGVVPLEIAECPRII

SEQ ID NO: 165666 - protein, 179 aa, Glycine max
  Coding DNA Sequence Number=SeqID_73981
  Gene Ontology: Mol. function=nucleoside-triphosphatase activity; Cellular component=protein complex; Biological process=protein catabolic process
  Homolog annotation: Hit_ID=Q8LAV7; Match level="QueryCoverage=90%, HitCoverage=35%, E-value=1e-70, Identity=84%"; Hit description=26S proteasome subunit 4
MGQGTPGGLNRQGLPGDRKPDGGDKKEKKFEPAAPPARVGRKQRKQKGPEAAARLPTVTPLSKCKLRLLKLERIKDYLLMEEEFVANQERLKPQEEKAEEDRSKVDDLRGSPMSVGNLEELIDESHAIVSSSVGPEYYVGILSFVDKDQLEPGCAILMHNKVGLGYAADLLNCFSVLID

SEQ ID NO: 165667 - protein, 223 aa, Glycine max
  Coding DNA Sequence Number=SeqID_73982
  Gene Ontology: Cellular component=mitochondrion
  Homolog annotation: Hit_ID=Q1SKZ9; Match level="QueryCoverage=45%, HitCoverage=20%, E-value=4e-07, Identity=26%"; Hit description=Zinc finger, CCHC-type
  Pfam annotation: Domain name=AT_hook; Domain location=28-40; Score =14.3; E_value=0.081; Accession=PF02178.10; Description=AT hook motif
MIINGHVIIMMMAEKKYWGGRGRGRGRGRGRGRPAKIPVPPSTTTQKSPPKLNPEPSNASHEVTVEDYVSSEDDESEETPIPSTNLPNCNVPEKPKEETNENKVPRKLWTDVISGNRKPENGMALEFFAPKIVEGKSIAEIEPEDIIGELKYWESALIMYVIGRDLSMNSVKQFMEKNWSFVKLPDLFYNDEGYFIMRFHSSQDKDEILSKGPYTIMNMTMLL

SEQ ID NO: 165668 - protein, 146 aa, Glycine max
  Coding DNA Sequence Number=SeqID_73983
  Gene Ontology: Mol. function=DNA binding; Cellular component =chromosome; Biological process=nucleosome assembly
  Homolog annotation: Hit_ID=UPI000065E2E5; Match level="QueryCoverage =60%, HitCoverage=55%, E-value=5e-39, Identity=94%"; Hit description =Homolog of Homo sapiens "Histone 1, H2ai
  Pfam annotation: Domain name=CBFD_NFYB_HMF; Domain location=28-91; Score=5.0; E_value=0.055; Accession=PF00808.14; Description=Histone -like transcription factor (CBFNF-Y) and archaeal histone
  Pfam annotation: Domain name=Histone; Domain location=25-94; Score =68.8; E_value=1.8e-17; Accession=PF00125.15; Description=Core histone H2AH2BH3H4
  Pfam annotation: Domain name=TAF; Domain location=28-92; Score=-6.7; E_value=0.024; Accession=PF02969.8; Description=TATA box binding protein associated factor (TAF)
  Pfam module annotation: Pfam domain module=CBFD_NFYB_HMF::Histone::TAF ; Domain location=28-91::25-94::28-92
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGAFLVRCIVIFASIEMEQRVFCFWNSLLVEAFVIVIASVLTVLKG

SEQ ID NO: 165669 - protein, 218 aa, Glycine max
  Coding DNA Sequence Number=SeqID_73984
  Subcellular localization annotation: CTP_CleavageSite=62; ConfidenceScore=5.53e-01
MVRKAVFSVSCGAIKIWWKPCRRSSLEKQVAMPSSSRSSSMVGIGKQSFFFTSSTSEENGAMAEGDEAGRQKFIHLTFNLCFLKIRVAVQAYVHEVGISEKKVVDCGERAAELQGGGVRGGGWCINVEGDWTAVEVELHGQRGVISDNRSELYEPLNAQDDVSTVDGKDVKVHGERRALKEDGSLVAYMGARNDGVVTDSNLEGKGGGGGKTEMLGHP

SEQ ID NO: 165670 - protein, 373 aa, Glycine max
  Coding DNA Sequence Number=SeqID_73985
  Gene Ontology: Mol. function=inositol or phosphatidylinositol phosphatase activity; Cellular component=intracellular; Biological process=abscisic acid mediated signaling
  Homolog annotation: Hit_ID=A7PSY4; Match level="QueryCoverage=95%, HitCoverage=77%, E-value=1e-138, Identity=66%"; Hit description =Chromosome chr8 scaffold_29, whole genome shotgun sequence
  Pfam annotation: Domain name=Exo_endo_phos; Domain location=91-363; Score=59.8; E_value=9e-15; Accession=PF03372.14; Description =EndonucleaseExonucleasephosphatase family
MRTESKKISKSSWPKLAVRKWLNIKSSAERFHSDYDATTAIAKERRRSCSDRDRYVVVPDDLSEGWVMDSTSGMKKKSAPGPGTGGPDLRMFVGTWNVGGKSPNEGFNLRNWLTCPSPADIYIIGFQEIVPLNAGNVLGPEDSGPAAKWLGLIREALNSNEELDNTGQNSPKSSPRYCLAASKQMVGIFLSVWVRADLCNHVTNLKVSCVGRGIMGYLGNKGSTSISMTLYNTTFCFVCTHLTSGEKFGDELRRNLDVSEILKKTKFYHSFKSLAHPLPPESILEHDNIIWLGDLNYRLASGYDDTHELLKKNNWQALLEKDQLRIEQKAGRVFKGWNEGNIYFAPTYKYLTNSDHYVAQSSKSKIKRRTPAW

SEQ ID NO: 165671 - protein, 286 aa, Glycine max
  Coding DNA Sequence Number=SeqID_73986
  Homolog annotation: Hit_ID=A5ARE7; Match level="QueryCoverage=54%, HitCoverage=55%, E-value=1e-21, Identity=40%"; Hit description =Putative uncharacterized protein
  Pfam annotation: Domain name=DUF1635; Domain location=1-197; Score =16.7; E_value=3e-10; Accession=PF07795.2; Description=Protein of unknown function (DUF1635)
MEANAKIKKYEETVKHLYKLLKKVCQERDEARGQLQLIRNFQASTPAETSSTIPQVDHPCLQYKTKPSLNSTKSLSHTRIAEPSNLTLTKQPNHMKADIGASRDNNMVDGASLVFDKLVCGKPLPQIGRLLQSVTEAGPLLQTLLVAPAPQWQNPPSLSSSGLTLGTQDNSSSTNTDDKANVNPNGFIPTSLGLVFPGNSHVPSQMSYASGFGLALKNELVLPTMYCKQEVRNGMVPNHAYPFVFYRGMPRNGSPPGGLMIKTYREAARTEVEVWLRLARHDVDGA

SEQ ID NO: 165672 - protein, 136 aa, Glycine max
  Coding DNA Sequence Number=SeqID_73987
MEEKKPKVNEIKMKAKKTRNELKVSDSKTYPLKNEERMKNGEERRKTFTDLLTEMSRKRCGNTSAWIFFTETIYFHPKQLKCIARGVGDIWNSPLSPIYRKKGEEVAAQLAQANWVDSSRTNPASKIFWKAPDSKI

SEQ ID NO: 165673 - protein, 124 aa, Glycine max
  Coding DNA Sequence Number=SeqID_73988
  Gene Ontology: Biological process=transposition, DNA-mediated
  Homolog annotation: Hit_ID=Q1J7G7; Match level="QueryCoverage=32%, HitCoverage=70%, E-value=9e-12, Identity=73%"; Hit description =Transposase
VLQWLLFLSAVPPVQLLTGWCVTAKAPPDISAGKCSGRVPFAIQAAQLLGRAIGAGLFAITPAGERGMCCKAIKLGIRSAIGGYHEWLKVHIRGLDWLAKLKVVSKESFEAPEEDEEVQALKAS

SEQ ID NO: 165674 - protein, 110 aa, Glycine max
  Coding DNA Sequence Number=SeqID_73989
  Subcellular localization annotation: CTP_CleavageSite=74; ConfidenceScore=5.64e-01
MASGDSIKFLKTLDFPSFFTVLHRSSCVLCSSTGLSSSSQLRIHRSKSPAFVDHPKRSLMVQRLNVSLISKTKRSLMVQRLNVSLLSKTKRSLMVQRLKVSLLSKNQKIV

SEQ ID NO: 165675 - protein, 62 aa, Glycine max
  Coding DNA Sequence Number=SeqID_73990
VLQWLLFLSAVPPVQATDGVAAQLLGRAIGAGLFAITPAGERGMCCKAIKLGNARVFPVTTL

SEQ ID NO: 165676 - protein, 159 aa, Glycine max
  Coding DNA Sequence Number=SeqID_73991
  Homolog annotation: Hit_ID=A6H5B3; Match level="QueryCoverage=38%, HitCoverage=78%, E-value=1e-24, Identity=87%"; Hit description =Putative ribosomal protein S3
CRAARRSSRECCTLDGESPVAESITSLRSDPSSMGHVESRVNQQGPPCKAKYSWVTDSEVVPETTGAVAKASLHRAIVTAYGPEPGGEMPLEPRASWFSPKCVEAQQLTRHLGVKHCFGAGRESGKQPGSPAKALNDRSVIKEVGVQRQPGGLPRSSHP

SEQ ID NO: 165677 - protein, 49 aa, Glycine max
  Coding DNA Sequence Number=SeqID_73992
CRPLLMEACLWSFYGGWIFELQCGPSMVIFHHGDAAEGKGEEERGGTIH

SEQ ID NO: 165678 - protein, 134 aa, Glycine max
  Coding DNA Sequence Number=SeqID_73993
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MKATFTDTPHQCPTYPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 165679 - protein, 204 aa, Glycine max
  Coding DNA Sequence Number=SeqID_73994
  Gene Ontology: Mol. function=structural constituent of ribosome; Cellular component=ribonucleoprotein complex; Biological process =translation
  Homolog annotation: Hit_ID=Q2PMP9; Match level="QueryCoverage=53%, HitCoverage=89%, E-value=2e-53, Identity=99%"; Hit description =Chloroplast 50S ribosomal protein L14
  Pfam annotation: Domain name=Ribosomal_L14; Domain location=86-204; Score=200.8; E_value=3.3e-57; Accession=PF00238.10; Description =Ribosomal protein L14pL23e
  Pfam annotation: Domain name=Ribosomal_L16; Domain location=1-108; Score=131.7; E_value=2.2e-36; Accession=PF00252.9; Description =Ribosomal protein L16
  Pfam module annotation: Pfam domain module=Ribosomal_L14::Ribosomal _L16; Domain location=86-204::1-108
MKGISYRGNHICFGRYALQALEPAWITSRQIEAGRRAMSRNVRRGGQIWVRIFPDKPVTVRPTETRMGSGKGSPEYWVAVVKPGKILYEMGGLIIAGARELMCIRILGASNRRYAYIGDIVVAVIKQAVPNTNLERSEVIRAVIVRTCKELKRSNGIIIQYDDNAAVVIDQEGNPKGTRIFCAIARELRQLNFTKIVSLAPEVL

SEQ ID NO: 165680 - protein, 118 aa, Glycine max
  Coding DNA Sequence Number=SeqID_73995
MQIVYDRMNRLNNLHVYIAVCVSGLQQLALDKIYHSPEESALKDLKDKDVLDIVSDIVDPAASILHLTFILPCALYSNSSIFGQDVLDIVSDIVDPAASILHLTFYLALCIVQPDLIP

SEQ ID NO: 165681 - protein, 126 aa, Glycine max
  Coding DNA Sequence Number=SeqID_73996
LLSGYCKERDGSWVKKNAPIQAAEDRSPSPHSQRDDSSSLLHSILERFDGLQTYVGLSSSKGGDCGSNAFQDYFDDAKESRVKQIPKIQESSFKNQDSRIKNQVSRTNKIKIQDSRFKNQEKTQSR

SEQ ID NO: 165682 - protein, 107 aa, Glycine max
  Coding DNA Sequence Number=SeqID_73997
SSSIQEEEEEEEKEEEEEEEEEEFDDEEDFSLFVKKFHKFVKNRRMERNHNFNNGKRSQEVSRHLNAISVINPAYIAWDDNDSSDGSKKEINLLSMDYESDENISQE

SEQ ID NO: 165683 - protein, 202 aa, Glycine max
  Coding DNA Sequence Number=SeqID_73998
GKIKLKTPEEATELIENMSASGHAILRDRTHQPMKKSLIELSSHDALLAQNKLQVVPSVVRLMKQANGPYNQQGQWRTHPSNQFNKDQSGPSNMPIQQGPNIFQRTTKLEETLTQFMQVTMSNHKSTESSLKNLEVQVGQLAKQIADKSSNSFVANTEQNPKEECKTVITRSKRFVEVEDEDSVVHEKKIADKKSTDGKKNK

SEQ ID NO: 165684 - protein, 121 aa, Glycine max
  Coding DNA Sequence Number=SeqID_73999
MPPTRHPLDPDKSNRALGFPALITGLCQSFDVPVTPSKRSIARLDRRKVAHPQAPDAPPPPHQADPAGSFDTERVEVAWPRDWPEAQAGEAPAEAPGDADEARMDEEMTDLLDFLGGSGAT

SEQ ID NO: 165685 - protein, 108 aa, Glycine max
  Coding DNA Sequence Number=SeqID_74000
MALKKISTKRFRRDTATEGSSAAPEFDSHRFRSAEHQQRFEAIKGWSFHRERHVQLRKDEYTDFQGEIARRHWTSLVTPMVKFDPEIVLEFYAMLDPQRRECEICVHG

SEQ ID NO: 165686 - protein, 91 aa, Glycine max
  Coding DNA Sequence Number=SeqID_74001
MYIPVLRFCMSASCCHTCIVCWSRLFVMGSQKIHITFLTTHMGHCTPKCATHDFTKKVNQVKLKYGSNHLAKIGAKDGSGYIVASSTAKHI

SEQ ID NO: 165687 - protein, 144 aa, Glycine max
  Coding DNA Sequence Number=SeqID_74002
MFLFLCFEAHCKPQVKNHDLTLTLRNFGALELLAPTSHTLDLNMDRARLVYGLVTGMDMNIGGLISGQITIMAQSNSSRLGFPALITALCRSRGVGSDALTSYKSLRPVINLAYIKRKCWNVNDQTVNFPGARKTRSRAAGVLH

SEQ ID NO: 165688 - protein, 191 aa, Glycine max
  Coding DNA Sequence Number=SeqID_74003
  Gene Ontology: Cellular component=mitochondrion
  Homolog annotation: Hit_ID=A6H595; Match level="QueryCoverage=36%, HitCoverage=80%, E-value=5e-28, Identity=85%"; Hit description =Putative 23S ribosomal RNA
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPMSRRLIGSGLVRETTGAVAKASLHRAIVTAYGPEP

SEQ ID NO: 165689 - protein, 204 aa, Glycine max
  Coding DNA Sequence Number=SeqID_74004
  Homolog annotation: Hit_ID=A7R5Q5; Match level="QueryCoverage=49%, HitCoverage=21%, E-value=2e-11, Identity=38%"; Hit description =Chromosome undetermined scaffold_1022, whole genome shotgun sequence
MAQPPPRERTLREMAAPDFTYESLCIQYPDEDVPYVLKTGLIHLLPKFHGLAGEDPHKHLKEFHIVCSTMKPLDVQEDHIFLKAFPHSLEGVAKDWLYYLTPRYNPGWRNHPNLRWSNPSQQQQQQQQPYFQNVVGPSRPYVPPPIQQQQQQQQQPQKHQTVEAPPQPSLEELVRQMTMQNMQFQQETIASIQSLTNQMGQLAT

SEQ ID NO: 165690 - protein, 58 aa, Glycine max
  Coding DNA Sequence Number=SeqID_74005
MKLEIGSGNYWKLKVENGSWKLEVGSWKWKLLEVGSWKWKLLEVESLKWKLEVEVTGS

SEQ ID NO: 165691 - protein, 142 aa, Glycine max
  Coding DNA Sequence Number=SeqID_74006
MAQPPPRERTLREMAAPDFTYKSLCIQYPDEEVPYPPDVQEDHIFVKAFPHSLEGVAKDWLYYLAPSNMERSMIDAASGGALRDMTPAEARNLIEKTASNSQQFSARSDAIVIRGVHKVATNSSSSAETKKLKGKLDALVNL

SEQ ID NO: 165692 - protein, 129 aa, Glycine max
  Coding DNA Sequence Number=SeqID_74007
  Homolog annotation: Hit_ID=A5AX49; Match level="QueryCoverage=90%, HitCoverage=37%, E-value=5e-10, Identity=28%"; Hit description =Putative uncharacterized protein
MTDKRKVLGKNNEETRSYFTWNLEMERVLADVLRDQRNLGNKGDGGWKRSILNVVAAVLSTSFNVNVTSDNVKNRIKLWRSGFDWDDTKHMITVENENAWNEYCTSHKSAKPFRYKVLQNWDDIVDLCA

SEQ ID NO: 165693 - protein, 242 aa, Glycine max
  Coding DNA Sequence Number=SeqID_74008
ETSLSTAIPLELEVIPQVKELLDEGLVRKSLNPRALLVPKIGIIRHQIPMIGGIMNVLSGATLFCKITHAPNIFMICVHRDSLGRFVLIFYFNANLGAHVGHLSDQGLPMDPKRIKVIPEWPTPPTPLIELVRNHVPSWEDIHERGVEGRSLEYEEPRDLRSNPFQGGGDDAILPPKALASLGIFSRKLLKEVSLAIIGENPLTSCSLHMKEKGKAKNEVLESKQSLTKLKSMREDSSDEEE

SEQ ID NO: 165694 - protein, 102 aa, Glycine max
  Coding DNA Sequence Number=SeqID_74009
MEHIVQMKGRLNLNVTTTSNGGMRTISNSDVLEQELDVLLKGSIKARRCSNDDGGKWLTAEDGIERRPMPYPCICKEAVSGFEPMTNKSPRRNFTAAPGLAL

SEQ ID NO: 165695 - protein, 171 aa, Glycine max
  Coding DNA Sequence Number=SeqID_74010
  Subcellular localization annotation: CTP_CleavageSite=28; ConfidenceScore=5.37e-01
MEFSMSPGIFNESKFPYVDMFENSTPVSQSTSSSIPFQFPSIPIVQSPNLSQPTSTPSQPTQTHISSTSVHSHSSDADHSPSVSAQSSPIHQPAQSKIEIPTSNPTQLSEHNTTDQSPPITDVSVPGISSEATSSSMDPTSSHRPVNTHPMQTRSMCLATSIVIMQAENYC

SEQ ID NO: 165696 - protein, 639 aa, Glycine max
  Coding DNA Sequence Number=SeqID_74011
  Gene Ontology: Mol. function=translation elongation factor activity; Cellular component=mitochondrion; Biological process=translational elongation
  Homolog annotation: Hit_ID=A7PKH3; Match level="QueryCoverage=40%, HitCoverage=33%, E-value=1e-120, Identity=83%"; Hit description =Chromosome chr15 scaffold_19, whole genome shotgun sequence
  Pfam annotation: Domain name=GTP_EFTU_D2; Domain location=369-434; Score=56.5; E_value=8.9e-14; Accession=PF03144.16; Description =Elongation factor Tu domain 2
  Subcellular localization annotation: CTP_CleavageSite=18; ConfidenceScore=5.21e-01
MASASPTFSFSGTPTITTAKLNWKNYLSWSTSVELWFLGQGYQTTWKKELVLFQMTRDLSGKNLTFNYVLCRGNLLSRMFWKSLDHSKHTNHDMLAHIGKARAAVEELKRFLVTDSLEEVNRKLNKFCMVLILRSLHSDFDHVHDQILSMDSLVTRLLRVSHVLKDENLAEVVETSAMVAPRGRGAMDILNAPIARGWVILKKIVTPYMAFRQGTWYGSSDWRRTASPGAAVKLCLGDLLVMGSNPETASLHMQGHPNTERLYANPPLNTKTFPNITGPGVESDDSVSVVPNTPCQGYPPSLPALYVNVLHNTGVQPLLDGVISYLPCPIEVSNYALDQAKNEDKVELRGSPDGPLVALAFKLEEGRFGQLTYLRIYEGVIRKGDFIINVNTGKKIKVPRLVRMHSDEMEDIQEAHAGQIVAVFGVECASGVCQESFAGDTFTDGSVKYTMTSMNVPEPVMSLAVQPVSKDSGGQFSKALNRFQKEDPTFRVGLDPESGQTIISGMGELHLDIYVERIRREYKVDASVGKPRVNFRETVTQRADFDYLHKKQSGGQDRAGLLWKIDACSCTVLVCKFLFGLNVGQDCDLGNPFDSSKVMDDALLLAWSWLKGGTIGVLYLFIFHQYLWMGMGMGLLFCN

SEQ ID NO: 165697 - protein, 444 aa, Glycine max
  Coding DNA Sequence Number=SeqID_74012
  Homolog annotation: Hit_ID=A7UQU7; Match level="QueryCoverage=59%, HitCoverage=59%, E-value=3e-22, Identity=27%"; Hit description=IMP dehydrogenase/GMP reductase, putative
  Pfam annotation: Domain name=DUF1723; Domain location=132-181; Score =51.5; E_value=2.9e-12; Accession=PF08330.1; Description=Protein of unknown function (DUF1723)
MQIIVRTKGLGWTLGRVIGRALGREVNRDLDEALQRRRPTTSAYRQREAAPVAEDPEEAAVDDVVPYVDGFLGGTHDTSVLIGYVHHVAERPELKLSSHGRKVEKFGRPTPEIEGLVAVTGLSPMIACSLGTGDWGLISAFVERWHKETSSFHLPVGEVTITFDDVASLLHLPIIGAFHSFKVLHMDEVVLLLVELLEVSANEANVETIQCCTLFANKSVVFLDAFRDLTQSGSYAWGSAALVHMYENLNDASKSSAKQLAGYITLLQSGKALPVLTYQERLNRLTSDVEYWIPYDDHRAYREFKLISLFSRRIRWGPSVVIHRPERIVRQFGYAGDPPRHPPVVHDDTFIEIYIPQHLMTAKAMEEAPADALGHVEKPRHAVEACQTIAERLEWLLNLRIVTNGTKAYIVMEDCLRISQCVMRNTMYTCSHNEGSIWKTHEDL

SEQ ID NO: 165698 - protein, 232 aa, Glycine max
  Coding DNA Sequence Number=SeqID_74013
MMIGCGITWMLWKLGRIDGDPTLRGTRIRATWEYMSSVGGGQQGMVEWYLEICRGGQETLGTSGGVLFPKTKLDQSQPNPGIVSQLENEVRKLGRLLIVMAAQLIHDRVEMECLEGAWETLEGNTRCLFRGTIRFTATSLVHPDEPARTLQRTVEWILPTPTPYRLVEPVQVIKDPEELPPEPAVDALDFLEGDEDPLPEVDSPEDVMSASEADSTEDSGPGEMAISGGSSS

SEQ ID NO: 165699 - protein, 73 aa, Glycine max
  Coding DNA Sequence Number=SeqID_74014
YILCGTSRGYIYLGLTENKKGYISCGSVLVEGTSTRVSKRTREAKAARGGHQWSVVVEEEVGGVGRGFRGRDA

SEQ ID NO: 165700 - protein, 324 aa, Glycine max
  Coding DNA Sequence Number=SeqID_74015
  Gene Ontology: Mol. function=aspartic-type endopeptidase activity; Biological process=proteolysis
  Homolog annotation: Hit_ID=A5BKX9; Match level="QueryCoverage=67%, HitCoverage=62%, E-value=3e-56, Identity=47%"; Hit description =Putative uncharacterized protein
MATPFKTKDVNEEITPKDIRSLMEQANYTNKYLQVLGESISKEKVFTKPKDHGSSSSAIQKEKPLFKPFKVSEKAKQRFRELRKQKLPNEEVEQVSEEGSVSEKIINPINTKHWKTPSKLYYQRPNTPDLLLEEKGKNNFKSFSENNIYEWNIDAQIEYNIMNTLQHMTMVATAYQTSHKCLEETIVDILVAGFSGQLKGWWDNYLTNEEKSKIYNAIKMDPNGKVITNDDNEEIPHTVNTLIFTIAQHFIGDPSLWKDRSAELLSNLKCRTLADFRWSKDTFLTRVYAREDSQQPFWKEKFLAGLRRSLGDKVRDKIRSQDIP

SEQ ID NO: 165701 - protein, 157 aa, Glycine max
  Coding DNA Sequence Number=SeqID_74016
MIYHTKFDEFKADLERRNWHKELTNFLDGSIDVAIVKEFYANLYDPEGKSPKQVRVRGHLIKFDEDALNTFLKTPVIIEEGEDLPAYSRFCRLRPDPQELANRLFIPRRGFELNADGLPLKILRKNLTTLAQTWSVLSFSNLAPTSHTLASHWTGPG

SEQ ID NO: 165702 - protein, 56 aa, Glycine max
  Coding DNA Sequence Number=SeqID_74017
MYHQERKTLDEASLLSSESEIQHDHRSTSTSYDSHRPRVLPVLLRILRCDEEFRPT

SEQ ID NO: 165703 - protein, 63 aa, Glycine max
  Coding DNA Sequence Number=SeqID_74018
MRVRKLHEHVKAQIENKRESYAKQAKKGRKKFVFEPGDGAFERFILNNKQKRQLRRWTLNDLK

SEQ ID NO: 165704 - protein, 452 aa, Glycine max
  Coding DNA Sequence Number=SeqID_74019
  Homolog annotation: Hit_ID=A5BSR3; Match level="QueryCoverage=38%, HitCoverage=50%, E-value=3e-15, Identity=31%"; Hit description =Putative uncharacterized protein
  Subcellular localization annotation: CTP_CleavageSite=41; ConfidenceScore=5.69e-01
MATPPSVPPPPPTNVASQSSSTLKWTRKATRLRSLATRPARAERQVDVTYENWKQVPTAQKDLIWEDIQFKFALMSKWALRADKDSVDDIRSFVGGIYVVIMSFINVEFLQDKLMDEKTNKKLEEAGQSGSTEAMIDPPSPIRQHIKWKMARTKKTGQMTSEAAKQIADKIDSLKELTSQGSFVAHGRQDVLTATIGRPEHPGCVRAAGVNVTIKQYFGLTPRTSCTSSSMAPEGLEHLTQQIRDQLEESITEKGLALPPELEVGPLAACVSAKESCVDPLGKNPDSSDSDKCGLYIEENPPRLVGVEEVRDADAPIPVPTEEVKLVGQTLNTFLAWPTHLVKCLSEQGAVGPAKPADRQDHEVDDPLYLMALTIPQLFLKPLQVMWDATMFGVFNEDFPLYIKHEDLSEIAHGGNYNYVQLQSTDTLIKVILVVKKVELPNLDSTDPVGIV

SEQ ID NO: 165705 - protein, 88 aa, Glycine max
  Coding DNA Sequence Number=SeqID_74020
MEEKVKKKINGGLRSTYLKLLCSDYHLMEACLWGFYGGWIFELKWGPLMVIFHHGDAAEDKGKEVASLRSFLEKISLRSFFEKTSLRG

SEQ ID NO: 165706 - protein, 69 aa, Glycine max
  Coding DNA Sequence Number=SeqID_74021
MTTIGNGEIDRDVHGLKLVDEVAKCFGSCLWGFYGGWIFELKWGPLMVIFHHGDAAEDKGKEVRGGAIH

SEQ ID NO: 165707 - protein, 83 aa, Glycine max
  Coding DNA Sequence Number=SeqID_74022
MSNESEPTNENSRRNPLTLKDANPQLEIRPDAHHSNKMEWMRRMKKVVGRITPPELVSHTRWCSLINQFLESLKELRRFTLTL

SEQ ID NO: 165708 - protein, 139 aa, Glycine max
  Coding DNA Sequence Number=SeqID_74023
MATVQHLVMDNKKRMPIICKTRPDLNKTFKQATKAIEVAQGSTTTTSSTRQIVQDGRYFNTVYAEVQVGQLAKQLSEHGSGSFSTTTQVNPKEHCNLVTTRWGTVIGLKDNDEKMNKEGVEKENKKNDEVVTSEKVEEK

SEQ ID NO: 165709 - protein, 297 aa, Glycine max
  Coding DNA Sequence Number=SeqID_74024
MGYVGVRELSWRWATGDGGFMRDLWMWKTCCAPSPDRHLVPHVMVVPGDMSRGSGDLGDVRRAPGSQQIKGTKTTKQGGLCGGWPAVNFEFIWDVASGNRLPRVGLKTRSGSYEGFWQQVVEASGNRLPVCVIDYIEEWVTGNRLPAQLIHDRVEMECLEGVWETLEGNARCRFRGTIQFTATSLVHPDEPVRTLQRTVEWILPTPTPYRLMEPVQVIEVTSSEEDPEEDLEELPLEPAGDALDFLEGDEDPLPEVDSPEEIMSASEADSTEDSGPREMATSGGSSSYHHCGHLCSG

SEQ ID NO: 165710 - protein, 157 aa, Glycine max
  Coding DNA Sequence Number=SeqID_74025
MTVHVAQIIANAIYLFAGTAPTRHPLDPEKSNKALGFPTLITSLCQFYGVVVIPSKVIRPPITRAFIKKYCTPRQAQGDTQQAVDAPPPQQPDPIRPLSVEQYLRHVVHYQAANNRGQVQLHECFYHFSLSQQGQGSTPFICPTLEQFRAEVAWPGD

SEQ ID NO: 165711 - protein, 198 aa, Glycine max
  Coding DNA Sequence Number=SeqID_74026
  Gene Ontology: Mol. function=nucleic acid binding
  Homolog annotation: Hit_ID=Q6RZV4; Match level="QueryCoverage=24%, HitCoverage=22%, E-value=4e-09, Identity=60%"; Hit description =Retrotransposon-like protein
MRGVPSEESIAPFITRGFSDPNARMLQRVRKAWNAVQWKDKEIRGSNYKATSCVCTSTALNMDDYKSLQIEFEIFKKDHYAECMKLQTELSYLKVLFRKLNKGKSDLNHMLNVQKHTTDKTGLGYNKQTTFSKKTKFVSSKGVNPDKVCLKARDSLWYLDSGYFRHMTGDKSKLTDFVSKEGGYVTFGDNNKWKIMGE

SEQ ID NO: 165712 - protein, 118 aa, Glycine max
  Coding DNA Sequence Number=SeqID_74027
MSFVAQVEGTSTWVVILRTREGTSLVDQFKWRVHLGCSKRTREGRHRSHLRPHFHRREKERKPQEANIILPYFHGKDNVEANLDWEIRVEQQLKRKSTSKSYGSHSYPKKDQGQGILG

SEQ ID NO: 165713 - protein, 166 aa, Glycine max
  Coding DNA Sequence Number=SeqID_74028
  Homolog annotation: Hit_ID=Q6WAY6; Match level="QueryCoverage=22%, HitCoverage=6%, E-value=8e-07, Identity=62%"; Hit description =Putative uncharacterized protein
VVDLAAINAFLAYHHSKESSVIAILADFYDTPAYPLQGHCLYAKKGKANLEQLLARFPNVPLMGTRDCINYNPVLAIRQLGYPMRGAPSKESIKPFIARGFSDPNTRAAREEEVETPEESEEVQTLKAELERAQAIKEKFKSTAIKFRKEYDELRDVNMATTEALE

SEQ ID NO: 165714 - protein, 160 aa, Glycine max
  Coding DNA Sequence Number=SeqID_74029
  Gene Ontology: Mol. function=oxidoreductase activity
  Homolog annotation: Hit_ID=A7PX74; Match level="QueryCoverage=96%, HitCoverage=33%, E-value=2e-52, Identity=56%"; Hit description =Chromosome chr12 scaffold_36, whole genome shotgun sequence
MQNRCGFERKGDIWVNDILNLGVSPAKLIEIVKTRFISLGGVIFEGCGVSCINVYEDAAVLKLSGDKILSSRLIIDAMGNFSPVVKQIRGGRKPDGVCLVVGTCARGFETNSTSDVIFSSSSIKKVGDSKAQLFWEGVSLDNLEILRVIYGIFPTYRQRY

SEQ ID NO: 165715 - protein, 265 aa, Glycine max
  Coding DNA Sequence Number=SeqID_74030
  Gene Ontology: Mol. function=chloramphenicol O-acetyltransferase activity; Biological process=response to antibiotic
  Homolog annotation: Hit_ID=P62577; Match level="QueryCoverage=82%, HitCoverage=99%, E-value=1e-130, Identity=100%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGVIFLRQLLVPRIFYLINKMIFLRSFGLRVISCSETKNRLAGRFSKVL

SEQ ID NO: 165716 - protein, 267 aa, Glycine max
  Coding DNA Sequence Number=SeqID_74031
SSKCCARKSDVPILFLTARDGVQDRIHAGRAAPPGGASGTGDPVDQQGVHAAAPAGAARGRSAVAHADRLSACAASAMSASHARERAHFTSAGVADAAHRHAVRAGGRFGGRADFPNSGAKTAHQREPGRGGIAADRADAGRPGADVGRRARRGNGAGGAAARGFSDGAPGRRQPVADLRRARDGQRAEDAGALPVAHRRGGGGGFPADCAVGVWGHAPGIEAVMAHGGAGVADCAQYAVDAPQRAGGAERVAAVDPFVQCDARSVE

SEQ ID NO: 165717 - protein, 106 aa, Glycine max
  Coding DNA Sequence Number=SeqID_74032
MKKNYTTWIWHGEVTDMQSGSQFEPFDVEMGDRLEDMICDLGQKCFQEARQGKSIGVNVEDDDSYMDTYVSPLTAQITPNVVGEEEADDIHANRNDHDEGELINIV

SEQ ID NO: 165718 - protein, 119 aa, Glycine max
  Coding DNA Sequence Number=SeqID_74033
  Subcellular localization annotation: CTP_CleavageSite=36; ConfidenceScore=5.50e-01
NSNSSPLSFTGLKVLAVTGLKVLAFIFHRTQGPLSLCFHRAQSPLSFTFQRLQCLQSFTLSKDYNCGSNDFQDYFDDAKESRVKQVPKNQESKSFKNQVSKNQDSRAIKFQDSRFKNNQ

SEQ ID NO: 165719 - protein, 67 aa, Glycine max
  Coding DNA Sequence Number=SeqID_74034
MPKDRGTCLDFRDCHHQKGGDCRRRIKLNVLMMPKVHMRLKALFKTKKLKIFKMNDQDKSLVLERVY

SEQ ID NO: 165720 - protein, 104 aa, Glycine max
  Coding DNA Sequence Number=SeqID_74035
MAYERGGDFLEDARKILNREAFPPGGSLVRSPVPAFRFTGVIPLLWPRLSHSTPDTQFRVGSSLQAGLYARPPRSVRPLRLIPETIRLESNPERHAKAPLAAAT

SEQ ID NO: 165721 - protein, 237 aa, Glycine max
  Coding DNA Sequence Number=SeqID_74036
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
IYSAQSASGDAAQLTDLVYDGVFEVLQWLLFLSAVPPVQLLTGWCVTAKAPPDISAGKCSGPPARRVPFAIQAAQLLGRAIGAGLFAITPAGERGMCCKAIKLGNARVFPVTTLNSIRGQPRDPGVLCERLTGVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 165722 - protein, 135 aa, Glycine max
  Coding DNA Sequence Number=SeqID_74037
MEWYQSNTLIFLNMQPSSESSMNFETGQSSKATNIVQPEYYILPGASNMDYTPPVVQPDDFLSNVFGTDCGMPASACEYMHSLQNKVEPSFTLMFNQDVEENNPSLHDIPDECPHRNSGRNMRCPPYGPGHHYGD

SEQ ID NO: 165723 - protein, 75 aa, Glycine max
  Coding DNA Sequence Number=SeqID_74038
MKNNKVATAGVSLSEGYALSEQYLLSKTIAGEENLEENLPRMHALSAPSACPASHLSLLAPNALDSLSQKSLTCA

SEQ ID NO: 165724 - protein, 87 aa, Glycine max
  Coding DNA Sequence Number=SeqID_74039
  Gene Ontology: Mol. function=structural constituent of ribosome; Cellular component=chloroplast; Biological process=translation
  Homolog annotation: Hit_ID=Q32703; Match level="QueryCoverage=43%, HitCoverage=90%, E-value=9e-12, Identity=86%"; Hit description =Putative uncharacterized protein
MNSQYICFYLMPFFVHGSIFWCPRRRGTTPIHPELGGYSGEQISSGDDGVGPVAQRIRARGYEPRCRGFESLLAHNRPKKGRFFPLG

SEQ ID NO: 165725 - protein, 54 aa, Glycine max
  Coding DNA Sequence Number=SeqID_74040
THLLLEVASPLSLPFSIPLPFIFQEAKESIDEEDPRPTSSNGACIITRATHLVR

SEQ ID NO: 165726 - protein, 67 aa, Glycine max
  Coding DNA Sequence Number=SeqID_74041
MSSPSEDYTSLPSEDYTSLPPEDNVSSPSEGCTPSPPLAIYICLGSKIPWICMYIAKIPHKNIHMFR

SEQ ID NO: 165727 - protein, 231 aa, Glycine max
  Coding DNA Sequence Number=SeqID_74042
  Gene Ontology: Mol. function=chloramphenicol O-acetyltransferase activity; Biological process=response to antibiotic
  Homolog annotation: Hit_ID=P62577; Match level="QueryCoverage=83%, HitCoverage=84%, E-value=3e-95, Identity=87%"; Hit description =Chloramphenicol acetyltransferase
  Pfam annotation: Domain name=CAT; Domain location=6-165; Score=314.6; E_value=1.8e-91; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVAHMDTSSPPFSPWANIYARRQGADAAGDSVVLLHVFPGWTQDDSYRIRRSGRTERGVRAYSPAWSELPTRN

SEQ ID NO: 165728 - protein, 81 aa, Glycine max
  Coding DNA Sequence Number=SeqID_74043
MVAITLTKVPQPPFFRGYNSNATCVYHGGVQGHSIEHSIDTLEPYTGAMRGTMHEPQANLGADQKFLPDRLKTQKGSLGKI

SEQ ID NO: 165729 - protein, 74 aa, Glycine max
  Coding DNA Sequence Number=SeqID_74044
MTAEWRRKRERRHHFKEKMSLEEAHHHRRPWIRAWRKKEMNEGRVSYLNFVWDHYLLACDLLLTASKCLTRIVI

SEQ ID NO: 165730 - protein, 80 aa, Glycine max
  Coding DNA Sequence Number=SeqID_74045
  Homolog annotation: Hit_ID=A5BD12; Match level="QueryCoverage=71%, HitCoverage=6%, E-value=8e-08, Identity=54%"; Hit description =Putative uncharacterized protein
MDVIGGREHRSAKYAKAAQHFVPGIIVKYKTSSSIEEGDDDPPRVILNRVFWAFNPYIEGFKYCKPLVQVDETFLTGKYH

SEQ ID NO: 165731 - protein, 45 aa, Glycine max
  Coding DNA Sequence Number=SeqID_74046
  Gene Ontology: Mol. function=transferase activity; Cellular component= transcription factor complex; Biological process=positive regulation of transcription, DNA-dependent
  Homolog annotation: Hit_ID=A2WSM9; Match level="QueryCoverage=86%, HitCoverage=4%, E-value=3e-13, Identity=92%"; Hit description =Putative uncharacterized protein
  Pfam annotation: Domain name=TPR_1; Domain location=1-34; Score=16.0; E_value=0.063; Accession=PF00515.19; Description=Tetratricopeptide repeat
  Pfam annotation: Domain name=TPR_2; Domain location=1-34; Score=17.7; E_value=0.045; Accession=PF07719.8; Description=Tetratricopeptide repeat
  Pfam module annotation: Pfam domain module=TPR_1::TPR_2; Domain location=1-34::1-34
GEKSYNYGLLHRSDREYREVIKCHRNALRIDPDNIEILRDLSLLQ

SEQ ID NO: 165732 - protein, 109 aa, Glycine max
  Coding DNA Sequence Number=SeqID_74047
MKGGQWFYTKKLLVLMLKMMIQPLILLSVLSPYKCHLTSMEKKLTTFVSLWDTTCLCRCEINRQVHQVVKYLKALGPLTEKIDVIKDVSGFYVEDSSTKHRCLVSLAEL

SEQ ID NO: 165733 - protein, 115 aa, Glycine max
  Coding DNA Sequence Number=SeqID_74048
MVRGISKSSQFVQQKAVKFCAAKNCVCAKNVVYCWLWKGEYILGSGRFLADPNASMRSFNGGFPPWRCSGRQRRRGERRRHPLGNKPWKKELHHQDEPWIRSLEGCFNGGKERGR

SEQ ID NO: 165734 - protein, 112 aa, Glycine max
  Coding DNA Sequence Number=SeqID_74049
MYNTTITHIGLHCSAHWQMVIILLKENLVVRFCSSHNRLDIYLKGIINSALKGLDDTPQPKSKAGARWIVVKCNRQKGSTECGYYMMHWMSTIILGSFRNNWETVLFDHAIF

SEQ ID NO: 165735 - protein, 85 aa, Glycine max
  Coding DNA Sequence Number=SeqID_74050
MGDIEEVQEQMKADMEALKDQMTSMMEAMLSMKRKIESNVAAAAATSATAEADPTHPSTIIQANQPIPDVLGQGGEVLGSTSSPC

SEQ ID NO: 165736 - protein, 337 aa, Glycine max
  Coding DNA Sequence Number=SeqID_74051
  Gene Ontology: Mol. function=sulfotransferase activity; Cellular component=cytoplasm; Biological process=thyroid hormone metabolic process
  Homolog annotation: Hit_ID=Q8L5A7; Match level="QueryCoverage=96%, HitCoverage=90%, E-value=8e-96, Identity=51%"; Hit description =Steroid sulfotransferase-like protein
  Pfam annotation: Domain name=Sulfotransfer_1; Domain location=62-325; Score=296.7; E_value=4.4e-86; Accession=PF00685.18; Description =Sulfotransferase domain
MDHEQEASEENKLSQDCKELILSLPREKGWITPYLYLFQGFWYSSTEIQAINTFQNQFQAKDNDVVIASVPKSGTTWLKALTFAILHRQYFPSLENHPLLIFNPHELVPPFEFVIYDEINGQTHDLSKMPEPRIFGTHVPFTSLAKSIKETDCKIIYICRNLFDTFVSTWVFVNKIMPKFLPTLPLEEAFERYCEGIIGFGPSWNHILDYWKESIARPKKVLFLKYEDLKENVHFNVKKIAEFLGCPFTKEEENSEVIENIIKLCSFEKMKELKVNKSGTMGKGRIVENKYFFRKAEIGDWVNYFSPSMVEKLSKIIEEKLSRSGLSFRVYDFNSSS

SEQ ID NO: 165737 - protein, 74 aa, Glycine max
  Coding DNA Sequence Number=SeqID_74052
MEEQEEFRYEGLGCSIQEEQASAVAMAVVKATISRNLMRHNEKAMALPEKLMAGKDAEKDMKEIIFATCYIGSL

SEQ ID NO: 165738 - protein, 52 aa, Glycine max
  Coding DNA Sequence Number=SeqID_74053
  Gene Ontology: Mol. function=nutrient reservoir activity; Cellular component=extracellular region; Biological process=pathogenesis
  Homolog annotation: Hit_ID=Q39837; Match level="QueryCoverage=71%, HitCoverage=31%, E-value=4e-12, Identity=86%"; Hit description =Albumin-1 precursor (A1) [Contains: Albumin-1 chain b (A1b) (Leginsulin); Albumin-1 chain a (A1a)]
  Pfam annotation: Domain name=Albumin_I; Domain location=1-52; Score= -23.5; E_value=0.00076; Accession=PF08027.2; Description=Albumin I
MTLTNLSIPYIHDMHGALHARYPNNYMDYGWCFDSDSEALKGFLAMPRAITK

SEQ ID NO: 165739 - protein, 239 aa, Glycine max
  Coding DNA Sequence Number=SeqID_74054
MFTSSQKQNGLKEAKIDLADPTPGPSVCGLHHKGNNFCTPNIFKVPYLPVFLYKFSLTLISTLFTPVGDFTFRVIFHSHSCKFESLGRHQNNQQICWYKENCAKLHTILLYLLNVKSDEKYKSNKEAKFHSKKGSIFSLMILGSSDPENPNKLVDSLIWNIPTNVHNTAKITDFHNSETHERKEKQKQKQPVPQNECASNVLVIVVCVGSDSPHGWQRKSKGDAKDKGSKNKKIGEAKK

SEQ ID NO: 165740 - protein, 27 aa, Glycine max
  Coding DNA Sequence Number=SeqID_74055
MEYNSESEIPNGGEEAHKHLGQVLDQQ

SEQ ID NO: 165741 - protein, 365 aa, Glycine max
  Coding DNA Sequence Number=SeqID_74056
  Gene Ontology: Mol. function=copper ion binding
  Homolog annotation: Hit_ID=Q8GW63; Match level="QueryCoverage=97%, HitCoverage=92%, E-value=6e-52, Identity=50%"; Hit description =Putative uncharacterized protein At1g64600/F1N19_16
  Pfam annotation: Domain name=Rsm22; Domain location=15-242; Score= -136.6; E_value=0.0037; Accession=PF09243.1; Description =Mitochondrial small ribosomal subunit
MAAQTIAETAQKILTPETLRYAAKQSARCLVVPVRLRRAIKKYLREQEEPYMKRKVLRLSQTFNQIKDVNLQLASTTAKKIVEDPFEQSKRWKITSSYGDIGLIYRDEETNAYVASRMPAVYSACYRVLKEKYRKSSRKNNEVCKDLITEKAGAFVVAPCPHDGACPLVKSGKYCHFVQRLERTSSQRAYKMKNFPMLFLDEDQGQGNDPWPLDGMEFETLKEQHAKRNPEDLEIDYEDWLKLQQSDDTPHEVADAETDIADDLETDDAPREVVNAVTYDSDDAVETDGPIDSEEDEEREEERGSADLGGGWGRIVFMPVRRGRQVTMNVCRSTKRDASEGSYDRIVVTRTKNPTLHQQAKRSIW

SEQ ID NO: 165742 - protein, 379 aa, Glycine max
  Coding DNA Sequence Number=SeqID_74057
  Homolog annotation: Hit_ID=A9PEC1; Match level="QueryCoverage=38%, HitCoverage=86%, E-value=4e-25, Identity=46%"; Hit description =Putative uncharacterized protein
MDWYYGCESSDFLVPKDQEDLLERHPSPENWSEWGINAPEGFNSPQEYLIMDTDETEVEFNFIDESFKNEIEFDPCLYDKDQSSSSSACGGLPEQSFQQTELSCDHQLQDQSTLEQKDDIFLDSVLEDFPCVESLRKSFFYPENQCSNTTGENYILVSEQVISKRSIIWMYKITNLFFPSGGVQKDIAASGTNFHTNSNCKVLDPFEQFNEDDIMVEQLSLEEFTLQGFEMLIAQFTEKTRICFRDALYRLARNTKQHVVEDLDGDLNMHQEMPDSVYNDTMRSEDSKPMESETNSIDRAVANLMFNKMEINIIDLPLTTLVNLKKEVIGSKGLQGKSSKALDVTKKSHSPHAEKLPADAEVPRFEPEDQQEATESYIA

SEQ ID NO: 165743 - protein, 33 aa, Glycine max
  Coding DNA Sequence Number=SeqID_74058
MAFIIVGITALGRKGKAGHSIVVETSTFSTVSN

SEQ ID NO: 165744 - protein, 96 aa, Glycine max
  Coding DNA Sequence Number=SeqID_74059
MVMRIMKLAKYRLNAQVEKDKAPEWRRMKAQTYQGNPCGVYPDLSSFTGSGVYPDLSSFTGSGVYPDLSSFTGSGVIQIFVTCIKRSAATQVHIKW

SEQ ID NO: 165745 - protein, 216 aa, Glycine max
  Coding DNA Sequence Number=SeqID_74060
  Pfam annotation: Domain name=zf-C2HC_plant; Domain location=113-158; Score=24.0; E_value=6e-05; Accession=PF07567.3; Description=Protein of unknown function, DUF1544
MAVFRGGISKKRHRIAVALRVWDGGAMAAAIAMAVVAGWRKWRKWRISWVFVRAYPAARTGTAVTSLPAAATTPPNSLPAAATPPSRRDTTQPPPRHHPLQHARTAATSEEEDPGNAVNARRRRRQEEDAGGITRAKQHLIGKSGNVAACKKTPPNVIEELKEYMATKKSGTTYSTSGSGNMANIRDFEFGEPIGCDGSEEDEFADSCNAAASAKT

SEQ ID NO: 165746 - protein, 637 aa, Glycine max
  Coding DNA Sequence Number=SeqID_74061
  Homolog annotation: Hit_ID=A7Q5C7; Match level="QueryCoverage=98%, HitCoverage=58%, E-value=0.0, Identity=72%"; Hit description =Chromosome undetermined scaffold_53, whole genome shotgun sequence
  Pfam annotation: Domain name=DUF810; Domain location=1-637; Score =693.8; E_value=1.3e-205; Accession=PF05664.2; Description=Protein of unknown function (DUF810)
MRQLMFGNHISESMDIRTRQGLLNALVGKVGKRMDTLLIPLELLCCISRSEFSDKKAFIRWQKRQLKVLEEGLVNHPAVGFGESGRKTNELRILLAKIEEAEFLPSSTGELQRTECLRSLREIAIPLAERPARGDLTGEICHWADGYHLNVRLYEKLLLSVFDMLDEGKLTEEVEEILELLKSTWRVLGITETIHQTCYAWVLFRQYVITREHGVLLHALEQLNKIPLMEQRGQQERLHLKSLHSKVEGERDMSFLQSFLTPIQRWTDKQLGDYHLHFNEGSATMEKIVAVAMITRRLLLEEPETSTQSLPISDRDQIEIYISSSIKNAFSRTVQVVDRVDMSHEHPLALLAEELKKFLKKESASFLPILSQRHPQATVVSASLVHKLYGHRLKPFLDSAEHLSEDVISVFPAAESLEQFIMALITSVCHEENAEILLKKLNLYQIEMKSGTLVLRWVNSQLGRILGWVERVIQQEHWDPISPQQRHAGSIVEVYRIVEETVDQFFGLKVPMRFTELNSLFRGIDNALQVYANNVVNELASKEELIPPVPILTRYKKEAGIKAFVKKELFDARVPEPDETRPSQISVLATPTLCVQLNTLYYAISHLNKLEDNIWERWTSKRSQEKLIKVENRDERE

SEQ ID NO: 165747 - protein, 311 aa, Glycine max
  Coding DNA Sequence Number=SeqID_74062
  Gene Ontology: Mol. function=nucleotide binding; Cellular component =intrinsic to membrane; Biological process=defense response
  Homolog annotation: Hit_ID=Q8GZF0; Match level="QueryCoverage=92%, HitCoverage=41%, E-value=3e-43, Identity=65%"; Hit description =Resistance protein KR4
  Pfam annotation: Domain name=LRR_1; Domain location=228-250; Score =7.8; E_value=11; Accession=PF00560.24; Description=Leucine Rich Repeat
  Pfam annotation: Domain name=LRR_1; Domain location=252-273; Score =6.3; E_value=21; Accession=PF00560.24; Description=Leucine Rich Repeat
  Pfam annotation: Domain name=LRR_1; Domain location=275-309; Score =5.9; E_value=25; Accession=PF00560.24; Description=Leucine Rich Repeat
  Pfam annotation: Domain name=NB-ARC; Domain location=21-197; Score= -29.0; E_value=2e-08; Accession=PF00931.13; Description=NB-ARC domain
  Pfam module annotation: Pfam domain module=LRR_1::LRR_1::LRR_1::NB -ARC; Domain location=228-250::252-273::275-309::21-197
MNSLPLKKASDDGVGSGSGSKVPQSTSSVVESDICDRDDDKERIFEWLTSDTDKKLSILSIVSMGGLGKTTLAQLVYNDSRIDGTFDIKASVCVSEKFDVFNVSRSILDTIIDSTDHSRELEMVQRRLKENLADKRFLLTTRSEKVSSTIRTELSPPSSRLKTCFAYCGLFGKDYEFDKECLIQLWMAENFLHCHKSSKSPEEVEQQYFHDLLSSMSKIHDLFSKFKLLRVLSLSQCSDIEELPDSLSNRKHLRSFELSNTCIEKLPEPTRSLYNLQILKLGYCPLLKQRCQKPEGQEWPKIADHIQDLQI

SEQ ID NO: 165748 - protein, 106 aa, Glycine max
  Coding DNA Sequence Number=SeqID_74063
  Gene Ontology: Mol. function=peptidyl-prolyl cis-trans isomerase activity; Cellular component=spliceosome; Biological process=protein folding
  Homolog annotation: Hit_ID=Q9ZVJ4; Match level="QueryCoverage=56%, HitCoverage=30%, E-value=1e-28, Identity=93%"; Hit description =Peptidyl-prolyl cis-trans isomerase
  Pfam annotation: Domain name=Pro_isomerase; Domain location=1-101; Score=37.1; E_value=7.2e-12; Accession=PF00160.12; Description =Cyclophilin type peptidyl-prolyl cis-tr
MSLLFGGVFSNFRHPFLPWPGDGSGCVSIYGLKFDDENFTAKHTGPGLLSMANSGQNTNGCQFFITCAKCDWLDNKHVVFGYNAAQGEQYKTQYNAAQGEQYKTNT

SEQ ID NO: 165749 - protein, 105 aa, Glycine max
  Coding DNA Sequence Number=SeqID_74064
MKNKRAATKGTKRISKALVQELTGQYSNVAETSMPMEEEENGHSERVHKTHLLHESETQLWRVDVDEGTNLMKPLEYSEYLSRSLMEPFNQQQHLQYDLLSFDMS

SEQ ID NO: 165750 - protein, 27 aa, Glycine max
  Coding DNA Sequence Number=SeqID_74065
MRPPPSGAEPTVAGKCEKKEKERRESS

SEQ ID NO: 165751 - protein, 91 aa, Glycine max
  Coding DNA Sequence Number=SeqID_74066
MKTKACIKITDNIVSETKQEALYQDDELVGLQEVLEVYPDIINESLADVDGGGEKIDANLLKQPNLVEPNEDECILSENEIESDFDDTNTS

SEQ ID NO: 165752 - protein, 180 aa, Glycine max
  Coding DNA Sequence Number=SeqID_74067
  Subcellular localization annotation: CTP_CleavageSite=68; ConfidenceScore=5.07e-01
MVDRGRGGGRRTFNHGRRHGVSLGVPITTNPSTSSIHISTSKSMIHVVAPALNTLPKTQDQPNPTFVRESIPTTPVGDASPSAPDDSLTPEYPPNPNCEHIVDQRPFIRAYKGEFQPTYGCCNIISDIIRAKFDEPTPSWLKYRWNPAEERAIRVDFETKGSRILKNAMNKMRNGQDKGK

SEQ ID NO: 165753 - protein, 255 aa, Glycine max
  Coding DNA Sequence Number=SeqID_74068
  Gene Ontology: Mol. function=chitin binding; Cellular component =extracellular region; Biological process=chitin metabolic process
  Homolog annotation: Hit_ID=O44238; Match level="QueryCoverage=46%, HitCoverage=41%, E-value=3e-09, Identity=28%"; Hit description=mRNA, endostyle-specific
LPPSSASLTSLAGRMMACRQRSNLFADELRLTLEVVAVCLLPATGHPNAAVVFRPAPAWGRRHPVGLIEARNQSWKPQGPVGLFRVHWVSCGGRLALRSLGRMLLSSNVLYICVRVVMLVRMVRTLLFAAARVKSCPSMHSSCVVASLSGCARTVGHPPISGGGPGTVKRKLLVRASSPLMARTCSPLKVRVCSPLLARTCSPLKVRACSPLLARTCSPLKARTCSPLEVRACNPLMVRTCSPLKARTCSPLNGE

SEQ ID NO: 165754 - protein, 89 aa, Glycine max
  Coding DNA Sequence Number=SeqID_74069
MDCPLWMLWSMECNIYGVKIKFDGPTNIGAGSGLRVDVGGITRAEEGTGAVEEEGAGVSGGTEVMGASDLLPLAFLGPLNVTVGSSRFQ

SEQ ID NO: 165755 - protein, 781 aa, Glycine max
  Coding DNA Sequence Number=SeqID_74070
  Gene Ontology: Mol. function=transferase activity, transferring phosphorus-containing groups; Cellular component=integral to membrane; Biological process=two-component signal transduction system (phosphorelay)
  Homolog annotation: Hit_ID=A7MQZ7; Match level="QueryCoverage=99%, HitCoverage=86%, E-value=0.0, Identity=60%"; Hit description=Sensor protein
  Pfam annotation: Domain name=HAMP; Domain location=52-121; Score =59.0; E_value=1.6e-14; Accession=PF00672.16; Description=HAMP domain
  Pfam annotation: Domain name=HATPase_c; Domain location=276-391; Score=146.2; E_value=9.3e-41; Accession=PF02518.17; Description =Histidine kinase-, DNA gyrase B-, and HSP90-like ATPase
  Pfam annotation: Domain name=HisKA; Domain location=164-229; Score =93.9; E_value=4.9e-25; Accession=PF00512.16; Description=His Kinase A (phosphoacceptor) domain
  Pfam annotation: Domain name=Hpt; Domain location=692-773; Score =57.5; E_value=4.5e-14; Accession=PF01627.14; Description=Hpt domain
  Pfam annotation: Domain name=Response_reg; Domain location=537-651; Score=129.3; E_value=1.1e-35; Accession=PF00072.15; Description =Response regulator receiver domain
  Pfam module annotation: Pfam domain module=HAMP::HATPase _c::HisKA::Hpt::Response_reg; Domain location=52-121::276-391::164 -229::692-773::537-651
MVLRTPIISERYSVDELPGEDAKPAGNPLGYVAIELDLQSVRLEQYKEVFVATLLLLFCLCIAMLFAYRLMRDVTGPIRNMVTTVDRIRRGQLDSRVDGYMLGELSILKNGINAMAMSLTAYHEEMQQNIDQATYDLRETLEQLEIQNVELDLAKKRAQEAARIKSEFLANMSHELRTPLNGVIGFTRQMLKTGLSTNQRDYMSTIERSANNLLSIINDVLDFSKLEAGKLVLESIPFPLRATLDETLVLLAPSAHEKGLEITVCLEKQVPDNVIGDPLRLQQILINLIGNAIKFTERGHIDLRVELRHLSITRAELEIQVHDTGIGISEQQQSQLFQAFRQADASISRRHGGTGLGLVITQKLVHEMGGEIAFHSRQNQGSTFWVQVHLDLNPNAPAIPRMLDDLHATPLAYIEPHPAVAKAVQEMLSITPLQVQHFASLDDLPDAHFPLLLMGLPVSDPHPATLSDALIARLRAHADSVLLALPSEMMLFADDLRARGIAGCIAKPVSLTRLLPMLLDLNMRHSDDAPRGVRQPLTVMAVDDNPANLKLIGALLEEQVQNIILCDNASQAIHQARQQRLDVILMDIQMPDIDGIRASEIIRSLPQHASTPIVAVTAHALDGEREQLIAAGMNDYLAKPIDEDKLKQLLQRYAPGSVASAVRQPAIAPSLDWALALRQAANKAELARDLLQMLLDFLPEVEQRVAQCMAQNDVDGLREIIHKLHGSASYSGVPRLKQLCQQLEKSLHQESDIAALEPELLELSDEMANVAREARQVLGVA

SEQ ID NO: 165756 - protein, 120 aa, Glycine max
  Coding DNA Sequence Number=SeqID_74071
MTPDWMPRNRHISFCSRKPKLLNMKSNVSPKRRKKELLRSKPVDDLRQKIVTEQAKRKELQEKADNSIQKLITEKGREGLKAFSASQAVADEARVMESADQVLTKEMATLKKLYEDLVLT

SEQ ID NO: 165757 - protein, 85 aa, Glycine max
  Coding DNA Sequence Number=SeqID_74072
AANHRGQVQIHECLYRFSLSQQRQGSAPFVCPTPDQFGAEVAWPKDWPDAQAGEEPAGSPGEVEESRMDEDMTDLLDFLGGSGAT

SEQ ID NO: 165758 - protein, 168 aa, Glycine max
  Coding DNA Sequence Number=SeqID_74073
  Gene Ontology: Mol. function=nucleic acid binding
  Homolog annotation: Hit_ID=Q5XM22; Match level="QueryCoverage=35%, HitCoverage=33%, E-value=5e-18, Identity=72%"; Hit description =Resistance-like protein HAAS-2
  Pfam annotation: Domain name=DUF1723; Domain location=49-98; Score =56.1; E_value=1.2e-13; Accession=PF08330.1; Description=Protein of unknown function (DUF1723)
MCSSIQKRPDLKLASHSRKVEKIGRPTPEIEGLVAATGLSPLIGCSVVTGDLGLIYALVERWHGETSSFHLPVGELTITLDDVSSLLYLPITGALHNFKPLVVEETVILLMELLEDIYLSRCEARRWIVAARAYLLHLVGCTLFANKSATHVHVVHLEAFQDLGESGR

SEQ ID NO: 165759 - protein, 131 aa, Glycine max
  Coding DNA Sequence Number=SeqID_74074
  Homolog annotation: Hit_ID=Q51617; Match level="QueryCoverage=29%, HitCoverage=55%, E-value=2e-12, Identity=92%"; Hit description =Putative uncharacterized protein
MTVKTSDTCSSRRRSPLVCKRMPGADKPVRARQRVLAGAIRHSGCATAGKGDRCGPLRYYASWRKGDRNKAIKLGSAIGKPVVPAALMNRPTRGERRFAYWALAECILAYYVGTDEGVSEVLHVAGEKRLH

SEQ ID NO: 165760 - protein, 342 aa, Glycine max
  Coding DNA Sequence Number=SeqID_74075
  Homolog annotation: Hit_ID=Q5QJQ3; Match level="QueryCoverage=31%, HitCoverage=85%, E-value=5e-58, Identity=99%"; Hit description =Putative uncharacterized protein
  Pfam annotation: Domain name=Fip1; Domain location=94-146; Score =38.1; E_value=3.2e-08; Accession=PF05182.4; Description=Fip1 motif
MTVKTSDTCSSRRRSQLVCKRMPGADKPVRARHRMRKEKIPHQAPFAIQAAQLLGRAIGSGLFAITPAGERGMCCKAIKLGNARVFPVTTLGIFDVNTDTLTEKLWKVPGVDITDYFNFGFNESTWNRETCRASCINESANARGEAVCVLGALPLPRSLTRCARSFGCGERYQLTQRRNRKKAASAGVYSIGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTRISRARYVGGATEFLKWWPNYGYTRRTVFGICALLKPVTFGKRVGSS

SEQ ID NO: 165761 - protein, 44 aa, Glycine max
  Coding DNA Sequence Number=SeqID_74076
MIMRGQEFIVETRGDTSCPSSSGSEDEVRGEESSEGKSTPMKKE

SEQ ID NO: 165762 - protein, 79 aa, Glycine max
  Coding DNA Sequence Number=SeqID_74077
MKHNYGLAQQLRLALFKGLTNRSIVALSLTGMNALSAIIWKSKILTVAMNKLSAVGANEARNMETSQFQHAKGSTEAQG

SEQ ID NO: 165763 - protein, 119 aa, Glycine max
  Coding DNA Sequence Number=SeqID_74078
  Homolog annotation: Hit_ID=Q9SKR9; Match level="QueryCoverage=69%, HitCoverage=8%, E-value=6e-07, Identity=38%"; Hit description =Putative Athila retroelement ORF1 protein
MKKGGEKLCKRGQHNQVQGEQFKDMGRNESLSEALERFHSFLLKTPTHGFSEPIQLNIFIDGLRLQSKQLLDASAEGKIKLKIPEEEMELIENMVASDHAILHDRTHVPTKRSLLELSS

SEQ ID NO: 165764 - protein, 167 aa, Glycine max
  Coding DNA Sequence Number=SeqID_74079
LGHHFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTAMIFLVK

SEQ ID NO: 165765 - protein, 160 aa, Glycine max
  Coding DNA Sequence Number=SeqID_74080
MAPKKLSTKRSRRDATGEGSSAAPEFDSHRFQSVEHQQCFEAIRGWRWTPLVTPMAKFDPEIVLEFYANAWPTEEGVRDMRSWVRGQWIPFDPDALSQFLGDPLVLEEGQQCEFSHRRDMADDFDEETIAQLLEAGADHAHQHDHFDPDMDDATAQQCLA

SEQ ID NO: 165766 - protein, 265 aa, Glycine max
  Coding DNA Sequence Number=SeqID_74081
  Homolog annotation: Hit_ID=Q6WAY3; Match level="QueryCoverage=47%, HitCoverage=5%, E-value=6e-07, Identity=28%"; Hit description =Gag/pol polyprotein
EVSGLWKAKSSVGSSLVAFTFDHIDACFVRVIQQWKLESGYKNLVVYVCLNAVLVEFSLTRGIYGRGLIRTRLGYHEESSKPVPFPYRSNKAVPWRYTSQKPNEKKEEAVEGDLCSAKVTNITSISGVTRSGRVFVAPDPLVRSKDAKVKAKVGMEESNKVNSTQDEDVPTGRFAEKGDFGGKKVVVEEANEFLRIIQQSEFKVIEQLNKTPARSPCWNYARRSVATYPLAGGRREGSRVRLPRKENARSRQQRLFEENVGKTGK

SEQ ID NO: 165767 - protein, 77 aa, Glycine max
  Coding DNA Sequence Number=SeqID_74082
MQVPQVARMTSGTTCPAGEVGWPEWLAGRASTAGGHGYTRGLSLEGETTMWKRLTLEEKMCWVTSVRLPYVVAPDPQ

SEQ ID NO: 165768 - protein, 41 aa, Glycine max
  Coding DNA Sequence Number=SeqID_74083
MMLSYNLRQGRWRLQFTSSGFKSITQFSAQHGCKGSFIHIQ

SEQ ID NO: 165769 - protein, 219 aa, Glycine max
  Coding DNA Sequence Number=SeqID_74084
MAKFDPDIVLEFYANAWPTEEGVRDMRSWVRGQWIPFDADALNQFLGYPLVLEEGQECEYGQRRNRADGFDEEAIAQLLCIPGQDFARTAAGRRVGIMRTNMTTLTQTWMTLLLSNILPSDHNSDLPLPKCQLVYAILTQMSVHMAQLIADAIYLFASMPPTRHPLEPDKSNRALGFPALITGLCQSFGVPVAPSKAQGGDPQAPDAPPPPPQADPKSW

SEQ ID NO: 165770 - protein, 147 aa, Glycine max
  Coding DNA Sequence Number=SeqID_74085
MAPRKLASKRSRKDKAAEGTSSALEYDSHRFRSAEHQQRFEAIKGWSFLQERRVQLKDDEYTNFQEEIARRRWASLVTPMAKFDPDIVLEFYANAWPTEEGVRDMKSWVRGQWIPFDADAISQLLGYPLVLEEGQECEYGHRRNRSD

SEQ ID NO: 165771 - protein, 172 aa, Glycine max
  Coding DNA Sequence Number=SeqID_74086
MGPKSTLRLMRTLGPSLASLAQSSWTLLSNALGRGYIYLGCNTENKRGYISCGSVQVEGTSTWLFKENKGGYIPCGSLLVKDFTRLLEISRTGGCLGTGCRHGKDTFIINSTPLLDYSEALYPTINLVCNKVDDAILPPRALDKRLQEDWAKDARESPRILMSLRVDFGLMG

SEQ ID NO: 165772 - protein, 79 aa, Glycine max
  Coding DNA Sequence Number=SeqID_74087
MEVHWSWALASQLDEEIGKMAWAIEERSRQEVVKDFHDHQLLPFAIVQFSMVPWVLVSHAKALMLCYRAKNIGENRALE

SEQ ID NO: 165773 - protein, 903 aa, Glycine max
  Coding DNA Sequence Number=SeqID_74088
  Gene Ontology: Biological process=protein modification process
  Homolog annotation: Hit_ID=A7R2A7; Match level="QueryCoverage=99%, HitCoverage=94%, E-value=1e-168, Identity=43%"; Hit description =Chromosome undetermined scaffold_411, whole genome shotgun sequence
  Pfam annotation: Domain name=ubiquitin; Domain location=29-92; Score =56.3; E_value=1.1e-13; Accession=PF00240.14; Description=Ubiquitin family
MAGQSSNEGSSTGNISAECSDSTVQLNIKTLDSRIYSFQVDKNMPVSLFKEKIANEIGVPVNQQRLIFRGKVLKDEHALSEYCILQIASGTSSGESTGTSGNRGSGAPRNHVGQISHSVVLGTFNVGEQGEGIVHDLTRVIGHVLNSIGNGGQSTLSGPNATQTSSVHPWNETEGMHAGNQNSAGNQAPSGQTFHGPTVQSVSHVVQIPVAAGAIPIPSLNAPIPDSLNTLSEFMNRMEQTLTQNGYQSNLSSANPGDQQAELPSNAQGLPTLEALSTVLHSAERLLGGQAVAALSGAEVWRWTSFVSFSLNILLEGRLEREGTSADLRVRDQIQSESVQIGLAMQHLGALLLELGRTMLTLRMGQSSAESVVNTGPAVYISPSGPNPIMVQPFPLQTSSLFGGPVPPSTPATLGTIGIGNAPRNVNIHIHAAIGSGANNGEGTRSEHRNEPGSGDSGSTRVLPVRNVIAATIPSHPPGVGISSSTQTGFGIPTSQPPSDSASLSSVLAEINSRLRNVVGNMHGDNTVPSGQMESNSRDLPSGSESRPATVNEQRDTMDMNGFGATSASSVGCTSESEVQKAVQTSSNDERDVLVDKFVSSSSNQDLRSCSSGETIVKPEKEQDVPAVSERQNVTEPAKAAPLGLGVGGLERKRRTRLQPPVSKGADDRSSSSSANQNQQTRTDGQHILQTLASHGSGLNSRNANGPSQRSLPSSDRPIDVAGLMSQALRSPALNGLLEGVSQQTGVDSPDGLRNMLQQFTQSPQMMNTVNQIVQQVGSQDVGNMFAGMERGQGGGIDISRMFQQMMPIVSQALGGGNPSSLFSAEEAEPHAPYCDGTINRDEYSDNQSLQLDLQPLAERIEHLGPSTDIFRAVAENAVQLSGSGSTSNDLLDELCSNESLAR

SEQ ID NO: 165774 - protein, 226 aa, Glycine max
  Coding DNA Sequence Number=SeqID_74089
  Gene Ontology: Mol. function=alpha-amylase activity; Cellular component=extracellular region; Biological process=carbohydrate metabolic process
  Homolog annotation: Hit_ID=A3ATI0; Match level="QueryCoverage=92%, HitCoverage=66%, E-value=2e-76, Identity=58%"; Hit description =Putative uncharacterized protein
  Pfam annotation: Domain name=Alpha-amylase; Domain location=1-223; Score=-111.3; E_value=0.0048; Accession=PF00128.15; Description =Alpha amylase, catalytic domain
MQAFNWESNKYNWWNNLEGKVPDIAKAGFTSVWLPPPTHSFSPEGDIFHGFPNIDHTKDFVRKDIIGWLRWLRHEVGFHDFRFGFVKGFSPKYVKEYIEGAKPLFCVGEYWHSCNYKGSTLDYNQDSHRQRRLINWIDGTGQLSTAFDFTTKGILQHKQPIPFFMSVDFFLIWKPPGVIGWWPSRSVTFVDDHDTGSTQAHWPFPKDHIMEVLLVTSGTMHVHKYV

SEQ ID NO: 165775 - protein, 242 aa, Glycine max
  Coding DNA Sequence Number=SeqID_74090
  Homolog annotation: Hit_ID=Q8S901; Match level="QueryCoverage=83%, HitCoverage=95%, E-value=6e-46, Identity=48%"; Hit description =Syringolide-induced protein 14-1-1
TPASNNFFFLPWQMEKEKEKEKKSKLKNKIFKILPKAAAMSVTFQNPPFSPGRDHKCKHYGGKGFFSGRMIPDEARRKAKNGHGVETQEPTSPKISCMGQIKHKKGGAKNMSMSMPTPRDPEVKKHASKFQRMLLFHAGKPKQSDADVESERAPAPPMGHMRRFASGRETFSNFDWKAQIAPHDDVDRLDDEIIIPFSAPLTLGGATALNLNVQPRKEINLWKRRTMAPPRPLKLNPLLTAK

SEQ ID NO: 165776 - protein, 219 aa, Glycine max
  Coding DNA Sequence Number=SeqID_74091
  Gene Ontology: Mol. function=oxidoreductase activity; Cellular component=extracellular region; Biological process=hydrogen peroxide catabolic process
  Homolog annotation: Hit_ID=A7NVL9; Match level="QueryCoverage=84%, HitCoverage=57%, E-value=9e-76, Identity=76%"; Hit description =Chromosome chr18 scaffold_1, whole genome shotgun sequence
  Pfam annotation: Domain name=peroxidase; Domain location=70-218; Score=181.1; E_value=2.8e-51; Accession=PF00141.14; Description =Peroxidase
  Subcellular localization annotation: CTP_CleavageSite=46; ConfidenceScore=5.27e-01
MLNNHTLVTTPSFPCHRLVSTNTILVNVNRNMAAIATVIMLITMSLASLVSALNVNYYENTCPHNVDSIVAAAVHKATMNDRTVPAALLRMHFHDCFIRGCDASVLLESKGKNKAEKDGPPNISLHAFYVIDNAKKAVEAVFPGIVSCADILALAARDAVALSGGPTWDVTKGRKDGRISKATETRQLPAPTFNISQLQQSFFQRGLSLEDLVALSEKQ

SEQ ID NO: 165777 - protein, 128 aa, Glycine max
  Coding DNA Sequence Number=SeqID_74092
  Gene Ontology: Mol. function=hydrolase activity, acting on ester bonds; Biological process=lipid metabolic process
  Homolog annotation: Hit_ID=A7NSR6; Match level="QueryCoverage=72%, HitCoverage=26%, E-value=1e-27, Identity=56%"; Hit description =Chromosome chr18 scaffold_1, whole genome shotgun sequence
MRAITENSGWRANKKVLRKELDSLGHNLSDTRIVYIDVYSPLLDIIDNYQKYGYKVMDRGCCGTGKLEVAVLCNPLDDTCSNASEYVFWDSYHPTEGVYRKIVNHVLEKFNIHSRHRSISGTFQIFPL

SEQ ID NO: 165778 - protein, 146 aa, Glycine max
  Coding DNA Sequence Number=SeqID_74093
  Homolog annotation: Hit_ID=A7NSS8; Match level="QueryCoverage=100%, HitCoverage=23%, E-value=4e-57, Identity=74%"; Hit description =Chromosome chr18 scaffold_1, whole genome shotgun sequence
MGILSTIASFFGFGVGTSIGLVIGYYLFIYFQPTDVKEYQGMLKFIVGKEWHLRDPVIQPLVEQDAKTLQLLLPEIPTWIKNPDYDRLDWLNKFILYMWPYLDKAICKTARSIAKPIIAEQIPKYKIDSVEFEELSLGSLPPTFQG

SEQ ID NO: 165779 - protein, 153 aa, Glycine max
  Coding DNA Sequence Number=SeqID_74094
  Homolog annotation: Hit_ID=A7NST6; Match level="QueryCoverage=68%, HitCoverage=74%, E-value=2e-20, Identity=49%"; Hit description =Chromosome chr18 scaffold_1, whole genome shotgun sequence
  Subcellular localization annotation: CTP_CleavageSite=40; ConfidenceScore=5.07e-01
MAVSDAVVSNLTLLYVALILSIKAYGFLCGRSFSGCFVLVASTAAVALILVATLTWDVSRKATYAFAAVQPPPPPPPPPHHTHETCKGGICWHGVAVRSPASQLKKLGTHCPRLFAMQRYGNDSSLCKGLELETLMTDHNGVSKAAVSFADMI

SEQ ID NO: 165780 - protein, 84 aa, Glycine max
  Coding DNA Sequence Number=SeqID_74095
  Homolog annotation: Hit_ID=Q84VH5; Match level="QueryCoverage=79%, HitCoverage=9%, E-value=2e-27, Identity=91%"; Hit description =Envelope-like protein
MLSQHPNILNNIDSVMKRESPLSLHYKLFEGTHVPDIVSTSGKAAVSGAVSKDDLIAELKDTCKLIEDAAARAWRQGEQKADVT

SEQ ID NO: 165781 - protein, 97 aa, Glycine max
  Coding DNA Sequence Number=SeqID_74096
MPNHKSTESTLKNLEVQVGQLAKQIADKSSNSFVANTEQNPKEECKAVMTRSKRFVEAEDEESVVYNEKVAEKKSVEVPYPVVPSKKEKVLDQVASK

SEQ ID NO: 165782 - protein, 57 aa, Glycine max
  Coding DNA Sequence Number=SeqID_74097
MAVCGGYWWLWVTEKVLGTLEMAQNAQVTKALGNGNVALTPDVLSKIPMVRSWTSVL

SEQ ID NO: 165783 - protein, 186 aa, Glycine max
  Coding DNA Sequence Number=SeqID_74098
TETHMLAIISKFKEELNLATAHEHKVADKYARVYVEKEARGRVIDSLHQEATMWMDRFALTLNGSQELPQLLAKAKAMADAYSALEEIHWLLSYCQTDAITKCALRHPYRPRSKSRTMGDLEEVQEQMKADMSALKEQMASMMEAMLGMKRLIERNAATAVAASTVAEANPALPIAMHHPVPNMVG

SEQ ID NO: 165784 - protein, 207 aa, Glycine max
  Coding DNA Sequence Number=SeqID_74099
RDSNVNMTDLVSTEDDQKNVYTDNHLGISARQRDSNVSMTDLVSTEDDQKNVYTDNHSGISARQRDSNVSMTDLVSAEDDQKNVYTDNHSGISARQRDSNVSMTDLVSADDDTDNHSGISVRQRDSNVSMTDLVSAEDDAFCPTDSKRMFMKVRTTTWVSPHVTEALAPMYPQMRNSDLRSPGATYAFRMKNNVSTGDGEYADEILP

SEQ ID NO: 165785 - protein, 152 aa, Glycine max
  Coding DNA Sequence Number=SeqID_74100
MGKVEEAQEQMKADMEAMKEQMATMMEAMMSMKKIMEANAVTVAAISAIVKVNPMPPSGLNQMNHPTSDMVDKDLGTDFEPCLGYATEGQAVGGIPMPNTLEGPQFRPQPQPLHFAVGRASPAMPKKGKVDHLKERLRAIEGGEDYAFANLE

SEQ ID NO: 165786 - protein, 183 aa, Glycine max
  Coding DNA Sequence Number=SeqID_74101
  Homolog annotation: Hit_ID=Q2HTA0; Match level="QueryCoverage=66%, HitCoverage=19%, E-value=5e-17, Identity=40%"; Hit description=IMP dehydrogenase/GMP reductase, related
  Pfam annotation: Domain name=DUF1723; Domain location=106-155; Score =46.7; E_value=8.4e-11; Accession=PF08330.1; Description=Protein of unknown function (DUF1723)
MKVTMMPPSSEGLLHQPELIDDQPEAPVEEGVTDVEGFPGGPHDTSILTDFENHIALRVWNGEECPELKLSSHGRKMTKFERPAPEIEGLVATSGLSPLIACSLDTGNRGLMFAFVECWHKETSSFHLLVGEVTITLDDIASLLHLPVIGAFHNFELLHVNDVVEMLVELLEVSAAEARLETI

SEQ ID NO: 165787 - protein, 192 aa, Glycine max
  Coding DNA Sequence Number=SeqID_74102
MAKFDPDIVLEFYANAWPTEEGVRDMRSWVRGQWIPFDADAISQLLGYPLVLEEGQECEYGQRRNRFDGFDEEAIAQLLCIRIMRTIMTSLTQIWMTLLLSNIQPSDHNSASPCRSVSWCMAPTRHLLDPDKSNKALGFPALITGLCLSFGVPVAPSKVIWPPITRAFIEKYCKQRQVQGDAPQAANAPPPH

SEQ ID NO: 165788 - protein, 202 aa, Glycine max
  Coding DNA Sequence Number=SeqID_74103
  Subcellular localization annotation: CTP_CleavageSite=35; ConfidenceScore=5.37e-01
MSVSSRQRARLPPGLTKGASNHKETMLVSVRQRARLASGVGDNVSLCASTGSFGLGLMKGVGNHKVVYAEDDVNLCVSMGLLAAIDKGCRRRFCTEDDINLCVSMGLLAVIDKGLWSARKMCSAVWLRMSPDKGDDSVSAIMPFAGERGRGSRVRFPKGGKMRGVATNVYLWKTSEKPKETGQNEILSSGVVFTLEEGITPL

SEQ ID NO: 165789 - protein, 20 aa, Glycine max
  Coding DNA Sequence Number=SeqID_74104
MALEELRAKPSSTTTKQGEL

SEQ ID NO: 165790 - protein, 63 aa, Glycine max
  Coding DNA Sequence Number=SeqID_74105
MTLSQQHDAPMATPNAPFAPQWNEFSTEAEQVEAGRQRGRRNPDRQAKMGSTMWHILTTSRTP

SEQ ID NO: 165791 - protein, 49 aa, Glycine max
  Coding DNA Sequence Number=SeqID_74106
MTTFKVPNKKLTDVILPRKGLVTRAMSKRLQEDWARAAEEGARVLMNLR

SEQ ID NO: 165792 - protein, 131 aa, Glycine max
  Coding DNA Sequence Number=SeqID_74107
  Homolog annotation: Hit_ID=A5ANC8; Match level="QueryCoverage=89%, HitCoverage=10%, E-value=6e-10, Identity=25%"; Hit description =Putative uncharacterized protein
IMPLPFSYLGIPIGANPRRCGLWDPILRKTESKLSRIPNRVAEKLTQIQRRFLWGGGLDQKKIAWVKWDCWLMEQEPLRAKYPRLYNISCQQQKLIQDMGCHSANVWEWKLEWRRHLFEWRSQFLCVCAEA

SEQ ID NO: 165793 - protein, 38 aa, Glycine max
  Coding DNA Sequence Number=SeqID_74108
MAFVDNWAVGKDKSQHGLLLHPHPLHLPQFSHSSKQDE

SEQ ID NO: 165794 - protein, 191 aa, Glycine max
  Coding DNA Sequence Number=SeqID_74109
  Homolog annotation: Hit_ID=A5AJT7; Match level="QueryCoverage=96%, HitCoverage=20%, E-value=1e-17, Identity=31%"; Hit description =Putative uncharacterized protein
MVLVLRGMHLDFDHICDQVLTGQEVVSLENLIIRLLRVPSPKIRGNSVDSIETSAMVSNRGGRSGCGNRGGRTRRGGRPQCSYYKRVGHTQDTCYSIHGFPRKSVNISKSETSEIKFSKTNYQEYLQLKAAKESQTSSSISGHNSIACISQFADGSRVAATRIGHECGTGRTIGVGHESHGLYYLKPNLSW

SEQ ID NO: 165795 - protein, 89 aa, Glycine max
  Coding DNA Sequence Number=SeqID_74110
MAAEWRRKRERRRQFKEKMSLEEAHHHRRPWIRAWRKKEMNEGRGREEHEILCSKRALKSEMNKSGMEKEEGEETPLQGEDESRRSSPP

SEQ ID NO: 165796 - protein, 57 aa, Glycine max
  Coding DNA Sequence Number=SeqID_74111
MEVRVGFVAEWRVGVAWVACDRDHLDDSINERHLHGGGVTPNATEPRALRCEAAIRS

SEQ ID NO: 165797 - protein, 432 aa, Glycine max
  Coding DNA Sequence Number=SeqID_74112
  Gene Ontology: Mol. function=protein binding; Cellular component =cytoplasm; Biological process=multicellular organismal development
  Homolog annotation: Hit_ID=A5HMS8; Match level="QueryCoverage=68%, HitCoverage=88%, E-value=1e-146, Identity=84%"; Hit description =Transcription factor WD-repeat protein 1
  Pfam annotation: Domain name=WD40; Domain location=134-202; Score =3.4; E_value=12; Accession=PF00400.23; Description=WD domain, G-beta repeat
  Pfam annotation: Domain name=WD40; Domain location=214-252; Score =13.3; E_value=0.72; Accession=PF00400.23; Description=WD domain, G -beta repeat
  Pfam annotation: Domain name=WD40; Domain location=256-293; Score =27.3; E_value=5.6e-05; Accession=PF00400.23; Description=WD domain, G-beta repeat
  Pfam annotation: Domain name=WD40; Domain location=345-384; Score =35.5; E_value=1.9e-07; Accession=PF00400.23; Description=WD domain, G-beta repeat
  Pfam module annotation: Pfam domain module=WD40::WD40::WD40::WD40; Domain location=134-202::214-252::256-293::345-384
MTFSNTKITIKVLRGEDAQIGLTAPQKDPNSASEEEEVEMRGLETMRGSIGSSRNKGTRRRKLISTVEAVVDGGKVVGCVIDIDGDEGGPGEEDWNMTTKFNDPSPQNYYGQYRHSNLRNEQKWRIRPKNPTSDPKTPFIEEYTNRVDILSFHPDTLSLTPNPSLSFDHPYPPTKLMFHPRKPPSSSSDLLATSGDYLRLWEVRDNSVEAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWDLPTLASPTGIDPVCMYSAGCEINQLQWSAVQPEWIAIAFANKMQLLKV

SEQ ID NO: 165798 - protein, 83 aa, Glycine max
  Coding DNA Sequence Number=SeqID_74113
MWGFEDETRKQTERAVRSRSGREGRVVCGGGGNISTGGAMMMQRVRGACVDGKVHAWKNKYEVGDGRLVVAFLLDVFSTMPID

SEQ ID NO: 165799 - protein, 276 aa, Glycine max
  Coding DNA Sequence Number=SeqID_74114
  Homolog annotation: Hit_ID=A7QEX6; Match level="QueryCoverage=78%, HitCoverage=78%, E-value=2e-52, Identity=47%"; Hit description =Chromosome chr16 scaffold_86, whole genome shotgun sequence
MPLHQKPSFSNLPCLTSPSLLLQCHRRHQSQRHHRNPIISGHNHLSNISQQANLCKVHIVLSLGFFEPAFLVTLLFLLNASIKRKTPNNDKWAITSVLLTCLPVATLQALLIFFAPFKNRVPAESSVVLNDGYGFETVLCAYPFLSSVLFAVFGVAYSSWFLFSCWRVLLLVINKGLRVRIYVLASIVLVAIPLQIVSLGFSVLWSPHQEVYGVVSLVGFLAAFGCATAGEGILVIKPISDALDAGGNCCVSTPQPGARQSEETEESGVVVRLEGG

SEQ ID NO: 165800 - protein, 103 aa, Glycine max
  Coding DNA Sequence Number=SeqID_74115
  Homolog annotation: Hit_ID=Q7XCS4; Match level="QueryCoverage=59%, HitCoverage=21%, E-value=3e-17, Identity=54%"; Hit description =Aldo/keto reductase family protein, putative, expressed
  Subcellular localization annotation: CTP_CleavageSite=66; ConfidenceScore=5.65e-01
MAVSVCSININPIALATPSFSFKSLKFPSFWPTQKVKMGPLSVSPMRFGTWAWGTTASISLIFDTADSYGTGKLNGQGEKLLGRFIREFQGFITHSFLTLIQF

SEQ ID NO: 165801 - protein, 267 aa, Glycine max
  Coding DNA Sequence Number=SeqID_74116
MYRMIGALYMQKQKLRTVLLGVLNCIDMNVTRRESGVTFPLGEKLVLGFLLSDFPNVVLPEHELVHLPPRATRVDHRHFALREPLQFVPLFLVLTAVRGGLLFHFRHRRVAAGSGRQGGGDGGFGVCGGGGGGGSEEDFRVCLFPGAFFVGFGEGGAHAEELSEDGAHGHGLVAGLGRRVPGRVIGAGLRGLRMGREEEGIEVGFVAGGDALVGPEAVEPVQTGFSGLGRAEHGEGSRENGRALQGVREKQRGKEECASVTATWTTK

SEQ ID NO: 165802 - protein, 739 aa, Glycine max
  Coding DNA Sequence Number=SeqID_74117
  Gene Ontology: Mol. function=oligopeptide transporter activity; Cellular component=integral to membrane; Biological process =oligopeptide transport
  Homolog annotation: Hit_ID=A7QEZ6; Match level="QueryCoverage=96%, HitCoverage=97%, E-value=0.0, Identity=72%"; Hit description =Chromosome chr16 scaffold_86, whole genome shotgun sequence
  Pfam annotation: Domain name=OPT; Domain location=44-703; Score =796.2; E_value=2e-236; Accession=PF03169.6; Description=OPT oligopeptide transporter protein
MASTFEGGSDLEKENNNIAESEEECPVKQVELTVPKTDDPTMQLLTFRMWVLGVLSCVLLSFVNQFFWYRTQPLIVTSISAQIAVVPIGHFLARTLPTRVFFKDTRFEFSLNRGPFNIKEHVLITIFANSGAGTVYATHILSAVKLMYKRRLDFLPALLVMLTTQVLGFGWAGLFRKFLVEPGEMWWPSNLVQVSLFSALHEKSKRPKGGTTRTQFFLLALVLGLAYYVFPGYLFSMLTSFSWMCWLAPKSILVQQLGSGLRGLGIAAFGIDWSTISSYLGSPLASPWFATANIAVGFFLVMYVMTPIAYWSNAYEAKTFPIFSSKLFMGNGSLYDISTIVNSEFHLDRQAYSINGPVHLSTFFAMTYGLGFAALSATVVHVLLFHGREILMQSKRAFGNSKKIDIHTRLMRRYKSVPMWWFYIILAANIALIIFICEYYNESLQLPWWGVLLACAISIFFTLPIGIINATTNQQPGLNIITEYIIGYMYPERPVANMCFKVYGYISMVQALSFLQDFKLGHYMKIPPRTMFMAQVVGTILSVFIYTITAWWLMRTIPHLCDTTMLDPDSPWTCPMDNVFFDASVIWGLLGPRRIFGDLGEYAKVNLFFFGGAIAPFLVWLAHKAFPGQRWITLIHMPVLLGATSMMPPATAVNFTSWLLVGFLSGYVAYRYRQEWWKRCNYVLSGGLDAGTAFMTILLFLALNNNNIMLNWWGNNPEGCPLATCPTEKGIVVKGCPVH

SEQ ID NO: 165803 - protein, 25 aa, Glycine max
  Coding DNA Sequence Number=SeqID_74118
MAKSQQSTDFKLLLFSKIMRHPNKG

SEQ ID NO: 165804 - protein, 703 aa, Glycine max
  Coding DNA Sequence Number=SeqID_74119
  Gene Ontology: Mol. function=protein phosphatase type 2A regulator activity; Cellular component=protein phosphatase type 2A complex; Biological process=signal transduction
  Homolog annotation: Hit_ID=A7QF05; Match level="QueryCoverage=99%, HitCoverage=98%, E-value=0.0, Identity=53%"; Hit description =Chromosome chr16 scaffold_86, whole genome shotgun sequence
  Pfam annotation: Domain name=WD40; Domain location=243-281; Score =39.9; E_value=8.9e-09; Accession=PF00400.23; Description=WD domain, G-beta repeat
  Pfam annotation: Domain name=WD40; Domain location=347-384; Score =43.0; E_value=1.1e-09; Accession=PF00400.23; Description=WD domain, G-beta repeat
  Pfam annotation: Domain name=WD40; Domain location=388-426; Score =35.5; E_value=1.9e-07; Accession=PF00400.23; Description=WD domain, G-beta repeat
  Pfam annotation: Domain name=WD40; Domain location=479-518; Score =3.9; E_value=10; Accession=PF00400.23; Description=WD domain, G-beta repeat
  Pfam annotation: Domain name=WD40; Domain location=520-559; Score =14.4; E_value=0.43; Accession=PF00400.23; Description=WD domain, G -beta repeat
  Pfam annotation: Domain name=WD40; Domain location=656-695; Score =2.2; E_value=17; Accession=PF00400.23; Description=WD domain, G-beta repeat
  Pfam module annotation: Pfam domain module=WD40::WD40::WD40::WD40::WD4 0::WD40; Domain location=243-281::347-384::388-426::479-518::520 -559::656-695
MGSFSEDEECRFFDAQEDVVSIPDEGVSNGFDYEVWIRSPRSVRERRGKFMKRMGLSSVDLVALENENSVDVRSVECEEEVMDRVNVNSGAVTRNCVMEEEFCSSRTSMSCWHRENSSGEFGMVDSSPCHDGNLEGNVDQEGLQCREMSEGRDLDSDRSVVAEEFKESENALRGTNGNVTVGKMNKYRKGWLRRLRSITCMVNRQEEGDNGREEGLGEMSGTCRLQKVKVRQSKKQMKELSALYMRQDIQAHEGSILTMKFSPDGQYLASGGEDGVVRLWQVVEEDRCNEVDIPEIDLSCIYFTVNNLSELTPLFIDKEKISKLKSLKKTSDSACIVFPPKIFRLLEKPLHEFRGHRGEVLDLSWSSNNYLLSSSVDKTVRLWQVNHDRCLKVFSHSNYVTCIQFNPVDDNYFISGSIDGKVRIWAIPDCHVVDWIDIKDIVTAVCYRPDGQGGIIGSLAGNCRFYNVSENRLQLDSQLCLIGKKKLSGRGITGFQFLPQDSNKVMVSCADSQVRILDGFNVIGKYKNLSTGSPMCASLTSDGKHILSACEDSNVYLWNVSQEESNPVKAKKITSCERFFSNASIAVTWHGLKSQNIEIQHQLDALDKRSSQVIQLSPPASFSLSQEFFLESFPKGSATWPEEKLPVSSPKAKTSVMRKSEYKFLKSSCKSTSSAHAWGMVIVTAGWDGRIKSFHNYGLPILA

SEQ ID NO: 165805 - protein, 86 aa, Glycine max
  Coding DNA Sequence Number=SeqID_74120
  Gene Ontology: Mol. function=acyl-CoA binding
  Homolog annotation: Hit_ID=A7QF10; Match level="QueryCoverage=72%, HitCoverage=17%, E-value=1e-22, Identity=79%"; Hit description =Chromosome chr16 scaffold_86, whole genome shotgun sequence
  Pfam annotation: Domain name=Ank; Domain location=32-64; Score=43.0; E_value=1e-09; Accession=PF00023.21; Description=Ankyrin repeat
MEAIHGFAREGDMANLLKCIENGVSMNLKDSEGRTPLHWAVDRGHLNVTELLVGKNADVNAKVFSFIYALDVLMSGTTYISILALP

SEQ ID NO: 165806 - protein, 218 aa, Glycine max
  Coding DNA Sequence Number=SeqID_74121
  Gene Ontology: Biological process=regulation of transcription
  Homolog annotation: Hit_ID=A7QF23; Match level="QueryCoverage=51%, HitCoverage=49%, E-value=3e-35, Identity=60%"; Hit description =Chromosome chr16 scaffold_86, whole genome shotgun sequence
  Pfam annotation: Domain name=RWP-RK; Domain location=106-157; Score =59.8; E_value=9.3e-15; Accession=PF02042.6; Description=RWP-RK domain
MEISPLEGFSELDWPYSSNHLCFNEFPDLENLDLDFSLPPLGEYLEEELDQKPLNIVVSQGVHCNREKGFGEASSFTIENGSATASYVQNIIRQRPQPVSSSSKKKTCVLKFDEIRKHFGVPITEAAKRLNVGLTMLKRRCRELNVKRWPHRKLKSLQLLIDNVKEMGLEDEVARVEKHKRLLEKLPGMELSEEAKKLRQACFKANYKKRRCMASLQA

SEQ ID NO: 165807 - protein, 155 aa, Glycine max
  Coding DNA Sequence Number=SeqID_74122
MVLSLKRVRCPCAGHALEAAADPQPDDKEDSADEQIEEEEDPHVFLPNVLGLVAVVVELGLERNGVVGDVERGGRVIGPFLFLQALSWRVERRRGLLLLLRSVVVVKRVLEDGGSDAVEEGEGLGFEEGVVGDGEEDEGRVDEEGVCAVVDGVGE

SEQ ID NO: 165808 - protein, 156 aa, Glycine max
  Coding DNA Sequence Number=SeqID_74123
MRTRVHGGVVEELLVVFEGGVGFAAIEVGLEYEVVGDDVGDHAGLRDEAVEGEEVGVAGLAEEGGEDGVNGEDGGAAVGVDRVARVQRRLVEGLDNRVIVGALERFGCGSGRRGAVPCGAGAFFGGAPPRPPPGRRRRGGGLKRTRKGGGENWRGF

SEQ ID NO: 165809 - protein, 248 aa, Glycine max
  Coding DNA Sequence Number=SeqID_74124
MEVSFKAKIFMGAERLHYQGDGVMGCWEVDMVVCVEASVVRMGNPNGGGPNAADATARVFKDRLPTSVNLEKRGIRLGGLQHRCVFCNMEEEDLTHMLFKCKFSMAVWANCYKWLGREYNGSAIKIPVCIFSNTIVIGWESDPLQYGVQWLGPYGAIETELFLQKRGRILTRNWVGWDYRHEGDKNCTVFFNCSEGKRCYQPSWSCSGEGVTRELMDIRAQKELVNMKQRIGSYSEFVNPMGYFQYPN

SEQ ID NO: 165810 - protein, 283 aa, Glycine max
  Coding DNA Sequence Number=SeqID_74125
  Gene Ontology: Mol. function=enzyme inhibitor activity; Cellular component=cell wall; Biological process=cell wall modification
  Homolog annotation: Hit_ID=Q708X3; Match level="QueryCoverage=82%, HitCoverage=91%, E-value=1e-122, Identity=87%"; Hit description =Pectin methylesterase
  Pfam annotation: Domain name=Pectinesterase; Domain location=4-225; Score=457.6; E_value=1.7e-134; Accession=PF01095.10; Description =Pectinesterase
MLADPVVAAASGSGFIAKDMTFENYAGPGRHQAVALRVGADHAVVYRCNIIGYQDTMYVHSNRQFYRECDIYGTVDFIFGNAAVVFQNCTLWARKPMAQQKNTITAQNRKDPNQNTGISIHNCRIMATPDLEASKGSYPTYLGRPWKLYARTVFMLSYIGDHVHPRGWLEWNTSSFALDTCYYGEYMNYGPGSALGQRVNWAGYRAINSTVEASRFTVGQFISGSSWLPSTGVAFIAGLSTKKTNATGEESRGKTEKYFAFVSFAFFLFGGGSITLSAFNMTS

SEQ ID NO: 165811 - protein, 266 aa, Glycine max
  Coding DNA Sequence Number=SeqID_74126
  Homolog annotation: Hit_ID=Q9LV07; Match level="QueryCoverage=96%, HitCoverage=86%, E-value=3e-55, Identity=50%"; Hit description =Arabidopsis thaliana genomic DNA, chromosome 5, P1 clone:MYN8
  Pfam annotation: Domain name=CCT; Domain location=201-260; Score =54.0; E_value=5.2e-13; Accession=PF06203.5; Description=CCT motif
MSLMQDDLVQSSVMSEYDLAAEGDLFKAPEPIIEEPIMDMDPMTATISMISCGEDVSSQGLKSTDIDILQNDQFLHEVFYECEKDLLEKAAIEPPFSEILEIKVPLLNIDENTIQENKLLPDMQLAKSVSSGSLSSMDWMRGAAMKPAFIDIPAIDFNADYGMRRSFSEGDIKTLGNGNMNIVQSPLERPLLISNCTSEERFQKLSRYRNKRTKRNFGRKIKPKQIPKSADDMLFFQYACRKALADSQPRIRGRFARTEESDVKRE

SEQ ID NO: 165812 - protein, 652 aa, Glycine max
  Coding DNA Sequence Number=SeqID_74127
  Gene Ontology: Mol. function=protein kinase activity; Biological process=protein amino acid phosphorylation
  Homolog annotation: Hit_ID=A7QEQ2; Match level="QueryCoverage=98%, HitCoverage=99%, E-value=0.0, Identity=65%"; Hit description =Chromosome chr16 scaffold_86, whole genome shotgun sequence
  Pfam annotation: Domain name=PAP_fibrillin; Domain location=399-596; Score=-44.8; E_value=0.015; Accession=PF04755.3; Description=PAP _fibrillin
  Pfam annotation: Domain name=Pkinase; Domain location=92-379; Score= -82.8; E_value=0.0012; Accession=PF00069.16; Description=Protein kinase domain
  Pfam module annotation: Pfam domain module=PAP_fibrillin::Pkinase; Domain location=399-596::92-379
  Subcellular localization annotation: CTP_CleavageSite=48; ConfidenceScore=5.63e-01
MALCRTGPNPIPGSYSAQNLSTKLIVPAPLRFTRQFSNLVRRKRKGVCCSSLRNAASASSKESLEDAPTTLSVCLEEETDHVIQFKMSDFKILDTVSVGLGGRSCTSTASSAQAQRRGKRAIEVLKKLVRRKLLYHSYSMQVHGYISLPASDASGSFILVHGYHGSFSLRHWLQQSDWLPTLEATLALDEESVRKVGEDFTGGPAVSRQLRLVRILMRDLLIGVNYLHSHGLAHTELRLENVHISPIDRHIKVGILGNAADFYKDGSNGSSLDNLDRRQMMIAFDMRCMGFIMAKMVMRELMDPLIFAKFKSFLTKGYDPSCLREFILEILGRSSPYGNAGLQILDRNWGAGWHLLSLLLATKPSQRISCLDALRHPFLCGPRWRVVPSMDIIRWGLGSTAMRIREKYIYRQPQQSRLAHFIDLMEMLNPHPQPRNWLELLPGKWRLLYSTGKHVGLTLRQPPLRVLVSDVHLTVTRESKLKDNLSFGSDIGFSVMIGQDWPHDKAGKSGRLQVNSLFTLRSGRRLYLKQDKTTEKFFFGPSSNVEALAQKFKGKKWRKIVPFKEFPSSLPAAKLASGDIDVRMNLDDPLNRNVDTARNVLQELRTQIPPEIFDLSRLVCGTYVDSRMLVLRGVNGSALLFTRSFVDRNGSS

SEQ ID NO: 165813 - protein, 139 aa, Glycine max
  Coding DNA Sequence Number=SeqID_74128
MGPIVFERNWICLSLFPGRDFLKEHRKWLAGDRKSIDPRRDNEGAGEVEAGVAGVEEEHGGDHGAMMAKSFPQSLQKCMCLCKDFHIVKLHDFAVVIEVLYVIIIFERRSCLFLLMTAGSGFSFFEWDSGSGAPTAAKF

SEQ ID NO: 165814 - protein, 255 aa, Glycine max
  Coding DNA Sequence Number=SeqID_74129
  Gene Ontology: Mol. function=mRNA (guanine-N7-)-methyltransferase activity; Cellular component=nucleus; Biological process=mRNA processing
  Homolog annotation: Hit_ID=A7QZT1; Match level="QueryCoverage=91%, HitCoverage=56%, E-value=7e-79, Identity=65%"; Hit description =Chromosome chr13 scaffold_286, whole genome shotgun sequence
MYLLFWKQCPWMLKDVHSCRAKYQRNVEAYHNKSSSMKPNIVPNCIRTENYMITFEVEEEKFPLFGKKYQLKFANDVSAETHCLVHFPSFIRLAREAGLEYVEIQNLTEFYDDNRAQLAGLLTHYVPNLLDPRGRLLPRSYDALGLYTTFIFQKPDPEIAPPIATPLLPDVSYNLDEVLLFLFNSITTIPLTCWVNILLKDSVVHHADRRKVTIRPDDEIINGHAVEPAIGLGKISEQKGILGPGPADLRFPEAL

SEQ ID NO: 165815 - protein, 190 aa, Glycine max
  Coding DNA Sequence Number=SeqID_74130
  Gene Ontology: Mol. function=oxidoreductase activity; Biological process=metabolic process
  Homolog annotation: Hit_ID=A7P515; Match level="QueryCoverage=87%, HitCoverage=52%, E-value=3e-37, Identity=47%"; Hit description =Chromosome chr4 scaffold_6, whole genome shotgun sequence
MYKCLAFFSPRMIGTNYIGAFALTKLLLPLLESSPVSSKIVNVSSFTHRAGKDNHYNPYFYYCLVDEGTVSGKRFFRSIQYPCAHIYEYSKYPGVVQTKLMQEVPAILSWLALYVLKRLQLLQSPECGVDSIIDAALAPPGTSGAYFFGGKGRTLNPSPLSRNAKLARELWESTSKLLSVTPFGAEGNSW

SEQ ID NO: 165816 - protein, 29 aa, Glycine max
  Coding DNA Sequence Number=SeqID_74131
MDQLDTIQRNKVEQDIFKLRLFVGYRFNA

SEQ ID NO: 165817 - protein, 303 aa, Glycine max
  Coding DNA Sequence Number=SeqID_74132
  Gene Ontology: Mol. function=transcription factor activity; Cellular component=cytoplasm; Biological process=regulation of transcription, DNA-dependent
  Homolog annotation: Hit_ID=A5B445; Match level="QueryCoverage=100%, HitCoverage=100%, E-value=8e-49, Identity=40%"; Hit description =Putative uncharacterized protein
  Pfam annotation: Domain name=AP2; Domain location=77-131; Score=49.9; E_value=8.8e-12; Accession=PF00847.11; Description=AP2 domain
  Subcellular localization annotation: CTP_CleavageSite=62; ConfidenceScore=5.13e-01
MEDSILCKHTVHRSVTKKLISPKKSSQTNSSTQTERRIVRISYTDPDATDSSSDEEGFPLVRKRMKRYVNQIEIETAAEKVVRKRPAAAVGKWAAEIRDPARRVRLWLGTYDTAEEAAMVYDNAAIRLRGPDALTNFLTPPQRESPSQATTVAVTEEASGSGYDSGDDHCQHNLSSPTSVLHFRSNSESDQKSEQVLRECEGEGEFLALDNMPLPAWDEVFNFETPEYPPLLFQEGNFLHDYQSQMLGETVPFSSDQGFSDSSIVLADSLIDFDKACPPPSTLCQVDDFFQDILLASDPLVLL

SEQ ID NO: 165818 - protein, 180 aa, Glycine max
  Coding DNA Sequence Number=SeqID_74133
  Gene Ontology: Mol. function=small conjugating protein ligase activity; Cellular component=proteasome complex; Biological process =regulation of protein metabolic process
  Homolog annotation: Hit_ID=P35132; Match level="QueryCoverage=82%, HitCoverage=100%, E-value=1e-82, Identity=97%"; Hit description=SUMO- conjugating enzyme UBC9
  Pfam annotation: Domain name=UQ_con; Domain location=37-174; Score =279.1; E_value=8.9e-81; Accession=PF00179.17; Description=Ubiquitin -conjugating enzyme
MVPFGVPPFDLGLGPWVGKKERVSYRKRQVLAMASKRILKELKDLQKDPPTSCSAGPVAEDMFHWQATIMGPPDSPYAGGVFLVTIHFPPDYPFKPPKVAFRTKVFHPNINSNGSICLDILKEQWSPALTISKVLLSICSLLTDPNPDDPLVPEIAHMYKTDRNKYESTARSWTQKYAMG

SEQ ID NO: 165819 - protein, 442 aa, Glycine max
  Coding DNA Sequence Number=SeqID_74134
  Gene Ontology: Mol. function=transferase activity, transferring glycosyl groups; Cellular component=integral to membrane; Biological process=protein amino acid glycosylation
  Homolog annotation: Hit_ID=A7QNC0; Match level="QueryCoverage=99%, HitCoverage=94%, E-value=3e-68, Identity=62%"; Hit description =Chromosome chr2 scaffold_132, whole genome shotgun sequence
  Pfam annotation: Domain name=Galactosyl_T; Domain location=226-427; Score=9.8; E_value=1.6e-07; Accession=PF01762.12; Description =Galactosyltransferase
MQIRGSSHRLSSMGNNRSRIPALLISMFATFASIYVAGRLWQDAENRVYLIKELDRITGQGQSAISVDDTLKIIACREQHKKLDAIETELAGARQEGFVSKPLIETNGTYSMRRPLVVIGILTKFGRQKNRDAIRKAWMGSGASLKKIEEGKGIIVQFVIGRSENRGDNQDKDIDRENRLTNDFIILDILGISFGIHFSMKILLSCLILNLEMEPPEYNFLDRFNNAPENSAHAKIESTKLIKVRIGGNFTTENSVASNLSPQPIVLVKLDQDNHVETNDAFPKKAKLFFAHAADKWDAEFYAKVNDDVYVNIDALGATLATHLDKPRVYMGCMKSGEVFSELEYLMILILVSVKYDRNHKWYEPEWWKFGDKKSYFRHASGEMYVISQALAKFISINRSILRTYAHDDVSAGSWFIGLDVKHVDEAKFCCSSWSTGLPLFS

SEQ ID NO: 165820 - protein, 153 aa, Glycine max
  Coding DNA Sequence Number=SeqID_74135
  Gene Ontology: Mol. function=calcium ion binding; Cellular component =endocytic vesicle; Biological process=endosome transport
  Homolog annotation: Hit_ID=Q9LTR4; Match level="QueryCoverage=47%, HitCoverage=13%, E-value=6e-18, Identity=66%"; Hit description =Similarity to EH domain containing proteins
MDFLSSLCWPLQRRKILAPQLPRVPKEARLNFEETCAKKNCVLNVRHVVISSVLKLERCCILSALVQKTKSLTVNAFLKNKCLNYFESAVTSIIIDGLERLYVERLKPLEFTYRFNDCVSPLLTDSDFDAKPMVMLLGQYSTENNLHKTFTKM

SEQ ID NO: 165821 - protein, 275 aa, Glycine max
  Coding DNA Sequence Number=SeqID_74136
  Gene Ontology: Mol. function=electron carrier activity; Biological process=electron transport
  Homolog annotation: Hit_ID=A7NSI5; Match level="QueryCoverage=84%, HitCoverage=94%, E-value=1e-94, Identity=74%"; Hit description =Chromosome chr18 scaffold_1, whole genome shotgun sequence
  Pfam annotation: Domain name=AhpC-TSA; Domain location=70-200; Score =48.2; E_value=2.9e-11; Accession=PF00578.12; Description=AhpCTSA family
  Pfam annotation: Domain name=Redoxin; Domain location=69-222; Score =24.4; E_value=6.4e-05; Accession=PF08534.1; Description=Redoxin
  Pfam module annotation: Pfam domain module=AhpC-TSA::Redoxin; Domain location=70-200::69-222
  Subcellular localization annotation: CTP_CleavageSite=59; ConfidenceScore=5.57e-01
MALRLRLKVSSIGSPFLQLGSSATAAFSFSQPCSLPKLAFHPPRLQLNKNSHPIRFLVRAGRTESKGVTLGFRAPQFQLPEPLTGKVWTLEDFEAYPALLVMFICNHCPFVKHLKKDIVKLTKFYVEKGLAVIAISSNSVATHPQDGPEFMAEDAKLFDYPFPYLYDESQDVAQDFGAVCTPEFYLFKKDGRRPFELVYHGQFDDSRPSNNVPLTGRDLSLAIDRVLSGQPVPSEQKPSLGLYYFHVLKVIVFLCMKCWMQHKVAPKEEVLIDKL

SEQ ID NO: 165822 - protein, 433 aa, Glycine max
  Coding DNA Sequence Number=SeqID_74137
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q6W6R7; Match level="QueryCoverage=65%, HitCoverage=56%, E-value=1e-111, Identity=63%"; Hit description =Cellulase
  Pfam annotation: Domain name=Glyco_hydro_9; Domain location=22-325; Score=13.9; E_value=3.6e-14; Accession=PF00759.10; Description =Glycosyl hydrolase family 9
MPPTVSSTFKSESDTEICAHTGHYPRNIPGKFRRDSGLQDGDLSKTDFTGGFYDSGNNIKFTITTAYTVTLLSWTVVEYRSKYADIGELDHVSDILRWGSDYLLKVFIPPSSTAGSNLTLFSQANLAGEIVAALSASSMVFKEDKDYSRRLVQAAESLFEAITSEDPSKQGTYTVAECGKQARMLYNSTSYKDELAWGATWLFLATENADYLATATEIFLSAKGFAYRIRYFRDPGFPLEDALKLSSNSTDALMCSYLFNKYFSRTSGGLIILKPDNGSLVQYAATASFLSKLYSDYHDHLKMSVRGHILSTTPLPNFQSVYATVFAKANRQEAMLDSESTMGIAFAVKKYSKKGIRKCTHCNRDNHVMETCFKLHGHPDWHLKGKTTPNAKVDAISKSHISTVVVFVTKSGISNSALNLSVVTRGSGWITDS

SEQ ID NO: 165823 - protein, 146 aa, Glycine max
  Coding DNA Sequence Number=SeqID_74138
  Gene Ontology: Mol. function=transcription elongation regulator activity; Cellular component=intracellular; Biological process =regulation of transcription from RNA polymerase II promoter
  Homolog annotation: Hit_ID=A7NSK9; Match level="QueryCoverage=84%, HitCoverage=13%, E-value=3e-46, Identity=76%"; Hit description =Chromosome chr18 scaffold_1, whole genome shotgun sequence
  Pfam annotation: Domain name=KOW; Domain location=96-127; Score=16.5; E_value=0.098; Accession=PF00467.20; Description=KOW motif
MPPSSPFFFPGPPGGPLLPPAKGGKDKSSPFLGGENEGPWFIPDILVNVHRAGEESVGVIREVLPDGSYRVALGSSGNGEAITALPNEMEAVVPRKSDKIKIMGGALRGATGKLIGVDGTDGIVKVDDTLDVKILDLVILAKLAQP

SEQ ID NO: 165824 - protein, 611 aa, Glycine max
  Coding DNA Sequence Number=SeqID_74139
  Gene Ontology: Mol. function=protein binding; Cellular component =Golgi apparatus; Biological process=vesicle docking during exocytosis
  Homolog annotation: Hit_ID=A7NSJ5; Match level="QueryCoverage=100%, HitCoverage=100%, E-value=0.0, Identity=81%"; Hit description =Chromosome chr18 scaffold_1, whole genome shotgun sequence
  Pfam annotation: Domain name=Sec1; Domain location=21-597; Score =449.8; E_value=3.6e-132; Accession=PF00995.14; Description=Sec1 family
MVVTSSARDYINRILQDISGMKVLILDSQTVGIVSVVYSQSELLQKEVFLVELVDSISKSNESMSHLKAVYFLRPTSENIQLLRRQLASPRFGEYHLFFSNILKDTQIHLLADSDEQEVVQQVQEFYADFVAIDPYHFTLHVPSHYIYMLPAMVDPSTVQRFSDRVVDGLAALFLALKRRPVIRYQRTSDIAKRIAQEAAKLMYQEESGLFDFRRMEVSPLLLVIDRRDDPVTPLLNQWTYQAMVHELIGIQDNKVDLKSIGKFPKDQEEVVLSSEQDSFFKANMYENFGDIGMNIKRMVDEFQQVSKSNQNIQTIEDMAKFVDNYPEYRKMHGNVTKHVTLVTEMSKIVEERKLMSVSQTEQELACNGGQGAAFEAVTNLLNNESISDVDRLRLVMLYALRYEKDSPVQLMQLFNKLASRSAKYKPGRASPGATVKLCLGDLLVMGSNPETASLHMQGKLLILIFVVAPQLVQFLLKQAGVDKRTGDLFGNRDLMNIARNMARGLKGVENVYTQHQPLLFQIMESIVKGRLRDVDYPFIGNHFQQGRPQDVIIFIVGGTTYEESRSVALQNASNTGIRFILGGSSVLNSKRFLRDLEEAQRVARSSTTVI

SEQ ID NO: 165825 - protein, 332 aa, Glycine max
  Coding DNA Sequence Number=SeqID_74140
  Gene Ontology: Mol. function=molecular_function; Cellular component =membrane; Biological process=auxin mediated signaling pathway
  Homolog annotation: Hit_ID=A7Q2G4; Match level="QueryCoverage=97%, HitCoverage=97%, E-value=5e-82, Identity=48%"; Hit description =Chromosome chr1 scaffold_46, whole genome shotgun sequence
  Pfam annotation: Domain name=DUF6; Domain location=169-298; Score =1.5; E_value=0.057; Accession=PF00892.11; Description=Integral membrane protein DUF6
MKELGVVAILLSIEFFDVIVYTVSKAAMKKGMNDFVFVMKRALPPLTYFIVGQLFINGFLSCSVQMLRFFGIGYGSPTLATAMSDLIPAFTFILAIVFRMEILDWKTNSTRAKSIGTLVSIAGALIITLYKGQAVINNHPSNKLFPKKHVSSEQFDWVIGAVLLAGHSFVLSLLFIVQTWIIRNYPAELVIVLTRGTLVAMLSIPPSLISVTDPKALRLGFDVNLIAIALQAIFGVSLRSIVHIWVMSKKGPLYVAMFKPIGIIFAVIMGIAFLGDSIYLGSVLGAAIVVIGFYAVIWGKSQEQAKEECEVYDDSESYSPVVPLLKNKRMEE

SEQ ID NO: 165826 - protein, 237 aa, Glycine max
  Coding DNA Sequence Number=SeqID_74141
  Gene Ontology: Mol. function=methyltransferase activity; Cellular component=nucleus; Biological process=regulation of transcription
  Homolog annotation: Hit_ID=A7NSL4; Match level="QueryCoverage=98%, HitCoverage=95%, E-value=2e-86, Identity=39%"; Hit description =Chromosome chr18 scaffold_1, whole genome shotgun sequence
  Pfam annotation: Domain name=PPR; Domain location=148-182; Score =48.5; E_value=2.3e-11; Accession=PF01535.11; Description=PPR repeat
  Pfam annotation: Domain name=PPR; Domain location=183-217; Score =27.1; E_value=6.6e-05; Accession=PF01535.11; Description=PPR repeat
  Pfam annotation: Domain name=PPR; Domain location=47-81; Score=41.2; E_value=3.6e-09; Accession=PF01535.11; Description=PPR repeat
  Pfam annotation: Domain name=PPR; Domain location=82-116; Score=13.4; E_value=0.2; Accession=PF01535.11; Description=PPR repeat
  Pfam module annotation: Pfam domain module=PPR::PPR::PPR::PPR; Domain location=148-182::183-217::47-81::82-116
MADGYARIGEMEAAREVFEMIPERNCFVWSSTINGLFFDWVPVRNLEIWNSMIAGYVQNGFGEKALQAFEGMGAEGFEPDEFTAVSVLSACAQLGNLDVGKQIHHMIEHKGIVVNPFVLSGLVDMYAKCGDLVNAMLVFEGFPEKNIFCWNAMISGFAINGKCKEALEFFGRMEESNIRPDGITFLTMLSACAHGGLVSEALEVISKMEGYRIEIGIKHYGCMVDLIGQSREIKRGL

SEQ ID NO: 165827 - protein, 44 aa, Glycine max
  Coding DNA Sequence Number=SeqID_74142
MTENRNAQIGEEFLLLRVQERKKLETGNWRKMHCGGGSHPRVFH

SEQ ID NO: 165828 - protein, 84 aa, Glycine max
  Coding DNA Sequence Number=SeqID_74143
  Gene Ontology: Mol. function=electron carrier activity; Biological process=electron transport
  Homolog annotation: Hit_ID=Q9ZRV5; Match level="QueryCoverage=77%, HitCoverage=53%, E-value=2e-24, Identity=78%"; Hit description=Basic blue copper protein
  Pfam annotation: Domain name=Cu_bind_like; Domain location=11-77; Score=72.2; E_value=1.7e-18; Accession=PF02298.8; Description =Plastocyanin-like domain
MFVSPTAGNRDPLLYSSSFFNYDSTTHNVVAVDRSGYNSCKTPGGAKVFSSGKDQIKLARGQNYFICNYPGHCESGMKVAINAV

SEQ ID NO: 165829 - protein, 401 aa, Glycine max
  Coding DNA Sequence Number=SeqID_74144
  Gene Ontology: Mol. function=flavin-containing monooxygenase activity; Cellular component=microsome; Biological process=aromatic compound metabolic process
  Homolog annotation: Hit_ID=A7NSN3; Match level="QueryCoverage=91%, HitCoverage=96%, E-value=1e-124, Identity=59%"; Hit description =Chromosome chr18 scaffold_1, whole genome shotgun sequence
  Pfam annotation: Domain name=FAD_binding_3; Domain location=4-285; Score=-158.6; E_value=0.036; Accession=PF01494.10; Description=FAD binding domain
  Pfam annotation: Domain name=FMO-like; Domain location=7-401; Score= -413.0; E_value=1.4e-05; Accession=PF00743.10; Description=Flavin -binding monooxygenase-like
  Pfam annotation: Domain name=Pyr_redox; Domain location=6-139; Score=- 8.3; E_value=0.027; Accession=PF00070.18; Description=Pyridine nucleotide-disulphide oxidor
  Pfam annotation: Domain name=Pyr_redox_2; Domain location=6-363; Score=-29.4; E_value=0.0036; Accession=PF07992.5; Description =Pyridine nucleotide-disulphide oxidore
  Pfam module annotation: Pfam domain module=FAD_binding_3::FMO -like::Pyr_redox::Pyr_redox_2; Domain location=4-285::7-401::6-139::6- 363
MEIEVPVVIVGAGPAGLATAACLNKYSIPNVVLERHDCHASLWRKRTYDRLKLHLGKDFCNLPHMPFPLDFPTFVPRVDFLRYLDNYVTRFKISIRYTRNVESASVDEENNGKWRVVVKDTTTNADEVYVADYLVVATGENDEGYVPQIEGLEGFEGEHMHCSQYLNGRHLYGKNVLVVGSGNSGMEIAYDLSTWGANTSIVIRGPVHYFTKEMVFVGMSLLKYFKMEKVDKLMLLMSKLKYGDMSEYGLVRPKDGPFFLKIKGGTTPTIDVGCVSRIKKGEVKVFPAISSIKKDKMVEFEDGQNGQFDVIIFATGYNSTVLKWLKDYRGLFNENGMPKPSFPNHWKGNNGIYCAGFSRRGLDGIAFDAQRIADDIKKTLNARNLPGDEEDNFASLKLLGK

SEQ ID NO: 165830 - protein, 230 aa, Glycine max
  Coding DNA Sequence Number=SeqID_74145
  Gene Ontology: Mol. function=protein serine/threonine kinase activity; Cellular component=integral to membrane; Biological process=protein amino acid phosphorylation
  Homolog annotation: Hit_ID=Q2HV99; Match level="QueryCoverage=89%, HitCoverage=29%, E-value=1e-54, Identity=49%"; Hit description =Protein kinase; Type I EGF
MTEDCSLDASFLVSCNRTSIFFITHPFLPQTNLSVLNISLNGELQISWPVASDCYAERGKLVSQTFQDINLTTFQVSSNRNKFTVIGCDTLGVVVGIDSKGRNYTTGCVSLCNRLQDIETNGSCSGTGCYETSIPRGLSGFSYGSGSVVDFNLCGHAFLTDLVNFDKTTFPVGMDWVVKNQTCQEAMKKVSSYPCRAQNSTSKCYHSLVALTVPVAIYNVVFHETLNNSP

SEQ ID NO: 165831 - protein, 678 aa, Glycine max
  Coding DNA Sequence Number=SeqID_74146
  Gene Ontology: Mol. function=catalytic activity; Cellular component =nucleus; Biological process=metabolic process
  Homolog annotation: Hit_ID=Q10AK3; Match level="QueryCoverage=99%, HitCoverage=99%, E-value=1e-165, Identity=43%"; Hit description =Pentatricopeptide, putative, expressed
  Pfam annotation: Domain name=PPR; Domain location=205-238; Score=6.1; E_value=1.5; Accession=PF01535.11; Description=PPR repeat
  Pfam annotation: Domain name=PPR; Domain location=267-301; Score =36.0; E_value=1.3e-07; Accession=PF01535.11; Description=PPR repeat
  Pfam annotation: Domain name=PPR; Domain location=337-371; Score =10.2; E_value=0.48; Accession=PF01535.11; Description=PPR repeat
  Pfam annotation: Domain name=PPR; Domain location=37-70; Score=3.9; E_ value=2.7; Accession=PF01535.11; Description=PPR repeat
  Pfam annotation: Domain name=PPR; Domain location=399-433; Score =26.0; E_value=0.00014; Accession=PF01535.11; Description=PPR repeat
  Pfam annotation: Domain name=PPR; Domain location=434-468; Score=8.2; E_value=0.83; Accession=PF01535.11; Description=PPR repeat
  Pfam annotation: Domain name=PPR; Domain location=500-534; Score =34.9; E_value=2.8e-07; Accession=PF01535.11; Description=PPR repeat
  Pfam annotation: Domain name=PPR; Domain location=535-568; Score=4.4; E_value=2.3; Accession=PF01535.11; Description=PPR repeat
  Pfam annotation: Domain name=PPR; Domain location=571-604; Score =14.1; E_value=0.16; Accession=PF01535.11; Description=PPR repeat
  Pfam annotation: Domain name=PPR; Domain location=99-133; Score=24.1; E_value=0.00053; Accession=PF01535.11; Description=PPR repeat
  Pfam module annotation: Pfam domain module=PPR::PPR::PPR::PPR::PPR::PP R::PPR::PPR::PPR::PPR; Domain location=205-238::267-301::337-371::37 -70::399-433::434-468::500-534::535-568::571-604::99-133
MELHGLVRTLQSWSTLREGRQLHVAFLKTGILNSSVAVANRLLQLYSRCRNLQDASHLFDEMPQTNSFSWNTLVQAHLNSGHTHSALHLFNAMPHKTHFSWNMVVSAFAKSGHLQLAHSLFNAMPSKNHLVWNSIIHSYSRHGHPGKALFLFKSMNLDPSQIVYRDAFVLATALGACADSLALNCGKQVHARVFVDGMGLELDRVLCSSLINLYGKCGDLDSAARIVSFVRDVDEFSLSALISGYANAGRMREARSVFDSKVDPCAVLWNSIISGYVSNGEEVEAVNLFSAMLRNGVQGDASAVANILSAASGLLVVELVKQMHVYACKAGVTHDIVVASSLLDAYSKCQSPCEACKLFSELKEYDTILLNTMITVYSNCGRIEDAKLIFNTMPSKTLISWNSILVGLTQNACPSEALNIFSQMNKLDLKMDRFSFASVISACACRSSLELGEQVFGKAITIGLESDQIISTSLVDFYCKCGFVEIGRKVFDGMVKTDEVSWNTMLMGYATNGYGIEALTLFCEMTYGGVWPSAITFTGVLSACDHSGLVEEGRNLFHTMKHSYNINPGIEHFSCMVDLFARAGYFEEAMDLIEEMPFQADANMWLSVLRGCIAHGNKTIGKMAAEQIIQLEPENTGAYIQLSNILASSGDWEGSALVRELMRDKHFQKIPGCSWADC

SEQ ID NO: 165832 - protein, 563 aa, Glycine max
  Coding DNA Sequence Number=SeqID_74147
  Gene Ontology: Mol. function=kinase activity; Cellular component =intracellular; Biological process=intracellular protein transport
  Homolog annotation: Hit_ID=A7NVL7; Match level="QueryCoverage=88%, HitCoverage=91%, E-value=1e-136, Identity=56%"; Hit description =Chromosome chr18 scaffold_1, whole genome shotgun sequence
  Pfam annotation: Domain name=GAT; Domain location=174-298; Score =81.2; E_value=3.3e-21; Accession=PF03127.5; Description=GAT domain
  Pfam annotation: Domain name=VHS; Domain location=8-136; Score=38.5; E_value=1.4e-08; Accession=PF00790.10; Description=VHS domain
  Pfam module annotation: Pfam domain module=GAT::VHS; Domain location =174-298::8-136
  Subcellular localization annotation: CTP_CleavageSite=48; ConfidenceScore=5.30e-01
MAILTAASPFLSHKATSNCSVSLKFLKRGKVGPLIMQAKDALKILKKRLASKNPKIQLLALFVLETLSKNCGESVFQQIIERDILHEMVKIVKKKPDLNVREKILILIDTWQEAFGGPTGVYPQYYAAYNELKSAGVEFPPRDENSVPFFTPAQTQPIIHSAAEYDDATIQASLQSDASDLSLLEIQNAQGLADVLMEMLSALSPKDRELSAKLSWQVVIFHLFLNILGKICQGVKEEVIVDLVDQCRSYQKRVMLLVNNTTDEQLLGQGLALNDSLQRVLCRHDDIVKGTADSGAREAETSVLPLVNVNHEDDESEDDFAQLAHRSSRDTQAQNQKPAYDKAEPGRINPLIPPPPASKKPVYSGTGMVDYLSGDTYKTEGSPENSEPTSFTAPLHSSPNPTSSTIPSLSSSHPHAVSTTSSPIFSSEPVYDEQPSSEDKSSECLPAAPWDAQSPGIIPPPPSKYNQRQQFFEQQGVSHSSSGSSSSYDSLVGQTQNLSLNSSTPTKQQKPEDALFKDLVDFAKSKTSSSSKPNRFFKDQSLFKFAGRKKGIGDYSMGNFKLL

SEQ ID NO: 165833 - protein, 294 aa, Glycine max
  Coding DNA Sequence Number=SeqID_74148
  Gene Ontology: Mol. function=protein-tyrosine kinase activity; Cellular component=integral to plasma membrane; Biological process =protein amino acid phosphorylation
  Homolog annotation: Hit_ID=A7NSP5; Match level="QueryCoverage=45%, HitCoverage=59%, E-value=3e-41, Identity=51%"; Hit description =Chromosome chr18 scaffold_1, whole genome shotgun sequence
MDSPPASASYVVVACDATRERTEHEIKLVVDHVQERHVFLPSVGYQTLTCPESFAGTNFRAREDEVKKKVDAYATKLLPSYEDFESEGDCHSVEDIEDSIISCKSYPHSIFSSDSSSTIRSYTKQSSYGNRSRENSSLSDFGSSSKQDRSDAPLLCTGCGTRLSIKESMRFSYSDIQSATNDFSKDKLLGEGGYGHVYNGVLKDGQQIAAKVCLKFFSTQEHSDAVGYAIAIGTAKELRFLHEECRGGPIIHRDMRPSNRLLTHDFVPMLGDFGLAKWKTGDDTLQTRIMGTLG

SEQ ID NO: 165834 - protein, 551 aa, Glycine max
  Coding DNA Sequence Number=SeqID_74149
  Gene Ontology: Mol. function=binding; Cellular component=nucleus; Biological process=mRNA modification
  Homolog annotation: Hit_ID=A7NSQ1; Match level="QueryCoverage=91%, HitCoverage=82%, E-value=1e-160, Identity=38%"; Hit description =Chromosome chr18 scaffold_1, whole genome shotgun sequence
  Pfam annotation: Domain name=PPR; Domain location=119-153; Score =31.7; E_value=2.6e-06; Accession=PF01535.11; Description=PPR repeat
  Pfam annotation: Domain name=PPR; Domain location=17-51; Score=16.3; E_value=0.091; Accession=PF01535.11; Description=PPR repeat
  Pfam annotation: Domain name=PPR; Domain location=220-254; Score=7.3; E_value=1.1; Accession=PF01535.11; Description=PPR repeat
  Pfam annotation: Domain name=PPR; Domain location=320-354; Score =40.9; E_value=4.4e-09; Accession=PF01535.11; Description=PPR repeat
  Pfam annotation: Domain name=PPR; Domain location=355-389; Score=3.4; E_value=3.1; Accession=PF01535.11; Description=PPR repeat
  Pfam annotation: Domain name=PPR; Domain location=391-425; Score=7.2; E_value=1.1; Accession=PF01535.11; Description=PPR repeat
  Pfam module annotation: Pfam domain module=PPR::PPR::PPR::PPR::PPR::PP R; Domain location=119-153::17-51::220-254::320-354::355-389::391-425
MADARRMFHEIPQPNAVTWNVIVRRYLDAGDAKEAVFMFSRMFSTSAVRPMNFTFSNALVACSSVSALREGVQIHGVVVKLGLREDNVVSSSLVNMYVKCGRLEDGFQVFDQLGFRDLVCWTSIVSGYAMSGKTLEAREFFDEMPERNVISWNAMLAGYTQCSEWSKALDFVYLMLDVIKDVDHVTLGLLLNVSAGISDHEMGKQVHGYIYRHGFHSDLRLSNALLDMYGKCGNLNSTRVWFNQMSDRRDRVSWNALLASYACANTFTLCLGKQIHGFMIRHGFHIDTVTRTALVYMYCKCRCLEYAIEVLKRAVSRDVIIWNTIIMGCVHNHKGKEALELFVIMEAEGIKPDHVTFKGILLACIEEGLVEFGTGCFKSMSSEFHVLPRMEHYDCMIELYSRHRYMDELENFMRTMTMEPTLPMLKRVLDVCHTSDGKYMQWNMTMIKVLSVMMIIGSIPGFATTGLLLSAVAVSKTFFDFAERKIIMVSIFQGTSAVVGLKGKCRNLELPDPCLENKLQKEAFFAIWDLNSDETIAGLEIARIDGDEIMW

SEQ ID NO: 165835 - protein, 65 aa, Glycine max
  Coding DNA Sequence Number=SeqID_74150
  Subcellular localization annotation: CTP_CleavageSite=45; ConfidenceScore=5.09e-01
MGMDQGAGMSTKKYETKVKNKKNAFASVIPAPRKSVKRMLGLICSASYPFCSMILAPYQDLGECS

SEQ ID NO: 165836 - protein, 1513 aa, Glycine max
  Coding DNA Sequence Number=SeqID_74151
  Gene Ontology: Mol. function=histone-lysine N-methyltransferase activity; Cellular component=chromosome, pericentric region; Biological process=chromatin modification
  Homolog annotation: Hit_ID=A7NVJ0; Match level="QueryCoverage=67%, HitCoverage=65%, E-value=1e-103, Identity=36%"; Hit description =Chromosome chr18 scaffold_1, whole genome shotgun sequence
  Pfam annotation: Domain name=zf-CW; Domain location=1062-1111; Score =43.9; E_value=5.7e-10; Accession=PF07496.6; Description=CW-type Zinc Finger
MGSCGRSAAIDDPSEKFVIEQQHLCSEVQEQVVSVQESCLEEEAYNVVDSNVELSTVTDGCLRGDRVSSEGRVDVTEGSGEGLGLASECKNADLLPLEKSTQDDCQNCLGVSCGSIEVLCVNSGSEGNFQDEGIFDQLSGSLTADDSQRRCAQQDEQKDDESGSLITEDSQRHCAQQDEQKDNKSDVLPAAGDDLDVVEGKNDETGVLADAFSHALDFRDCEVSLESESMADLLVDCNQQSEQEKIMRNPDPLLNVVEKCDALIGEETDACRKISPTPAMEVPSGALCTDTEVESINDHPCDQKDGEETDACRQISPTPTMEVPSDALFTDTEVESISDQPCDQKDGEETDACRKISPTLAMEVPSGPPSGALCTDAKVESTNDQPCDQKDIEDQNSTCEEKFKAFVDEEVININSCIKISSSLDCQETVASSPVVGFPCEPALLDPGCEMKNDMLQIDDFCKLKDCSSEETTNSTFRKPFSPESGLPSVALITNCSAKDVLDLHSKGDDVSINNNNAVNNPGQMDNDGTKAVEVDCITESIPLPSLRDSRRTKFGRKTQTKKASRNCKNKTKVTHSNGGMKLNLEAARKKRSCFSKPARSSVWGLIGNIEQFFEQDNELGVGEAVCQELGKARSKRQSGKAVKNGASTTSLSSVQKCSVSTTRVRLKIKFGKEVDLSCSNVLIPESVDGLASASYLVSDSGSQKVAGNADDKISDAVALGNSESFSNDLGKDGLVLNEQVANNPLETTEITEKSYGDAEEPCLAVPPEKVVEALIEPMSNKGMDPGTSPDSEVINSIPEVQIGERHQEDVHHAVLGSSKELNSKLNVTISKRGKKKEKLICSGNCITEDGSQGPRGNSRAKHSKNHRRKKNCRDAFSSLELPTEISKSVTSKELSPELLPHSGETELGGSVEALKVKNHMDAKTSNKPSVDHGFSDSLVSEKMLSSARPLGRKLPKSLRPSKVSKTKSKASDSSGRKKTTAGTCKEKQKNPINKSKVKGKGASLKVTCEVEDCPHPANAGNHKLDAIGKIIADDNRVSVNVSNLDMLSGVGFGEQILSPRNAWVRCDDCHKWRRIPAVLADRIDETNCTWTCKDSSDKAFADCAIPQEKSNAEINAELGLSDASGEEDAYEGSKNFKELEYWPPIGGKLGCGDECLNRILNIECVQGTCPCGDRCSNQQFQKHKYASLKWFKCGKKGYGLKAIEDVAQGQFLIEYVGEDEELTFDYNYVRVFGAAAKKCYCGSSNCRGYIGGGDPLNAELIVQSDSEEEFPEPVMLTKDGEIEDAVPTPKYFNNVDTESAKHMLKDRDILENPTTAIDSDGSPEKESSMNPASAVSLLHSSAEMEDSKGKLPSSVRDEEISQQMEDVTSKPMPSVHQGYEKESEFADKTSSIQRLETTSPPTTVSKMLPNSAGSNRESKSEIIGGKKTPKLNGSVKKGKVHANPPNGLKTEVTANRLQVSSIKHKKVEGSSNGRFEAVQEKLNELLDGDGGISKRKDATKGYLKLLFLTVAS

SEQ ID NO: 165837 - protein, 914 aa, Glycine max
  Coding DNA Sequence Number=SeqID_74152
  Gene Ontology: Mol. function=transferase activity; Cellular component= chloroplast; Biological process=metabolic process
  Homolog annotation: Hit_ID=A7NVI4; Match level="QueryCoverage=99%, HitCoverage=88%, E-value=0.0, Identity=58%"; Hit description =Chromosome chr18 scaffold_1, whole genome shotgun sequence
  Pfam annotation: Domain name=NAD_kinase; Domain location=670-912; Score=23.4; E_value=7.7e-07; Accession=PF01513.12; Description=ATP -NAD kinase
  Subcellular localization annotation: CTP_CleavageSite=37; ConfidenceScore=5.68e-01
MVFSVDRITPTFVSVFSGNARVLAFRFQLRRNTHLVTAQLSNSFSFNFGLDSQSLNSIQSHAPSRLPWTGPVPGDIAEVEAYCRIFRSSERLHSALMDALCNPLTGECSVSYEVLSDEKPLLEDKIVSVLGCIVALVNGGRQDVLSGRSSIGTPFRSTEVGMMEDTLPPLALFRSEMKKCCESLHVALENYFIPGDDRSLDVWRKLQRLKNVCYDSGFPRGEDYPSPEIFANWSPVYLFTSKEDMDSKESEAAFCMGGQVTEEGLKWLLDKGYKTIIDLREEDVKDNFYQAAVCDAISSGSIKLVRIPVKVRTAPTMEQVERFASYVSDCSKRPMYLHSKEGVWRTSAMVSRWRQYMTRPASQFFSNQAVISNDMSSYYTIGSGKLQDSMIAEGSSLEKDTNLLQEGLGATHGSASRFDSCSSLKKNNEKTQSNGALSELSPDDIASSQATAATGEGSFPIFSRKTRPLEAQVPPFDIFSKKEMSKFLGSRQIPKPSHFSHQGKRLEGLPDSRNPEPKLVDPEKSSNGSAHVDYPSGSNWKLVNLNNSSSVRTTVNGFSEGEMYYRSDANFSTIVNNDIDNVNTNSQRIGVNKDKAGLALSDEDLGLIEGDMCASSTGVVRVQSRKKAEMFLVRTDGFSCARERVSESSLAFTHPSTQQQMLMWKTTPKTVLLLKKPGEHLMEEAREVASFLYYQEKMNVFVEPDAHDIFARIPGFGFVQTFYTQDTCDLHEKVDFVACLGGDGVILHASNLFRNAIPPVVSFNLGSLGFLTSHNFEDYKQDLQQVIHGNSTRDGVYITLRMRLRCEIFRKGKAVPGKVFDILNEVVVDRGSNPYLSKIECYEHAFTISKHLLEAVSFLLYDDDYHVFQVQGDGVIVATPTGSTAYSTAAGGSMEYGQYTPCKTWAILPSRANF

SEQ ID NO: 165838 - protein, 30 aa, Glycine max
  Coding DNA Sequence Number=SeqID_74153
PDLLAIPVFREEKLAVLHCKERFHVMDENI

SEQ ID NO: 165839 - protein, 959 aa, Glycine max
  Coding DNA Sequence Number=SeqID_74154
  Gene Ontology: Mol. function=protein binding; Cellular component =nucleus; Biological process=carbohydrate metabolic process
  Homolog annotation: Hit_ID=A7NVG5; Match level="QueryCoverage=76%, HitCoverage=99%, E-value=0.0, Identity=59%"; Hit description =Chromosome chr18 scaffold_1, whole genome shotgun sequence
  Pfam annotation: Domain name=Myb_DNA-binding; Domain location=548 -593; Score=45.7; E_value=1.6e-10; Accession=PF00249.22; Description =Myb-like DNA-binding domain
  Pfam annotation: Domain name=SWIRM; Domain location=325-414; Score =80.9; E_value=4.3e-21; Accession=PF04433.8; Description=SWIRM domain
  Pfam annotation: Domain name=ZZ; Domain location=487-531; Score=6.3; E_value=0.039; Accession=PF00569.8; Description=Zinc finger, ZZ type
  Pfam module annotation: Pfam domain module=Myb_DNA-binding::SWIRM::ZZ; Domain location=548-593::325-414::487-531
MENKLNLISGMNNISFLSATVGLPNSGAYLEGRVAGLRSLKVQGRDFTNQAWGYQVGLLGEKLQIYTASGSSKVKWESFLSSTKPLTWYKTTFDAPVGNDPVVLNLGSMGKGYTWVNGQGIGRYWVSFHTPQGTPSQKCTREGSKAARIEPHSSRSDSENRTRWRKRKRDSQISRRHQKHEEDDDDDDENPNAEEDLAERDYDSEDQTHHNHPNSQPHVETEVLSDHGVQISQFPAVIKRSVNRPHSSVTAIVALERALESGENKAPSALAAPVLENVSHGQLQALSSVPSDSFAFDGDSSFVITPPPILEGRGVVKRYGTKALVVPMHSADWFSPATVHRLERQVVPHFFSGKSPDHTPEKYMECRNCIVALHMEDPGKRITVSDCKGLLAGVNVEDLTRIVRFLDHWGIINYCVRMPSHESPNAVSCLREETSGEVRVPSEALKSIDSLIKFDKPNCKLKADEIYSSLSAHSADVLDLEDRIREHLSENHCNYCSCPLPVVYYQSQKEVDILLCTDCFHDGRFVIGHSSIDFVRVDSTRDYGELDGDSWTDQETLLLLEAMEIYNENWNEIAEHVGTKSKAQCILHFLRLPMEDGKLENINVPSMSLSSNAINRDHSGRLHCYSNGDTAGTVHQTRDSDNRLPFANSGNPVMALVDSYTFGFGWCIPKVAFLASAVGPRVAASCAHAALAVLSEDNSGSTSQMEAPGHDNRTNSENIHCRDGGPHGETAVSNNHNEMLLLISEDKAKVRGSWGLNEGRITPLSAEKVKDAAKAGLSAAAMKAKLFADHEEREIQRLCANIVNHQLKRLELKLKQFAEIETLLMKECEQLERTKQRCAADRSRIMSARLGTVGATPTMNASGVGPSMASNGNNRQQMISASSSQPSVSGYGNNQPVHPHMSFAPRPSMFGLGQRLPLSMIQQSQPASSTAMFNAPSNVQPTTNHPLLRSVSGTNSGLG

SEQ ID NO: 165840 - protein, 173 aa, Glycine max
  Coding DNA Sequence Number=SeqID_74155
  Gene Ontology: Mol. function=transporter activity; Cellular component= membrane; Biological process=transport
  Homolog annotation: Hit_ID=A7NVG8; Match level="QueryCoverage=82%, HitCoverage=34%, E-value=6e-50, Identity=69%"; Hit description =Chromosome chr18 scaffold_1, whole genome shotgun sequence
MVQASGHATRLEIIVREHYLVKETIYYPHDLMILSFELPFALIPLLNFSSSSTKMEPHKNSMIVIVIPWILSLRMIGINVYYLCTAFVGWLIHNNLPKVANVFIGIIVFPLMAVYAVAIIYLAFRKDTVQTHIETKNEPAMQTHTERGFTANGQLELSQVTYREDLADIPPPQ

SEQ ID NO: 165841 - protein, 300 aa, Glycine max
  Coding DNA Sequence Number=SeqID_74156
  Gene Ontology: Mol. function=protein binding; Cellular component =mitochondrion; Biological process=response to stress
  Homolog annotation: Hit_ID=A7NVE5; Match level="QueryCoverage=82%, HitCoverage=74%, E-value=1e-117, Identity=81%"; Hit description =Chromosome chr18 scaffold_1, whole genome shotgun sequence
  Pfam annotation: Domain name=F-box; Domain location=60-107; Score =51.1; E_value=3.9e-12; Accession=PF00646.24; Description=F-box domain
MASGSDFALAVSSELESVLRLETVNYFVTRRPWLDLYGVNVRPVAPVGSASRRPYVDPALIHRSLPDELLFEVFARMTPYDLGRASCVCRKWKYTIRNPVFWRNACLKAWQLSGIVENYRILQSKYDGSWRKMWLSRPRLRTDGLFVLQCSHISGLYVSRNTYIRAGVAEWKITNPVHVVCYFRYLRFFPSGRFLYKNSSQKVKDVAKCMNFRSSKADCVFGGHYTLSDDKVEAAVLYPGMRPTVLRIRLRLGFDVPLYSYHFTNIQWIPQNNSLPSPMPNKKKEASNSRGISFSAWIME

SEQ ID NO: 165842 - protein, 359 aa, Glycine max
  Coding DNA Sequence Number=SeqID_74157
  Gene Ontology: Mol. function=aspartic-type endopeptidase activity; Cellular component=cellulose and pectin-containing cell wall; Biological process=proteolysis
  Homolog annotation: Hit_ID=Q9C6Y5; Match level="QueryCoverage=100%, HitCoverage=88%, E-value=1e-125, Identity=58%"; Hit description =Nucellin, putative
  Pfam annotation: Domain name=Asp; Domain location=1-351; Score= -107.4; E_value=3e-07; Accession=PF00026.14; Description=Eukaryotic aspartyl protease
YYTVSLAIGNPPKVYDLDIDTGSDLTWVQCDAPCKGCTLPRNRLYKPHGDLVKCVDPLCAAIQSAPNHHCAGPNEQCDYEVEYADQGSSLGVLLRDNIPLKFTNGSLARPMLAFGCGYDQTHHGQNPPPSTAGVLGLGNGRTSILSQLHSLGLIRNVVGHCLSGRGGGFLFFGDQLIPPSGVVWTPLLQSSSAQHYKTGPADLFFDRKTTSVKGLELIFDSGSSYTYFNSQAHKALVNLIANDLRGKPLSRATGDPSLPICWKGPKPFKSLHDVTSNFKPLLLSFTKSKNSPLQLPPEAYLIVTKHGNVCLGILDGTEIGLGNTNIIGDISLQDKLVIYDNEKQQIGWASANCDRSSKS

SEQ ID NO: 165843 - protein, 407 aa, Glycine max
  Coding DNA Sequence Number=SeqID_74158
  Gene Ontology: Mol. function=aspartic-type endopeptidase activity; Cellular component=cellulose and pectin-containing cell wall; Biological process=proteolysis
  Homolog annotation: Hit_ID=Q9C6Y5; Match level="QueryCoverage=90%, HitCoverage=90%, E-value=1e-129, Identity=57%"; Hit description =Nucellin, putative
  Pfam annotation: Domain name=Asp; Domain location=47-399; Score= -122.0; E_value=2.2e-06; Accession=PF00026.14; Description=Eukaryotic aspartyl protease
MDVKNSGRGIPFMTFYLFLLLLSAISVLSHASSIAFQIKGNVYPLGYYSVNLAIGNPPKAYELDIDTGSDLTWVQCDAPCKGCTLPRDRQYKPHGNLVKCVDPLCAAIQSAPNPPCVNPNEQCDYEVEYADQGSSLGVLVRDIIPLKLTNGTLTHSMLAFGCGYDQTHVGHNPPPSAAGVLGLGNGRASILSQLNSKGLIRNVVGHCLSGTGGGFLFFGDQLIPQSGVVWTPILQSSSSLLKHYKTGPADMFFNGKATSVKGLELTFDSGSSYTYFNSLAHKALVDLITNDIKGKPLSRATEDPSLPICWKGPKPFKSLHDVTSNFKPLVLSFTKSKNSLFQVPPEAYLIVTKHGNVCLGILDGTEIGLGNTNIIGDISLQDKLVIYDNEKQRIGWASANCDRSSLM

SEQ ID NO: 165844 - protein, 676 aa, Glycine max
  Coding DNA Sequence Number=SeqID_74159
  Homolog annotation: Hit_ID=A5BXJ6; Match level="QueryCoverage=84%, HitCoverage=81%, E-value=1e-115, Identity=43%"; Hit description =Putative uncharacterized protein
  Pfam annotation: Domain name=DUF869; Domain location=125-590; Score =414.8; E_value=1.2e-121; Accession=PF05911.2; Description=Plant protein of unknown function (DUF869)
MEKNICKSSEDSPSETESLGSELSHSEKQPDEQHQALNESPIGHNQSPKVTSEAVAIAEDINDMSFINAQSAEVISHTTHKGHDGLLEEDENGANDSIIKDGDVTDGLRNMSKNLSAEVVNVSAKEDLVKQHAKVAEEAIAGWEKAENEVTSLKKQVEALTLRNSTLEDRVTHLDSALKECVRQLRQTREEQEQNVHDAVLKKTQELESAKTKLEKQLKELHSKSDASNASSHSSIEFDMIQKVEYLENENMALKHELKAQSEKLKLRTIERDLSTQTAEMASKQHLESINKVAKLEAECRRLKNMACRASITSSSFCAESFKDGQSESGERTNATEIDTTRKSGSEPDMCELSCSDSWASALIAEPDQFKNEKYKQIPSGSVNIDLMDDFLEMERLASLPDTKNESLIKDSLVANQCIHEESSMDELKEKLEKAKEEKEEVKICLMKTESVIEASQLQMREAETKLEELQIELENAYKSRQVFENELMSMQAEAQSITAKVHLLEEEIDKEKAMSVEIESRCKELEEELERMKQEEKLGSVTGSYTEMKLKQEDLALAAGKLAECQKTIASLGNQLSSLATLEDFLIDTTSIPEFSASPSLIARAGGDMLQKLHSNDTYLPKRDSGSSRSGPPLNKNEETSPPSSTNLPNHESSKSRNGFAKFFSQTESGIQLGI

SEQ ID NO: 165845 - protein, 1198 aa, Glycine max
  Coding DNA Sequence Number=SeqID_74160
  Gene Ontology: Mol. function=nucleoside-triphosphatase activity; Cellular component=nucleus; Biological process=cell cycle
  Homolog annotation: Hit_ID=A5B201; Match level="QueryCoverage=93%, HitCoverage=98%, E-value=0.0, Identity=42%"; Hit description =Putative uncharacterized protein
  Pfam annotation: Domain name=AAA; Domain location=404-627; Score= -33.1; E_value=0.016; Accession=PF00004.20; Description=ATPase family associated with various cellular activities (AAA)
MDATVTDLSPSCNAAAEPPRRSVRRRLVQSTLFPHKPPEPDQKNDKEDERDEDYSDSENHKKRKKPKAKTTPRKKASKNATPKKNVSANGTNKGSTSRQVLADSDRVIAPVHDLFLEAKLAAEEDSRIFTGRQIHPFFSLWKAGKKVQDVADSGSNLSTTKSEDERTTCGPIHVFENTQDDTSSLDWRNWTFLENTTSMNYGSESLNSSVLEASVESLNFDKLRSSLYPSGTSISQNSLSSDRLCIHPENLEELSPSNSASLAKQTCPPTCEDAKLDLEVDESATTTVQAGIFRKSDTEPPIRFLQESMRSYYCSCVDKAENSLWTYKYKPTKAVEVCGNDESVNFLRDWLHLWHERRYKSRKDISDMDKSDMRDVGDDDDDYKCSYSDYDSEDINEEDSLQNVLLITGPIGSGKSAAVYACAEEQGFEILELNASDCRNGTAVRNYFGDALGSLGFKRSSENTASPQKKTTKFPLALALFSGKAADEVNDGVDELITIPDDEAHIPSGSLQKLLGKNNVVASCDKVQTLILIEDVDILSPEDRGCIAAIQQIAETAKGPIILTSNSDNPGLPDNFDVLHVSFVLPSPKELLCHLYTVCLTEGVNIHPLLLEKFIHSCDGDIRKSIMHLQFWFQGKRFQKDGKAQTHYGSLPFDLELGHQILPKIMPWDFPSEISKLIENEITKSTNKMEETSRGLVTELLHTDEQKNDLNVQCMEADYIEAKKVEMIKRNSSLTDYSELEIQYNAISEFANSSDSPLTSCRQNGRRKLVVMSSDSEDEDSNNGYPVDTHDEANTRQLMKENNECPSELQLNGNYPSTTLRKLVCSEFEHSEEEHFKYSETADDTCLNETCKSLDASCVPESTFVPETEIENGTESISGAVSSGPLVGPQDQEVSVNNELKPFCVRRRLTKLSQNPDLLDTEISDHSPKGVLQDVLDEHIETIVNVMDECSRVDFKAKPMFLQSNPLTETEKIQKLWKDLRERRMDLKQHATSEQLGAFQVVKLASGLNNLISEADLFHKRDIMEPSTFLSGEATSSWYHEQIMTSTVAEHGFCFYAKLIADEASKLGCANCVDITSEMLASAIKLSGQDLTKSKVIYTGKEVEWKSPINSTQKSENKTSQFKAIQSIVPARISLALKGGAFNEYLSSLREITRSEASRISQEVEKNRRGRCTTLSPEDISLVSEGNLYRKDSSQHTT

SEQ ID NO: 165846 - protein, 510 aa, Glycine max
  Coding DNA Sequence Number=SeqID_74161
  Homolog annotation: Hit_ID=A7NVB7; Match level="QueryCoverage=86%, HitCoverage=81%, E-value=8e-88, Identity=45%"; Hit description =Chromosome chr18 scaffold_1, whole genome shotgun sequence
  Pfam annotation: Domain name=CHZ; Domain location=427-462; Score =35.9; E_value=1.5e-07; Accession=PF09649.1; Description=Histone chaperone domain CHZ
  Pfam annotation: Domain name=DEK_C; Domain location=175-233; Score =10.8; E_value=0.038; Accession=PF08766.2; Description=DEK C terminal domain
  Pfam annotation: Domain name=Morbilli_P; Domain location=1-266; Score= -158.0; E_value=0.099; Accession=PF01647.7; Description=Morbillivirus RNA polymerase alpha subunit
  Pfam module annotation: Pfam domain module=CHZ::DEK_C::Morbilli_P; Domain location=427-462::175-233::1-266
MAEASEGTTKKEEILESQIETAMRSRVSHFKEQSDSLTFEGVRRLLEKDLGLEEYALDVHKRFIKQCLLKNPIMWHFSIPPPQAVCEGKPAIVCLEGVGDDDGPKISGKEGEKGSSIQESEEPKEECESKDAKDLCPEDEEKMEDSPVLGLLKEQKRAKLETKDDKGNGTKVVPSEALIKKAVRKRSSYIKANAEKITMAGLRRLLEEDLKLDKFTLDPYKKFVSQQLDEVLTSSEVPEPAKNAKKIVKKKPDTKVTKKVSSEENSDTSDKETDEEESEEDEVKPRKKILPKGKVKTSVQPKKRKGEESDLSSKKRVKPAKAASEDNSDAEDNGKNSEDDQSHSSPEKPSKKKEVSNPVYGKRVEHLKSVIKACGMSVPPVIYKKVKQVPENKREGQLIKELEEILSREGLSSNPSEKEIKEVKRKKARAKELEGIDLSNIVSSSRRRSTSSYTSPPPKPKVPVETSGNGAEGSDNDDEDNDNEEDEEDEEEDSGDDDGSQSEEFNDVVK

SEQ ID NO: 165847 - protein, 105 aa, Glycine max
  Coding DNA Sequence Number=SeqID_74162
  Homolog annotation: Hit_ID=A7R482; Match level="QueryCoverage=78%, HitCoverage=7%, E-value=2e-11, Identity=45%"; Hit description =Chromosome chr18 scaffold_628, whole genome shotgun sequence
  Subcellular localization annotation: CTP_CleavageSite=55; ConfidenceScore=5.19e-01
MKKILGLQAPMELASARFLSQTTSKMQSNTMRLKGSIGYIARVTLTLSNIGILLLEMLVAKRPTDEIFKEGLSLSIFISAMDENEVLKVADRRLIDDYEYSTQSP

SEQ ID NO: 165848 - protein, 83 aa, Glycine max
  Coding DNA Sequence Number=SeqID_74163
  Gene Ontology: Mol. function=molecular_function; Cellular component =membrane; Biological process=auxin mediated signaling pathway
  Homolog annotation: Hit_ID=A7NVB2; Match level="QueryCoverage=95%, HitCoverage=20%, E-value=9e-19, Identity=53%"; Hit description =Chromosome chr18 scaffold_1, whole genome shotgun sequence
MRTWFRNAKLYLLLLAVQFGSAGMFVFAMDAIKKGMSHYVFTVYRNVIASVTLAPFAFVLERKVRPKMTVRIFAEIMALAFFE

SEQ ID NO: 165849 - protein, 300 aa, Glycine max
  Coding DNA Sequence Number=SeqID_74164
MTSKNNTGILRFIPTNCTKGGRTGVGEEDLKWWHSRPVSPRSARDERTSHVMVLERSDMRRSARCKVSDAKSLDKEFKLIWAKWVRFESGVRVGSGVGSTRSILGQLGSSSSATRRKAFRGVAMSSRVAPEMAEVATVSAVESAAEAVMVRDLVVWVRSMETKKGSGGRVTEAVIGEGHPDGLEAVLASRRKVMVGWRLLWMVVVGAVMASMEGSHRSSVRQVTAMEGNHGSSVRRVAAMEAPYSEVSTSKNKEEEGEDKLVSRLPVPQEEEEKQRAEQHRIFHPAHNTPARSCSNEVTK

SEQ ID NO: 165850 - protein, 157 aa, Glycine max
  Coding DNA Sequence Number=SeqID_74165
MQFGVDWLLGIGYFPLLVLNDFMDLGYILHHQDMNHKLVATLQFGKVFALHRIEALPSSKDMSSKSIAKRAANDINLEARRMAISIKSYIFVLLIASLRMEPYPFKNCNNDDGGDNTDDGNNDDNTNIDSDGNNDNVDSNGGNNDNNNDDSDKSDNQ

SEQ ID NO: 165851 - protein, 99 aa, Glycine max
  Coding DNA Sequence Number=SeqID_74166
MGWECLASPVDETQAVSPAVWASPTSGVSPFPLAASAGCVAVPIGDTLLSPSYVAISRHCYWQYTLLSSFTATGNGGLSHAASGNGGFLHKTNPLRYLF

SEQ ID NO: 165852 - protein, 563 aa, Glycine max
  Coding DNA Sequence Number=SeqID_74167
  Gene Ontology: Mol. function=oxidoreductase activity, acting on single donors with incorporation of molecular oxygen, incorporation of two atoms of oxygen; Cellular component=cytoplasm; Biological process=abscisic acid biosynthetic process
  Homolog annotation: Hit_ID=Q94IR2; Match level="QueryCoverage=100%, HitCoverage=100%, E-value=0.0, Identity=80%"; Hit description =Carotenoid cleavage dioxygenase 1
  Pfam annotation: Domain name=RPE65; Domain location=38-554; Score =745.7; E_value=3.1e-221; Accession=PF03055.6; Description=Retinal pigment epithelial membrane protein
MGDDGKKISGEGGLVKVEPKPSNGFTSKVVDLLEKLVVKFLYDSSLPHHYLTGNFAPVSETPPTKDLPVKGYLPDCLNGEFVRVGPNPKFAPVAGYHWFGIDMHAFKFISIKKCVLQLDFEAYQALPDCFCRFDGDGMIHGLRIKDGKATYVSRFVRTSRLKQEEYFGGSKFMKIGDLKGLFGLLMVNIHMLRTKWKVLDASYGTGTANTALVYHHGKLLALSEADKPYAIKVFEDGDLQTLGMLDYDKRLGHSFTAHPKVDPFTGEMFTFGYAHTPPYITYRVISKDGYMHDPAKGIPGVSVLIFWQKLIFQEMVKNKTLIFSFDSTKKARFGVLPRYAKDEKLIRWFELPNCFIFHNANAWEEEDEVVLITCRLQNPNLDLVGGTAKEKLENFSNELYEMRFNMKTGEASQKKLSASAVDFPRVNESYTGRKQRYVYGTTLDSIAKVTGIIKFDLHAEPDNGKTKLEVGGNVQGLYDLGPGKYGSEAVYVPRVPGTDSEEDDGYLICFVHDENTGKSFVHVINAKTMSADPVAVVELPHRVPYGFHAFFVTEEQLQEQGKL

SEQ ID NO: 165853 - protein, 293 aa, Glycine max
  Coding DNA Sequence Number=SeqID_74168
  Gene Ontology: Mol. function=transcription factor activity; Cellular component=nucleus; Biological process=regulation of transcription, DNA-dependent
  Homolog annotation: Hit_ID=A7Q299; Match level="QueryCoverage=40%, HitCoverage=41%, E-value=2e-21, Identity=50%"; Hit description =Chromosome chr13 scaffold_45, whole genome shotgun sequence
  Pfam annotation: Domain name=CBFB_NFYA; Domain location=215-268; Score=48.9; E_value=1.8e-11; Accession=PF02045.6; Description=CCAAT -binding transcription factor (CBF-BNF-YA) subunit B
MFLLRSHSIIEKRGYLERERDNGSHFNAIQVLKTKAFHRKSCAKMPGKADTDDWRVERGEQIQFQSSIYSHHQPWRCGVGENASKSSSADQLNGSIVNGITRSETNDKSGEGVAKEYQNIKHAVLSTPFTMDKHLAPNPQMELVGHSVVLTSPYSDAQHGQILTTYGQQVMYFFIRLIVSEEDARLALDVTQYKINPQLYGMYHARMPLPPEMEEEPVYVNAKQYHGILRRRQSRAKAELEKKVIKNRKGVSTSLKTLKKKEKCVVYACKPIQHLCSILMKYCLPLAGKLLYR

SEQ ID NO: 165854 - protein, 701 aa, Glycine max
  Coding DNA Sequence Number=SeqID_74169
  Gene Ontology: Mol. function=nucleic acid binding; Cellular component= nucleus; Biological process=regulation of transcription
  Homolog annotation: Hit_ID=A7Q2A5; Match level="QueryCoverage=100%, HitCoverage=100%, E-value=0.0, Identity=68%"; Hit description =Chromosome chr13 scaffold_45, whole genome shotgun sequence
  Pfam annotation: Domain name=Ank; Domain location=57-90; Score=16.2; E_value=0.12; Accession=PF00023.21; Description=Ankyrin repeat
  Pfam annotation: Domain name=Ank; Domain location=92-127; Score=33.6; E_value=7.3e-07; Accession=PF00023.21; Description=Ankyrin repeat
  Pfam annotation: Domain name=zf-CCCH; Domain location=275-300; Score =26.4; E_value=0.00011; Accession=PF00642.15; Description=Zinc finger C-x8-C-x5-C-x3-H type (and similar)
  Pfam module annotation: Pfam domain module=Ank::Ank::zf-CCCH; Domain location=57-90::92-127::275-300
MKSLTVNTEDSFSSLLELASNNDIEGFKVLLEKDSSTINEVGLWYGRQNGSKQFVLEHRTPLMVAATYGSIDVMKMVLLCPEADVNFACGANKTTALHCAASGGSTKAVDAVKLLLSAGADVNCVDANGNRPIDVIAVPPKLQGAKAVLEELLSDNASDVSVGEFSVPVSVNSSSPGSPAHSSNGMPYTPSVSPPSPVAAKFTDAAICSLSEKKEYPIDPSLPDIKNSIYATDEFRMFSFKVRPCSRAYSHDWTECPFVHPGENARRRDPRKFHYSCVPCPDFRKGACRRGDMCEYAHGVFECWLHPAQYRTRLCKDGTSCNRRVCFFAHTAEELRPLYVSTGSAAPSPRSSASGPNVMDMAAAMSLFPGSPSSGSSMSPSHFGQPMSPSANGMPLSSAWAQPNVPALHLPGSNLQSSRLRSSLSARDIPPEDLNMMSDLDGQQQHHLNDLSCYIQPRPGASSVSRSGRSKTLTPSNLEELFSAEISLSPRYSDPAAGSVFSPTHKSAVLNQFQQLQSMLSPINTNLLSPKNVEHPLFQASFGVSPSGRMSPRSVEPISPMSARLSAFAQREKQQQQLRSVSSRDLGANSPASLVGSPANPWSKWGSPIGKADWSVNGDSLGRQMRRSSSFERKNNGEEPDLSWVQSLVKESPPEMIKEKFASPMPTASADGPNSNSQIESIDHSVLGAWLEQMQLDQLVV

SEQ ID NO: 165855 - protein, 128 aa, Glycine max
  Coding DNA Sequence Number=SeqID_74170
  Gene Ontology: Mol. function=drug transporter activity; Cellular component=membrane; Biological process=multidrug transport
  Homolog annotation: Hit_ID=A7Q2A7; Match level="QueryCoverage=50%, HitCoverage=12%, E-value=6e-16, Identity=64%"; Hit description =Chromosome chr13 scaffold_45, whole genome shotgun sequence
MIPIKTHHFSSDLSKPKKVGCFKHFSVDLSRLYEIHYPMDENRSSNEPNKWKMPLFVFFKDARNVFKLDALSREILGIALPSALAVSADPIASLIDTAFIGRLAIRWLCAITMSDTPIATCRPYKFLW

SEQ ID NO: 165856 - protein, 338 aa, Glycine max
  Coding DNA Sequence Number=SeqID_74171
  Gene Ontology: Mol. function=calcium-dependent phospholipid binding; Cellular component=cytoplasm; Biological process=negative regulation of coagulation
  Homolog annotation: Hit_ID=O65848; Match level="QueryCoverage=100%, HitCoverage=100%, E-value=1e-144, Identity=77%"; Hit description =Annexin
  Pfam annotation: Domain name=Annexin; Domain location=14-79; Score =98.8; E_value=1.7e-26; Accession=PF00191.11; Description=Annexin
  Pfam annotation: Domain name=Annexin; Domain location=193-258; Score =51.8; E_value=2.3e-12; Accession=PF00191.11; Description=Annexin
  Pfam annotation: Domain name=Annexin; Domain location=268-333; Score =84.5; E_value=3.5e-22; Accession=PF00191.11; Description=Annexin
  Pfam annotation: Domain name=Annexin; Domain location=86-150; Score =55.9; E_value=1.4e-13; Accession=PF00191.11; Description=Annexin
  Pfam module annotation: Pfam domain module=Annexin::Annexin::Annexin:: Annexin; Domain location=14-79::193-258::268-333::86-150
MATLIAPSNHSPQEDAEALRKAFEGWGTDENTVIVILGHRTVYQRQQIRRVYEEIYQEDLVKRLESEIKGDFEKAVYRWILEPADRDAVLANVAIKSGKNYNVIVEIATILSPEELLAVRRAYLNRYKHSLEEDVAAHTSGHLRQASSCVHLTHIKSKSEGYVARLDVIQLLVGLVTAFRHVGDEINPKLAQSEAEILHDAVKEKKGSYEETIRVLTTRSRTQLVATFNRYREIHGTSISKKLVDEGSDEFQRALYTAIRAINDPIKYYEKVVRNAIKKVGTDEDALTRVVVSRAEKDLKIISEVYYKRNSVLLEHAIAKEISGDYKKFLLTLLGKED

SEQ ID NO: 165857 - protein, 215 aa, Glycine max
  Coding DNA Sequence Number=SeqID_74172
  Gene Ontology: Mol. function=calcium-dependent phospholipid binding; Cellular component=cytoplasm; Biological process=negative regulation of coagulation
  Homolog annotation: Hit_ID=P51074; Match level="QueryCoverage=93%, HitCoverage=95%, E-value=5e-41, Identity=38%"; Hit description =Annexin-like protein RJ4
  Pfam annotation: Domain name=Annexin; Domain location=14-75; Score =70.0; E_value=7.7e-18; Accession=PF00191.11; Description=Annexin
  Pfam annotation: Domain name=Annexin; Domain location=145-210; Score =65.6; E_value=1.6e-16; Accession=PF00191.11; Description=Annexin
  Pfam module annotation: Pfam domain module=Annexin::Annexin; Domain location=14-75::145-210
MATLVAPRNHFPQEDAEALWKAVKDEKTIIKILGHRNASQRQQIRLVFQDIHLEDLVKRLESELSGDFEQLWVGLVSSFRYGGDEINARLAKSEANILHEAIKDKESFKDENNISISKKLLEETSDDFYKAVNVAIHCINDHKKYYEKVLRNAIKGVGNNEDGQTRVFVTRAEKDLKDIKELYYKKNSVHLEDTMAKENSGYYKKFLLTLLGKGG

SEQ ID NO: 165858 - protein, 43 aa, Glycine max
  Coding DNA Sequence Number=SeqID_74173
MGRHYFSGKTTKIGNVVQLVWILKNTYTGLQKIWESRLLVPHK

SEQ ID NO: 165859 - protein, 30 aa, Glycine max
  Coding DNA Sequence Number=SeqID_74174
MGCIAGAHEERMGIGVERRCCSAKSWTDVL

SEQ ID NO: 165860 - protein, 129 aa, Glycine max
  Coding DNA Sequence Number=SeqID_74175
MEIFGGEAPSSLAYSLVDGASPLLFSFSFCRNVPSWASEGEAHGCAFQRRKDARIRHQRLFVENVRKTEGNRSTKAGLLLLRTLLWRGNQTYVVLLMRESSDSFTLKGDHFKALDLKNDPFYLIKREMT

SEQ ID NO: 165861 - protein, 78 aa, Glycine max
  Coding DNA Sequence Number=SeqID_74176
MSLHVLYLYAFSGFPPGISRLLYLSLQSFKEMNGQDHLELPSGVGTKHGKQKPIKSQPTDRCPFSALNKQRTSLQDSP

SEQ ID NO: 165862 - protein, 19 aa, Glycine max
  Coding DNA Sequence Number=SeqID_74177
IGDTIIWGFGRVSIDVADQ

SEQ ID NO: 165863 - protein, 53 aa, Glycine max
  Coding DNA Sequence Number=SeqID_74178
MYIVVVLKDERKRGWGHDRPIVALLCAKQAGNVAARQPRILFILQLSFTICLF

SEQ ID NO: 165864 - protein, 117 aa, Glycine max
  Coding DNA Sequence Number=SeqID_74179
MATMMEAMMSIKEIMEVNVTAIASTGTIAEVYLTPQYGLNKINHPTSDMVGLEGKELGGTGGPHLVQKISVPYGLPPNYTPPNVTYTLGEDVNNSAPILVERRQPQTDHAHVSQPMG

SEQ ID NO: 165865 - protein, 342 aa, Glycine max
  Coding DNA Sequence Number=SeqID_74180
  Gene Ontology: Mol. function=phosphotransferase activity, alcohol group as acceptor; Cellular component=cytoplasm; Biological process =carbohydrate metabolic process
  Homolog annotation: Hit_ID=Q1C374; Match level="QueryCoverage=100%, HitCoverage=71%, E-value=1e-169, Identity=90%"; Hit description =Bifunctional protein hldE [Includes: D-beta-D-heptose 7-phosphate kinase (EC 2.7.1.-) ...
  Homolog annotation: Hit description=(D-beta-D-heptose 7 -phosphotransferase); D-beta-D- heptose 1-phosphate adenosyltransferas e (EC 2.7.7.-)]
  Pfam annotation: Domain name=CTP_transf_2; Domain location=244-342; Score=43.0; E_value=1.1e-09; Accession=PF01467.17; Description =Cytidylyltransferase
  Pfam annotation: Domain name=Phos_pyr_kin; Domain location=29-207; Score=-131.1; E_value=0.003; Accession=PF08543.3; Description =Phosphomethylpyrimidine kinase
  Pfam module annotation: Pfam domain module=CTP_transf_2::Phos_pyr _kin; Domain location=244-342::29-207
HPTITKLRVLSRNQQLIRLDFEEGFSNVDPQPMLERIQQALPQIGALVLSDYAKGALSQVQGMIQLARAAKVPVLIDPKGSDFERYRGATLLTPNLSEFEAVVGHCKDEAELVERGMKLVADFELSALLVTRSEHGMTLLQPGVEPLHLPTQAQEVFDVTGAGDTVIGVLAASLAAGNSLEESCFLANAAAGVVVGKLGTSTVSPIELENAVRGRAETGFGVMTEAQLKTAVAQARQRGEKVVMTNGIFDILHAGHVSYLANARKLGDRLIVAVNSDASTKRLKGEKRPVNALENRMIVLGALEAVDWVVPFEEDTPQRLIAAILPDLLVKGGDYKPEEIAG

SEQ ID NO: 165866 - protein, 114 aa, Glycine max
  Coding DNA Sequence Number=SeqID_74181
MDNHLGISAYYLTSWVRINFTGHDSKKWGGRQKQGFCSYSLSGDAESIELAFVTTLASACQSNLGSPNDEVQITERCLRMLPDSWVMIAKGGVVDKSEAFAPTYPPFVMRNSDL

SEQ ID NO: 165867 - protein, 93 aa, Glycine max
  Coding DNA Sequence Number=SeqID_74182
MVMQRVQPSPLGGGEAFVAQEPQPELEVTHEAIPQVSHATLPVVEVSEGGAEYLGSLAYSTLETPQPAQDTPSSPHGQPTSAQDEPIVAQDDC

SEQ ID NO: 165868 - protein, 308 aa, Glycine max
  Coding DNA Sequence Number=SeqID_74183
  Homolog annotation: Hit_ID=Q6WAY6; Match level="QueryCoverage=74%, HitCoverage=37%, E-value=8e-25, Identity=33%"; Hit description =Putative uncharacterized protein
ELDRGKQVENGVVGVPRKCLEAKARVLASQGEWAPFMDILALLIFRVVLFPNVDGLVDRAAIDAFLTFYDRKESPDVAILADLYDTFDRRCEKNNARIVCCTPTLYVWLVSHFFRQEMRHVCPLEGHRSCIEKKEANWDRLLASKEEASVNWFPRWKEGRTGILISCGKFPNVPLMGTRGCINYNCVLAIRQLGYPMRGAPSEEGLIPFIIRGFNSTNAGVFQRVHKAWEMLQRKDKELRGSSNGPIGGYCRWLKAYEQDLDWLPSLRTTKGMEIETPKEDEEVQALKTELEKTQAVKEKFKSTAVRF

SEQ ID NO: 165869 - protein, 182 aa, Glycine max
  Coding DNA Sequence Number=SeqID_74184
  Gene Ontology: Mol. function=helicase activity; Biological process =viral genome replication
  Homolog annotation: Hit_ID=Q2A9I1; Match level="QueryCoverage=96%, HitCoverage=12%, E-value=3e-31, Identity=37%"; Hit description =Putative uncharacterized protein
MMLGSCKGPTSFEDIKTVANIQYPTYREACFAMGFLQDDREYVEAIREAKNWGTSNYLRKLFVLILLIGAMSKPEEIWNQCWHWLADDIGYQYTKSTINSEIQINDDTLRNLAFIEIEQLLHINQRSLKNYPTMPYPQDINLTSYLQNNLVLSELDYNHDETRSEFEHLFASMTDNILIHTL

SEQ ID NO: 165870 - protein, 128 aa, Glycine max
  Coding DNA Sequence Number=SeqID_74185
  Subcellular localization annotation: CTP_CleavageSite=31; ConfidenceScore=5.67e-01
MARLLRQKLQKNPFSFSASKNPSSSNSYPLSPAKPSYFQILVIPFIINLTVSLNFATVLRESKLLLTDSTNHQTLRKNHPFSDFLQCRKDKQFRLLGSGNALQSGMMEKRWFQNHMVTPNRQKPGNQR

SEQ ID NO: 165871 - protein, 109 aa, Glycine max
  Coding DNA Sequence Number=SeqID_74186
  Homolog annotation: Hit_ID=Q2HW90; Match level="QueryCoverage=83%, HitCoverage=18%, E-value=1e-09, Identity=39%"; Hit description =Putative uncharacterized protein
MGSSQKPSLKKRFYQVKIKSLEVTSLREVGQLMGQLQRQAFRKAYGKIWDLARVEVSMEPIASLSQYYDQPLRCFTFEDFQLVPTEVSYPNFVRGPLLDDMRPFFGPCE

SEQ ID NO: 165872 - protein, 59 aa, Glycine max
  Coding DNA Sequence Number=SeqID_74187
MASYGGELLLDSSSPSSGISSLSSFSIPLPFIFQEAKESIDEEDHTPTSSNGAYIMELT

SEQ ID NO: 165873 - protein, 138 aa, Glycine max
  Coding DNA Sequence Number=SeqID_74188
  Homolog annotation: Hit_ID=Q2H7J5; Match level="QueryCoverage=86%, HitCoverage=52%, E-value=4e-08, Identity=27%"; Hit description =Putative uncharacterized protein
MSTFNMRTLFLLLFIVFNIEYLENRCCHIYANIGFTKPMLTLIHSASALSTSVLEPMFHIDKNVKAKCKSLIGQKNASDYVMDNWGNLADCPSEQEFLEHLQRLQVVCSLWPMFVDYVCETWIVPHKEKFITAWTNKG

SEQ ID NO: 165874 - protein, 110 aa, Glycine max
  Coding DNA Sequence Number=SeqID_74189
MAIYRKRHLGQGQLAQASQLLMAKGISSPRRAGCLALKAFHGSGEPNASLGVKHHNSTSNDQNITAFIKKFCLNDTSKVGMPSFHKVHKSSMSGYKYTSILCLGFDGPGI

SEQ ID NO: 165875 - protein, 291 aa, Glycine max
  Coding DNA Sequence Number=SeqID_74190
  Homolog annotation: Hit_ID=Q6WAY6; Match level="QueryCoverage=43%, HitCoverage=21%, E-value=9e-10, Identity=33%"; Hit description =Putative uncharacterized protein
STLEDPLSGFYPSMARIANVVKILAQELDRVKQNRNGVVKIPRKHLEEKAKALADQGEWVLFIDVLALLVFGVILFPNVDRLVDLAAIDAFLAYHHSKESPVVAVLADAYDTFDLRCEKSGARIVCCTPALYVWLGHLSVGSPDGRKEEPESCPCARGSPSEESTTPFITRGFSDPNARIFQRVRKAWSAVQRKDKEFRGSSNGIVGGYHKWLKARTQELDWLPKLKVSSEEEAETPDESEEVQALKVELERAQAVKEKFKTTAMMVRKECDELGDINVATAEALEWEIKR

SEQ ID NO: 165876 - protein, 105 aa, Glycine max
  Coding DNA Sequence Number=SeqID_74191
MHKALRANAPLPYPQLSKDQNGQWLKKDALPPQDKRTPSPPPQRDDSALMTEVLFELRGLRTYVGERFDSLDNCFAGMDICLTQLEEDVGYIRQTFDLPPPPPPS

SEQ ID NO: 165877 - protein, 155 aa, Glycine max
  Coding DNA Sequence Number=SeqID_74192
MAGTDRQAFGVADGFGQVGLGAARGLGHVLDLGQQRGQGGRQGAAGAMGVGGLDAVAGQLDHAVAVVQQVDGVVAGQVAALDHDPALARMRQLVAQAFGHPSHFLDRFHRTFFQQHAGLGQVGGEQRGLRQQRFAHGADGVAFQQQVAALGHHDR

SEQ ID NO: 165878 - protein, 122 aa, Glycine max
  Coding DNA Sequence Number=SeqID_74193
MAPRKLSAKRSRKDVTTEGTSAAPEFDSHRFRSAEHQQRFEAIKGWSFHRERHVQLRDDEYTDFQEEIAHRRWTSLVTPMAKFDPDIVLEFYANAWPTEEGVRDMRSWVRGQWIPFDADALC

SEQ ID NO: 165879 - protein, 18 aa, Glycine max
  Coding DNA Sequence Number=SeqID_74194
MLPVAKCPFAGERGRGSR

SEQ ID NO: 165880 - protein, 59 aa, Glycine max
  Coding DNA Sequence Number=SeqID_74195
THLLLEVASPLSPPVSIPLPFIFQEAKESIDEEDPRPTSSNGAYISIPINRWSPDDIRV

SEQ ID NO: 165881 - protein, 112 aa, Glycine max
  Coding DNA Sequence Number=SeqID_74196
  Subcellular localization annotation: CTP_CleavageSite=24; ConfidenceScore=5.34e-01
MNRKAWFEGRWLPPSSPRRAQLAQASRVASSRSNRLLEESSGGPKWAWVLFAPPFLPSSPPSAVFFGDPFFRKVTETYEFRNDTCFLSVMLRNLANYIIIPFLTYGMLRNLT

SEQ ID NO: 165882 - protein, 157 aa, Glycine max
  Coding DNA Sequence Number=SeqID_74197
MDEDQWAYDSSMYEEFDMDFEDEEQCGVNERHVDCSDAFNTSQVMMFISFSRLVECMFCIKNNVRVALSDTDTGHRGRSSFVLIGCEGAVSTSVGIKNVLEETLLRGKPVCGGEGWMVKLICGMHNHELAKSLVGHPYVGRLTKDKKNILDDMTKSM

SEQ ID NO: 165883 - protein, 249 aa, Glycine max
  Coding DNA Sequence Number=SeqID_74198
MAWMGNMESKAAVEGEEERRSVEARAALGCLGCPIPEDKAEEDRRSVDEAEELATALKKETVVAVTAAAMVAGLKKETVVAATVTAVVAASMQETGSAGEISRSESIAARLAMAASSRSRLASRGSTSAIEEQQRRGQGVERGKGNTFDPFHLAMHIITSNQQISTIGLKLIPNLTMHANKATPNTSTNKRSKPKAETEATMENELNGNRRIPDATTTICPHDPHDNNGDFNGDRAMVQATMATLTEAE

SEQ ID NO: 165884 - protein, 114 aa, Glycine max
  Coding DNA Sequence Number=SeqID_74199
  Homolog annotation: Hit_ID=A5BEV8; Match level="QueryCoverage=53%, HitCoverage=7%, E-value=1e-07, Identity=42%"; Hit description =Putative uncharacterized protein
MFPPPSKVKTKGAPKKSMKRNERSTKHDPSYWEYVDAFHSVQSSNTSGFIEDVVDIKANGNCGYRSIAALLGMGEESWPMVYNELIKELGKWSHDYINLFGGTERFEQLRMSLC

SEQ ID NO: 165885 - protein, 147 aa, Glycine max
  Coding DNA Sequence Number=SeqID_74200
MPGLLRLARIYSSYSLKSITGPNQDYIFNTIILMLLILIAVIRVCNVCHRDGNQYKLKHKPKIKNQIAKVLTEEPSSKKVLPYESTEERSSIRDIRSYGRTFFRGFIGRTFFRANDFHTSTNTKEGSSVFQERSVFYLSHGFSDKKP

SEQ ID NO: 165886 - protein, 505 aa, Glycine max
  Coding DNA Sequence Number=SeqID_74201
  Gene Ontology: Mol. function=ATPase activity, coupled to transmembrane movement of substances; Cellular component=integral to membrane; Biological process=transport
  Homolog annotation: Hit_ID=A7PMJ5; Match level="QueryCoverage=96%, HitCoverage=94%, E-value=0.0, Identity=74%"; Hit description =Chromosome chr14 scaffold_21, whole genome shotgun sequence
  Pfam annotation: Domain name=ABC_membrane; Domain location=36-314; Score=119.3; E_value=1.1e-32; Accession=PF00664.14; Description=ABC transporter transmembrane region
  Pfam annotation: Domain name=ABC_tran; Domain location=389-504; Score= 1.9; E_value=5.2e-07; Accession=PF00005.18; Description=ABC transporter
  Pfam module annotation: Pfam domain module=ABC_membrane::ABC_tran; Domain location=36-314::389-504
MSGDHNSSVSMVGKKKKNGSLRSIFMHADGLDWFLMIFGLFGAIGDGIGTPLVLFITSKIMNNIGGFSSNIGSTFIHSINENAVVLLYLAGGSFIACFLEGYCWTRTGERQAARMRVRYLKAVLRQEVAYFDLHVTSTSEVITSVSNDSLVIQDCLSEKVPNFLMNASMFVGSYIVAFALLWRLAIVGFPFVALLVIPGFMYGRTLMGLASKIREEYNKAGTIAEQAISSIRTVYSFVGESKTIDAFSEALQGSVELGLRQGLAKGLAIGSNGVVFAIWAFMSYYGSRLVMYHGAKGGTVFAVGAAIALGGLALGAGLSNVKYFSEASTAGERIMEVIKRVPKIDSDSMAEEILENVSGEVEFNHVDFVYPSRPDSVILNDFCLKIPAGKTVALVGGSGSGKSTVISLLQRFYDPIEGEIFLDGVAIHKLQLKWLRSQMGLVSQEPALFATSIKENILFGREDATQEEVVEAAKASNAHNFISQLPQGYDTQCVSRHASFTLGGC

SEQ ID NO: 165887 - protein, 1371 aa, Glycine max
  Coding DNA Sequence Number=SeqID_74202
  Gene Ontology: Mol. function=protein binding; Cellular component =nucleus; Biological process=regulation of transcription, DNA -dependent
  Homolog annotation: Hit_ID=A7PMK0; Match level="QueryCoverage=99%, HitCoverage=96%, E-value=0.0, Identity=60%"; Hit description =Chromosome chr14 scaffold_21, whole genome shotgun sequence
  Pfam annotation: Domain name=HDAC_interact; Domain location=485-585; Score=211.3; E_value=2.3e-60; Accession=PF08295.3; Description =Histone deacetylase (HDAC) interactin
  Pfam annotation: Domain name=PAH; Domain location=171-217; Score =68.6; E_value=2.1e-17; Accession=PF02671.12; Description=Paired amphipathic helix repeat
  Pfam annotation: Domain name=PAH; Domain location=373-419; Score =51.8; E_value=2.3e-12; Accession=PF02671.12; Description=Paired amphipathic helix repeat
  Pfam annotation: Domain name=PAH; Domain location=82-128; Score=69.2; E_value=1.4e-17; Accession=PF02671.12; Description=Paired amphipathic helix repeat
  Pfam module annotation: Pfam domain module=HDAC_interact::PAH::PAH::PA H; Domain location=485-585::171-217::373-419::82-128
MKRARDDMYPASQFKRPFASSRADSYGQNQVPGSGGGGGGGGGGGSGNGGGVGGGANASQKLTTNDALSYLKEVKDMFQDQREKYDMFLEVMKDFKAQRTDTAGVIKRVKELFKGHNNLIFGFNTFLPKGYEITLDEDEAPPKKTVEFEEAISFVNKIKVFLLQKRFLSDEHVYKSFLDILNMYRKEHKDIGEVYSEVATLFKDHRDLLEEFTRFLPDTSAAPSTQHAPYIRNSLQRFNERGSMAPMIRQMPADKAQRYRRDRLPSHDRDMSAERPELDDDKTMMNIHKEQRKRESRERRMRDQDEREHDLDNNRDLNLQRFPDKKKSVKKAEGFGMASDFASYEDKDTLNSPGMYSQAFSFCEKVKGKLSSSDDYQTFLKCLHIFSNGIIKRNDLQNLVTDLLGKHSDLMDEFNDFLERCENIDGFLAGVMSKKSLSTDAHLSRSSKLEEKDKEHKRDLDGAKEKERYREKYMGKSIQELDLSDCKRCTPSYRLLPADYPIPTASQRSELGAQVLNDHWVSVTSGSEDYSFKHMRRNQYEESLFRCEDDRYELDMLLESVSSAAKKAEELYNSINENKISVETLNRIEDHFTVLNLRCIERLYGDHGLDVIDILRKNPTHALPVILTRLKQKQEEWSKCRSDFNKVWAEIYAKNHYKSLDHRSFYFKQQDSKNLSTKSLVTEIKEIKEKQQKEDDIIQSIAAGNKQPLIPHLEFEYSDVGIHEDLYKLVRYSCEELFSSKELLNKIMRLWSTFLEPMLGVPSQSHGTERAEDRKTGHNVRNFGAPNVGGDGSPREDTLSINSRVPKSDKNEADGRVTEVKNVHWTTVAASNDKENGSVGGEIVSRDDPLMDKGQKNVECNDKASGFSKQFASGEEGAKNNVSIAIRGENSLNRTNLDASSGCALTPSQPTDVDDSVSKSQGVNVPSVEGCDMATPVPVVNGVLSESSKVKTHDESAGPCKIEKEEGELSPIGDSEEDNYVAYGDSNVQSMAKSKHNVEKRKYQSRNGEDESCPEAGGDNDADADDEDSENVSEAGEDVSGSESAGDECFREDHEEEEDIEHDDVDGKAESEGEAEGICDAQVGGDGTSLPLSERFLSSVKPLTKHVSAVSFVEEMKDSRVFYGNDDFYVLFRLHQALYERILSAKTHSMSAEMKWKAKDASSPDPYSRFMNALYNLLDGSAENAKFEDECRAIIGNQSYVLFTLDKLIYKLVRQLQTVATDEVDNKLLQLYEYEKSRKSGKLNDSVYHANAHVILHEDNIYRLQCSSTPSRLFIQLMDNMNEKPELFAVSIDPNFSFYLHSDFLSVFPNKKEPHGIILHRNKRQYGNLDELSAICSAMEGVKVVNGLECKIACSSSKCGCAAIVKSMVWI

SEQ ID NO: 165888 - protein, 125 aa, Glycine max
  Coding DNA Sequence Number=SeqID_74203
MKSSTIKKFGRSVICSLYPVTMEEKRRRWRGCLETQSEHGGDGLLHGVSGGGGHAFGDGGVVEGLDAAEHGGDHGEAAVEVAGGDGVVGEAGGKEAAAATREGEENGGRWRSWKRGRLGWEELKE

SEQ ID NO: 165889 - protein, 59 aa, Glycine max
  Coding DNA Sequence Number=SeqID_74204
MSAMPIIINFVPHCPEALRYAKAVSGFEPMTNKSPRHNFTAAPGLALKYREDRILQQNI

SEQ ID NO: 165890 - protein, 315 aa, Glycine max
  Coding DNA Sequence Number=SeqID_74205
  Gene Ontology: Mol. function=tRNA-pseudouridine synthase activity; Cellular component=nucleus; Biological process=pseudouridine synthesis
  Homolog annotation: Hit_ID=A5AJY9; Match level="QueryCoverage=90%, HitCoverage=49%, E-value=8e-87, Identity=59%"; Hit description =Putative uncharacterized protein
  Pfam annotation: Domain name=PseudoU_synth_1; Domain location=58-163; Score=33.3; E_value=9.1e-07; Accession=PF01416.11; Description=tRNA pseudouridine synthase
MENSDTKLTTSSLPPPPPVSAEEPEPKKLKMSTTTSDDEECAAGTGTKKRYKRRKVAIFFAYCGVGYQGMQKNPGAKTIEGDLEEVLYVSGAVPEQDRGVPKRYDWARSARTDKGVSAVGQVVSGRFYIDPPGLVDRLNSNLPSQIRIFGYKRVTASFNAKKFCDRRRYVYLIPVFALDPSCHRDRETVMASLGSGNELVKCLECSERGRKVIGLVGNRKKNLELEAVDVEAGISSNRDSGVTEDVEVSLSKGDDNHLNEEYGNDNKGGMNSKTGLETMVPVQEEGTPFNGESVNNSDILEDEKVNGEDKLTNGS

SEQ ID NO: 165891 - protein, 97 aa, Glycine max
  Coding DNA Sequence Number=SeqID_74206
  Homolog annotation: Hit_ID=Q8LFL4; Match level="QueryCoverage=96%, HitCoverage=97%, E-value=8e-08, Identity=39%"; Hit description =Putative uncharacterized protein
  Subcellular localization annotation: CTP_CleavageSite=54; ConfidenceScore=5.02e-01
MGVGGVISCKKLLLGALVSLGVIWFMFLAISVNRQTKRTVLVPMNVISKHLKLVSMQRHALHSNSGLFIVSKRRVPNGPDPIHNRRVVKTRRPPTQA

SEQ ID NO: 165892 - protein, 447 aa, Glycine max
  Coding DNA Sequence Number=SeqID_74207
  Homolog annotation: Hit_ID=A7PMI9; Match level="QueryCoverage=97%, HitCoverage=80%, E-value=5e-31, Identity=40%"; Hit description =Chromosome chr14 scaffold_21, whole genome shotgun sequence
MKLSNRYTAEAEKASLEQQRKIDELEAQLNEAEDIVTDLRAELKLVYLELETARNNQVQPLNGQNEKQVVTFQESAKPEISISSPHKELECVTSCDVANKSLTMNVLDNKCCNSKQQTEQLCIYNLEDSCGHNSDFASIITRSKEPELRRNGFTQRVRALEGNLLDEKLLKQDVHNQHYGKKLGIIAKDSNGQVAKYSALTEKMEIKKHVKHHKIPKRKIYSYYWSRFLSSCKIHLNDNCKSSKGVCFLPSIKLGAISKWKSKRRRHRHLGMKSFAFRSCKPSFFLKQCSSVCNNEKCCEDESGAKMKSLPPLTDVEPVHRTIGVTESIQAVNKFELVEKAIEKDSELLNLEENAAQNLTGPSSDMKVEGFDFPSTDTDLEDAKAFEKNDRSASQVNDSRPLKYTFQRKRKKESLGNADQNIDSEKRTVERRVEDKQNCAIELQNLA

SEQ ID NO: 165893 - protein, 62 aa, Glycine max
  Coding DNA Sequence Number=SeqID_74208
EKPRRRLGVHGRTCLTMGRPVRVTLLCENAPTMWDRHRLKGALKPDDPQGLHSKESVRVSPF

SEQ ID NO: 165894 - protein, 114 aa, Glycine max
  Coding DNA Sequence Number=SeqID_74209
  Homolog annotation: Hit_ID=A6NQ44; Match level="QueryCoverage=77%, HitCoverage=91%, E-value=6e-45, Identity=100%"; Hit description =Putative uncharacterized protein
  Subcellular localization annotation: CTP_CleavageSite=80; ConfidenceScore=5.08e-01
MDERNRQIAEIGASLIKHCVRPRRKDQRIFLRSFFSARNLLLANKKTTATSGGLFAGSRATNSFSEGNWLQQSADTKYCSSSVAVVRPPLQELCSTAYIPRSANPVTSGCCQWR

SEQ ID NO: 165895 - protein, 218 aa, Glycine max
  Coding DNA Sequence Number=SeqID_74210
PTVEEFEEILGCPLGGRKPYLFSGFYPSMARIAKVVKISAQELDWVKQNRNGVVGVPRSCPLSERGMDLAAIDTFLAFHHSKESPIIAILADMYDTSSLVHRKGKANWDLLLASMEGASANWFPRWKEGRTEIIISCEGFPNVPLMGTRVTPTRGCFEESARHGIIGGYRKWLRVRTQGLDWLPKLRVAREEEAEAPEESEEVQALKAGLEKAQVVKE

SEQ ID NO: 165896 - protein, 163 aa, Glycine max
  Coding DNA Sequence Number=SeqID_74211
MAGTNFEVLCGTVTASLSSEEIKKDQSRVDGLILKDELRVCLRSQRSLSQQLCKTKTNMLAFLGKYQEELNLATAHEHKVADEYARVYAKKEARGRVINSLHQEATMWMDRFALTLNGSQELPQLLAKAKAMADTYSAPEEIHRLLRYCQHMIDLMTHIIRSR

SEQ ID NO: 165897 - protein, 72 aa, Glycine max
  Coding DNA Sequence Number=SeqID_74212
AGAIVNENLGHDVIHAFERYMQSPIMSSSLNGNLLLSKGECRNLPFDGRATRDSRNACSTKGIRAELPPTFI

SEQ ID NO: 165898 - protein, 157 aa, Glycine max
  Coding DNA Sequence Number=SeqID_74213
DDVSLCMSTGSLAFWLTKGADNHSEIVFVRITGTPPATLHGLGLIVCTDNHLGADDDVSLCMLPDSKSDEKKMSVCGLSYRASPRTNGLTGHVAKGGVVDKSEAFAPTYPQFVMRNSDLRQGWTFSPSVKVYGELGFWLKACRMAGHDLCQDVGLAS

SEQ ID NO: 165899 - protein, 26 aa, Glycine max
  Coding DNA Sequence Number=SeqID_74214
MELTSSDPSCWTKLDQNCIKTYIPTT

SEQ ID NO: 165900 - protein, 72 aa, Glycine max
  Coding DNA Sequence Number=SeqID_74215
MPIGWTTQNCGADTEEEEPTNLRSNPLQRGGDDAILPRKGPITRAMSKGIQEDWARVAEEGPRVLMNLRVDF

SEQ ID NO: 165901 - protein, 114 aa, Glycine max
  Coding DNA Sequence Number=SeqID_74216
MNTLSTPTVLSLFIAAVKFLDFQMIALSGPCRAKRAKHVLCAKPKGHSAKAEFTSPEAWERYTDIVVPRKLLPERNVVIYHSEFDEFKEELERRKWDKELTSFDEGSIDVAIVK

SEQ ID NO: 165902 - protein, 198 aa, Glycine max
  Coding DNA Sequence Number=SeqID_74217
  Gene Ontology: Cellular component=chloroplast
  Homolog annotation: Hit_ID=Q49KT9; Match level="QueryCoverage=30%, HitCoverage=53%, E-value=1e-13, Identity=70%"; Hit description =Putative uncharacterized protein ORF113
MSPHGGDMDGGEKRKERDGVSLAFGIAGPGGRPARRAISSVVERAPDNCVVVPGLRIDGAIQVRSNVDPTFSSLVGSGRSGGDHHGSSLLENSYIPYQYMDSYLSSTGLGLASMEKNGAPNNVSSQTRTTRSPLSFWGDGLKKDLRVSRVVPGGSLNAFLFLLIGVISQRLAMVKKKGEQAHLESAVQRIVVCCVREG

SEQ ID NO: 165903 - protein, 141 aa, Glycine max
  Coding DNA Sequence Number=SeqID_74218
  Pfam annotation: Domain name=Transposase_23; Domain location=30-95; Score=-17.3; E_value=0.092; Accession=PF03017.5; Description =TNP1ENSPM transposase
HPGRVRATGVEKVTQQLRSCVDSSATDPDTGDSDKCKLYIEENPPCLVALGRVYEGSTVVHNIPLLHDQVKVGVEEVKDADAPISIPTDKGIVGPAKPADRLDPKPQSIQKFGQSQFESESYIKNWMQSSKRDVYLGVYLN

SEQ ID NO: 165904 - protein, 110 aa, Glycine max
  Coding DNA Sequence Number=SeqID_74219
MESLRLNQHEETDKKKKGIALKASSAIQEDSDKEDSFDLDNDEDISLFVKRFNKFLRKKMEKSEKKNINEKKLKKAYITWDENDMESSEDSENEEINLCLMAKSYESDEE

SEQ ID NO: 165905 - protein, 36 aa, Glycine max
  Coding DNA Sequence Number=SeqID_74220
MEDRVTTDQSSPLSGAGPAENVAARQPSSSRQDANP

SEQ ID NO: 165906 - protein, 192 aa, Glycine max
  Coding DNA Sequence Number=SeqID_74221
ISLIAQSNSSRLGFPTLITALCKARGVTSNSLTFESLSPAINLAYIKKNCWNLDEPSITFPGTQKSRARRSEASSSSAAHAPPTLAPSTSALPSVPAAPVLPGPSVQSLEPFMSMLQSLHQGELLIMQSLQDVVQQRPVMSLKEFVQKVAWPGVQPSPLGGGESSAAQKPQPDKEDDIIEASQPTPPESFIF

SEQ ID NO: 165907 - protein, 104 aa, Glycine max
  Coding DNA Sequence Number=SeqID_74222
MIHLGSTRVVAEVAPMTFLKDQLPKFRHIVSQPTLLRASETRLTGAFSKGGKCTESPPTFICGKRRKNRRKPVKKNIPSSGVVFTFEEDISTSHVCLKGQQPYF

SEQ ID NO: 165908 - protein, 50 aa, Glycine max
  Coding DNA Sequence Number=SeqID_74223
MGRLAGFTKNNIGLSDIGVPLSGNYYGLANRNAQLSKCCKDFCLAQEILA

SEQ ID NO: 165909 - protein, 35 aa, Glycine max
  Coding DNA Sequence Number=SeqID_74224
MADQLATKSKAKGSKIPWICMYIAKIPHKNIHMFR

SEQ ID NO: 165910 - protein, 107 aa, Glycine max
  Coding DNA Sequence Number=SeqID_74225
MHHRPRARRHLIKAGPAGLFDTKQYLRHLVRQQAANHRAHSQGFTSFPCHTPDQFRAEVAWPGDWPEAQAGEAPAGAPAEAPDEADEARKDEEMIDLLDFLGGSGAT

SEQ ID NO: 165911 - protein, 84 aa, Glycine max
  Coding DNA Sequence Number=SeqID_74226
  Gene Ontology: Mol. function=histone-lysine N-methyltransferase activity; Cellular component=nucleus; Biological process=chromatin modification
  Homolog annotation: Hit_ID=Q949T8; Match level="QueryCoverage=95%, HitCoverage=16%, E-value=1e-20, Identity=53%"; Hit description =Histone-lysine N-methyltransferase ASHR3
MNRCKVAFHSKYAAWSDSVLQLKDHPGHTVCWRHPYDWHLDRKICYPTFFQEVFCQLPLPFISEEFKIDFTWKDMDAKMEQPLP

SEQ ID NO: 165912 - protein, 125 aa, Glycine max
  Coding DNA Sequence Number=SeqID_74227
  Homolog annotation: Hit_ID=Q84VH5; Match level="QueryCoverage=61%, HitCoverage=11%, E-value=6e-34, Identity=96%"; Hit description =Envelope-like protein
MKRESPLSLHYKLFEGTHVPDIVSTSGKAAASGVVSKDALIAELKDTCKVLEATIKATTEKKMELERLIERLTDSGIDDGEAAEEEEDPAEEEEAVEQEEEAAEEKEDAAEETESDDDADSEATP

SEQ ID NO: 165913 - protein, 217 aa, Glycine max
  Coding DNA Sequence Number=SeqID_74228
MASSGEVIATTIAIETTLDRGIRGTHVVGSCKLNGGGGKVVEVVGGNCGKGKGRDGIGGIDGKGSVLLRWLVTETTQGVYTQGTLQVEVELLIKVAWQSDTIAEPSMQLTPSTDGISNLYTPYWSVVLFTEKLICSLVFGEVALNLHLALFRESAGGAGITINSSYHTDTGDNWTWRLSNEQKWATEERLGSGRATIFYSEHRIEESWGGFGELIDP

SEQ ID NO: 165914 - protein, 188 aa, Glycine max
  Coding DNA Sequence Number=SeqID_74229
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=A2Q2S3; Match level="QueryCoverage=87%, HitCoverage=14%, E-value=4e-78, Identity=80%"; Hit description =Glycosyl transferase, family 48
MWFMVGTWLFAPFLFNPSGFEWQKIVDDWTDWNKWISNRGGIGVPPEKSWESWWEEEQEHLQYSGMRGIIVEILLSLRFFIYQYGLVYGISWLVIFVILFVMKTVSVGRRKFSANFQLVFRLIKGMIFLTFVSILVILIALPHMTVLDIVVCILAFMPTGWGMLQAKVGSYMEVTKTSINGWKLHGSY

SEQ ID NO: 165915 - protein, 975 aa, Glycine max
  Coding DNA Sequence Number=SeqID_74230
  Gene Ontology: Mol. function=lipid binding; Cellular component =cytoplasmic vesicle; Biological process=endocytosis
  Homolog annotation: Hit_ID=A2Q4X4; Match level="QueryCoverage=86%, HitCoverage=86%, E-value=0.0, Identity=63%"; Hit description=Epsin, N-terminal; ENTH/VHS
  Pfam annotation: Domain name=ENTH; Domain location=23-146; Score =257.2; E_value=3.4e-74; Accession=PF01417.11; Description=ENTH domain
MKKVIGQTVRDLKREVNKKVLKVPGIEQKVLDATSNEPWGPHGSLLADIAQATRNPHEYQMIMSVIWKRINDTGKNWRHVYKALTVLEYLVAHGSERVIDEIREHAYQISTLSDFQYIDSSGRDQGNNVRKKSQSLVILVNDKERIIEVRQKAAANRDKFRNNAAGGMYRPGSHSSSGAYGDRYDDDRYGSREEDRNGYGYGREREWGNRDDDQHSRDGDRYGRDYEDRYGRDGYRDDDYRGRSRSVDYQYDTRSRSSDRDRCDDDGQHSSRGSNAKAEDQSLEARLERKLSEQNMGAPPSYEEAVGESRSPVHSERDAETSAPSAPRDSSPHVNDNPSQISAPTGSFPVNNNPTEATTAASGAQETETTDDFFDPRGPSSAAPAAPATTNSVEMDLLGSLSDSFSSNALSLVPAASATAAPDANSGSTASFAAAPSGSNNFDQSFEDPFGDSPFKAFTSTETAPSQPQTYQSIEPSQSNGLNAETNSNYGFGDSFSVVPYSAPVSSDAQPFSANSQFPSQDMSSSQPETDILADILPPAPLPEMHSQQNISAPAFDHPSSPSFPASSGQMASQPFSEPTGQFPQQGFSAATSQPAQTFPVPTDQFSQQHFSAPNGQPGQVQSSFSSPSSQYAQQPFSSHAGQPGLHAFSSPTGQHMQSPFASQGGQPAQSGSMYGGLHSQGGSPTMSPQSQNGYNGHMNSGNFGSMAAFPSHMAPQAPTGQLSQGTNFPHHGGSIAHTAPHLSSHSPTHQPSQFNSQSFTGQQGNATPHSSPITNQSLASQSNSLVSQPSKDKFETKSTVWADTLSRGLVNLNISGPKTNPLADIGVDFEAINRREKRMEKPTTTAVTSTVTMGKAMGSGSGMGRSGAGSLRPPPNPMMGSGMGMGMGMGMGNGPSVGMGMGGYGGMNTSMGMGMGGMGGMGMGQGYHNQMQPPTRLPPGSNIPGNYNNSMMGPGSYGQQPYGSYGQQPYGGYR

SEQ ID NO: 165916 - protein, 272 aa, Glycine max
  Coding DNA Sequence Number=SeqID_74231
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=A5C0X0; Match level="QueryCoverage=70%, HitCoverage=36%, E-value=4e-94, Identity=91%"; Hit description =Putative uncharacterized protein
MEGHREKLKMNPVISDVENSYGGSEYEDANMDVQANYMGIDNERGLELFCLCKREQDDVLGMSSSRGGAGPSSEAPPPRRIMRTQTAGNLGESVIDSEVVPSSLVEIAPILRVANEVEKTHPRVAYLCRFYAFEKAHRLDPNSSGRGVRQFKTALLQRLERENDPTLKGRVKKSDAREMQSFYQHYYKKYIQALQNAADKADRAQLTKAYNTANVLFEVLKAVNMTQSMEVDREILETQDKVAEKTEILVPYNILPLDPDSANQAIMRFPEA

SEQ ID NO: 165917 - protein, 576 aa, Glycine max
  Coding DNA Sequence Number=SeqID_74232
  Gene Ontology: Mol. function=kinase activity; Cellular component =Golgi apparatus
  Homolog annotation: Hit_ID=A7PCE0; Match level="QueryCoverage=94%, HitCoverage=88%, E-value=1e-115, Identity=38%"; Hit description =Chromosome chr2 scaffold_11, whole genome shotgun sequence
  Pfam annotation: Domain name=DUF248; Domain location=56-574; Score =686.2; E_value=2.4e-203; Accession=PF03141.7; Description=Putative methyltransferase
MKNTTACLKIFSTLILLASLFYIIIAPSFYTSPRIHQNLHLQSQHHFDFCPSNYTNHCPCQDPIRQRRFPKAKMFRKERHCPQSTTERLRCLIPIPPGYQTPFPWPKSKDTAWFSNVPFPKLVEYKKSQNWVRLEGDHFVFPGGGTSFPEGVKAYVNALKRLLPVPLESGDVRTVLDVGCGVASFGASLMDYGILTMSLAPSDEHQSQVQFALERGLPAILGVLSIHRLTFPSRSFDMVHCSRCLVPWTDYAWETEPHELKKEQNTLEDLAMQLCWEKVAERDQIAVWQKHIDHISCMQKLKTRRSPKFCNSSESDPDAGCPIERLRTILEKVIKKGLMVNNIYDDLVFKTLEDGNLYIAKVSLFLNPFKNFEFTTVLLRYTKMTACIFPLPDVKDVHEVSGGVLEKWPMRLETVPPRVRNENDDGFTLKTYIEDNQTWKRRVSNYGVLLKSLSSGKYRNVMDMNAGFGGFAAAIVKYPVWVMNVVPFDVKSNNLGIIYERGLIGTYMDWCDITDILLEMHRILRPKGAVIVRDHGDVILKVKEITDRIRWKGIVVAGDQDGPFHPEMIMVINNDD

SEQ ID NO: 165918 - protein, 477 aa, Glycine max
  Coding DNA Sequence Number=SeqID_74233
  Gene Ontology: Mol. function=triacylglycerol lipase activity; Cellular component=chloroplast stroma; Biological process=thylakoid membrane organization and biogenesis
  Homolog annotation: Hit_ID=A2Q4Y5; Match level="QueryCoverage=99%, HitCoverage=95%, E-value=1e-179, Identity=68%"; Hit description =Peptidase S26A, signal peptidase I; Esterase/lipase/thioesterase; Lipase, class 3
  Pfam annotation: Domain name=Lipase_3; Domain location=205-368; Score= 185.3; E_value=1.5e-52; Accession=PF01764.16; Description=Lipase (class 3)
  Subcellular localization annotation: CTP_CleavageSite=36; ConfidenceScore=5.13e-01
MASVTHLPSISRTNNDHITFSQTFHPIKSHPFGQISLPMRKNHDLSPLSHSIVASGSVLGITSSESIHNVSKTTTKPTHTSTLSNFWREVQGCNNWENLLEPLHPLLRQEIIRYGEFVTASYKAFDLNPNSKRYLNCKYGKKSMLSEVGMSNSGYNITKYIYATPDINLPNMTYNNSSSSSARWIGYVAVSSDEAVKRLGRRDILVTFRGTVTNQEWISNLMSSLTPAMLDPYNPRPEVKVESGFLSLYTSDESSASNKFGLESCREQLLSEVSRLMNKYKGEKENLSISLAGHSMGSALAILLSYDIAELGLNKKSGTHEVPVTVFSFGGPRVGNSEFKHRCEELGVKVLRIANVNDPITKLPGVVFNENFRVLLGGRYEFPWSCSCYAHVGVELLLDFFNVQNPSCVHDLDSYIGLLRRPNKDEVLMKRERDEDGVNSLLEKARELLFNSQSMKILAGVLTAYNYHDLLNSVVTS

SEQ ID NO: 165919 - protein, 116 aa, Glycine max
  Coding DNA Sequence Number=SeqID_74234
MEEAKPISSPKVGGCKLTKTGSEDVSDPTLYGFVVRNFTGFHQASFLHSCSVMQIRPLILMTGGPHLTVVARSSTEAEYRSMTLVAIEVKVSHASPVILCDNTSTVALAHNPVLHS

SEQ ID NO: 165920 - protein, 126 aa, Glycine max
  Coding DNA Sequence Number=SeqID_74235
KYPALVSNSFKTSKLLINEHVLEIQEFRERLLDLGVEVSPVLAPGDQGSSQLSWDVVCVMVGTISKIVMDSHSWCYPACIQCHRKTDIETGPFTCECDKDNDQPVLRYRVEVMLVIGGFLFFLAGW

SEQ ID NO: 165921 - protein, 632 aa, Glycine max
  Coding DNA Sequence Number=SeqID_74236
  Homolog annotation: Hit_ID=O22799; Match level="QueryCoverage=93%, HitCoverage=87%, E-value=1e-104, Identity=41%"; Hit description =Uncharacterized protein At2g33490
MDGGMTLQDMQDMRDCYDTLLSAAAATASSAYEFSESLRDMGSCLLQKTALNDHGDETGKLLLMLGKIQFKLHKLIDHYRSHIFQTITIPSESLLNELRIVEEMKRQCDEKRDLYDYMVTRYREGGRSKGGKGETFSLQQLQTAHDEYDEEATLFVFRLKSLKQGQSRSLLTQAARHHAAQKAVKSLETVEPHVKSVTEQQHIDYHFSGLEEEDGDEGDYGDDVGGGYDENDDGELSFDYGQIEQDQDVSTSRNSMEETNSMSIRVVDKDVLQSCAQKLCILVCLNVTICSMHLDQVELTLPRDSTAEAAKENLDNLVRNLFSFKVRAGSQSAPLFADNKPDASEKLRQMRPSLSRKFSSYVLPTPVDAKSSTSSGSNNPKPSKMQANLNEPTKNLWHSSPLEQKKQEKDIGDEFSGSIVRSAQSVLKESNSNTASMRLPPPLIDSLLSSNRDYISAYSKKIKRHAFSGPLTSNPGPTKPVSIESVQLFSGPLLPAPIPQPPSSSPKASPSASPTLMTSPKISELHELPRPPTSFPSNSRLLGLVGHSGPLVSRGQKVTANNLVASSAASPLPMPPQAMARSFSIPSSGARVAALHMPRTLESSHRSSISENIASPPLMPISLSSSRPSLDG

SEQ ID NO: 165922 - protein, 103 aa, Glycine max
  Coding DNA Sequence Number=SeqID_74237
  Subcellular localization annotation: CTP_CleavageSite=83; ConfidenceScore=5.62e-01
MEAQTRTPQTRTRQCGCNHRSAAQFATNTNSGRRRNNNKALGCTSMDKFQRRSPQTRSPQCGCGHGSTGDFDTRRKKKNDMVQAQGERRRTIGFKRKEKEEER

SEQ ID NO: 165923 - protein, 75 aa, Glycine max
  Coding DNA Sequence Number=SeqID_74238
MAAQLIHDRVEMECLEGAWDTLEGNARCRFRGTIRFTATSLVHPEEPTCTLQRTVEWILPTPTPYRLVEPIQVIE

SEQ ID NO: 165924 - protein, 286 aa, Glycine max
  Coding DNA Sequence Number=SeqID_74239
  Homolog annotation: Hit_ID=Q2HW90; Match level="QueryCoverage=94%, HitCoverage=57%, E-value=9e-31, Identity=33%"; Hit description =Putative uncharacterized protein
MGQLQRQAFRKAYGKIWDLARVEVSMEPIASLSQYYDQPLRCFTFEDFQLVPTVKEFEEILGCPMGGRKPYLFSGFYPSTTRVAKYQGSVWRKGQRPWQIKANGLSFIDILALLIFGVVLFPNMEGLVDLAAIDAFLAFHHGKESPIVAILAMYDTFDRGCEKSGARIVCCTPALYVGLVSHLFLQEGRPAYPLQGHRSCVEKGKANWDQLLASMEGRLLIGSPRWKEGKEGVLFSCGRYPNIPLVGTRGCINYNPTLAIRQLGYPMRGAPTEESMSPFLVRDLGA

SEQ ID NO: 165925 - protein, 219 aa, Glycine max
  Coding DNA Sequence Number=SeqID_74240
  Homolog annotation: Hit_ID=Q2HW90; Match level="QueryCoverage=68%, HitCoverage=33%, E-value=8e-14, Identity=35%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPSTTRVAKYQGSVWRKGQRPWQIKANGLSFIDILALLIFGGVLFPNMEGLVDLAAIDAFLAFHHGKESPVVAILAMYDTFDWGCPSIRYKVTARASKRERESRTSPIASQGQSSALYLLRPRGDPRTSQLLSAYDRLNGPYD

SEQ ID NO: 165926 - protein, 226 aa, Glycine max
  Coding DNA Sequence Number=SeqID_74241
MTTLTQIWMTLLLSNILPNDHNFDLPVPKCQMVYTILTRMTVHVAQIIADAIYLFAGTVPTRHPLDPERSNRALGFSALITGLCQFYGVLVIPSKVIRTSITQAFIEKYCTPRQVKGDAQQAADAPPPQQPDPVIPLSVERYLWHLVRQQTANHHGQGQGSPPFVCPTPEQFRAEVTWPGDWPTEEGTGPAASPGEAEEAHMDEDMTDLLGYLGGGGATRPRSPHL

SEQ ID NO: 165927 - protein, 62 aa, Glycine max
  Coding DNA Sequence Number=SeqID_74242
RKYSWREKKESHEDSKNEGFNPFSVSMTFRNSIGAVGGKAGEINRDAIIAVRRHVIPLRGME

SEQ ID NO: 165928 - protein, 88 aa, Glycine max
  Coding DNA Sequence Number=SeqID_74243
MPSMHAPSAQSARPASHWRAFEDKKSLKVEVGKRRKEFFEERNRGIRERRNRGKTRQQSTKDLSFQEDSRFRSDYYVLRGGGDMPTTV

SEQ ID NO: 165929 - protein, 116 aa, Glycine max
  Coding DNA Sequence Number=SeqID_74244
MGRSMIDATGGGALMEKTLIVAGQLISHICHWSTIECDGSQSTKAVWYICALDHPTDCGSNVFQDYFDDAKESRVKQVSRIKIKIQDSRIIKIKIQDSRIIKIKIQVKRRLNQDKY

SEQ ID NO: 165930 - protein, 164 aa, Glycine max
  Coding DNA Sequence Number=SeqID_74245
MDNEEGVQEQMKADMMALKDQMASITEAMLKIKKSIEDNATATASNTTREAEPVLQPARNLVRDRSATGFNRRYSPQAYPYGLPPDFSPRTAPDDLSQAPTFEGQLPPHADYPLQEDDEGDAHLGPLLPLKEPAPHELPQPNIIRHAPSQSTPVMELVPISKDN

SEQ ID NO: 165931 - protein, 79 aa, Glycine max
  Coding DNA Sequence Number=SeqID_74246
  Gene Ontology: Cellular component=mitochondrion
  Homolog annotation: Hit_ID=Q5M9Z0; Match level="QueryCoverage=81%, HitCoverage=54%, E-value=2e-13, Identity=57%"; Hit description =Putative uncharacterized protein orf116
ERAESMCSNFWPCIDHLMDHGLNGHCLKGLCPVDRRPPQAKVAGGQEGPLGDLGSQQEMRREYSNPGNLGLLRWVEKPG

SEQ ID NO: 165932 - protein, 116 aa, Glycine max
  Coding DNA Sequence Number=SeqID_74247
MASRKRKALASVSQARCDRSIFVSQYAWDCYANNVLCWKILLERNVKLYITKFDEFRREIERRNWYKELTNFFGGSIDVALVKEFYANLYDLEDKSPKQWSSRKGRACPLTPGSAG

SEQ ID NO: 165933 - protein, 129 aa, Glycine max
  Coding DNA Sequence Number=SeqID_74248
MHKALRANAPLPYLHLVTLFLHHFNVPLDDEPFVKVKRSFSIGVGAVTSFGYRKDVDGQWVRKQDLPSPIPDKCTPSPPPQWGDSTSLLTEVLTELRGLRAFVGECFNVMDTPLDAMDTRFDEMDTRIT

SEQ ID NO: 165934 - protein, 166 aa, Glycine max
  Coding DNA Sequence Number=SeqID_74249
EWHPQDTQWTRRSPTRPWGFQLWLRASVRCLFPPARDRAHMTPSGPGEVQQGPRVFSSGYGPLSVLQGARPPGKGSRPQDTQWTQRSPTGSWSCQSLITGLCQFYGVPVTSSKGIRPPTNRAFIKKYCVPRQAQGETPQQPRDGRQRAIDAPPSPLEFTSAHPQKG

SEQ ID NO: 165935 - protein, 74 aa, Glycine max
  Coding DNA Sequence Number=SeqID_74250
MTKVMTKSSKINQRTTQENPRPIKNNSRVQDKNQEEFKTQEESLETRIKIQGSRSQESRSRFKTQDSRMKRRLN

SEQ ID NO: 165936 - protein, 128 aa, Glycine max
  Coding DNA Sequence Number=SeqID_74251
LIRTIARSPPSTTCDGVVPGDMSRELGDLGDVRRAPGSQPIKEQRPQSKEACVVAGQLWILSDIWNMASGSLGDPRRQCEMLIPWHDPTYGYFIGTSRRTSTHASAHRGVDITYTYSISTSGASPSDR

SEQ ID NO: 165937 - protein, 54 aa, Glycine max
  Coding DNA Sequence Number=SeqID_74252
MAEINQGTDVSGARVTTDRSLPLPGAKQVENVAARQPSILCVRSFFYYCLSFLK

SEQ ID NO: 165938 - protein, 277 aa, Glycine max
  Coding DNA Sequence Number=SeqID_74253
  Gene Ontology: Mol. function=4 iron, 4 sulfur cluster binding; Cellular component=integral to membrane; Biological process=protein -chromophore linkage
  Homolog annotation: Hit_ID=Q85FM0; Match level="QueryCoverage=92%, HitCoverage=43%, E-value=1e-116, Identity=67%"; Hit description =Photosystem I P700 chlorophyll a apoprotein A2
  Pfam annotation: Domain name=PsaA_PsaB; Domain location=1-276; Score =25.9; E_value=8.3e-07; Accession=PF00223.10; Description=Photosystem I psaApsaB protein
AFAHGAIFFIRDYNPEQNEDNVLARMLDHKEAIISHLSWASLFLGFHTLGLYVHNDVMLAFGTPEKQILIEPIFAQWIQSAHGKTSYGFDILLSSTNSPAFNAGRSIWLPGWLNAVNENSNSLFLTIGPGDFLVHHAIALGLHTTTLILVKGNVSQFNESSTYLMGWLRDYLWLNSSQLINGYNPFGMNSLSVWAWMFLFGHLVWATGFMFLISWRGYWQELIETLAWAHERTPLANLIRWRDKPVALSIVQARLEMNHYGKEKCDSEGEEETKIGT

SEQ ID NO: 165939 - protein, 230 aa, Glycine max
  Coding DNA Sequence Number=SeqID_74254
RVMGEVEEVQEKMKADMEAMKEQMATMMEAMMSMKKIMEANAVIVAATSAVAKVNPMLPSGLKQMNHPTSNMVGKDLGSTDDPMMCKFKTSTPSRHMACLPNYTPPNVAYIPNEDVNNSTPILIKSQQPQSDHAHVSRPMEETHGMPHHNLADFEPCLGYATEGQAVGGIPLQNTLEGPQAIEGGKDYAFANLEELFLVPNIITPPKFKVLDSDKYKETTCPKNHLKMYC

SEQ ID NO: 165940 - protein, 81 aa, Glycine max
  Coding DNA Sequence Number=SeqID_74255
MEDLLKPSKGIEEPNLVVLLIMLMLMVTIVRRQQIRILPSSLPVTFFRKNIPTKAAISEIELHLYLTMASPFIKWESKECE

SEQ ID NO: 165941 - protein, 319 aa, Glycine max
  Coding DNA Sequence Number=SeqID_74256
  Gene Ontology: Mol. function=magnesium ion binding; Cellular component=membrane; Biological process=metabolic process
  Homolog annotation: Hit_ID=Q8RXU2; Match level="QueryCoverage=52%, HitCoverage=30%, E-value=3e-12, Identity=33%"; Hit description =Putative uncharacterized protein At4g16745
MGEIVREMNFNPLRCTLPSKVLIQFATGLSSSTSCLLQGVVLDKTNGVKSPLNSIALASLTEPAQKQFWKCQEGLAQLVEQPSSSKIVIACKRRLFSSPFVTFPSISSKIDQRRSLPDSDPSSELVRNEMKRAFRRTAFVLMRELSWRCFGHKIDWRRFFVLVAILTVSAFVFQTLVHAYLALPNRPLHSPHQSNSSLQGGRLQKVHLTLTDSVISPNASNKLIQSFSVQLENAELEAPIQRKNSVSARKKDKNLAGTTKVATSLSPPRHVPKQRHIQLLPPNKALVQAKKEIDRAPSVNEDPDIYAPIFRNISVFKRY

SEQ ID NO: 165942 - protein, 85 aa, Glycine max
  Coding DNA Sequence Number=SeqID_74257
MAPRREKTTMENGELPTMEKKEEEETNNGTADQLVGSHTVAKEGGRRSHGKKKSQLLGANVIKWAAAKRVEPVKSAAVGPAGQGL

SEQ ID NO: 165943 - protein, 95 aa, Glycine max
  Coding DNA Sequence Number=SeqID_74258
  Homolog annotation: Hit_ID=A7R2C9; Match level="QueryCoverage=58%, HitCoverage=98%, E-value=4e-19, Identity=80%"; Hit description =Chromosome undetermined scaffold_419, whole genome shotgun sequence
MMIHLFRYRRREQKLLLGYTLTDKSASGNIFILCLVEMPIRSLVEVEPPSPLRYLIGAAVMMIGVVLPVGYMMFRNKRVPSSSSYSKQTNKELET

SEQ ID NO: 165944 - protein, 830 aa, Glycine max
  Coding DNA Sequence Number=SeqID_74259
  Homolog annotation: Hit_ID=A5AEB8; Match level="QueryCoverage=90%, HitCoverage=88%, E-value=0.0, Identity=54%"; Hit description =Putative uncharacterized protein
  Subcellular localization annotation: CTP_CleavageSite=35; ConfidenceScore=5.33e-01
MPSHSSSTFDSLSKSQDLSSAIQSATTPSQISSACASIETFLHSHSPDQSRHFFSLAFPTLISKLFGFDDSSNAWILHRHSSADGDLSQTLFSLLSPSGNLAAAIAAVDRLSLVKYVFPAERLPHWTRSFLSDTDSRSLSDLCPSLFKPSPSPSQIQFNVFEYFFFWFAYYPVSKGKNDNNECVSVNKRVKKFRLEDWTNTWTSSIPGFSASSSSKRCSSEGKPQCDLYTRLLCAYLRAFVPSYDFHAHQPYRTSILHYGSGYDSSVSARAEFVVNALIHFWLVDNDFSPLPASVCRSLRVSFPAGETPPPPGLGEVVRLFVRYLNLSTVATFRENGGGGECGTPWWRALEGAKSKDLGSLSSVRSLGCWNFCLQRPLYRYLLRTFLFCPMAASVKNVSQVLSVWVGYLEPWTMNADEFSNMDGFNGEKKEDSVPASAGDGFSPQWQDYVLSNYLYYSSLVMHFIGFAHRFLHSDVEVVVQMVLKVLDTLTSSKELIDLLKTVDSLFHSKQVGSGKAMLNNLYRYVPIIHEQLQDWEDGLCETDADGSFLHENWNKDLRLYADGEDGGQQLLQLFILRAEAELQAISGDNLVPSLRCIDSLKAKLGCLFDGHAIIKSLSTCTEPMPHQQSRDEIFKPRRGAGNYAFADVKYKGDWMRRPISNDEIAWLAKILIRLSDWLNESLGLNQAESNQVSSTVSYVEVSADVAAHIWGPYKALKVFLCTIGSWFLFLGAASLGCMRKHGLRVNLRLLASKKFVMREGETKNDVIDGQQRVVVEDWPTVKERWESAETPVPEEVILVEELDGDNKKARKTDLMKRVLVFYTFQFMIG

SEQ ID NO: 165945 - protein, 104 aa, Glycine max
  Coding DNA Sequence Number=SeqID_74260
MVLNMDQEDGYEENNIEELEPEPQLHLQPVDPNFGALLVEPTQPYQVRLGDGVDDVILGVAWLATFGEVKVNWRTLSMTFVHQGTRQWGWRVGHVAAPGGLASG

SEQ ID NO: 165946 - protein, 301 aa, Glycine max
  Coding DNA Sequence Number=SeqID_74261
  Gene Ontology: Mol. function=molecular_function; Cellular component =membrane; Biological process=auxin mediated signaling pathway
  Homolog annotation: Hit_ID=A7R3N0; Match level="QueryCoverage=88%, HitCoverage=99%, E-value=2e-59, Identity=63%"; Hit description =Chromosome chr2 scaffold_541, whole genome shotgun sequence
  Pfam annotation: Domain name=DUF6; Domain location=146-276; Score =23.5; E_value=0.00081; Accession=PF00892.11; Description=Integral membrane protein DUF6
  Pfam annotation: Domain name=TPT; Domain location=137-276; Score= -29.7; E_value=0.032; Accession=PF03151.7; Description=Triose -phosphate Transporter family
  Pfam module annotation: Pfam domain module=DUF6::TPT; Domain location= 146-276::137-276
MMNGGMLEDIAIIGGLIGVQFVYAGNAVLLSYLMSLGVESLTLVIFTSFATFLILLPLAFYYERCKWPRRVSFKLLIQLLSLSLGGFHFLKFGHGSGFEYHPLGNIVPVSIPPRNQSNLSNNGNSHAKPCTRHKIIGCLYLLAAIFILSSNIVLQAFTLGDFPAPMSLCAITSFFGTFMTAAVQLVEDHEFKPGWPIVSVGDMIAYSLLAGAVSGICLSVNGWALEKRGPVLVSMFSPIGTVCSVLFSVVTLGQTINIGSFAGMFLMFTGFYFVLWAKGTEGYAKGGGLESEYDAEKPLLS

SEQ ID NO: 165947 - protein, 211 aa, Glycine max
  Coding DNA Sequence Number=SeqID_74262
  Gene Ontology: Mol. function=RNA binding; Cellular component =spliceosome; Biological process=nuclear mRNA splicing, via spliceosome
  Homolog annotation: Hit_ID=A2Y8C5; Match level="QueryCoverage=87%, HitCoverage=81%, E-value=9e-30, Identity=43%"; Hit description =Putative uncharacterized protein
  Pfam annotation: Domain name=Cwf_Cwc_15; Domain location=1-211; Score= 254.5; E_value=2.2e-73; Accession=PF04889.3; Description=Cwf15Cwc15 cell cycle control protein
MVGDRWNCLDQEQDLDTILEIYFYLARKEGQDTQDELKRRNLRDELEDRERRHFSSKNKSYDDRDHGKGSHLFLEGSKREMEDHIVPRSVDADDSDVEVKSDDDSDDDEDDEDDTEALLAELEQIKKERTEEKLRKERQQQEEELKVKEAELLRGNPLLNNPTASFNVKRRWDDDVVFKNQARGETKTAKRFINDTIRNDFHRKFLQKYMK

SEQ ID NO: 165948 - protein, 415 aa, Glycine max
  Coding DNA Sequence Number=SeqID_74263
  Gene Ontology: Mol. function=pectinesterase activity; Cellular component=cell wall; Biological process=cell wall modification
  Homolog annotation: Hit_ID=A7QY79; Match level="QueryCoverage=93%, HitCoverage=100%, E-value=1e-152, Identity=71%"; Hit description =Chromosome chr2 scaffold_241, whole genome shotgun sequence
  Pfam annotation: Domain name=Pectinesterase; Domain location=51-379; Score=154.0; E_value=4e-43; Accession=PF01095.10; Description =Pectinesterase
MAPLFISMQMLLLVFTCILLHVTCTTYHDSTPKTVPSTNSSKWVGPIGHRVITVDVNGGAHFRSVKAAVNAVPENNRMNVLIQISAGYYIEKVVVPVTKPYITFQGAGRDVTVIEWHDRASDPGPNGQQLRTYRTASVTVFANYFSARNISFKNTAPAPMPGMEGWQAAAFRISGDKAYFSGCGFYGAQDTLCDDAGRHYFKECYIEGSIDFIFGNGRSMYKISNFYSFTVLAFGFIMSVAFDIWNAPSPLALWERVLLHSIATRFGSIAAQDRQFPYEKTGFSFVRCKVTGTGPIYVGRAMGQYSRIVYAYTYFDGIVAHGGWDDIDWNTSNNNKTVFFGVYKCWGPGAAAIRGVPLAQELDFESAHPFLVKSFVNGRHWIAPSDAYVEPASLSIAGSWEEPFLCARTHSKIIQ

SEQ ID NO: 165949 - protein, 78 aa, Glycine max
  Coding DNA Sequence Number=SeqID_74264
  Subcellular localization annotation: CTP_CleavageSite=42; ConfidenceScore=5.07e-01
MCSYQNLELVPLGGMRLKWAPGLHTLVSRGAFVKRTRCGTCRTRPKWAPGLHTLVSRGAFVKRTRCGTCRTNDSDAQE

SEQ ID NO: 165950 - protein, 760 aa, Glycine max
  Coding DNA Sequence Number=SeqID_74265
  Gene Ontology: Cellular component=mitochondrion
  Homolog annotation: Hit_ID=A7QY91; Match level="QueryCoverage=99%, HitCoverage=99%, E-value=0.0, Identity=46%"; Hit description =Chromosome chr2 scaffold_241, whole genome shotgun sequence
MAIIGCSSDGHMDDTKFSKPMPWIGIYIAAASLACLIAMAADLIHGIRGRKLWFPCKFFCLNATSLAIIAVAVKLSVDLNTPMPHRHDQLSKLSSSALICTIMANSMPTLGITENKDTMMNFMAMAILVITMIVNICIQFVTGVIYLFWVEHAVIMLIMLILLMTMASSAISLPKMKHYFELKYKMNEEALKEGSKLLGEEGNQMVNRLRDQLMKIWMMAHTSSPQFVLGRSVTGTASGAFCLLSTLTLVEAMLRSYLMPWSFDFCTGDTDYKWSIILILIVQVAAVVVGTIAPAFRWFIAITYKCPNVRKKRCKRRFHVEGYWTTKLLLIKESPLGFRIHNRQYRKLAHDAKLVLLCFCVKLQVGIVLMCKVTQYVSIYLMYLILTCCDHCKKVKSKFVSSASSVSSSATTESRPGPKLDLRRFVLHLEGEEELVEVMLKQNRDATIHWVQVGEKKQPKLLIELLEQKCSFLQGFKGVETFDSDQVLSLHCVEAAYSWSLPLVTLASVVVSLPNINRDSVKKLISTLNEGLHFVKFIENNLDKERELFRLRTAAEIVWLGVDLYDKWLDVDLHELSLQDKSPKETLEKLADAAKIRYEKFRAKYNHICIKESPSLWPIKVSASHTMYRICKTALLNHELLRDNSSERLFEALTVMISDILGACLTNLPLVISNKCLNSTIEEREDTVRHAVYILGKTKKIIEMLEKRAFPRVNFCQGTFIEDWRSMHKQNSFLHFVPSSLENDTHTDPLKSNDLYLNVD

SEQ ID NO: 165951 - protein, 57 aa, Glycine max
  Coding DNA Sequence Number=SeqID_74266
MASIIVAICSFMASMSAFIFSCTSSTSRITLALAQKWVYDPNMVGSWYLTHATKNAS

SEQ ID NO: 165952 - protein, 65 aa, Glycine max
  Coding DNA Sequence Number=SeqID_74267
MSAYSHFAKRKPRAKRISIHVLSRESQELSAQPLHLRLIHSTKLGKAKLSLIEFDLNLTKRQPNR

SEQ ID NO: 165953 - protein, 189 aa, Glycine max
  Coding DNA Sequence Number=SeqID_74268
  Homolog annotation: Hit_ID=Q2HS67; Match level="QueryCoverage=88%, HitCoverage=55%, E-value=5e-15, Identity=31%"; Hit description =Cyclin-like F-box; F-box protein interaction domain
  Pfam annotation: Domain name=F-box; Domain location=7-54; Score=32.1; E_value=2e-06; Accession=PF00646.24; Description=F-box domain
MRSEKKSCSPLLCDELIKEILSRLPVKPLIQFKCVYKGWNSLMSDPYFIKLHLNKSAAKDDLEHLQLMKNVCVGSIPEIHLESCDETRVISRELPTLSFSPGIGRRTMFGFGYDPSSDKYKVVAIALTMLSLGVSQKTEMKVYSAGDSSWRNLKGFPVLWTLPKVGGVYLSGTLNCIVIKGKETIHSEI

SEQ ID NO: 165954 - protein, 92 aa, Glycine max
  Coding DNA Sequence Number=SeqID_74269
  Subcellular localization annotation: CTP_CleavageSite=64; ConfidenceScore=5.24e-01
MDRARLVYGLVTNMDMNIGALISGQISSIAQINFRGARKARVRPADVPSSSTLPAPSNSTTPTPAHLGSSTQDSQCFEAMLQSIHQGQILLL

SEQ ID NO: 165955 - protein, 99 aa, Glycine max
  Coding DNA Sequence Number=SeqID_74270
  Subcellular localization annotation: CTP_CleavageSite=46; ConfidenceScore=5.77e-01
MATPPALPPPPPSPPPPSTVASQSPSTLKRTRKATQLRSLATRPPRAERPVVNIDPATGKANGPHKKKLRTYLGIAARDKVDVTYETWKEVPTAQKDLI

SEQ ID NO: 165956 - protein, 102 aa, Glycine max
  Coding DNA Sequence Number=SeqID_74271
MEAMMSMKKIMEVNAVTIAATSTVAKTHEIPHHNLAYFEPCLGYASEGQAVGGITLQNPLEGPLYHPQLHLLHSTTSKNPHAMAKMGKLDHLEERLRAIEGG

SEQ ID NO: 165957 - protein, 78 aa, Glycine max
  Coding DNA Sequence Number=SeqID_74272
  Homolog annotation: Hit_ID=A5C3T2; Match level="QueryCoverage=92%, HitCoverage=9%, E-value=1e-10, Identity=45%"; Hit description =Putative uncharacterized protein
MTSIPQPVVDNLVDQVDHQIPENDEQPAEQHNPKKMLCSIKEDETNSMQSNKVSNLVELPNRVKVIGCKWVFKTKGIH

SEQ ID NO: 165958 - protein, 142 aa, Glycine max
  Coding DNA Sequence Number=SeqID_74273
  Homolog annotation: Hit_ID=A6FJQ2; Match level="QueryCoverage=26%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLSTLEDPHNLVLRRLSPKDHRRMVHNSNTAAGQPRRRSNKRLRRPWGHHRRRHNLDLRRLSPKSRRRMVLLLQRCFVADDRRKRRC

SEQ ID NO: 165959 - protein, 107 aa, Glycine max
  Coding DNA Sequence Number=SeqID_74274
MEDESSEATIPEPFDIGEEAEETQVRQVATATPERSLKATSKPFAPVVNLPSPQPAANPFTPLLEMPEDPTTPFLAMDTSPPTTPVLQLIDEEDGQTQDTQDQSYEF

SEQ ID NO: 165960 - protein, 134 aa, Glycine max
  Coding DNA Sequence Number=SeqID_74275
MGDLEKVQEQMKADMSALKEQMTSTMDAMRGMKQLMESNAATATTISLAAEADPTLPTVVHHPIPNMVGRERSTPGHISNPHPGYNQGAYPYGLPPNYTAPVIRDDAGHVPPLILKREPPRHPDEVHKDHREHA

SEQ ID NO: 165961 - protein, 239 aa, Glycine max
  Coding DNA Sequence Number=SeqID_74276
  Homolog annotation: Hit_ID=UPI000065F7CF; Match level="QueryCoverage =50%, HitCoverage=18%, E-value=1e-07, Identity=35%"; Hit description =Homolog of Homo sapiens "Leucine-rich repeats and IQ motif containing 1
MDKLDILVSLILLQTHICLFNFHRNVSGEPLGTSTLAFGGLGALAFRGLHVLAFRGLHVLAFRGLHALSEHLFRGLHVLAFRGLHVLAFRGLHTLAIQRTTRTHLQGYKSSPSEGYTPSLQRTTRPLPSEGYTLTLEDYTSSTFREATSTTFKGLHVLAFRGLHALALEGARPHLQRTTRPHLQRATHPRLQRTTRPHLQKNTRPRLQRATRPRYQRTTSPHLQRAARPHLQRTTILRL

SEQ ID NO: 165962 - protein, 137 aa, Glycine max
  Coding DNA Sequence Number=SeqID_74277
  Gene Ontology: Mol. function=aspartic-type endopeptidase activity; Cellular component=small subunit processome; Biological process=DNA integration
  Homolog annotation: Hit_ID=A5BBZ3; Match level="QueryCoverage=79%, HitCoverage=16%, E-value=1e-17, Identity=37%"; Hit description =Putative uncharacterized protein
METEEDELVMEIEEDELEEEVALNVLTADYEEYLQLKAAKESLTSPTISGHNSTACISQSGNNQSPWIIDLGASDHIAGNSSLFSSLSPLKIPHFITLADGSRVAATGIGHERGTGRTIDVGHESHGLYYLKPNLSW

SEQ ID NO: 165963 - protein, 370 aa, Glycine max
  Coding DNA Sequence Number=SeqID_74278
  Gene Ontology: Mol. function=transporter activity; Cellular component= membrane; Biological process=transport
  Homolog annotation: Hit_ID=A1FVL0; Match level="QueryCoverage=36%, HitCoverage=27%, E-value=3e-59, Identity=86%"; Hit description=RND efflux system, outer membrane lipoprotein, NodT family precursor
MGESAPLRGHVESIAAGIEDRYRSNGSTLLPNVTPAFDWVRLAQRIPHQACRQGRHRADTGGPVNATLPRLGLIVALASLAACRTVGPDYALPEGSAFKRPEANAAFIDTQNPQVAANQALPDRWWSLYNDPVLDGLITQALRDNVELKAADAHLRRAAAVYEQALDAGGFEYEAEAGVSRAQLSAESFLQEHELPLPVRPVRQAQARRRSGACRRAVGGGGTRSGPGQCGRPGGRQLPGNLPCQPRTARGRAFAAAATTQPHRYRAPDRGWPWHAAGAGPRQCPGSAAGSCTAAAAGPAVGSRLFAGRTAGPDPGPVASRPPPGRAPAERKLASATARIGVPPPSCIRTSAWVPRWGAAGLLEELRHRR

SEQ ID NO: 165964 - protein, 169 aa, Glycine max
  Coding DNA Sequence Number=SeqID_74279
WATRDGVLMPGLVEMGCFFCAIAQSPPSTTYDGVVPGDMSRGSGDLGDASVAFSFQCAKAVVIRFWALIAMAAQLIHDHVVMEFLEGVWETLEGNERCRFRGTIRLTATSLPVQVIEVSSSKEDLEEDQEELSFAPVMDAPDLPEDDEDPLLDVDSPEDIMSASKADST

SEQ ID NO: 165965 - protein, 247 aa, Glycine max
  Coding DNA Sequence Number=SeqID_74280
  Homolog annotation: Hit_ID=UPI00016621D1; Match level="QueryCoverage =78%, HitCoverage=41%, E-value=1e-11, Identity=28%"; Hit description =UPI00016621D1 related cluster
ALTIRGQHVLALRGLHPLAFRGLHVLTLRGPHVLTFRGQHAFAFRGLHILASRGQHVLSLRGLYILAFRGLHVLAFRGLHVLALRGLHVLSIRGLYVFAIRGLHVLAFRGLHLLDFRGLHDRAFRELHFLSIRGLHVLAIRGLHVLAFRGLHLLDFRGLHVLTFTGLYLLAFRGLHVLAIRGLQVLAFRRLHVLAFRGLHGCTSWPSEDYTSSPSEDFKSLHSEDCMSSPSEVYTCSTLEGCTFSPS

SEQ ID NO: 165966 - protein, 105 aa, Glycine max
  Coding DNA Sequence Number=SeqID_74281
MEREMIIVKVDTLPVFYREKMVGYTPSSFVDLVFADERIKASLKRAKFNHPAWTNEKTGANEEGENEGETLAMTAIPIRPGFPPNQQCHYSANTSHSHYPPPIYP

SEQ ID NO: 165967 - protein, 49 aa, Glycine max
  Coding DNA Sequence Number=SeqID_74282
MAEINQGKTMIGHDWPHIVVSYLQGHDRPSSLPGTRQAEDITARQPSIL

SEQ ID NO: 165968 - protein, 111 aa, Glycine max
  Coding DNA Sequence Number=SeqID_74283
  Homolog annotation: Hit_ID=Q51617; Match level="QueryCoverage=54%, HitCoverage=88%, E-value=1e-16, Identity=75%"; Hit description =Putative uncharacterized protein
  Subcellular localization annotation: CTP_CleavageSite=95; ConfidenceScore=5.69e-01
MLCKKRLAPSVSDRVRSKCRSVSLMVMAALHNSLTVMPSVRCFSVTGVSRGPFVSRVSVMTVKTSDTCSSRRRSQLVCKRMPGADKPVRARQRVLAGVGAGLTMRHQSRLY

SEQ ID NO: 165969 - protein, 109 aa, Glycine max
  Coding DNA Sequence Number=SeqID_74284
  Subcellular localization annotation: CTP_CleavageSite=40; ConfidenceScore=5.10e-01
VALLVLARLARISEFRLSARLFALPQAVCLAGFALAQRTCTAHPSSRFFLALSQRSVVLSRWLAKPEDWLSERMKINTSQTCLINLKLRGNDYYVRQVASDILRRGGLN

SEQ ID NO: 165970 - protein, 172 aa, Glycine max
  Coding DNA Sequence Number=SeqID_74285
MAKFDPEVVLEFYANAWPTEEGVRDMRSWVRGQWIPFDADALSQFLGVLLVLEEGQQCEFSQRRNRADGFGEEAIAQMLCTPGKDFARTAAGRRVRIMRTSMTTLTQTWMTLLLSNVLPSNHNSVSLCRSVSWCMPPTRHPLNPDKSNRALGFPALITGLCQSFGVPVTPSK

SEQ ID NO: 165971 - protein, 74 aa, Glycine max
  Coding DNA Sequence Number=SeqID_74286
  Homolog annotation: Hit_ID=A6FJQ2; Match level="QueryCoverage=51%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVYEEIAGRNPFARTPVGPTNQHKL

SEQ ID NO: 165972 - protein, 315 aa, Glycine max
  Coding DNA Sequence Number=SeqID_74287
  Gene Ontology: Mol. function=transporter activity; Cellular component= membrane; Biological process=transport
  Homolog annotation: Hit_ID=A4TLY3; Match level="QueryCoverage=41%, HitCoverage=39%, E-value=8e-49, Identity=74%"; Hit description=Sugar transport system, permease protein
  Pfam annotation: Domain name=BPD_transp_2; Domain location=1-271; Score=-39.9; E_value=0.0068; Accession=PF02653.7; Description =Branched-chain amino acid transport system  permease component
MALAGSVAAGLMLAAVPIPLAMVAALAVGALFGLANGACIAYLRMPPIIVTLASMGIARGLALLYTGGYPISGLPDVFAFFGRGTVLGIQVPILIMLGVYVLAWLMLNQLPFGRYVYAMGGNEEAARLSGIRRPDRRAGRAGADLAPDERAAQRRRRLRAGRHRRGGAGRGGDLRRARRHRRHAGGGDDARGAQQRPQSDERVAVYPERGEGRHHPGRHLPQLRAAQIGGAMAVFLGIDVGGTVIKAGLYRASGEELAIAERDGAAIAAQPGFSERNMDALWDDVCAAIRQTLHAAGLEAGQVRGRQLLGARQRA

SEQ ID NO: 165973 - protein, 280 aa, Glycine max
  Coding DNA Sequence Number=SeqID_74288
  Homolog annotation: Hit_ID=A7MQ30; Match level="QueryCoverage=50%, HitCoverage=54%, E-value=1e-41, Identity=62%"; Hit description =Putative uncharacterized protein
MSPFSGENMSKSIMAIALLFTVLMVQGCNKSMEYEPQDFFEGRQLDIAQLIYDGDEVKLKEKLPSISKEELNRPVKADMALLFWSVLNAIYDKNTPERLKIITDLVKAGADPLQPRPEGGSSPAEFVLKADKGIWIKAMLDGGLPPNAKDKRIETPLRSASKTWNMPLRGRMATAIQPLLAQPTLTQFLRYRTKHQRCLQRLRAEGRLRLRPGRPLDDHQILRLIDHNHLAEDPQRPQRMLEGSLRGGFHVGRIHRHFVVPPLVAVDAVRMRRRHRARRQ

SEQ ID NO: 165974 - protein, 142 aa, Glycine max
  Coding DNA Sequence Number=SeqID_74289
MWMDRFALTLNGSQELPRLLAKAKAMADTYSAPEEIHGLLGYWKNTITKRATRHPYRTRSKSRTMGDQEETQEQMKADMSALKEQMASMMEAMLGMRQLMEKNAATAAVVSSAAEADPTLLATAHHPSSNIVGRGRDTLGHD

SEQ ID NO: 165975 - protein, 201 aa, Glycine max
  Coding DNA Sequence Number=SeqID_74290
MALKKLSTKRSGRDATGEGSSAASEERRVQLREDEYPNFQGEIARRHWARLLTPMAKFDPEIVIEFYANAWPTKEGVWDMRSWVRGHWVPFDADAISQFLGDPLILEEDQQCEFSQRRSQTDGFDEEAITQLLCIPGQDFTQTAAGRRVRITCTSMTTLTQIWMTLLLSNVLPSDHNSDLPLPKCQLVYAILTQMSVHVAQ

SEQ ID NO: 165976 - protein, 90 aa, Glycine max
  Coding DNA Sequence Number=SeqID_74291
MAHIKKTGQMTSEAAKQIADKIDSFVTHGRQDVLTTVIGQPEYPSRVRAVGASVTIKQYFELAPRTSRTSSSMAPEDLEQLTQQIRDQLE

SEQ ID NO: 165977 - protein, 75 aa, Glycine max
  Coding DNA Sequence Number=SeqID_74292
MGSSQKPSLKKRFYQVKVKSLGITSLKEQGQLMGIRPPKASRKWGGRDTEKMLEAKARILAARSEWAPFIDVLAL

SEQ ID NO: 165978 - protein, 283 aa, Glycine max
  Coding DNA Sequence Number=SeqID_74293
  Gene Ontology: Mol. function=isomerase activity; Biological process =cellular metabolic process
  Homolog annotation: Hit_ID=Q0LXG0; Match level="QueryCoverage=97%, HitCoverage=97%, E-value=1e-74, Identity=51%"; Hit description=NAD -dependent epimerase/dehydratase:3-beta hydroxysteroid dehydrogenase/i somerase:Male sterility-like
  Pfam annotation: Domain name=Epimerase; Domain location=3-207; Score=- 18.5; E_value=8.7e-06; Accession=PF01370.12; Description=NAD dependent epimerasedehydratase family
  Pfam annotation: Domain name=NAD_binding_4; Domain location=5-188; Score=-85.6; E_value=0.0032; Accession=PF07993.3; Description=Male sterility protein
  Pfam annotation: Domain name=RmlD_sub_bind; Domain location=1-278; Score=-146.0; E_value=0.00035; Accession=PF04321.8; Description=RmlD substrate binding domain
  Pfam annotation: Domain name=adh_short; Domain location=1-113; Score=- 50.9; E_value=0.028; Accession=PF00106.16; Description=short chain dehydrogenase
  Pfam module annotation: Pfam domain module=Epimerase::NAD_binding _4::RmlD_sub_bind::adh_short; Domain location=3-207::5-188::1-278::1 -113
MNVFITGASGFIGMAIAAELIQAGHHVTGLARSEQTVQRLNRIGADAHRGELKNLLSLTVGARAADAVIHCAYDHAFSHPQDTAMQEMQAIAALGKGCGHGQSRTGSACQRGFLRPVDANPRKSTEIAAAQVADSGVNVSIIRLPQVHNEVKQGFVSALIQLAREKGVSAYVEEGTNQWAAAHVADVASLYRTVLEKALPGQRYHAVAEQGISLRNIAEDIGAGLGVPVVQLTREEASAHFGWLALFVTMDMRASAELTRQRTGWQPSHPGLLQDLERYFRLA

SEQ ID NO: 165979 - protein, 248 aa, Glycine max
  Coding DNA Sequence Number=SeqID_74294
  Gene Ontology: Cellular component=1-2nm peptidoglycan-based cell wall; Biological process=regulation of cell growth
  Homolog annotation: Hit_ID=A8GKR6; Match level="QueryCoverage=98%, HitCoverage=34%, E-value=1e-102, Identity=73%"; Hit description =Intracellular growth attenuator IgaA precursor
  Pfam annotation: Domain name=IgaA; Domain location=1-248; Score= -100.4; E_value=1.8e-14; Accession=PF07095.2; Description =Intracellular growth attenuator protein IgaA
MIFVAVLMIAWGCWNLFRRPASRELKEIHCLRGTPKRWGLFGESGQGQISNISLGIIDLIYPPHWQPYLTQDLGKTTDVDVYLNRQVVRQGRFLSLHDEVKNFPLQQWGRNAVLVASSALVLLLLLIYIPLNLPLTLSMAWLQGAQKVEVTSVQALEATPLRIGDTLKVRGSGMCYVPPPANGGGAANFAPFDCSGIYWNNAAPLPQPESEVIDKATALLATVNSQLHPSGADQKVNPQLASAIENPA

SEQ ID NO: 165980 - protein, 291 aa, Glycine max
  Coding DNA Sequence Number=SeqID_74295
MAKFDPEIVLEFYANAWPTEEGARDMRSWEGQQCEFSQRRRRANDFDEEAIAQLLCIPGQDFAWTAAGRRVRIMRTSMTTLTQTWMTLLLSNVFPSDHNSDLPLPKCQLVYAILTRMSVHVAQVIVDAIYLFVGMAPTRHPLDPDKSNRALGFPTLIIGLCQSYGVPVTPSAGDAHQAADAPPPPRQADRAGSLGVERYLQHLVRQQAAYHRGQVQIHECLYRFSLSQQGQGFAPFVCLTPEQFGAEVAWPRDWPDAQAREEHAGSLGEADESHIDEDMTDLLSFLGGRGA

SEQ ID NO: 165981 - protein, 255 aa, Glycine max
  Coding DNA Sequence Number=SeqID_74296
  Gene Ontology: Mol. function=DNA binding; Cellular component=nucleus; Biological process=regulation of transcription
  Homolog annotation: Hit_ID=A5BSG8; Match level="QueryCoverage=57%, HitCoverage=32%, E-value=6e-12, Identity=32%"; Hit description =Putative uncharacterized protein
MCELPGRTDNEIKNFWNTRQKKRKRAGLPLYPEDIEVLNVDNPQSINQNDSTQHANDSQPGTSSHNVPELVFNNYKLVNGKHPSCVPPISVMPENSTFEQQDNSDKQVMHPPHLQIMHRSHEQLQDSLPNDYIKFQGDYMSCDDKCSSGISLPSFDDDLLRMGEDPPTQTHDQYYEPRSPRSNGYLESIFCPPPKIVEGSDDCSMQGESSLGNGENLDPIMNQDTLGDTWVENYDKDQYALKDTLFSIIYPFFPH

SEQ ID NO: 165982 - protein, 76 aa, Glycine max
  Coding DNA Sequence Number=SeqID_74297
MWQKVLLQKQTRGQGNTRHQIAQDGDISHNTKVLGVSGSATTSQVHNHNCSCISHICLQFPTISMIAIETVTMNAI

SEQ ID NO: 165983 - protein, 150 aa, Glycine max
  Coding DNA Sequence Number=SeqID_74298
  Gene Ontology: Mol. function=exonuclease activity; Cellular component= intracellular; Biological process=nucleobase, nucleoside, nucleotide and nucleic acid metabolic process
  Homolog annotation: Hit_ID=A7PG21; Match level="QueryCoverage=63%, HitCoverage=50%, E-value=3e-41, Identity=84%"; Hit description =Chromosome chr6 scaffold_15, whole genome shotgun sequence
MEKLANSFSVLELDADDSHVPTTADISDKRVNADVDIVPVKSEKQNQENPVTPSCEYKLPLVWIDLEMTGLNIEVDRILEIACIITDGNLTKTVEGPDLVIHQTKECLDRMGEWCQSHHAASGLTKKVLKSTISEGEAEEQTYQIVKLVY

SEQ ID NO: 165984 - protein, 822 aa, Glycine max
  Coding DNA Sequence Number=SeqID_74299
  Gene Ontology: Mol. function=protein binding; Cellular component =ribonucleoprotein complex; Biological process=RNA processing
  Homolog annotation: Hit_ID=A7PG84; Match level="QueryCoverage=96%, HitCoverage=83%, E-value=1e-151, Identity=44%"; Hit description =Chromosome chr6 scaffold_15, whole genome shotgun sequence
  Pfam annotation: Domain name=La; Domain location=331-388; Score =114.0; E_value=4.5e-31; Accession=PF05383.8; Description=La domain
VLVLNITDSTGKGKSWELGGLQREKKAVMVIAENEIGEDQKEIGAPKSPWKTPTVDGKGGDVSVMMGTESWPRLSDAQRPPKNLETAAAAASVTSAGEIAPRPPSMQKVNGAGNVNPVHKLPLSRHQKPGAKRNSNGGPPFPVPIPYHQPVPPFFHPMVPPPHVAVPGYAFPLGPGPFPGAENPLVKPVSQAPGQAFAPPAHAVDGKNVQPLVRGDPNAYVGNFSNGRTNIQEQGDHLNHAWHHQRPFPSRVNIPMQQGLGPRPFIRPPFYGPPPGYMVGPSFPGPAPVWCVPMPPPGSIRGPHPRHFVPYPVNPTPQPPPPETVSLRTSIVKQIDYYFSDENLQNDHYLISLMDDQGWVPISTVADFKRVKKMSTDIPFILDALQSSNTVEVQGDKIRQRDSWSKWIGASSGNSGSSTAQVQQGQLVDGAFNSLENSDAVGDKMKEISEENPKDAVHDSIFEEHNQPNRDMLQVSLMNQEKNNEGHRSNDKSHEGVKFCDFETTNNNLCSQQEVEPKVFDNNEAGNMDVLTEMDVRDLSNDFGNTFMLDEEIELEQKMLRKTELSSSGRNDDEDDEMAVIEQDVQRLVIVTQNGDPKQRSRGGGKESISISNELASAINDGLYFYEQELKHRRSNRRKNNSDSRDQNIKSPSRNSGASNIKAVENIGGNCVEESGSYNSRRKQKVFHKQPSSLKQRFFSSNFRNHGTGRNSHGIISESPPSNSVGFFFASTPPENHGFKPSKLSSSPHGGFSGSPRGGFAGSPHGGFAGSPPVGSMPKSFPLFQHPSHQLLEENGFKQQKYLKYHKRCLNDRKKLGIGCSE

SEQ ID NO: 165985 - protein, 792 aa, Glycine max
  Coding DNA Sequence Number=SeqID_74300
  Homolog annotation: Hit_ID=Q0GPD1; Match level="QueryCoverage=66%, HitCoverage=100%, E-value=0.0, Identity=90%"; Hit description=BZIP transcription factor bZIP114
  Pfam annotation: Domain name=DUF630; Domain location=1-60; Score =112.1; E_value=1.6e-30; Accession=PF04783.3; Description=Protein of unknown function (DUF630)
  Pfam annotation: Domain name=DUF632; Domain location=308-712; Score =447.8; E_value=1.5e-131; Accession=PF04782.3; Description=Protein of unknown function (DUF632)
  Pfam module annotation: Pfam domain module=DUF630::DUF632; Domain location=1-60::308-712
MGASSSKMEDDKALQLCRERKKFVRQALDGRCSLAAAHVSYIQSLKNTGTALRKFTEPEGPIEPSLYTTATPEQPLALTERTLSFSSASVSHHIDAAEHENFSPTPSLPSSSSKFRANHMKHSTISSKKVEEKPPVPVIGIVTSSGTTTQNTSVMSGTAAFEDSSLPAGTPQWDFFGLFHPIDHQFSFQDGKGMHQDIGNADDIQRLREEEGIPELEDDEEKASSHGREHSRDSEDEFDEEPAAETLVQRFENLNRSNSHVQANFEPATTKPLRGHSASEVELVNGEKGNSAYLSPLKTAPMPALPPPETNKPMEKESRNENKVTPKNFFSSVRDIELLFIKASESGQEVPKMLEANKVHFRPIFQGKESNLSDGSLVSSFLKVCFSCGEDPSQVPEEPAQNSVKYLTWHRTASSRSSSSRNPLGANSIDNAEDHANNLFDNSCMISGSHASTLDRLYAWERKLYDEVKASEIVRKEYDMKCKFLRQLESKGEKTSTVDKTRAKVKDLHSRIIVSIHRINSISKRIAELRDKELQPQLEELIEGYAPGWMVHTSTYVDCYELLAFVFHLFLLCFDVRLNRMWEVMHECHKLQFQIMSAAYNNSHARITMHSELRRQITSYLENELQFLSSSFTKWIGAQKCYLEAINGWLHKCVRHEEKSSKRKRRLQSDLSFYDPPIYVTCALWLDKLSALPVKDVADSIKSLATDTAQFLPHQDKNQGKGAHPHMSTWKADIGGESADGLLRDDISEDWVAELRQAIQKVKNYQRLNSQSQNGHLNSQSQDGHPNSESQS

SEQ ID NO: 165986 - protein, 191 aa, Glycine max
  Coding DNA Sequence Number=SeqID_74301
  Gene Ontology: Mol. function=oxidoreductase activity; Cellular component=cytoplasm; Biological process=metabolic process
  Homolog annotation: Hit_ID=A7NVS2; Match level="QueryCoverage=46%, HitCoverage=24%, E-value=4e-32, Identity=73%"; Hit description =Chromosome chr18 scaffold_1, whole genome shotgun sequence
  Pfam annotation: Domain name=ADH_zinc_N; Domain location=1-145; Score= -19.3; E_value=0.031; Accession=PF00107.17; Description=Zinc-binding dehydrogenase
MEHKVATTTEGQPIRCKAAVCREAGEPLSIEEIIVAPPMPGEARIRITCSTLCQTDISFWNMQVILEMTDGGADYCFECVGMASLMQEAYVSCRKGWGKTIVLGVDKPGSKLNLSCSEVHVCGKSLRGYLFGGLKPKSDVPILLKRYMDKGHVAQDPQHKGGVRHSTRLRRENIKLKDYTFSGTGDDSVAG

SEQ ID NO: 165987 - protein, 52 aa, Glycine max
  Coding DNA Sequence Number=SeqID_74302
MSIASKSIIRPSRNIKSQVQGPTKREGDGKSEDSAWWIVKAFRVPHDTGLLL

SEQ ID NO: 165988 - protein, 70 aa, Glycine max
  Coding DNA Sequence Number=SeqID_74303
MINQWNNRTDFRVDVYPRQEGLLSFNSDYMVWYRRKTKMFVDPKNSNMATLRRYSTWCHHKGEIHERLTI

SEQ ID NO: 165989 - protein, 47 aa, Glycine max
  Coding DNA Sequence Number=SeqID_74304
MIEARQKGGRSLPPSSPRRAQLAQASKVASSRSNSLLEEESGRPKWA

SEQ ID NO: 165990 - protein, 117 aa, Glycine max
  Coding DNA Sequence Number=SeqID_74305
MRMYACCSALRDTTCLCGCEIYLQVHRVIKELVHLVKVCSISRHLQTEIMIVNESKSMFYSNYKAINVSKCENRYLKALGPLTEQIDAIKDVSLIKDVSVFYVEGSSTKHRCLVSLA

SEQ ID NO: 165991 - protein, 138 aa, Glycine max
  Coding DNA Sequence Number=SeqID_74306
VVPYVVVLMNPVFAFLWKSKRKRLATQGINKGRDTIKVDSQVSSRVHTTNKDSGDHTLKTTKLEETLTQFMQVTMSNHKSTESALKNLEIQVGQLDKQLAEKSSNSFKANTEKNLKEECNAVMTRNKKRLVVEDKDRV

SEQ ID NO: 165992 - protein, 75 aa, Glycine max
  Coding DNA Sequence Number=SeqID_74307
MRKGKSEVNTDKKKDTTPNEGKEVPYPLEKLSSTCDAILPRKGPVTRFMSKRLQEDWAKATEEGPRVLMNLRVDF

SEQ ID NO: 165993 - protein, 406 aa, Glycine max
  Coding DNA Sequence Number=SeqID_74308
  Gene Ontology: Mol. function=protein-N(PI)-phosphohistidine-sugar phosphotransferase activity; Biological process=regulation of transcription, DNA-dependent
  Homolog annotation: Hit_ID=A4WDB7; Match level="QueryCoverage=82%, HitCoverage=79%, E-value=1e-154, Identity=80%"; Hit description =Transcriptional antiterminator, BglG
  Pfam annotation: Domain name=PRD; Domain location=186-274; Score =23.6; E_value=0.00072; Accession=PF00874.11; Description=PRD domain
  Pfam annotation: Domain name=PRD; Domain location=295-385; Score =59.7; E_value=9.6e-15; Accession=PF00874.11; Description=PRD domain
  Pfam module annotation: Pfam domain module=PRD::PRD; Domain location =186-274::295-385
MPELGEVVLAEHVGHHFRCQLFPDLIAGFCVTRIIEQVSRGDLIHRPAHFQTAQLRAVGDQLGFKANKTVRRRCQVLLMLYLPDAAVTAQSIIAANGVDDAMARQDIAETRDEIQRYHRLDIVTHQDGSYRLEGTALNQRLCLLHWLRRALRLCPQFVSHQFTPALKTALKQHGIARPLYDDANLRALINFCSRKLQRQFECRDVQFLQLYLQYCLIQHQLGNTPQFSHSQRSWTQSRGEYFTAQEIVRHWKRRVPQGAHGDEQLFLALLFMMLRTPDPVLDKHQQDQRLRRAIVRMVARFRSQTGMNFSDEQGLTDQLYIHLAQALDRSLFEIGIDNSLPEEIHRLYPRLLRTTKEALFELEAEFGLRFSDEEMSLVAVIFGAWLMQETDLHEKQVILLTGDDKA

SEQ ID NO: 165994 - protein, 55 aa, Glycine max
  Coding DNA Sequence Number=SeqID_74309
MSGVQGRQAVQVGLMILKSTRMMTLLGGLIQEQQAMCAKIVVGSRNLDQSMMALL

SEQ ID NO: 165995 - protein, 167 aa, Glycine max
  Coding DNA Sequence Number=SeqID_74310
  Homolog annotation: Hit_ID=A8P6U5; Match level="QueryCoverage=14%, HitCoverage=40%, E-value=3e-07, Identity=96%"; Hit description =Putative uncharacterized protein
MKTSLANAFAVFVFHKSKNFTSDYEIRMPPTVPVNHYSDPEGQHNRIRILWCYPMLMYTERRLALSTLISSKSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 165996 - protein, 30 aa, Glycine max
  Coding DNA Sequence Number=SeqID_74311
GKGSLGCSEVVKRIFTKLVEISSGLLKDWM

SEQ ID NO: 165997 - protein, 99 aa, Glycine max
  Coding DNA Sequence Number=SeqID_74312
MRDKSTIVSIDLEIEATCRRNNAARRRREQDIDTSPPLSPNHVQMDREPVRRVTLEDFCQTTTPEFFTSITPPKVQAPNISYPHSLIQLIQGNLFHGLP

SEQ ID NO: 165998 - protein, 63 aa, Glycine max
  Coding DNA Sequence Number=SeqID_74313
MSKWSPRSSVTSTKCTQCMLYAVYQLALRGLEYGSMKYDTWAPSMHKPWIIKDSKPPLHSRDA

SEQ ID NO: 165999 - protein, 104 aa, Glycine max
  Coding DNA Sequence Number=SeqID_74314
MQAVIALLAGAGMAFAKVAQNGLVAAGGGFAVAEQGIKLQAFQPFAFFGGFAAIEHLPHGDDIAHAVQMCDKTHVGFINAHAKRNRRHHDDAFFTQEAALVMFA

SEQ ID NO: 166000 - protein, 297 aa, Glycine max
  Coding DNA Sequence Number=SeqID_74315
  Gene Ontology: Mol. function=motor activity; Cellular component=cell projection
  Homolog annotation: Hit_ID=UPI00006A16D8; Match level="QueryCoverage =93%, HitCoverage=94%, E-value=2e-20, Identity=30%"; Hit description =UPI00006A16D8 related cluster
VDSRGSPTFKGLHVLAFRGLHILTFRGLHVLAFRGQHVLTFRGLHVLAIRGLYILTFRRLHALTFRGLHALAVRGLHVLAFRGIHVLLFRGLHALAFRGLHILAIRGLHALTFRGLHVLAIRGLHAFTFRGLHVLAIRGLHALTFRGLHVLAIRGLHALTFRGLYVLAIRGLHALTVGGLHALAFRGLHVLTFRGLHALAFRGLHVLAFRGLHALAFRGLHVLLFRGLDVLTFRGLHALPLRELHVLAFRGLHAVAFRDLHAVVFKGRHVLDFEGLHAPSPLEGYASSFSVGSISTP

SEQ ID NO: 166001 - protein, 88 aa, Glycine max
  Coding DNA Sequence Number=SeqID_74316
  Gene Ontology: Mol. function=protein serine/threonine kinase activity; Cellular component=plasma membrane; Biological process =protein amino acid phosphorylation
  Homolog annotation: Hit_ID=Q2QW32; Match level="QueryCoverage=85%, HitCoverage=7%, E-value=5e-14, Identity=51%"; Hit description =Leucine Rich Repeat family protein, expressed
  Pfam annotation: Domain name=LRRNT_2; Domain location=8-44; Score =16.5; E_value=0.017; Accession=PF08263.3; Description=Leucine rich repeat N-terminal domain
MVAEGETADGDLTTFLSLINTWENTPPNWVGSDPCDDWVGIKCKNSHITSITLSSTGLAGQLSGDIGSLSELETLDTENKDQESSESM

SEQ ID NO: 166002 - protein, 367 aa, Glycine max
  Coding DNA Sequence Number=SeqID_74317
  Gene Ontology: Mol. function=unspecific monooxygenase activity
  Homolog annotation: Hit_ID=Q9AVH2; Match level="QueryCoverage=62%, HitCoverage=99%, E-value=2e-69, Identity=52%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVSSSRTPAYLLTDVPPQPNSPPDNVFRPDRPAEADLGSKKRGSAPLPIHGITPTYPTPLKSFHKVGLESSSTGSSFPADSAKPVPLAVVSLDSRQGQWESLDCSTPGEEAPKGPFPIRPPTGTRRPALAAEAARAVHRQPTGSGLGPPCPALRANPFPE

SEQ ID NO: 166003 - protein, 46 aa, Glycine max
  Coding DNA Sequence Number=SeqID_74318
MGENLFAPRQTKTEKEKAKKIKSRKTHQKNPFPREVLLIHDHACNF

SEQ ID NO: 166004 - protein, 268 aa, Glycine max
  Coding DNA Sequence Number=SeqID_74319
MAPKKLSAKRSRRDAAAEGTSAAPEFDSQRFRSAEHQQRFEAIKGWSFHRERRVQLRDDEYTDFQGGDSSPTLDVADALSQFLGDPLVLEEGQECEFSQRRNRADGFDEEAIAQLLCIPRLGFTPTAAGRRVRIMRTSMTTLTQIWMTLLLSNVLPNDHNSDLPMPKCQLVYAILTRVSVHVAQLIADAIYLFTGMPPTRHPLDPDKSNRALGFLALIMGLCQSFGVPVTPSKVIRPPITRAFIEKYCTPRQAQGDAPQGAGAPPPTP

SEQ ID NO: 166005 - protein, 183 aa, Glycine max
  Coding DNA Sequence Number=SeqID_74320
MMIDTSKHYTRALRGTVHGPQANLGVDQKFSPVDVFKQKKGSEKPWDFSGLIKWLHHRHSKIINTLALRGRQALALKGLHVLTLKGLHALAFRGLHVLVFRGLHALAFRGLHRTTRPRLKRSHVLAFIGLHALAFKGLHVLHFRGLHALVFRGLHVLAIKGLRMLAFRGLHIYAFRELKVLYP

SEQ ID NO: 166006 - protein, 202 aa, Glycine max
  Coding DNA Sequence Number=SeqID_74321
  Homolog annotation: Hit_ID=UPI00016621D1; Match level="QueryCoverage =75%, HitCoverage=39%, E-value=4e-14, Identity=36%"; Hit description =UPI00016621D1 related cluster
VPSYKVMMKDNNWYLKALTWAMRGIMHEPQVNIGADQKFLPVDDGPLRTSTLTLRGLHALTFRGLHLLTFRGLHALAIRGLYVLTSRGLHVFTFRGLHVLTFRGLRIHAIRGLYVLTSRGLHVLAFRGLYVLTFRGPHVLTFRGLHALTFRGLHALAFRWLHALSVRGLYVLTSRGLHVLTFRGLHVLTFRGLHVLTFRGLH

SEQ ID NO: 166007 - protein, 56 aa, Glycine max
  Coding DNA Sequence Number=SeqID_74322
MEAMKEKMATRMEAMMSMKKITEANAVTIAATSAIAKVNSMPLSGLNQMNHPTSDM

SEQ ID NO: 166008 - protein, 76 aa, Glycine max
  Coding DNA Sequence Number=SeqID_74323
MDSTSDSPQIPASPHQLDFAPYASRSYSAQWNAPGLLHDKHTLCLSRILGEMEVEEPWLGLWLPIELSSRYGSKSA

SEQ ID NO: 166009 - protein, 50 aa, Glycine max
  Coding DNA Sequence Number=SeqID_74324
MEMQRKTKEKRLPVDKKLGEDASMEEKKEGEKERGGSTELKEEKGREVEL

SEQ ID NO: 166010 - protein, 68 aa, Glycine max
  Coding DNA Sequence Number=SeqID_74325
MDPPLVTLEAFIQQVSWPGVHPSIDGGGGGGVSHLRQESLPRLELGMTSWQTWQLLIGAHIQTWVEEA

SEQ ID NO: 166011 - protein, 124 aa, Glycine max
  Coding DNA Sequence Number=SeqID_74326
  Subcellular localization annotation: CTP_CleavageSite=32; ConfidenceScore=5.24e-01
MAQPKTCSTHGVPSARKQALMLSANTCTHAKRAARTKCSTEGIARMEVQAANILYPHSLIQLIQRNLFHSLPNEDPYAHLTTYIKIYNTGKQKGGYTPLKEIVCGPGGSCRKVLEEILPIVKDC

SEQ ID NO: 166012 - protein, 105 aa, Glycine max
  Coding DNA Sequence Number=SeqID_74327
  Pfam annotation: Domain name=PPR; Domain location=38-72; Score=37.3; E_value=5.7e-08; Accession=PF01535.11; Description=PPR repeat
  Subcellular localization annotation: CTP_CleavageSite=22; ConfidenceScore=5.16e-01
TKFRALLFLSLHSSSSTFKLLSMASYGGLQAPHGATSCAYSTAIAGFCRERELGKAFQMKKEMVEEGFLPDVGLLLDEVTYVKPCGLKNLKRNRLRMQKKQQQSI

SEQ ID NO: 166013 - protein, 90 aa, Glycine max
  Coding DNA Sequence Number=SeqID_74328
MVLRVYAFGALMLEIQCIEVDVHPQICVVVEVAVCGGGRWCLWLEVGMIVEEDRLEVVATEEGLGKRIREVWQDTVRRKLVLGLCFVLAL

SEQ ID NO: 166014 - protein, 184 aa, Glycine max
  Coding DNA Sequence Number=SeqID_74329
MAKLDLEIVMEFYANAWPTEEGAQDMRSWVRGQWIPFDADALNQFLGHPLILEEGQQCEFSQRKSQPEVLTRRPLLSFCAYRGRILPGSLQGDRLRVRHHSSLETPSRRQPMHLRLPRSPPQLTCGGWRAIYNTWLTSRRPIIEDSSTPRWHGFEIGPMLRQGQGPQAPLEMDTELRKTMTWLM

SEQ ID NO: 166015 - protein, 58 aa, Glycine max
  Coding DNA Sequence Number=SeqID_74330
MQYCGGHPVVHRNSLPLVISLRHKGVPLPGTSDKVNAPPMNMHNIQHMNVSTIKYKDH

SEQ ID NO: 166016 - protein, 82 aa, Glycine max
  Coding DNA Sequence Number=SeqID_74331
MYKVCAYVLCLPLYILVNSPKFGTNCLEPSALLESKQGVEGSAAGCGEERSTTGAGGFDVPSRDLSGVAAVSGLSYSSPASG

SEQ ID NO: 166017 - protein, 132 aa, Glycine max
  Coding DNA Sequence Number=SeqID_74332
QKLLAEKTKKKLEEAAQFGSTEAMIDPPSPIKWHVKWKMARMKKTSQMTSDAAKEIAKKIVSHFQLTIVIVATYPSAGGRRRAHECVFQERKMSGVTTNVYSRKTSEKPKKVWSTNFKCERFGSYFYARGRY

SEQ ID NO: 166018 - protein, 75 aa, Glycine max
  Coding DNA Sequence Number=SeqID_74333
MGPVLSDPQRPLVGEQKLLAEKTKKKLEEAAQFGSTEAMIDPPSPIKWHVKWKMARMKKTSQMTSDAAKEIAKKI

SEQ ID NO: 166019 - protein, 79 aa, Glycine max
  Coding DNA Sequence Number=SeqID_74334
MHNCPKFGVSWYKVKDDNECSSDESTMKGPPTKITQNTLHGMQIGEIAMECSGIRLIPLSGRRLIVYIQKLAKRQGILG

SEQ ID NO: 166020 - protein, 108 aa, Glycine max
  Coding DNA Sequence Number=SeqID_74335
MTSIYVRGRGCHSLRMGKFLGSTRVLPLLLRILKCDEGFRPKQRGHFGAVAAHPGELKLSVEAMSLPRRAGFFTMKLFGGPGEPKLFRIVTGVQHRKSTSKDQKINER

SEQ ID NO: 166021 - protein, 67 aa, Glycine max
  Coding DNA Sequence Number=SeqID_74336
MGEVQGQVQGHNVGEVEGHAQCKKLEEQMWVRFEENGCGTNETESLPYSSRSRDVSEFNLREWAVKA

SEQ ID NO: 166022 - protein, 339 aa, Glycine max
  Coding DNA Sequence Number=SeqID_74337
  Gene Ontology: Mol. function=RNA-directed DNA polymerase activity; Biological process=RNA-dependent DNA replication
  Homolog annotation: Hit_ID=Q1SKV6; Match level="QueryCoverage=76%, HitCoverage=56%, E-value=1e-18, Identity=25%"; Hit description=RNA -directed DNA polymerase
PSKEFAPKRGLRQGDPLAPLLFNIVVEGLTGLMRSTVSKNRFSSYQVGSQKEEVSGLKINYSKRHFGCLGKTEGVSSKSWSVWQPIIRKFEAKLAKWKQRSHHEADKIPWVKWDTVCLPKNKGGLGIKDLSKFNEALLNKWGKFSSHWWQDLKAVFQQQHRNSFIDNLKWRDRWEWKLIWRRNFFYHEIDMVAAFLAEIEIAHILQSSRDFLFWKADPNGLYSTKSAYKVLQEADNNVNEDRASKILWSLKIPPRESAFLCTTSPQGVLWVLARTMWVSRERFSTDFRREEKEKSDFRQEDDKEKRESKVFEHARFVKSQFFLTYKHNNIGFLWITDVN

SEQ ID NO: 166023 - protein, 47 aa, Glycine max
  Coding DNA Sequence Number=SeqID_74338
MSREKKESHEDSTNGGFNPFSFFLTFGNPYQSNQRNLRNLSEMSLLL

SEQ ID NO: 166024 - protein, 233 aa, Glycine max
  Coding DNA Sequence Number=SeqID_74339
MEGKKFIMFIALAQKHKAKRVESVNVDAEAFGDHWESSDCSMHSEAEALEHMKKRNRGHQSLLLENKTGDSTVVKMSQKNNNVDAGNCMTLEDHEGEEHCCGKGTNARRSWLLHLPPLLLLLHPPPPPPTPVPSDTSASPSTVKQTRKASCLRSLSTRPPGAERPVVHVDPATGKADGPHRKKLRTYLGIMARDKVDVTYENWNKVPTAQKDLIWEDIQEEFEIPEASDSRTK

SEQ ID NO: 166025 - protein, 118 aa, Glycine max
  Coding DNA Sequence Number=SeqID_74340
  Gene Ontology: Mol. function=nucleic acid binding; Biological process= DNA integration
  Homolog annotation: Hit_ID=A5AV98; Match level="QueryCoverage=99%, HitCoverage=15%, E-value=5e-29, Identity=50%"; Hit description =Putative uncharacterized protein
MNINIAILEEKPATITDASSNEEKSHYKAWERSNQFNLIFMRMNVTNSIKTTLPKTDSAKEFMRLVGEHFQTADKSLARTLMSTLTTIKFDGSRTMHEHIIEMTNITARRKTLGMGIL

SEQ ID NO: 166026 - protein, 215 aa, Glycine max
  Coding DNA Sequence Number=SeqID_74341
  Gene Ontology: Mol. function=oxidoreductase activity; Cellular component=intracellular; Biological process=electron transport
  Homolog annotation: Hit_ID=A5BXF6; Match level="QueryCoverage=37%, HitCoverage=40%, E-value=2e-23, Identity=60%"; Hit description =Putative uncharacterized protein
  Pfam annotation: Domain name=HA2; Domain location=112-180; Score =29.5; E_value=1.3e-05; Accession=PF04408.14; Description=Helicase associated domain (HA2)
MEFCPSGDLHALRQRQPGKYFSEHAVSCMLFNIDGHQVPQHIMMEVGDTYKRILAETAKVRDEHPDDMPILQAISIVLNRHPELRMEAWFAFDAIIIPLKTWDQASAIILVEGHKILFRLSFYTWRYLTMLPMEPILGKMLILGSILNCLDPILIVVAGLSVRDPFLTPLDKKDDDLTDIEKEDIDRAIALSLSEDDHKGKKVVEFPGGFLSPDR

SEQ ID NO: 166027 - protein, 60 aa, Glycine max
  Coding DNA Sequence Number=SeqID_74342
MSLIDAILTRKAPVTRAMSKRLQEDWARAAEEGPRVLMNLRVGYPRNIAFFSPCILGHLD

SEQ ID NO: 166028 - protein, 168 aa, Glycine max
  Coding DNA Sequence Number=SeqID_74343
MLEVFNSYSFVQRRFKHKNCRGLCYHFSKALTHSVLHSLSKAVTHSPYTLCPHSDRALRQSLAVKGVSHATPQSLSSLKEVVHQTISVTFEDPVVQELLLKLYQKVLVPTWPKEAASFFMPLVFPPVTIRKYTFNIGYLEHSTSVLKPMLKVPMLNVSMLTSVLQNRC

SEQ ID NO: 166029 - protein, 174 aa, Glycine max
  Coding DNA Sequence Number=SeqID_74344
MRGYRMVIRTIRQPGANETVDAQRLTSSSVPFVNQGQANSLTRGDLHRLLCLCRPNPRRYRMVILIFRQQGANEPVDAQRLTSSSARFVIQGQGVRWQAEIPYGRLHLSSTKANEFDGIRMMSFTLIVWRHSSPMTHEILLCWAGTIKFDCVWKRCGPAGWDIGWPNDVPLERN

SEQ ID NO: 166030 - protein, 34 aa, Glycine max
  Coding DNA Sequence Number=SeqID_74345
FFEELAKRAYCAKRVHPLRMNTHPLAELHAAKRG

SEQ ID NO: 166031 - protein, 148 aa, Glycine max
  Coding DNA Sequence Number=SeqID_74346
MIAPPDSIPSVEQFNEMVAWPGTQPSLHKEDKGPTAQVPQHMEDESSEATIPEPFDIGEEAEETQVRQVAPTTLERSLEATSEPSAPVVNLPLPQPVAHPSTPLLQMPEDPTIPVLAIDTSPPTTPVLQLTDEEDGQTQDTQDQSQEF

SEQ ID NO: 166032 - protein, 327 aa, Glycine max
  Coding DNA Sequence Number=SeqID_74347
MAGFAHAHHHHFATAGKDHFAGAAEVGVNILVELFQPFAFNAQYRFTCLLEAQQGEQHADAQHNPVIPRKGMRIDRAGMHQRRQAQHNRQIEDIGANQVADGDIVFAFQRAGQHRGQFRQAGTDSNQRQSHHQFANAEVIRKHRGVVDHHARRHRQNNQRHRQPEKRHRIAAFVARQFRQLFTRQGVIIIALGPPGDADRHQQITQRQQQQCYAIQPAELVIKQHDAAEQVQQRSATKDQQNIGDVRAQRENETISSGSEVPMLTTVMPMINGGMPRDRHRIAALNTRRGYEHEKSLMDNGAGKPCPTGKSSARAESGADFDCLRGK

SEQ ID NO: 166033 - protein, 146 aa, Glycine max
  Coding DNA Sequence Number=SeqID_74348
  Homolog annotation: Hit_ID=UPI00006A2939; Match level="QueryCoverage =92%, HitCoverage=77%, E-value=1e-11, Identity=30%"; Hit description =UPI00006A2939 related cluster
MRGPLKESTSCFLVRGLHVLTFVGLQALTIRGPHVFTFRGLHALAIRGLHVLTFRGLHVLTFRGLHVLTFAGLHALTFRGPHVLTFRGLHALAIRGLHVLTFKGLLALAIRGLHVLTFRGLHALAIRGLHVLTIRALYALTSRGLH

SEQ ID NO: 166034 - protein, 137 aa, Glycine max
  Coding DNA Sequence Number=SeqID_74349
  Pfam annotation: Domain name=zf-CCHC; Domain location=5-22; Score =19.5; E_value=0.0017; Accession=PF00098.14; Description=Zinc knuckle
DKKNVDCYNYGKKGHYAVDCWYKDKNLVDKAQLAEGADSVFEPVLLMVTNKTMPDDKGISSNLLSLGQLLQKGFKITMKDMMMLVGTQALEHKCLSAVSNREEWFWHYRLGHLNFRDLAQMHKFAQGIPQLQQPQEK

SEQ ID NO: 166035 - protein, 59 aa, Glycine max
  Coding DNA Sequence Number=SeqID_74350
MEKAPRFPKGERRTGGRSLWKNASNAAFLRFLAFCWPFAHMFFPALSPDSVDNRITAFE

SEQ ID NO: 166036 - protein, 38 aa, Glycine max
  Coding DNA Sequence Number=SeqID_74351
  Gene Ontology: Mol. function=cysteine protease inhibitor activity
  Homolog annotation: Hit_ID=P25973; Match level="QueryCoverage=81%, HitCoverage=64%, E-value=5e-09, Identity=93%"; Hit description =Cystatin
MAALGGFTDITGAQNSIDIENLARFAVDEHNKKEGSHK

SEQ ID NO: 166037 - protein, 193 aa, Glycine max
  Coding DNA Sequence Number=SeqID_74352
MEFGVADAGDAAAFHHAVDGGIGAAIDLALEAGRQQLHEGGHGGHGVAARGRVQVAQLDAVPGVQLAMAVERVQRLAAALVGIVEDRRGAAGGAVAHRRHVVAVARHAVAFGTRDRLGGGRIVLGEAGVQEAQQRDVQAIQPDHRFATVDGLGVAVVVPGPGRRDDEVARMHGGALAIDGGVGAAAFDDETQG

SEQ ID NO: 166038 - protein, 149 aa, Glycine max
  Coding DNA Sequence Number=SeqID_74353
MLRFPKSNVQNFKFGMRGPLDESISCFLIRVDPWVIVPIAFRGLHVLAFRGLHVLAFRGLQVLASRGLHVLAFRGLHVLAFRGLHTLALPLEGYTPSPSEDYTSSPSESYTPLPSEDYTSSPSKDYTSSPSEGYTPSPLEDYMPSPLED

SEQ ID NO: 166039 - protein, 92 aa, Glycine max
  Coding DNA Sequence Number=SeqID_74354
MEESVFQLLLVDHRVVPEDMSRGSGDLGDVRWGAIAQNQGWPIPTQPGHSQSMRTYDVPQQASSWQSTNKGTKVHEAGGLCGDWPTIYLCFI

SEQ ID NO: 166040 - protein, 183 aa, Glycine max
  Coding DNA Sequence Number=SeqID_74355
MEEGFFHGSVPIILGRPFIKTTRTKIDVYAGTLSMEFGEIVDQIVDDYMFDFDSVLHGRKHPFLSDLHTCHSLCIESESEFEFDPTSDFYAESEFEFESGVVPLDIDFLESECTNHVAGSTYTFDLLYEVQAEEPSSSPTMEFNIHLGSTFQPAIQSPKLKFTIDTIIRKPKSSRKGSQSKTL

SEQ ID NO: 166041 - protein, 191 aa, Glycine max
  Coding DNA Sequence Number=SeqID_74356
  Homolog annotation: Hit_ID=A7PY44; Match level="QueryCoverage=45%, HitCoverage=16%, E-value=6e-29, Identity=75%"; Hit description =Chromosome chr15 scaffold_37, whole genome shotgun sequence
MASGSAVGVCQYCHKKIVSFVRQDIAEKLQVEEDTHVEDSQKARENPLGCSSNAYESLLRQKSRAKWLKEGDNNSAYFHKLINFRRHYNGLEGILIHGVWIQNPNEVFDKDIGQDKRLGIVKLPLNDLEPETEKEFELGLLSSLDTQKVKDKKDQGTITIKIFYHQFNKEEQLVALEAEKNIVEERKKLKE

SEQ ID NO: 166042 - protein, 156 aa, Glycine max
  Coding DNA Sequence Number=SeqID_74357
MPLNSVIFVTLADNKLMSVTPSFLSLGGAYPHGIAWLFLYGNGIGLTTEGCRGVWGAASLVKCITKDLGFLRPSSSADCMHMCCSSPPSSPTSSRPWSIICCNRSPTAEHASMLCDTSGCIKQESFSCPPWGITLRAHVMDLRGLPDSTTLTAPPP

SEQ ID NO: 166043 - protein, 29 aa, Glycine max
  Coding DNA Sequence Number=SeqID_74358
MKNGEKREVVAAQLAQESWVASTRRPKWA

SEQ ID NO: 166044 - protein, 275 aa, Glycine max
  Coding DNA Sequence Number=SeqID_74359
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=84%, HitCoverage=7%, E-value=7e-20, Identity=29%"; Hit description=CTV.20
MSLTKFPKIIKKSWADIASESNDDSETNLQNIIQDVSISKTVTNPKGKQTLAKTQTPITKQTNNYIYKNKFSTVLQMEHEFWDMNPFKATVKAFSTGFHFKPSAINKSRIFYELILVDSNSMSIKHFKDPKDQTLNTHSTIQILKVLQPRHFGLDLNKGKKFSVPFDLVGYTYWDYVDVWTKVFWHQNTRFKHSCKTEKTNQYPSLQRHAFVKWWAQFDTSKANPEQVKLWFQSHPEFLKAADPETSVFLNQKSHLAAFLAGSKSKESLTKNLKE

SEQ ID NO: 166045 - protein, 106 aa, Glycine max
  Coding DNA Sequence Number=SeqID_74360
  Gene Ontology: Cellular component=mitochondrion
  Homolog annotation: Hit_ID=Q6YSL1; Match level="QueryCoverage=98%, HitCoverage=95%, E-value=6e-18, Identity=50%"; Hit description =Putative uncharacterized protein orf120
MQDASGMIGRTEARAASFPPRPSLCVGDIKRVHRKRTGTGSIYSMAKHPKHNCTLTRSLPRDRSIRCVGQRARGTCCPPFLLCFENRVNGEWAEGKEVLIRSRTLT

SEQ ID NO: 166046 - protein, 249 aa, Glycine max
  Coding DNA Sequence Number=SeqID_74361
  Gene Ontology: Mol. function=aspartic-type endopeptidase activity; Biological process=RNA-dependent DNA replication
  Homolog annotation: Hit_ID=Q6WAY3; Match level="QueryCoverage=95%, HitCoverage=14%, E-value=2e-14, Identity=25%"; Hit description =Gag/pol polyprotein
MVVISPGKIYQPPFPKWYDPDATCAYHGKTPGHSTERCLALKYKDQPNMKTNPLANHGGGVVNVVKSGRPRIVQAFEGRDDPQESVDEGSFGKPKPLVVYFTRDAAPQTPRYPSVVKPISFSYQNSHAVPWRYVPPSERKEEATDISSLSAKVTNITGLSGVTRSGRVFAPPDLPTQPANVKGKAKIAEEQNDKMIPTPNENIPVKGLSEKKDGCGKKEVLLEEAGEFLRIIQQSEFKIIEQLNKTPAR

SEQ ID NO: 166047 - protein, 89 aa, Glycine max
  Coding DNA Sequence Number=SeqID_74362
QEEVGGICTVRSVDGVIDPPSPDSFKEQVTQGSFIPYGRQDVLTAAIGRPEHPGRVRSAGAGVTIKKYFGSAPRTSCSSSSLPPEELQS

SEQ ID NO: 166048 - protein, 83 aa, Glycine max
  Coding DNA Sequence Number=SeqID_74363
  Subcellular localization annotation: CTP_CleavageSite=63; ConfidenceScore=5.17e-01
TYQGNPCGVYPDLSSFTGSGVYPDLSSLTGSGVYPDLSFFTGSSVYPDLSSLFGSGVIQISVTCIKRSTPTQVHIIWYQSFGS

SEQ ID NO: 166049 - protein, 117 aa, Glycine max
  Coding DNA Sequence Number=SeqID_74364
MKNSGKPSRNRPRKRLESVTKEPRLEFSSRKQFFSLILRENGRSLPSSSPRRAGLLPPEGGAFCWKILEGPSGPNCYLYTHNFTDCALTLPFDSRHVTKLHGLPNNGCQVPRSGQAK

SEQ ID NO: 166050 - protein, 158 aa, Glycine max
  Coding DNA Sequence Number=SeqID_74365
GHPGKILKKDLTTLARVWSVLSYYNLAATSHTSDLTVDRARLIFGLVSCMDMNIGALISGQMTSIPQSNTSRLGFPALITALCRARGVVSDSLTFERLRLVINLSYIRKNYWNPEDLTISIRGVMRARARLAELPSTSAAQTPTSTSAAPSVPAQTDS

SEQ ID NO: 166051 - protein, 76 aa, Glycine max
  Coding DNA Sequence Number=SeqID_74366
MTGMKRMGQDGGIRGRQREEGIDGVEVNIRTFKGTRNPKVYLEWEMKGELVFACSNYNEEIKSQESAGGRYLLGAL

SEQ ID NO: 166052 - protein, 47 aa, Glycine max
  Coding DNA Sequence Number=SeqID_74367
MNSLGSSSSVSCLYKLFYSAWKIFSVRNGWYYPPGAWMNATCEGVDV

SEQ ID NO: 166053 - protein, 314 aa, Glycine max
  Coding DNA Sequence Number=SeqID_74368
  Gene Ontology: Mol. function=protein binding; Cellular component =nucleus; Biological process=ribosome biogenesis and assembly
  Homolog annotation: Hit_ID=A5BE31; Match level="QueryCoverage=100%, HitCoverage=63%, E-value=1e-110, Identity=66%"; Hit description =Putative uncharacterized protein
  Pfam annotation: Domain name=AARP2CN; Domain location=88-168; Score =107.1; E_value=5.3e-29; Accession=PF08142.3; Description=AARP2CN (NUC121) domain
MAKVADLMVFVASARSSCEETDSYYIDSFGNQCLSVFRSLGLPSTAVFIRDLSTDLKQRNELKKMCTSSLASEFPEDCKFYPADTKDELHKFLWLFKEQRLKVPHWRTQRSYLLSQKVDAEYDGNSEKCTLFLTGYLRSRNLSVNQLVHVSGAGDFQLSKIEVLKDPCPLNSRKNQDLMDADEMHDAEVIGSLAPDPQNQEALVVENIPDPLAGEQTWPTEAEIAKADEDKKKKKIKKRSLPHGTSEYQAAWIVDDSDEEESDCDNENDDGMVLDEGEDGFPGQENRYSDFDGDGASLRLGDSDEETDIDSVMM

SEQ ID NO: 166054 - protein, 883 aa, Glycine max
  Coding DNA Sequence Number=SeqID_74369
  Gene Ontology: Mol. function=hydrolase activity, hydrolyzing O -glycosyl compounds; Cellular component=chloroplast; Biological process=carbohydrate metabolic process
  Homolog annotation: Hit_ID=Q9XIS4; Match level="QueryCoverage=94%, HitCoverage=97%, E-value=0.0, Identity=88%"; Hit description=Starch branching enzyme
  Pfam annotation: Domain name=Alpha-amylase; Domain location=250-576; Score=-37.1; E_value=2.2e-07; Accession=PF00128.15; Description =Alpha amylase, catalytic domain
  Pfam annotation: Domain name=Alpha-amylase_C; Domain location=653 -756; Score=103.0; E_value=9.3e-28; Accession=PF02806.9; Description =Alpha amylase, C-terminal all-beta do
  Pfam annotation: Domain name=Isoamylase_N; Domain location=120-204; Score=111.9; E_value=1.9e-30; Accession=PF02922.9; Description =Isoamylase N-terminal domain
  Pfam module annotation: Pfam domain module=Alpha-amylase::Alpha -amylase_C::Isoamylase_N; Domain location=250-576::653-756::120-204
MAESLTIIVRSKQYLATQKPVNLALGYRNPHGYGFSFGSRRSIHERVSSHFKGIAVMTDDKSTMSSTEEDLENIGIFHIDPSLKPYKDHFKYRLKRYVDQKKLIEEYEGGLEEFSQGYLKFGFNREEGGIVYCEWAPAAQEAQIIGDFNGWDGSNHQMEKNQFGVWSIRIPDTDGNSAIPHNSRVKFRFRHGDGVWVDRIPAWIKYATVDPTRFAAPYDGVYWDPPLSERYQFKYPRPPKPKAPRIYEAHVGMSSFEPRINSYREFADEILPRIRANNYNTVQLMAVMEHSYYASFGYHVTNFFAVSSRSGTPEDLKYLIDKAHSLGLQVLMDVIHSHASNNVTDGLNGFDVGQTSQDSYFHTGDRGYHKLWDSRLFNYANWEVLRFLLSNLRWWLEEFKFDGFRFDGVTSMLYHHHGINIAFTGDYNEYFSEATDVDAVVYLMLANCLIHSILPDATVIAEDVSGMPGLGQPVSDGGIGFDYRLAMAIPDKWIDYLKNKNDYAWSMKEISWSLTNRRYTEKCVSYAESHDQAIVGDKTVAFLLMDEEMYSGMSSLVDASPIVERGIALQKMIHFITMALGGEGYLNFMGNEFGHPEWIDFPREGNGWSYEKCRRQWNLVDTDHLRYKFMNAFDRAMNLLDDKFSFLASTKQIVSSADDDDKVIVFERGDLIFVFNFHPENTYEGYKVGCDLPGKYRVALDSDAWEFGGRGRVGHDVDHFTSPEGIPGVPETNFNNRPNSFKVLSPARTCVAYYRVEESQEDDDNNSLVGVEETSAAADVAKIPDESASTESEDIKLDGVKETLAAADVAKIPDESAPLESEDSNLDVVKEPLAAANAEVTKISGELVSVETEGINLDKLEETIVAASVESEVVRDKPEDAAN

SEQ ID NO: 166055 - protein, 176 aa, Glycine max
  Coding DNA Sequence Number=SeqID_74370
  Gene Ontology: Mol. function=electron carrier activity; Cellular component=chloroplast; Biological process=electron transport
  Homolog annotation: Hit_ID=P17340; Match level="QueryCoverage=92%, HitCoverage=98%, E-value=8e-51, Identity=63%"; Hit description =Plastocyanin, chloroplast precursor
  Pfam annotation: Domain name=Copper-bind; Domain location=67-166; Score=193.9; E_value=4e-55; Accession=PF00127.11; Description=Copper binding proteins, plastocyanin
  Subcellular localization annotation: CTP_CleavageSite=52; ConfidenceScore=5.67e-01
MATVTSAAVAIPSFTGLKASAGKVSAAVKVSAPQATRLGIKASLKDVGVAVVATAASAVLASNAMAIEVLLGGDDGSLAFVPNNFSVASGEKIVFKNNAGFPHNVVFDEDEIPSGVDAGKISMSDEDLLNAPGETYSVTLDAKGTYSFFCSPHQGAGMVGKVTSLVDLSCYGLWDE

SEQ ID NO: 166056 - protein, 407 aa, Glycine max
  Coding DNA Sequence Number=SeqID_74371
  Gene Ontology: Mol. function=electron carrier activity; Cellular component=nucleus; Biological process=electron transport
  Homolog annotation: Hit_ID=A7NVM9; Match level="QueryCoverage=92%, HitCoverage=90%, E-value=1e-146, Identity=59%"; Hit description =Chromosome chr18 scaffold_1, whole genome shotgun sequence
  Pfam annotation: Domain name=AhpC-TSA; Domain location=176-302; Score= -15.5; E_value=0.022; Accession=PF00578.12; Description=AhpCTSA family
  Pfam annotation: Domain name=C1_1; Domain location=354-397; Score =3.0; E_value=0.012; Accession=PF00130.13; Description=Phorbol estersdiacylglycerol binding
  Pfam annotation: Domain name=C1_3; Domain location=362-390; Score =22.4; E_value=0.0012; Accession=PF07649.3; Description=C1-like domain
  Pfam annotation: Domain name=Redoxin; Domain location=166-334; Score=- 17.4; E_value=0.085; Accession=PF08534.1; Description=Redoxin
  Pfam module annotation: Pfam domain module=AhpC-TSA::C1_1::C1 _3::Redoxin; Domain location=176-302::354-397::362-390::166-334
MVIAGRQPYGVGHGLGLWSASDTIINVKVSDLEGKVVGLLFAANWYPPCRGFTQVLAGIYEELKSRVPQFEIVYVSSDEDLNAFNSFYGSMPWIAIPFSDLETKKSLTRKFDVEAVPCLILLQPDDRKEHATVRDGVELIYRYGIQAYPFSKDRLEQLQKEDKVKRDNQTLTNLLANHHRDYVLSHTHTGLKKVPVASLVGKTIGLYFSAEWCVPCAKFTPKLISVYEKIKHELAEKGEEDFEVVLISSDRDQASFDSYYSTMPWLALPFGDPEIKNLVRHYNVQGIPWLVIIGPDGKTITVHGRSLINLYQENAYPFTKAKVEELEKQLEEEAKGLPALVYHQGHRHDLNLVSDGNGGGPFICCVCDEQGSSWAYQCLQCGYEVHPKCVRTVERDDNVLVDTTGCF

SEQ ID NO: 166057 - protein, 138 aa, Glycine max
  Coding DNA Sequence Number=SeqID_74372
  Gene Ontology: Mol. function=protein serine/threonine kinase activity; Biological process=protein amino acid phosphorylation
  Homolog annotation: Hit_ID=A7P8H9; Match level="QueryCoverage=74%, HitCoverage=17%, E-value=3e-25, Identity=59%"; Hit description =Chromosome chr3 scaffold_8, whole genome shotgun sequence
MGDHTESCNSGIFNSGWNLSPKQRQKVGVYNEVLCRLRELNVPEAMVPGFEDELWAHFYRLPSRYALDMNVERAQDVLMHKRLLDIARAPTTAFGPAVEVRLVQVLKLGPLTTPFVCGLNDEGFSSYIKRKSSTPNIF

SEQ ID NO: 166058 - protein, 63 aa, Glycine max
  Coding DNA Sequence Number=SeqID_74373
MSLSKFLNKLVHQTKLLSLTVIQQANCYVPHRLIKTEMRHLRPRKRSSSSVAVDVYVPGNNGA

SEQ ID NO: 166059 - protein, 151 aa, Glycine max
  Coding DNA Sequence Number=SeqID_74374
  Gene Ontology: Cellular component=integral to membrane; Biological process=peroxisome organization and biogenesis
  Homolog annotation: Hit_ID=A7NVS6; Match level="QueryCoverage=100%, HitCoverage=32%, E-value=4e-53, Identity=65%"; Hit description =Chromosome chr18 scaffold_1, whole genome shotgun sequence
MEEVVEVKVSGRPRETQSSPGISTPKSPFATRFMSTPLASPMKKAIENMQGYLGEVGRFTKLDPQDDWLPITESRKGNAYYAAFHVLSSGIGFQALVLPLAFTSLGWTWGIICLCVAFTWQLYTLWLLIQLHESDSGVRHSRYLRLAMAAF

SEQ ID NO: 166060 - protein, 314 aa, Glycine max
  Coding DNA Sequence Number=SeqID_74375
  Homolog annotation: Hit_ID=A2YH49; Match level="QueryCoverage=99%, HitCoverage=98%, E-value=2e-26, Identity=27%"; Hit description =Putative uncharacterized protein
  Pfam annotation: Domain name=DUF241; Domain location=72-309; Score =100.7; E_value=4.5e-27; Accession=PF03087.5; Description=Arabidopsis protein of unknown function
MVGVFRRSLSFPNKNPNRPSQQKPHISHHIRSISLPCRSHPLISEIKDEINDLTSWASTSKSNPQTHTTISHGLTLLKDTHETLQHILQLPQTLETLRSHPLWVEKLLEDFLRFVDAFGMFQTSIMSLKEEHSSAQMAIRKRDESRVVAYVKAKKKISKEMEKLVSVLRCVHVTQHQQHSTLQVPSSVVDAQLRHVIADVMSVTVSVSVALFNGIGVSFASRRLSWTQMVRLSRNGGRENNNKEHEGIEELRNGVGMERLQNLKKKGDEEVRLVLKKMRDLEECVCGIETVTEKVFRALINSRVALLNILTLTQ

SEQ ID NO: 166061 - protein, 525 aa, Glycine max
  Coding DNA Sequence Number=SeqID_74376
  Gene Ontology: Mol. function=nucleotide binding; Cellular component =Golgi apparatus; Biological process=regulation of transcription, DNA- dependent
  Homolog annotation: Hit_ID=A7NVT8; Match level="QueryCoverage=87%, HitCoverage=91%, E-value=1e-164, Identity=59%"; Hit description =Chromosome chr18 scaffold_1, whole genome shotgun sequence
  Pfam annotation: Domain name=DUF246; Domain location=116-388; Score =529.5; E_value=3.7e-156; Accession=PF03138.5; Description=Plant protein family
MAHQRRRHHYYQRFRHMIPVFSAVAAALFFLFALLSFLAPSPVETDRIHRRRQHTSVNVQKDDAIDNPAFRVPGDGGKLGRDIWSSLNSEHFFGCSNSSNKFQKAQVITQPNRYLMIATSGGLNQQRTGITDAVVAARILNATLVVPKLDQRSFWKDSSNFSEIFDVDWFISFLSKDVKIIKQLPTKGRKALSAYNMRAVQLSKFDYRLANRFEPDMLAFSGCDYGGGEKEQKELGAIRRRWKTLHRSNPDRARRQGRCPLTPEEVGLMLRALGYGSDIHIYVASGEVYGGERTLAPLKALFPNFHSKETIATKEELEPFSSFSSRMAALDFIVCDESDVFVTNNNGNMAKILAGRRRYFGHKPTIRPNAKKLYRLFLNRSNSTWEAFASSVRTFQKGFMGEPKEVRPGRGGFHENPSSCICEDSAAAKVDKNSQSRKYGKDNTTKKNVANDELDVDNVSEWPDMDDDDDDQNDLAEKGTFNETISDYDALNFEDPEGYQKRAMEVELEDIHSNIAAHKIEFARK

SEQ ID NO: 166062 - protein, 151 aa, Glycine max
  Coding DNA Sequence Number=SeqID_74377
  Gene Ontology: Mol. function=hydrolase activity
  Homolog annotation: Hit_ID=A7QQ68; Match level="QueryCoverage=33%, HitCoverage=6%, E-value=5e-20, Identity=92%"; Hit description =Chromosome undetermined scaffold_141, whole genome shotgun sequence
  Subcellular localization annotation: CTP_CleavageSite=40; ConfidenceScore=5.36e-01
MLSAVIRSALGYPAFTVGTITGTPEVRPSRSSRTRERSSQCSNAPHRIWSELSHDVLNPSSRTALMGEQPNPWNILQPQVAKSRHRGAKPSRRSTALPLGTVGSLRPTFVPARRVGLAVKLPSAFALEGQSPSGPRKPLHASVTFWEAYAP

SEQ ID NO: 166063 - protein, 62 aa, Glycine max
  Coding DNA Sequence Number=SeqID_74378
MSRNFTYCATKGAKYLEAVKQMLPAIKQWSPDEIRIRFVGGGCTNNARQSIRGAPDLKVEDA

SEQ ID NO: 166064 - protein, 138 aa, Glycine max
  Coding DNA Sequence Number=SeqID_74379
MTRGNPGDLQPFDPEIDRTFHRLLRHSVHPDHSMHFEHSEYYVAGDSEHFDFEHSTTNFHTENMAQPPPRERTLREMAALDFTYESLCIQYPDEDVPYVLKTGLIHLLPKFHGLADEDPHKHLKEFHIVYSTTKPPDV

SEQ ID NO: 166065 - protein, 184 aa, Glycine max
  Coding DNA Sequence Number=SeqID_74380
  Gene Ontology: Mol. function=RNA-directed DNA polymerase activity; Cellular component=cell wall; Biological process=RNA-dependent DNA replication
  Homolog annotation: Hit_ID=A2Q4L4; Match level="QueryCoverage=57%, HitCoverage=11%, E-value=3e-12, Identity=33%"; Hit description=RNA -directed DNA polymerase
MCSTFKKFDMLKSVLLLKALLRGFELASGVNINFGKTQFGIIGGGVNWALEAANILHRRQLDYPFFFGGKNMYINIKQKKIAWVSWTQCCASRDAGGLGIKDLRILNNSLLIKWKWYMFHQPEQLWNRILISKYQGCRGLDQGPHKQHFSTWWADLKALNQDHNMTAISKQFCWKMGRGDQILF

SEQ ID NO: 166066 - protein, 131 aa, Glycine max
  Coding DNA Sequence Number=SeqID_74381
  Gene Ontology: Mol. function=magnesium ion binding; Cellular component=cytoplasm; Biological process=Mo-molybdopterin cofactor biosynthetic process
  Homolog annotation: Hit_ID=A8GC11; Match level="QueryCoverage=88%, HitCoverage=28%, E-value=1e-47, Identity=76%"; Hit description =Molybdenum cofactor synthesis domain
  Pfam annotation: Domain name=MoeA_N; Domain location=9-131; Score =117.0; E_value=5.7e-32; Accession=PF03453.8; Description=MoeA N -terminal region (domain I and II)
MDHCHTSDLISLEQALEKMLGQIAPLQQSESVALTAAAGRITAAPVVSPLDVPPFANSAMDGYAVRLADLAANAPLPVAGKAFAGAPFDGQWPANSCVRIMTGAPIPAGADAVVMQSSRGERPGRAFYRAG

SEQ ID NO: 166067 - protein, 154 aa, Glycine max
  Coding DNA Sequence Number=SeqID_74382
  Subcellular localization annotation: CTP_CleavageSite=73; ConfidenceScore=5.12e-01
MGNQQRQGYTQGGFSGFQQGPYNQQGQWRTHPGNQFNQDHSGPSNRPIQQGPNIFKRTTKLEETLTQFMQVTMSNHKNTESAQKNLEVLVGELAKQIADKSSNNFVANKKHNRKEEYKVVMTRSKRFVEVEDEESVVHKKKTADKKGTDCKKNE

SEQ ID NO: 166068 - protein, 50 aa, Glycine max
  Coding DNA Sequence Number=SeqID_74383
MRESEGRSDGLEVPSKAVSEYREREVGKKVASFSKVASNDSACQKAMKAP

SEQ ID NO: 166069 - protein, 191 aa, Glycine max
  Coding DNA Sequence Number=SeqID_74384
GLYIEENHHRLVALERLYERFTTVHNIPLLHDQVKVGFDEVRDANAPIPVPTEEVKLVGQTLNTFLAWPTYLVKRLSEQVMWDATVFGVYNNNFPLYKKHEDLSEIAHDAENADVYGFPEPQSIQRSGQSQFESESYIKNWMQNSRRDVYLGAYLNGAYWKMVIILPKENVVIWFCSLHNRPENYLKGIMN

SEQ ID NO: 166070 - protein, 66 aa, Glycine max
  Coding DNA Sequence Number=SeqID_74385
MEETNGQECEEQGIKALDLLHQWSPLLLEDQWQQNWRRKKDDKRCHFKEKMSQKQARYHRKPWIRA

SEQ ID NO: 166071 - protein, 417 aa, Glycine max
  Coding DNA Sequence Number=SeqID_74386
  Gene Ontology: Mol. function=nucleotide binding; Cellular component =nucleus; Biological process=defense response
  Homolog annotation: Hit_ID=A2Q4E5; Match level="QueryCoverage=98%, HitCoverage=47%, E-value=3e-96, Identity=47%"; Hit description =Disease resistance protein
  Pfam annotation: Domain name=LRR_1; Domain location=154-175; Score =7.1; E_value=15; Accession=PF00560.24; Description=Leucine Rich Repeat
  Pfam annotation: Domain name=LRR_1; Domain location=177-199; Score =10.4; E_value=3.6; Accession=PF00560.24; Description=Leucine Rich Repeat
  Pfam annotation: Domain name=LRR_1; Domain location=201-223; Score =11.6; E_value=2.1; Accession=PF00560.24; Description=Leucine Rich Repeat
  Pfam annotation: Domain name=LRR_1; Domain location=271-293; Score =9.8; E_value=4.7; Accession=PF00560.24; Description=Leucine Rich Repeat
  Pfam annotation: Domain name=LRR_1; Domain location=349-371; Score =8.5; E_value=8.1; Accession=PF00560.24; Description=Leucine Rich Repeat
  Pfam annotation: Domain name=LRR_1; Domain location=373-395; Score =14.9; E_value=0.3; Accession=PF00560.24; Description=Leucine Rich Repeat
  Pfam module annotation: Pfam domain module=LRR_1::LRR_1::LRR_1::LRR _1::LRR_1::LRR_1; Domain location=154-175::177-199::201-223::271 -293::349-371::373-395
MSGNVQCFALFSLYPKDYEFRSFEVVRLWGALGVLASPRKNETLEDVVKQYLDELLSRSFLQDFIDCGTFYQFRIHDLVHDLAVFVTKEECLLVNSHIQNIPENIRHLSFAEYSCLGNSFTSKSVVVRTIMFPNGAEGGNVESLLNTCVSKFKLLRVLDLSYSTCKTLPRSIGKLKHLRYFSIENNRNIKRLPNSICKLQNLQLLSVRGCKKLKALPKALRKLISLRHLKITTKQPVLPYSEITNLISLAHLSIESSHNMESIFGGVKFPALKTLYVADCHSLKSLPLDVTNFPELETLIVHDCVNLDLDLWKDHHEEQSPMLKLKCVGLGGLPQLVALPQWLQETANSLQSLGIINCDNLEMLPEWLSTMTNLKSLVISDCPELISLPDNIHHLTALERLRIAYCPELCRKYQPHV

SEQ ID NO: 166072 - protein, 210 aa, Glycine max
  Coding DNA Sequence Number=SeqID_74387
MLLYKRSWALHLPPLLLLLLLLLLLLLSTRPPGAKRPVVHVDPATGKANSPHRKKLRTYLGIVARDKVDVTYENWKEVPTAQKYLIWEDIQAEFDIPEASDTDQDGVEDTVCEKYDISKEKWAQFCQTRRDLSWEKQNTAPHILSRGGYDYLEQKLLAEKTKKKLEEAAQLGSVDGVIDLPSPVRRHVKWKMARTKKTGEMTTEAAKEIR

SEQ ID NO: 166073 - protein, 156 aa, Glycine max
  Coding DNA Sequence Number=SeqID_74388
MVRSMIDTASGGTLGDMTLVEARNLIEKMASNSQQFSARNDAIVLRGVHELAMNQKSATAPVARVYGLCSSADHHTNLCSSLQQSGVNEQPEAHAANIYNRSPQQKNQQQQNNYNLSSNKYNPGWRNHPNLRWTSPPQQHQLVPPFQNATGPSKPY

SEQ ID NO: 166074 - protein, 95 aa, Glycine max
  Coding DNA Sequence Number=SeqID_74389
MFSKKEGMMRIMKLAKYKLKAQVEKDEGPSGEGQSPRVEKDEGPSNPCGVYPDLSSFTGSGVYPDLSSFTGSGVIQNLRSLYQTIRSYSGSHQES

SEQ ID NO: 166075 - protein, 35 aa, Glycine max
  Coding DNA Sequence Number=SeqID_74390
MAKNIHGFDHENVTEALRKRLGLDFSFFLLLLTNF

SEQ ID NO: 166076 - protein, 97 aa, Glycine max
  Coding DNA Sequence Number=SeqID_74391
  Subcellular localization annotation: CTP_CleavageSite=30; ConfidenceScore=5.13e-01
MYPLLFLVTTTQVDVPSTCTTKDVPSNVLRQSSQAGEGRHKRIQVLSPLFFWKREKRDTKRIQAVSPLFFWKREKRDTKRIQVVSPWQIHFGKGRRE

SEQ ID NO: 166077 - protein, 107 aa, Glycine max
  Coding DNA Sequence Number=SeqID_74392
MACNLCLTASRYLTPIVRVFQQKAVPSGGSNPARLGELGGNHLPLFPYKLGKEGRVISFSPSGVATYPFAGRARQGSRVCLPKEENARSRHQRLFMENVRKTEGNRS

SEQ ID NO: 166078 - protein, 42 aa, Glycine max
  Coding DNA Sequence Number=SeqID_74393
MAFSEGALVLTNMDGEELPLPVNSDIVKGRIVLGSGQMPGRS

SEQ ID NO: 166079 - protein, 142 aa, Glycine max
  Coding DNA Sequence Number=SeqID_74394
  Gene Ontology: Mol. function=endonuclease activity
  Homolog annotation: Hit_ID=Q9AY32; Match level="QueryCoverage=35%, HitCoverage=75%, E-value=4e-19, Identity=96%"; Hit description=RRNA intron-encoded homing endonuclease
QSKSLNEDPLEGKSGASSRVKKLVVGPWVGSIGPPPVCTGRLVPSAGDALLSLTGRVVPPDSDPIVLAFGIGVMINRDSRGHSYFIVRDTVLVSTINDADQGSADVAFRTPLAPYEKSKSLGSGGSMVARLKLKGIDGGHHQ

SEQ ID NO: 166080 - protein, 134 aa, Glycine max
  Coding DNA Sequence Number=SeqID_74395
  Gene Ontology: Mol. function=transporter activity; Cellular component= intracellular; Biological process=transport
  Homolog annotation: Hit_ID=Q6Z661; Match level="QueryCoverage=96%, HitCoverage=21%, E-value=7e-35, Identity=55%"; Hit description =Putative phosphatidylinositol transfer
  Pfam annotation: Domain name=CRAL_TRIO_N; Domain location=45-130; Score=12.9; E_value=0.0038; Accession=PF03765.6; Description =CRALTRIO, N-terminus
MGLGEEVLAQEDERGRCFEPETSEDEWQKSRTRSLRRKAMTASTRLAYSLRKRNTRVANSDFASIFIEDVRDANEEKAVNSFRQVLLTRDLLPDSHDDYHEMLRKFDIEKKVQMWADMLHWRKEYGVDSILQKD

SEQ ID NO: 166081 - protein, 92 aa, Glycine max
  Coding DNA Sequence Number=SeqID_74396
  Subcellular localization annotation: CTP_CleavageSite=81; ConfidenceScore=5.15e-01
MGGATCAARSLHRYAYSLKLSQPTLLRASEARLSGAFSKGGKCAESPPTFICGKRRNNRRKPVIKNIPNSGVVFTFEEGISTSHVCPKGQQP

SEQ ID NO: 166082 - protein, 71 aa, Glycine max
  Coding DNA Sequence Number=SeqID_74397
MGAKYLEVAKRGSHPNNGWSPDEIRIICHHHDICISVSHVTASPYSLSFTLSIFREKTKHGSKLDESKTHQ

SEQ ID NO: 166083 - protein, 224 aa, Glycine max
  Coding DNA Sequence Number=SeqID_74398
  Gene Ontology: Mol. function=chlorophyll binding; Cellular component =integral to membrane; Biological process=photosynthetic electron transport
  Homolog annotation: Hit_ID=Q2MI75; Match level="QueryCoverage=78%, HitCoverage=34%, E-value=2e-97, Identity=98%"; Hit description =Photosystem II P680 chlorophyll A apoprotein
  Pfam annotation: Domain name=PSII; Domain location=1-171; Score= -43.4; E_value=8.6e-10; Accession=PF00421.10; Description=Photosystem II protein
MDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKNSCCEGCPKAIYKAYPVKLTSKPDIEMAIRVAVSIIRILKFQDHNRSIG

SEQ ID NO: 166084 - protein, 122 aa, Glycine max
  Coding DNA Sequence Number=SeqID_74399
MDAILHLHQEHQANVHSSLENITTRLENIETRLSLSNLLNLNEDEAYLFLSVKELFRIRLRIMSSIQSQDFPNALNVVFKFSIIKAKKGEIVRDRGSNMVNNLRLKLVKLEEVLNKFWLLHA

SEQ ID NO: 166085 - protein, 20 aa, Glycine max
  Coding DNA Sequence Number=SeqID_74400
MATLQGCALMRTGINRVFLN

SEQ ID NO: 166086 - protein, 225 aa, Glycine max
  Coding DNA Sequence Number=SeqID_74401
AEFDVPEASDTLAAYKDNVDDTICEKYGPPSPIRQHVKWKMARTKKTRQMMSEAANKNAEKIASQGSFVPHGREDVLTAAIGRPEHPGHVRVAGVGVTIKQYFGSATWTSHTSSSMTPEELKQLTQQIRDQLEESITKKPKVGPSAARVSTKGSCVDPSPTDHDTGDSDKCGLYIEENPSRLVALGRIYEGSIAVHNIPLLHGQVKVGVEEVKDAEALVPVPTDE

SEQ ID NO: 166087 - protein, 19 aa, Glycine max
  Coding DNA Sequence Number=SeqID_74402
LVESIFQPMLARFFYQRGL

SEQ ID NO: 166088 - protein, 145 aa, Glycine max
  Coding DNA Sequence Number=SeqID_74403
  Gene Ontology: Mol. function=transcription factor activity; Cellular component=nucleus; Biological process=regulation of transcription, DNA-dependent
  Homolog annotation: Hit_ID=A5AVA4; Match level="QueryCoverage=95%, HitCoverage=99%, E-value=3e-32, Identity=51%"; Hit description =Putative uncharacterized protein
  Pfam annotation: Domain name=AP2; Domain location=19-71; Score=85.6; E_value=1.6e-22; Accession=PF00847.11; Description=AP2 domain
QKKGMEEHQKGKLQGKEEVRFRGVRRRPWGKYAAEIRDPSKQGSRLWLGTFDTAEEAARAYDRAAFNLRGHLAILNFPSEYYSQIRGSPPYPPHLATPSSSSHASESTSSAAQQRHVFEIPCLDDKVLEDLLGLSEEHKKKKKGD

SEQ ID NO: 166089 - protein, 276 aa, Glycine max
  Coding DNA Sequence Number=SeqID_74404
  Homolog annotation: Hit_ID=A7NX31; Match level="QueryCoverage=78%, HitCoverage=20%, E-value=1e-97, Identity=83%"; Hit description =Chromosome chr5 scaffold_2, whole genome shotgun sequence
MAVAIALIPPSVILFMGGGCSAPLSRIDYLAYDMNHMMNISIDFFDLIIVWSVADTLHRFWKKEHDWGWKKFMELSKVYDGFVDSSDNLIIKAQVQVIREKSDRPFRCLDCQYRRELVRVYLTNVEQICRRFVEERRSKLGKLIEDKARWSSFFTFWREIDQTSRHHMSREKTDVILKVVVKHFFIEKEVTSTLVMDSLFSGLKALEGQTKSKKGRVKLLDAEEIPAPIVHVEKDMFVLVDDVLLLLERAAIEPLSPKDEKCPQNRTKDVTWSQIT

SEQ ID NO: 166090 - protein, 75 aa, Glycine max
  Coding DNA Sequence Number=SeqID_74405
MWSQGTEFWLMARINRKSQYDLGNSCPKSIMLKISNVNLRVLRLSNANLRFKPKTLIKWAIHDDFVTEIGKERRK

SEQ ID NO: 166091 - protein, 539 aa, Glycine max
  Coding DNA Sequence Number=SeqID_74406
  Gene Ontology: Cellular component=integral to membrane
  Homolog annotation: Hit_ID=A9P935; Match level="QueryCoverage=95%, HitCoverage=83%, E-value=3e-70, Identity=39%"; Hit description =Putative uncharacterized protein
  Pfam annotation: Domain name=Mem_trans; Domain location=9-537; Score =112.2; E_value=1.5e-30; Accession=PF03547.9; Description=Membrane transport protein
MELWKLFVTALMPVLKVLLITAVGTFLALHRFNILRESARKHLNTIVYFVFTPALVCSILAKTTTFKSLVAVWFMPLNILLTFIIGTTLGWLFMKITKAPPDMQGLVLGCCAAVCKESSSPFGAVDVCNKKGMAYASLSMAVGHIYIWTFVYNIIRVYSCRIFNVNKVDDSTVGPAAIETDLENYSTRPVVTAEDLSQTNDHVSQFGSECALPGGRDRMSLCPNIFGNVDTLCALVLQILGLIIGVVPPFQKMFVGDDAPLRVIEDSASMLGDASIPAITLLVGANLLDGLKRSGMKLSLVVGIIVVRYIALPILGVGIVKGETHSASAPEKQPLWKPLSPFGANFRSSSFHGAEECAVCKECSSPFGAVDVCNEKGMAYASVLGSPVSAIETDLESHSTVPVVASEVLSETNDHVTTLPGGRAKILGLIIGVVPPFRKMFVGDNAPLSVVEDSASMLGEASIPAMTLLLGANLLNGLKRSGMKFSLLMGITVIRYIALPILGVVIVKGAIHFGIIHHDPLYQFVLLLQYVLPPATRRQ

SEQ ID NO: 166092 - protein, 100 aa, Glycine max
  Coding DNA Sequence Number=SeqID_74407
  Homolog annotation: Hit_ID=O22789; Match level="QueryCoverage=92%, HitCoverage=86%, E-value=1e-11, Identity=47%"; Hit description =Putative uncharacterized protein At2g33390
MDTKKSTKDTNGCVNKPMALTMTLTVASLEGRKVEDRNKEDDSDSNSLLPLRKGGISRKSDKTYRKRKVQWNDRIGNKLVEVLEYEPRASDTSQSHVVNK

SEQ ID NO: 166093 - protein, 513 aa, Glycine max
  Coding DNA Sequence Number=SeqID_74408
  Gene Ontology: Mol. function=binding; Cellular component=nucleus; Biological process=metabolic process
  Homolog annotation: Hit_ID=A7NSY3; Match level="QueryCoverage=87%, HitCoverage=91%, E-value=0.0, Identity=46%"; Hit description =Chromosome chr18 scaffold_1, whole genome shotgun sequence
  Pfam annotation: Domain name=PPR; Domain location=147-181; Score =42.1; E_value=2e-09; Accession=PF01535.11; Description=PPR repeat
  Pfam annotation: Domain name=PPR; Domain location=182-216; Score =12.4; E_value=0.27; Accession=PF01535.11; Description=PPR repeat
  Pfam annotation: Domain name=PPR; Domain location=218-252; Score =15.5; E_value=0.11; Accession=PF01535.11; Description=PPR repeat
  Pfam annotation: Domain name=PPR; Domain location=284-318; Score =16.0; E_value=0.097; Accession=PF01535.11; Description=PPR repeat
  Pfam annotation: Domain name=PPR; Domain location=46-80; Score=44.2; E_value=4.5e-10; Accession=PF01535.11; Description=PPR repeat
  Pfam module annotation: Pfam domain module=PPR::PPR::PPR::PPR::PPR; Domain location=147-181::182-216::218-252::284-318::46-80
EARRVFDKMPVKDLVSWNAILSGCVNARRIEEANSIFREMPVRSLLTWTVMISGLAQNGFGEEGLKLFNQMKLEGLEPCDYAYAGAIASCSVLGSLDNGQQLHSQIIQLGHDSSLSVGNALITMYSRCGLVEAADTVFLTMPYVDSVSWNAMIAALAQHGHGVQAIQLYEKMLKEDILPDRITFLTILSACSHAGLVKEGRHYFDTMRVCYGITPEEDHYSRLIDLLCRAGMFSEAKNVTESMPFEPGAPIWEALLAGCWIHGNMELGIQAADRLLELMPQQDGTYISLSNMYAALGQWDEVARVRKLMRERGVKKEPGCSWIEVENMVHVFLVDDAVHPEVHAVYRYLEQLVHEMRKLGYVPDTKFVLHDMESEQKEYALSTHSEKLAVVYGIMKLPLGATIRVFKNLRICGDCHNAFKYISKVVDREIIVRDRKRFHHFRNGECSCSNYCLKDGNLPSTNPPLLHMDDRVHYCYIKSLTIFNFCFKRLLALTIASGTVIQFSGAQFKCPGR

SEQ ID NO: 166094 - protein, 102 aa, Glycine max
  Coding DNA Sequence Number=SeqID_74409
MSMFVERNSDSASSSFKPRVEGTHLDSTLEKLSTVKLLTHRTRCRCPRLGHARPTGALGRALRAGALTRALGVGVLARIAVTDTSLFYNNIKLLIVVEDNYR

SEQ ID NO: 166095 - protein, 173 aa, Glycine max
  Coding DNA Sequence Number=SeqID_74410
  Gene Ontology: Mol. function=shikimate kinase activity; Cellular component=transcription factor TFIID complex; Biological process =transcription from RNA polymerase II promoter
  Homolog annotation: Hit_ID=A7NZE8; Match level="QueryCoverage=67%, HitCoverage=60%, E-value=9e-39, Identity=67%"; Hit description =Chromosome chr6 scaffold_3, whole genome shotgun sequence
MARGRRQTSGDWKDNRVHCSSRSHPAPPHQYILSLELEIMSGFLSLVSKVCDELEDVMEAGGNIVDYHGCVFFPERWFNCVVVLQTDNTILYDRLSRSGFIIIAYFPRICDRGYKDSKLSNNIECEIFQVLLKESYSEEKVIAMKSDNIEDISRNDATLTDWVRNWSLPSQTS

SEQ ID NO: 166096 - protein, 573 aa, Glycine max
  Coding DNA Sequence Number=SeqID_74411
  Gene Ontology: Mol. function=receptor activity; Cellular component =mitochondrion
  Homolog annotation: Hit_ID=A7NX45; Match level="QueryCoverage=98%, HitCoverage=98%, E-value=0.0, Identity=64%"; Hit description =Chromosome chr5 scaffold_2, whole genome shotgun sequence
  Pfam annotation: Domain name=DUF668; Domain location=404-493; Score =190.7; E_value=3.6e-54; Accession=PF05003.3; Description=Protein of unknown function (DUF668)
MVAEAWIVKMGNQVSANLKHALLLEPSAKRKHNPKSQDNKELIGILSFEVANVMSKIVHLHRSLSEPEIVKLKNEISNSQGVQNLVSSQEGYLLGLARAEKLEELNRVANVVSRLGKKCSLPALQGFEHVYGDIVSGVIDVRELGFLVKHMEGMVRKMDRYVSATRSLHSEMGVLNDLEQAVKKFQHNLHEESRRAFEQKLTWQKQDVRHLKEISLWNQNFDKVVELLARTVCTIYARICMIFGDSTWRKSNSLGLSGGSPSPTLQNECGLVSGQISVPVSSEKLKSNHGKRNGRTAVETRETISRPMRRGELAYLQIEDFGFPCGTSPGRLFMDCLSLSSSDQHDRGSISQSIGVGNKAKKRDHLYHSGCPNHVQSGVPFTEDLSCSTFGPQSRLSVYAPPSTLGGCALALHYANVITVMEKLLRYPHLVGEEARNNLYQMLPTSLRLSLKGKLKSYVKNLAIYDAPLAHDWKVTLDGILKWLAPLAHNMIRWQSERNFEQHQIVSRTNVLLFQTLYFADKDKTEEAICQLLMGLNYICRYEQQQNALLGCASSFDFEDCMEWQLQCGAFPS

SEQ ID NO: 166097 - protein, 235 aa, Glycine max
  Coding DNA Sequence Number=SeqID_74412
MASRKRKSTTYKPQAQNVKIYHTEFDEFKAELERHNLHKRLTNFQDGSIDVIVVKEFYANLYSPKDQSPKQVRVRGHLIKIDANSLNTFLETPVVLEKGETLPTYSRFTRMRIDPQEFSGHLCIPDMECPLLQQPDSHFPTSDLNMDKARLVYNLVTGMDMNIIALISGQISTIAQSNSSRLEFTTLITALCGARGVTSNSLTYESLILAINLAYIKKNCWNVDDLTINFRGARK

SEQ ID NO: 166098 - protein, 123 aa, Glycine max
  Coding DNA Sequence Number=SeqID_74413
MAASDIAILRDKTHIPTKKSLLELTSQDVLLAQNKFLSKQLEALTKTLRCAICGRAHNFGCCIPNEEPAHKVNYMGNQPTQNFNAGGYSGFQHGKPYNSQQRQWKIHLGNQFNKDQGGPSTRP

SEQ ID NO: 166099 - protein, 141 aa, Glycine max
  Coding DNA Sequence Number=SeqID_74414
MMAHQNPPYLAFCTPGQNETKNKIQGYQRETNKNIHIFLNEHQGMKGMEKVKTKGAPKKPLAKQQKSTKRDSSYWEILFVATYPSAGGRRETRGMRVPRKEYARSRHQRLFEENVGKTGKDAIYELLSERFGSCIYARGRY

SEQ ID NO: 166100 - protein, 234 aa, Glycine max
  Coding DNA Sequence Number=SeqID_74415
MVQKKDKELRGSNNEPIGDYRRWLKAHMQGLDWLPSLRTTKGMEVEGLEEDEEVEALRAELEKAQTLPPRPWNERPKGPVGKNMAGTNSEGLCGGNNSELKLWREERDQSRVDNLILKDELKVCLRSKRSLSQRLCETETNMLAIISKYQEELNLATAHEHKVADEYARVYVEKEARGRVIDSLHQEATIWMDRFALTMNRSQELPRWLAKAKAMAETYSAPEEIHIFSAIAII

SEQ ID NO: 166101 - protein, 207 aa, Glycine max
  Coding DNA Sequence Number=SeqID_74416
MASMMEAMLSMKRLIESNMAMVASTSTVAKADPTHLSTTNDAHQPASDMGGRGGEILGSTDSLHLGYNINAYPYGLPPNFTLPTMHENVDHAVPITFKGQLPQPIGGTRKEPQERAQVDIDSYPSFTTKGPTFHAMPQPNTVGAFQPRPIQPLHFSVGGPPLTTEGKGKLDLIEERLRAVDGFSDYLFANMTNLCLVSDVVIPPKFK

SEQ ID NO: 166102 - protein, 78 aa, Glycine max
  Coding DNA Sequence Number=SeqID_74417
GEEFCYTRLDEIVDVVAVDEDDNLMDRVQGELKVLVCDEKHNPYSRQTDISSAVSLLTGSLDEGVEKKVEGLGNKGEW

SEQ ID NO: 166103 - protein, 18 aa, Glycine max
  Coding DNA Sequence Number=SeqID_74418
MEFPLGNKEFEEAMNLEV

SEQ ID NO: 166104 - protein, 49 aa, Glycine max
  Coding DNA Sequence Number=SeqID_74419
KDDDKGDDKKLKGQSKNVKDQASKNQDQDSRLNRRLNQDKYEKVFSETE

SEQ ID NO: 166105 - protein, 16 aa, Glycine max
  Coding DNA Sequence Number=SeqID_74420
MEIKITKEQIKGLVVV

SEQ ID NO: 166106 - protein, 111 aa, Glycine max
  Coding DNA Sequence Number=SeqID_74421
MSSVIACLQRRQCPHLHFEDKNVFSHCMPSKATMSSSTFRRRQCLHSLHVFKGDNILIYISKTKISSVIACLQRRQYPHLHFEDDNVFSHCMPSKGDNFFICILKTTMSSP

SEQ ID NO: 166107 - protein, 90 aa, Glycine max
  Coding DNA Sequence Number=SeqID_74422
  Subcellular localization annotation: CTP_CleavageSite=42; ConfidenceScore=5.72e-01
MQRNSLASSSDTSFLPQPSLFSGRPFTGVATYPSVGGRRVTRGMRVPRKEYARSRHQRLFEENVGKTGKDAIYDLLSERFGSRIYARGRY

SEQ ID NO: 166108 - protein, 255 aa, Glycine max
  Coding DNA Sequence Number=SeqID_74423
  Gene Ontology: Mol. function=hydrolase activity, hydrolyzing O -glycosyl compounds; Cellular component=cytoplasm; Biological process= carbohydrate metabolic process
  Homolog annotation: Hit_ID=Q6CYS3; Match level="QueryCoverage=100%, HitCoverage=53%, E-value=1e-113, Identity=71%"; Hit description=6 -phospho-beta-glucosidase
  Pfam annotation: Domain name=Glyco_hydro_1; Domain location=1-254; Score=-86.0; E_value=2.3e-14; Accession=PF00232.9; Description =Glycosyl hydrolase family 1
MPYHLVKEYGGWANRKVVDFFVRFSDVVMTRYRHKVKYWMTFNEINNQRNWQYPLFGYCCSGVVFTEHEKPEQTMYQVMHHQFVASAKVVKRGHEINPDFQIGCMIAMVPVYPFSCHPDDVMRAQESMHQRYVFSDVQMRGAYPAYTLKEWARKGYHIAMEADDAETLRQGCCDYIGFSYYMSNAVDTKASGVDDPITGFDGVVPNPHVKASDWGWQIDPVGLRYVLNALYERYQKPLFIVENGFGAIDKHNAEG

SEQ ID NO: 166109 - protein, 134 aa, Glycine max
  Coding DNA Sequence Number=SeqID_74424
  Homolog annotation: Hit_ID=UPI00006A2D9E; Match level="QueryCoverage =91%, HitCoverage=85%, E-value=1e-09, Identity=15%"; Hit description =UPI00006A2D9E related cluster
GLHVLAIRGPRVLAFRGLHALAIRGLHVLAIRGLHALAFRGLHALAIRGLHVLTFRGLHSLTFRGLLVLAFRGLHALAFRGLHALAFKGLHALAFRGLHALTFRGLHVLAFRGLHALVFRGLHVHMVACMTSFV

SEQ ID NO: 166110 - protein, 237 aa, Glycine max
  Coding DNA Sequence Number=SeqID_74425
KGKTRQRKVQVTRYTHPERSALSYKRKTRPLQEPLNKKPKGPARRNMAEINFEELCREELAAYARSKRSLAQHLEATEQSMLAIIGQYKEELNQSVTHEEKLVEDFAQAYAEKEARGRVIDALHQEATMWMDRFALTLSQDLPRLLAKVKAIAEADLLALKDQMASITEAMLKLQKTLEDNATVTASNTVREAEPVLQPAINLGRDRNTTVFGRRYSPQAYPYGLPPDFTPRAALED

SEQ ID NO: 166111 - protein, 70 aa, Glycine max
  Coding DNA Sequence Number=SeqID_74426
MPSKIILMMPKNQELRKFQRFKNQVSRIKIQESSFKIQEQSRSRFKTQDSRIKRRLNSDKYQKKVFQNIE

SEQ ID NO: 166112 - protein, 40 aa, Glycine max
  Coding DNA Sequence Number=SeqID_74427
MVNVGSVADRSKAKRNCFTDQKEQYGFHLKEPKNSNNNLT

SEQ ID NO: 166113 - protein, 136 aa, Glycine max
  Coding DNA Sequence Number=SeqID_74428
  Pfam annotation: Domain name=Transposase_23; Domain location=51-121; Score=7.4; E_value=0.00018; Accession=PF03017.5; Description =TNP1ENSPM transposase
MASFSQMQSQLQSQMQSQELALPPEPEVGPSAARVSTKRSCVDPSPADPETGDSDKCRLYIKENPSHLVALGRFYEGSTVVHNIPLLHGQVKVGVEEVKDVEAPVPVPTNEVQLVGQALNTFLAWQTHLVKRVSEH

SEQ ID NO: 166114 - protein, 98 aa, Glycine max
  Coding DNA Sequence Number=SeqID_74429
MQKRYVHYDAVKRGMMQSRNMLEDIIPFEKHITTVGTTSNNMLSKRKTLDEGSLLSSKSETQHDHRFTSTPYVPMDPGIGPLFNSPCVQKGVDVVCIK

SEQ ID NO: 166115 - protein, 94 aa, Glycine max
  Coding DNA Sequence Number=SeqID_74430
  Homolog annotation: Hit_ID=Q51617; Match level="QueryCoverage=43%, HitCoverage=59%, E-value=1e-14, Identity=95%"; Hit description =Putative uncharacterized protein
  Subcellular localization annotation: CTP_CleavageSite=77; ConfidenceScore=5.29e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARR

SEQ ID NO: 166116 - protein, 113 aa, Glycine max
  Coding DNA Sequence Number=SeqID_74431
  Subcellular localization annotation: CTP_CleavageSite=36; ConfidenceScore=5.22e-01
MVRCLPNAGPKGSFTYHAPTFMYSYTQKQTLVPRPKQGNGGNAACPPFSEHNLGLRPLPTTLQLNKNKQQSKDKMPRGFEHAWANEASKYTNGKLGSQRMRYLLVGVSMSTKK

SEQ ID NO: 166117 - protein, 172 aa, Glycine max
  Coding DNA Sequence Number=SeqID_74432
MRLRIAATSVVAKVNPTSPSGLKQMNHPTSNMVGKDLGKTHEIPHHNLANFEPWLGYTTEGQAVGGIPLQNPLEGPQYHPQLHLLHSTAVKTPYDYGRNGKVGSSRGKAQGIEGGEDYAFANLEELFLIPKHGHSQVQGAGLWQVQGDYSLQEPSLLCTVGRWGHTQKMRNC

SEQ ID NO: 166118 - protein, 71 aa, Glycine max
  Coding DNA Sequence Number=SeqID_74433
GVAIFRNLPSSGGTKRPLGWAKNVSSIEGKCVGSPPTHGEGISTPRAHHKGRQPLIEWVDKGVVLTPMYPQ

SEQ ID NO: 166119 - protein, 143 aa, Glycine max
  Coding DNA Sequence Number=SeqID_74434
MPFKVILMMPKNQELSKVSSKDPRIKFQESRFNNNQDQDSRLKILESRRRLNQDNTRSFHKIITKEFYSLLIDYQKRVHLLGDCYAENKRGYISCGSVHVEGTSTWVFKENKGGYSPCGSLACKGFYMVERNLKNHRLLGDWI

SEQ ID NO: 166120 - protein, 27 aa, Glycine max
  Coding DNA Sequence Number=SeqID_74435
GVMAGRNDHAIADALQALAQAIGNPNR

SEQ ID NO: 166121 - protein, 425 aa, Glycine max
  Coding DNA Sequence Number=SeqID_74436
  Gene Ontology: Mol. function=transporter activity; Cellular component= membrane; Biological process=sodium ion transport
  Homolog annotation: Hit_ID=A7MGM5; Match level="QueryCoverage=100%, HitCoverage=88%, E-value=0.0, Identity=83%"; Hit description =Putative uncharacterized protein
  Pfam annotation: Domain name=MFS_1; Domain location=15-380; Score =35.0; E_value=2.7e-07; Accession=PF07690.7; Description=Major Facilitator Superfamily
MKGAALSFREKLGYGMGDAGCNMIGGAIMLFLNYFYTDVFGLAPALVGTLLLSVRVLDAVTDPIMGAIADRTQSRWGRFRPWLLWISLPYVLFSVLMFTTPDWSYDNKVIWAFVTYFLMSLTYTAINIPYCSLGGVITNDPGERVSCQSYRFVMVGIATLILSLSLLPMAEWFGGDNKARGYQLAMSVLALIGLVMFLFCFATVRERIRPAVPSNDDLKKDLRDVWKNDQWVRILLLTFCNVCPGFIRMAATMYYVTWVMGQSTHFATLFISLGVIGMMLGSTLAKVLTDRWCKLKVFFWTNIALALFSSGFYWIDPHATVTVVIAYFLLNILHQIPSPLHWSLMADVDDYGEWKTGKRITGISFSGNLFFLKVGLAVAGAMVGFLLSMYGYDAAAKQQSASALNGIVLLFTLIPGVGYLITAGV

SEQ ID NO: 166122 - protein, 99 aa, Glycine max
  Coding DNA Sequence Number=SeqID_74437
  Subcellular localization annotation: CTP_CleavageSite=18; ConfidenceScore=5.08e-01
MWALSLSLQVAGVATYPSAGGRRGAHGCIFHGRKMRGVATNVYLRKTSEKPERCGLRTLSVKGSGVVFTHGEGCFPRSYVSSIAMRKSDLHSSFRTKRG

SEQ ID NO: 166123 - protein, 200 aa, Glycine max
  Coding DNA Sequence Number=SeqID_74438
  Homolog annotation: Hit_ID=A7QLB6; Match level="QueryCoverage=83%, HitCoverage=25%, E-value=3e-24, Identity=34%"; Hit description =Chromosome chr11 scaffold_118, whole genome shotgun sequence
  Pfam annotation: Domain name=XS; Domain location=3-111; Score=32.7; E_ value=3.5e-09; Accession=PF03468.5; Description=XS domain
MCWKGSIVAYIFGKPKHEPVECDSMYWLRKFEQYKPEGAYVLHCAEDPTGYVVLEFGTEWTGFMQMMKLDRDFLVDHHGKKDYYESRKMGYSSGLFGWCAQAEDYNSEGLVGNFLRQKAELKTTLMVAQESLNEKTETLDHLYGEIGSVNKKISEMESKYIKDYMSLDKMMKEIEKKRDLLHQTRAEELAVTIGGFKCAM

SEQ ID NO: 166124 - protein, 86 aa, Glycine max
  Coding DNA Sequence Number=SeqID_74439
  Subcellular localization annotation: CTP_CleavageSite=55; ConfidenceScore=5.48e-01
MLVATPRTFPPLESAPVSLAFARPQKGTLRQLATPLGTFLFPNRGKEQTRSVPFVLMHFLGSRKIHLVFLTAHMGHCAPQMRNKER

SEQ ID NO: 166125 - protein, 26 aa, Glycine max
  Coding DNA Sequence Number=SeqID_74440
MSRLFNGNSTFNIGADVRNDVEICSF

SEQ ID NO: 166126 - protein, 112 aa, Glycine max
  Coding DNA Sequence Number=SeqID_74441
ELLLLPGIGPKIAHLGQCPRDMCRYSCAPHLQSSWEGTDEAKATWENVAEFQANFPNFNLEDKVVLKGDGIVMLSDKRKLLEGKNDSIETTQQRGIFAKSHVSTMGNRKSVK

SEQ ID NO: 166127 - protein, 54 aa, Glycine max
  Coding DNA Sequence Number=SeqID_74442
MTFSRGYEIGHEFCLTGYEIDSLKAKYLPMHAVDFSNIFKMTLPGLKLNLKTTK

SEQ ID NO: 166128 - protein, 312 aa, Glycine max
  Coding DNA Sequence Number=SeqID_74443
  Homolog annotation: Hit_ID=Q6WAY6; Match level="QueryCoverage=78%, HitCoverage=43%, E-value=4e-15, Identity=26%"; Hit description =Putative uncharacterized protein
MEGRTRVLISCGGFPNVPLMGTRGCISYNPVLAIRQLGYPMRGAPLEDELTPIISRGFNKTNVETLQKVRKAWEVLQKKDKELRGNNNGPISGYRKWLRAHVQGLDWLLSLRTAKREEVKAPEEDEEVQVLRAELEQAQTVKERFKSAALKIRKENAEIRDMNVATTKALEQETKRARKEEHGRNKFRGALWGSNSELKLWREERDQSRVDSLILKDELKTSMLAIVSKYQEELNLATAHEHRLADEYAQVYAEKEARGRVIDSLHQETTMWIDRFALTLNESQELPRLLAKAKVMADTYSAPEEIHGLLSY

SEQ ID NO: 166129 - protein, 124 aa, Glycine max
  Coding DNA Sequence Number=SeqID_74444
MAYSPTSKAKPTLDASSDEDDSHPEDTVNSYDEEVIFESREDLIKWYNQLLFASTRVSKSYNKLNKCFQQLGREHEDPKKAHQVHLVDFILEATLPNSVQDAFVCEEVKALLDEKGIQWTKNSS

SEQ ID NO: 166130 - protein, 380 aa, Glycine max
  Coding DNA Sequence Number=SeqID_74445
  Homolog annotation: Hit_ID=A2Y0I4; Match level="QueryCoverage=80%, HitCoverage=42%, E-value=4e-32, Identity=33%"; Hit description =Putative uncharacterized protein
  Pfam annotation: Domain name=XH; Domain location=164-308; Score =113.0; E_value=8.8e-31; Accession=PF03469.5; Description=XH domain
MESLILATEKQMKARSDVLSLLEKHQMEKKAVSDALLKLEKEMGNEQKLNLEIAELEEQLKVLKCVNLEEADHENKRKIEIEEIEEKLEDMIFDMSVKDDENQALKKKVQEAKIELEDARQQIIKLLAVGTVLSQLMFSVQKLIECICLTIQELPQFLKGVTKIQIKKIGEVSARSFKKVCMNRYKNNKKASSESVKLCAKWQKEILDSTWHPFKIVDVEGKEIQEEIDENDPKLLSLKNDLGEEAYVAVVTALKELHEYHNSDDAENTHNSSEKQVIPEIWDSENGRRATVTEALKYISNRVIKMRKIYSVGNGVGIACMKEETKRIKGKEKKIQMRKMEKEKIEGENTEGENTTTDKTQEREERVMDKIHTIMSIKRN

SEQ ID NO: 166131 - protein, 76 aa, Glycine max
  Coding DNA Sequence Number=SeqID_74446
MNIFAVEYSPSAFSLNEFGTIGLSLDLGKSFSSFLEFVGRSQGHRKHNGQRSGIPAGTRSTMEGEVEFEQPLAIKI

SEQ ID NO: 166132 - protein, 257 aa, Glycine max
  Coding DNA Sequence Number=SeqID_74447
  Homolog annotation: Hit_ID=A3B031; Match level="QueryCoverage=86%, HitCoverage=11%, E-value=1e-21, Identity=31%"; Hit description =Putative uncharacterized protein
  Pfam annotation: Domain name=XH; Domain location=164-255; Score= -34.8; E_value=0.0052; Accession=PF03469.5; Description=XH domain
MESLILATEKQMKARSDVLSLLEKQEMEKKAVSDALLKLEKEMGNEQNLNLEIAELEEQLKVLKCVNSEEANHENKRKIEIEEIEEKLEDMIFDMSVKDDENQALKKKVQEAKTELEDARQQIIKLLAVGIVLSQLMLSVQKLIECICLTIQELPRFLKGVTKIQIKKFGEVSARSFKKVCMNRYKNNKKASSESVKLCAKWQKEILDSTWHPFKIVEVEGKEIQNIYIGSKTDVESDDVECMNVNIGFGDPMLTYI

SEQ ID NO: 166133 - protein, 35 aa, Glycine max
  Coding DNA Sequence Number=SeqID_74448
RIASSGKCLYVIRKGMYWLRPLPRGATHMYLSQGL

SEQ ID NO: 166134 - protein, 158 aa, Glycine max
  Coding DNA Sequence Number=SeqID_74449
  Homolog annotation: Hit_ID=A7NYZ4; Match level="QueryCoverage=48%, HitCoverage=10%, E-value=4e-09, Identity=39%"; Hit description =Chromosome chr6 scaffold_3, whole genome shotgun sequence
  Pfam annotation: Domain name=XH; Domain location=53-158; Score=6.8; E_ value=6.1e-07; Accession=PF03469.5; Description=XH domain
MEKRARKGFTEKKKAREARVNGEEGSASEIGRFKSFSSSARSNVIMSLYYRSHKHMIIVCYNQTGIICKTWHVICREVIDENDPKLLSLKNDLGEEAYVAVVTALKELHEYHNSDDAKNTHNSSEKQVIPKIWDPQNGRRATVTEALKYISNRVIKMR

SEQ ID NO: 166135 - protein, 44 aa, Glycine max
  Coding DNA Sequence Number=SeqID_74450
MASTVYGKWENSWYSECRPCQHEMPLKIGFLPSNGRGPIAQYIT

SEQ ID NO: 166136 - protein, 155 aa, Glycine max
  Coding DNA Sequence Number=SeqID_74451
  Subcellular localization annotation: CTP_CleavageSite=28; ConfidenceScore=5.60e-01
MPPKASSTSFQGGRSCRKDFKLALLEPSSNKISPSKTRSLTQSGSSTQKCKQQDGSFTLLVEIKPKSSTQEPSKNQTSKQAKADYAFPIKTLLALQEIGLTKIPKKTWADIASESDDESEIDLKTLIQKAKGTKIICNSPKEKQIINGNTSPKTH

SEQ ID NO: 166137 - protein, 71 aa, Glycine max
  Coding DNA Sequence Number=SeqID_74452
MIELQHKGFTPMPRKGKSAEPQVVGANEDQPDDCGMKKDIEHMGTYLLSENFSSAASQRLKTQRHSALQGL

SEQ ID NO: 166138 - protein, 106 aa, Glycine max
  Coding DNA Sequence Number=SeqID_74453
MRVTPRPTVRVRPKVIVLILRHKSESESESDKGFEVARSPKFLVRLSLGSPSCPPPSTPKLPLGPPPATRMPKALPHTTSPPLHQSRAMEDIQSLKGRSELPSIQS

SEQ ID NO: 166139 - protein, 59 aa, Glycine max
  Coding DNA Sequence Number=SeqID_74454
MIIKSSNIFALIWFHRNISEEEEEPPKKEAESSENNDDQEDDPFYQNEDDCFGISLDDD

SEQ ID NO: 166140 - protein, 104 aa, Glycine max
  Coding DNA Sequence Number=SeqID_74455
MQQIYSLNQECAQCLLHFANPSPLHFLFLLNLLGLAPLAERVSFLTDWRTSECNMCKCNRDDHSMISTSPEQSSCCEVVPVGFHSLKPSLGSWQCTPLWWFSQS

SEQ ID NO: 166141 - protein, 306 aa, Glycine max
  Coding DNA Sequence Number=SeqID_74456
  Homolog annotation: Hit_ID=A7QLB6; Match level="QueryCoverage=96%, HitCoverage=40%, E-value=3e-32, Identity=31%"; Hit description =Chromosome chr11 scaffold_118, whole genome shotgun sequence
  Pfam annotation: Domain name=XH; Domain location=163-306; Score =101.0; E_value=3.6e-27; Accession=PF03469.5; Description=XH domain
MESLILATEKQMKARSDVLSLLEKHQMEKKAVSDALLKLEKEMGNEQKLNLEIAELEEQLKVLKCVNSEEADHENKRKIEIEEIEEKLEDMNFYMFVKDDENQALKKVQEAKTELEDARQQIINLLAVGTVLSQLMLSVQKLIECIYLTIQELPQFLKGVTKIQIKKFGEVSARSFKKVCMNRYKNNKKASSESVKLCAKWQKEILDSTWHPFKIVEVEGKEIQEVIDENDPKLLSLKNDLGEEAYVAVVTDLKELHEYDNSNDAENTHNSIEKQVIPEIWDSQNGRRATVTEALKYISNRVIKMR

SEQ ID NO: 166142 - protein, 207 aa, Glycine max
  Coding DNA Sequence Number=SeqID_74457
  Subcellular localization annotation: CTP_CleavageSite=35; ConfidenceScore=5.03e-01
MSTSASTSIARILPYMYSIHFSQTYTYPFYTPGITAPNVLSFTQFWRAPPIGWRKPNLAAFRVGKNIIEVPLSYHRQWRPYYPTYVLFYYNGSTHFVRVRKYGNHYFFADGLKEFRRTHSINDGVIIRFFAPDKNTSFEVDVMGPIHGQPTGSYCRRNQWQITIHDGLPSLAEPWFLYQSENNLMLGDEVVFFFKFDEHAWELLFRK

SEQ ID NO: 166143 - protein, 186 aa, Glycine max
  Coding DNA Sequence Number=SeqID_74458
  Gene Ontology: Mol. function=oxidoreductase activity, acting on the CH-OH group of donors, NAD or NADP as acceptor; Cellular component =cytoplasm; Biological process=malate metabolic process
  Homolog annotation: Hit_ID=Q006Q0; Match level="QueryCoverage=67%, HitCoverage=22%, E-value=1e-35, Identity=61%"; Hit description =Cytosolic NADP-malic enzyme
  Pfam annotation: Domain name=Malic_M; Domain location=37-177; Score= -63.1; E_value=3.4e-07; Accession=PF03949.6; Description=Malic enzyme, NAD binding domain
  Pfam annotation: Domain name=XH; Domain location=57-182; Score=0.3; E_ value=2.5e-06; Accession=PF03469.5; Description=XH domain
  Pfam module annotation: Pfam domain module=Malic_M::XH; Domain location=37-177::57-182
MTVVKQNYGEKVLIEFEYFANHNSFELLAKYGTTHLVQGTASVVLAGVVAALKLINGNLANHTFLFLGAGEAGTGIAELIALEMSKQTKTPIEETRKNIWLVDSKEVINGNDPKLLSLKNDLGEEAYVAVVTALKELHEYQNSDDAENTHNSSEKQVIPEIWDTQNGRRATVTEALKYISNRVIKM

SEQ ID NO: 166144 - protein, 51 aa, Glycine max
  Coding DNA Sequence Number=SeqID_74459
MRVTPRPSMRVRLRVIVSILRHKSESESDKGFEVARSVREMSELPKARKIL

SEQ ID NO: 166145 - protein, 133 aa, Glycine max
  Coding DNA Sequence Number=SeqID_74460
  Homolog annotation: Hit_ID=A7QLB6; Match level="QueryCoverage=90%, HitCoverage=24%, E-value=1e-09, Identity=29%"; Hit description =Chromosome chr11 scaffold_118, whole genome shotgun sequence
MYWLRRFEQYKPEEAYVLHCAEDPTGLIWLVCAQAEDYNSEGLVGNFLRQKVELKTTSMVAQESLNEKNETLDHLYGEIGPVNKKISEMESKYIEDYMSLDKMMKEIEKKRDLLHQTRAEELAVTIGGSKCAM

SEQ ID NO: 166146 - protein, 213 aa, Glycine max
  Coding DNA Sequence Number=SeqID_74461
  Gene Ontology: Mol. function=nucleic acid binding; Cellular component= intracellular; Biological process=biological_process
  Homolog annotation: Hit_ID=A7P0P0; Match level="QueryCoverage=33%, HitCoverage=8%, E-value=8e-27, Identity=81%"; Hit description =Chromosome chr19 scaffold_4, whole genome shotgun sequence
  Pfam annotation: Domain name=Bromodomain; Domain location=50-126; Score=19.1; E_value=3.8e-05; Accession=PF00439.16; Description =Bromodomain
MALRSSKGTFSKISINCVCVKGRKVESKGLHSVPVSGALVILQSGIPLPDKRTLELILDKLQKKDAYGVFADPVDPEELPDYHDVIKHPMDFATVRKKLGNESSYTTLEQFEGPKKEDPSVNYGLFLSTPQSPCHWSLHSSTTSVGLGLNLEVSNFEPIMVVTMMSWPPWPPLSSKKFEVVFIVRRLEGSTSMEKAEEVKSKVVEIKWKEPLC

SEQ ID NO: 166147 - protein, 41 aa, Glycine max
  Coding DNA Sequence Number=SeqID_74462
MSDAILPMKGPFTRAMSKRLQEDWARAAEEGPRVLMNLRGT

SEQ ID NO: 166148 - protein, 157 aa, Glycine max
  Coding DNA Sequence Number=SeqID_74463
MQKRSRLREHLLHCFIGQKNFFEKGQIATMTGDFSAPAATAPAPLHRSCTASLRLNLPLQSQPASQTSDFRNEAQTRQKSWRLAGGMKSPSPLAFSLPRGRCSANSSLAMAVCYVSHAVYVENNPPPPHVKYFKRTPFGEILCKSTPSGEICHWDTI

SEQ ID NO: 166149 - protein, 81 aa, Glycine max
  Coding DNA Sequence Number=SeqID_74464
MAEVSTEAITCLAQYYDQPLRILASRGEWASFIDILALLIFGGFHFPNVDGVVDLAAIDAFLAFHDRKESPVVAILADLYD

SEQ ID NO: 166150 - protein, 128 aa, Glycine max
  Coding DNA Sequence Number=SeqID_74465
MKLFFHTHETSQCIPTEENTQEIHFMGNQQRQGYTQGGFLGFQQGPYNQQGQWRTHPGNQFNKDQADRSSNSFGANTKNNPKEECKAVMTRSKRFVEAEDEESVVYKEQMGEKTGAEAKENDVKGKEN

SEQ ID NO: 166151 - protein, 196 aa, Glycine max
  Coding DNA Sequence Number=SeqID_74466
MVWYRRKTKMFVDPQNAKTATLAEVAETLQYMVSPQGRNTWTVDDLRQFPAQQFHILQSSVETQGIDRRRETIEAEEYSQQMSECGHGMYYTPQTFAQYPTQMYQYPFQGHQTDTSASQQSFGGVAETQAHFSWPTMTPSQQYHDPIPTPNAPLTKKKRGGIGAEEILIAKHEDGIDHVAHPHGITNTKMNDLHVS

SEQ ID NO: 166152 - protein, 57 aa, Glycine max
  Coding DNA Sequence Number=SeqID_74467
  Subcellular localization annotation: CTP_CleavageSite=17; ConfidenceScore=5.12e-01
MNDFVKIIHRSSSFFVRSSSFFGLQPLNMDCSKNIKSICNFTAFCQTPQEIVNGPTP

SEQ ID NO: 166153 - protein, 68 aa, Glycine max
  Coding DNA Sequence Number=SeqID_74468
DPTMLDLRQNDGQMENIQLQERRRRQREGDETYLGMVAKEKKQRLVMMLECDEHDAQMQTGTVSLDGD

SEQ ID NO: 166154 - protein, 71 aa, Glycine max
  Coding DNA Sequence Number=SeqID_74469
MIRGDTLGLSAPFCHPEAAGPMTSRDQVWSFCTLVSSRGGGPDDTRKYPVIRINIPFCYPERSDDSMQRLT

SEQ ID NO: 166155 - protein, 363 aa, Glycine max
  Coding DNA Sequence Number=SeqID_74470
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q7HDI4; Match level="QueryCoverage=100%, HitCoverage=78%, E-value=0.0, Identity=91%"; Hit description=ATP synthase subunit beta
  Pfam annotation: Domain name=ATP-synt_ab; Domain location=112-307; Score=255.4; E_value=1.3e-73; Accession=PF00006.16; Description=ATP synthase alphabeta family, nucleotide-binding domain
  Pfam annotation: Domain name=ATP-synt_ab_C; Domain location=320-363; Score=0.6; E_value=0.026; Accession=PF00306.18; Description=ATP synthase alphabeta chain, C terminal domain
  Pfam annotation: Domain name=ATP-synt_ab_N; Domain location=1-56; Score=44.4; E_value=4.1e-10; Accession=PF02874.14; Description=ATP synthase alphabeta family, beta-barrel domain
  Pfam module annotation: Pfam domain module=ATP-synt_ab::ATP-synt_ab _C::ATP-synt_ab_N; Domain location=112-307::320-363::1-56
MPNIYNALIVKGRDTVGQQINVTCEVQQLLGNNRIRAVAMSATEGLMRGMEVIDTGAALSVPVGGATLGRIFNVLGEPIDNLGPVDTRTTSPIHRSAPAFIQLDTKLAIFETGIKVVDLLAPYRRGGKIGLFGGAGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIE

SEQ ID NO: 166156 - protein, 158 aa, Glycine max
  Coding DNA Sequence Number=SeqID_74471
MLKILMKLLEDQYLGYFVEDLLQLNIKRKLQSGRDKAWHSHWWKDLRRLYNQPDFHNIHQNMVWKVDCGDKIKFWQDSLLSEGCKHFKKRFLEIWKEVFKHFKERLSEQNPCRPTLDGIQFSSLGQGQKESLVARFSEVEIKSAVGVLVEIKALAQMV

SEQ ID NO: 166157 - protein, 89 aa, Glycine max
  Coding DNA Sequence Number=SeqID_74472
MRIKRSFKVVMGPRTRKGNIGSKGLSKELIQGRLIWLEAYKNKMPKSSPNMPVKQEVSTRVKPRLLCKQSMGQNTPNKIDDDGSNSHQG

SEQ ID NO: 166158 - protein, 56 aa, Glycine max
  Coding DNA Sequence Number=SeqID_74473
MTMRGQDIYSSQEETTSSSSSSGSEDEVNGEESSEEVYPREEGDLLMVRRLLGAQD

SEQ ID NO: 166159 - protein, 166 aa, Glycine max
  Coding DNA Sequence Number=SeqID_74474
MTFSAGFTYLEGECVNNVVWALERFRGIFLRRDALPRVIVTDRDLALMNAVYVLNHIAAEFERIHYAAKNPSSCGCVMRTTHGLPYAYQGLSEPQVTIKEEMKTICKRFEELDACGKVTLKSKLWEIAYLDQNSMCPPPEKVNTKGAQKRLTNKNQRSTKRDPSYW

SEQ ID NO: 166160 - protein, 79 aa, Glycine max
  Coding DNA Sequence Number=SeqID_74475
MTSGGEEEEEARIAQPGQGKAKKLLPTGPKTLCPLPHPPPPHGIRKTFHCVAEKECVSLKFCDNSMFRCVLGHSIVQNS

SEQ ID NO: 166161 - protein, 233 aa, Glycine max
  Coding DNA Sequence Number=SeqID_74476
MKADMEAMKEQMTTMMEAMMSMRKMMKDNTATVVVASTTTEMDPIHPAGFIQVNHLVSDVVGQEGEAAKSACEPHHVKVQSKHSFPPYGLPPNYTPPTIVYASSENINNFAPVLIENQQPQSDHAHFSQPMGETHEVPQDHTLAGFTVYPGYTTERQAFSGIPVLNAPEISQYRPLSQPLHFVMGEGPSTILEKERFEHMEERLHAIRGGNYVFTDMAELCLVPDVVIPPKFK

SEQ ID NO: 166162 - protein, 150 aa, Glycine max
  Coding DNA Sequence Number=SeqID_74477
  Pfam annotation: Domain name=zf-CCHC; Domain location=78-95; Score =27.4; E_value=5.2e-05; Accession=PF00098.14; Description=Zinc knuckle
MELQHLNQNEEIDKRKRSIALKASSSIQEEKEEEEESDDEEDFSLSVKKFHKFVKNRIMERSQNFNNGKKSQEVSPTLKCNKCNQLGHIKANCPSNESWPEKNEKKSYKERRSKKAYIVWDDNDSFDGSEKEINLLSKDYESDENISQED

SEQ ID NO: 166163 - protein, 101 aa, Glycine max
  Coding DNA Sequence Number=SeqID_74478
KSILEIGSTFGRPLVLDYMLFLVSNPWRFTIGNWLCDSDLVNPIGIDRILTEKNLLADSYLDLEASILDEKEFLLSKEELPHPIYGSWKRNIDLCYISDKQ

SEQ ID NO: 166164 - protein, 461 aa, Glycine max
  Coding DNA Sequence Number=SeqID_74479
  Gene Ontology: Mol. function=oxidoreductase activity; Cellular component=glycolate oxidase complex; Biological process=ATP biosynthetic process
  Homolog annotation: Hit_ID=A1FWL0; Match level="QueryCoverage=100%, HitCoverage=100%, E-value=0.0, Identity=91%"; Hit description=FAD linked oxidase-like
  Pfam annotation: Domain name=FAD-oxidase_C; Domain location=218-457; Score=289.9; E_value=5.2e-84; Accession=PF02913.10; Description=FAD linked oxidases, C-terminal domain
  Pfam annotation: Domain name=FAD_binding_4; Domain location=43-182; Score=195.0; E_value=1.9e-55; Accession=PF01565.14; Description=FAD binding domain
  Pfam module annotation: Pfam domain module=FAD-oxidase_C::FAD_binding_ 4; Domain location=218-457::43-182
MSPALPAPLVAELSVLLGAEGWRMDDGALEANAQDNSWRHQRPAAVALPADIEQVQALVRACRAHGVALVARGAGTGTTGAAVPQPGSIVLSFTRMDRIVEIRAGDRCAVVQPGVLNGTLQQALAPHGLFWAPDPSSAEICSIGGNLACNAGGPRAVKYGTSRDNVLGLVAVTGTGDVIRCGGAYTKDATGYDLTHLLVGSEGTLALIVEATLKLTPLPVSQAGLRVLYRDADAAAAAVSRLMSQPVVPTRLEFMDARSLELLRLNGADVPEAGAMLLVEADGDHDTLPYLLQALASAAEGDGMIELDVAMEGRARDQLWAARKALSPALRSVAPGKINEDVVVPVSRIPELVGGVQALARDYALTIVTFGHAGNGNLHVNILYHPEDPDENARAHAALPKIFELTLALGGTLSGEHGIGLAKRDFMVQAFTAETLATMRAIKAALDPDGILNPGKVLPPV

SEQ ID NO: 166165 - protein, 62 aa, Glycine max
  Coding DNA Sequence Number=SeqID_74480
MPQKQHVEANSPGEDYGEDIGLENMQEVPVEMESSFQKELLKWEKMKTKQEICSQREWQGTP

SEQ ID NO: 166166 - protein, 289 aa, Glycine max
  Coding DNA Sequence Number=SeqID_74481
  Homolog annotation: Hit_ID=UPI00016621D1; Match level="QueryCoverage =59%, HitCoverage=40%, E-value=1e-18, Identity=36%"; Hit description =UPI00016621D1 related cluster
STLTFKGLHVLAIRGLHALAFKRLLVLAFRGLPVLIFRGLRALTFRGLHVLAFRGLPALAFRGLHVLAFRGLHALAFKELHVLSFRGLHSLTFRGLHALTFRRLDVLALKGLALAFRGLHVLSFTGLNALTFRGLDALTFRGLDVLAFRGLQVLAFRGLPVLTFRGLWALAFRGLHGYAPSPSENYTSPPSEGYTPSPSEDYMSLPSEGYMPSPSEDCTSSPSEGYTSSPSERCTPLPSEDYMSSSTEGYIPSPLEGSTPSPIVDYTSSLSEGCTPSPSEEYMSYAGSL

SEQ ID NO: 166167 - protein, 55 aa, Glycine max
  Coding DNA Sequence Number=SeqID_74482
MIEEAKEHHMDEDALIPHNVAPLEWRRRKGDWRCHFKEKMSQEQAYHHRKPWMRA

SEQ ID NO: 166168 - protein, 59 aa, Glycine max
  Coding DNA Sequence Number=SeqID_74483
MRFQPNSLSTPTTLSEFIFWGRTFIFLRRYLWLSGADLLSPGPLSATLLSLAHICCDYH

SEQ ID NO: 166169 - protein, 64 aa, Glycine max
  Coding DNA Sequence Number=SeqID_74484
MDWFFRILHPFMTPGHASDPLPHGHAPQPRIVPQAPQTDIPHVPKPGASSTSVEEPRHAVVKSL

SEQ ID NO: 166170 - protein, 141 aa, Glycine max
  Coding DNA Sequence Number=SeqID_74485
MSRNLIDYAIVPSLASGMLRNFMDCALTLPFNSRHVAELHGLPNEGCQVPRSGQARVASQQTDGPQTKLGGVSSLSSFSIPLPFIFQEAKESIDEEDPRPTSSNEGFFSKCVSGDLLSSSGIVEHSMLGLKIGREDAAESF

SEQ ID NO: 166171 - protein, 152 aa, Glycine max
  Coding DNA Sequence Number=SeqID_74486
MTILRRFGPPLQWHFVMLDIGIGETYVVQPWYQFLADIDFSHGDESNTSLEGLEVVELEGSGGDTGGNYGFVDADVGALDGEDRSDRGATSPSNDPLRGIRDPMKRFKTKRIKQALQGLIQNIKEKEDQCELRNAPNWVTFLQIDEDALRPT

SEQ ID NO: 166172 - protein, 177 aa, Glycine max
  Coding DNA Sequence Number=SeqID_74487
MASKKRKSTASRPTAQYDTRRFQSLKAWNRYTDNILGRNILPERNVKLYHIEFDEFKVELERHNLHKCLTNLQDGSIDVSMVKEFYVNLYSPEDQAPKQARVRGHLIKIDANNLNEFLQTPVVLEEGESLPTYPRFCKLRTNHQEIEARLCIPRKGFVLNAEGQPWKLLRKDLMTLA

SEQ ID NO: 166173 - protein, 56 aa, Glycine max
  Coding DNA Sequence Number=SeqID_74488
MSRRWLSTNLFIFSWARSSFLLKSMNISSRKVLFHHMAKHLGLVVTQGVIGRAHVQ

SEQ ID NO: 166174 - protein, 200 aa, Glycine max
  Coding DNA Sequence Number=SeqID_74489
MWDFTSHLYSNSSPPQVHYGHLWYLHHCSICGAQCVGHQVKPSALIPIVGEIQGRQLWTTSHHIRKPDTGDLAHGTCEAHRFLRHVLPCRQRWGRRHQQPLHYHARHYHHGPNHPAPSPPHCGTTWTTSSTTCAAPTSPITIHTSALSSHVVDPDATRFICDLHSFALTRFPLYCFVLLYVCLFWVSTLVVENFKEDEEC

SEQ ID NO: 166175 - protein, 129 aa, Glycine max
  Coding DNA Sequence Number=SeqID_74490
  Pfam annotation: Domain name=Chromo; Domain location=18-65; Score =9.1; E_value=0.043; Accession=PF00385.15; Description='chromo' (CHRromatin Organisation MOdi
MASDQSLPPTALDNQPIIEPLIILYHKWDNSDPPQLHVLVQWLGLLPEDLAWESWTELQANYHLEDKVILEEVGNDSNPESEANCRPKRITKRPQGWEEFIHYMLSDHHQNFVFLDLKYKKPLSIELHQ

SEQ ID NO: 166176 - protein, 45 aa, Glycine max
  Coding DNA Sequence Number=SeqID_74491
EIKSESTDKSFKVNGHRLKPFLTNSSLVDVVVEETSSPYFSSTMT

SEQ ID NO: 166177 - protein, 90 aa, Glycine max
  Coding DNA Sequence Number=SeqID_74492
MHHQNRKTLDKASLSSSESETQHGHRSTSTPYGSDRPGYRAQYLKVCAKSVGNRYKDTHQEVTTCQRLYTSMIQTKNKRNEIEAKPQKER

SEQ ID NO: 166178 - protein, 127 aa, Glycine max
  Coding DNA Sequence Number=SeqID_74493
MVFVGERIKAGVRKGKFNYVASMNPSNGGSARSGERKKEGEPHVVVALPAWPNFPLAPYNTMYQYPPQQYHYSSKISHSHYPPPYQPRTPNQPQSHKPNKDSSTSISPRIQLKCDMCLSWGSSGAFL

SEQ ID NO: 166179 - protein, 382 aa, Glycine max
  Coding DNA Sequence Number=SeqID_74494
  Gene Ontology: Mol. function=transporter activity; Cellular component= intracellular; Biological process=transport
  Homolog annotation: Hit_ID=A7Q9E7; Match level="QueryCoverage=63%, HitCoverage=36%, E-value=8e-60, Identity=53%"; Hit description =Chromosome chr19 scaffold_66, whole genome shotgun sequence
  Pfam annotation: Domain name=CRAL_TRIO; Domain location=152-346; Score=7.7; E_value=5.8e-05; Accession=PF00650.11; Description =CRALTRIO domain
MERVLADVLRDQRNLGNKGNGGWKRSALNAAATMLSTSFNVNVTSDNVKNRIKLWRSWYGISHKSAKPFRFKVLQNWDDIVDLCAKDRSTGHEAETAMDADEAMSRETNEVEFMGLDNKWAKAIKWLADDPKQLAIVDFEFEEQEEVLQHYPQGYHGVDKEGRPVYIERLGKAHPSRLMRITTIDGYLKYHVQEFEKALEEKFPACSIAAKRQISSTTTILNVQGLEIKRLQCEEFSYKHRHDFDIPNGENARNWIVNLVFKFHDDPTVNESEIIVFLRMLWPAAQKFLDAKTIAKIQVLEPNLYVNYWISLTLDFLGGTCTCPGQGGCLRSSKGPWNDPDIMKATFERQIARMSNEQENLDSLWIASLNLLEFEKYDFTNN

SEQ ID NO: 166180 - protein, 133 aa, Glycine max
  Coding DNA Sequence Number=SeqID_74495
  Homolog annotation: Hit_ID=Q5XM22; Match level="QueryCoverage=71%, HitCoverage=68%, E-value=6e-16, Identity=40%"; Hit description =Resistance-like protein HAAS-2
MSWGIRCTLFSNKNATHVHAGFLDAFRDFSQSGSYAWVAITLVHMYDNLNDACKSSNRQLAGYITLLQCWTYEHFPSVAESLTDPDYAEMSPRACRWIFMKASSKSLPASTYWKRLDGLTIADVCWMFYGDHH

SEQ ID NO: 166181 - protein, 132 aa, Glycine max
  Coding DNA Sequence Number=SeqID_74496
MDQLKHLSIPSGKFRFSNHASYPRLGHPTRKISMQQGQTDILIARFPDPNYGVTMGFRSLPKPQAKLEILLRLKGSSRCGFSMENNDGLWWLMVDVGDGESTLNFRNGFGRKKEEEMTFFLSYARAKAEMLK

SEQ ID NO: 166182 - protein, 111 aa, Glycine max
  Coding DNA Sequence Number=SeqID_74497
  Pfam annotation: Domain name=Thioredoxin; Domain location=21-104; Score=-26.0; E_value=0.026; Accession=PF00085.11; Description =Thioredoxin
MEERASFRSKKHLICFGGVDDVGTVCGEEGVALDSGGEDGGGSGSQSHAIHAMFEELTDVDFVKIDVNELPFPMMSTFVLVKKGKEVDKVVGAKKDELERRVRNMIAILVL

SEQ ID NO: 166183 - protein, 128 aa, Glycine max
  Coding DNA Sequence Number=SeqID_74498
MEIKKTTKEKRKRKECLTKENKNAIEFLDEHVFYYDEEDEQWFKEKDDQWVKNIPCYKEDTTKVVLNSVDFNFDMQNKDLDEFLKVPSPPRVHALAAPAPHRVYTFADLVSVPSARIAWVPDPAAPTP

SEQ ID NO: 166184 - protein, 33 aa, Glycine max
  Coding DNA Sequence Number=SeqID_74499
LSSSFSRKLLKEEVFSKKLLKEVFLRKLLKEAT

SEQ ID NO: 166185 - protein, 220 aa, Glycine max
  Coding DNA Sequence Number=SeqID_74500
  Gene Ontology: Mol. function=protein serine/threonine kinase activity; Biological process=protein amino acid phosphorylation
  Homolog annotation: Hit_ID=Q9FGC1; Match level="QueryCoverage=38%, HitCoverage=10%, E-value=3e-15, Identity=45%"; Hit description =Protein kinase-like
MVLDRLPTRGNLLRRNVQMQDTSCPLCGNAQEEVDHLFFNCEMTIGLWWESMSWNQMVGPIASSPAAHFIQFCEGYAVGQNQSRRYGWWVALTNSIWKHRNQLVFEGLVEFDPAKRWSPFQASKHPFVTGEPFTHPYKPPPETPHMNNFVLAGISHKRGLSKGELGGHKGRVMFKSLLDQTHQSMFLLLPLILQFSFHYLSVPTRFFSRGICAILQVSYY

SEQ ID NO: 166186 - protein, 133 aa, Glycine max
  Coding DNA Sequence Number=SeqID_74501
MVLVMSTMVVKIEILFKIGKGSMDCKSGDRNTDHYDFDYHDVNSSGDEEIPMMVVLVVAVVVAAAAAMPMVVAVTKVVLVVVVAMSVSMVVDGGGGNKCWRCGVGGGCGDSDRGGIVGSSGGGGASDDGAWWQ

SEQ ID NO: 166187 - protein, 55 aa, Glycine max
  Coding DNA Sequence Number=SeqID_74502
MGGGGLVVWITGEGKTARKPHYKRNLKESWASSSKGNNTRKSSLPWIQTENANEA

SEQ ID NO: 166188 - protein, 233 aa, Glycine max
  Coding DNA Sequence Number=SeqID_74503
  Homolog annotation: Hit_ID=A7PAZ1; Match level="QueryCoverage=69%, HitCoverage=55%, E-value=6e-36, Identity=49%"; Hit description =Chromosome chr16 scaffold_10, whole genome shotgun sequence
MTSICGFDHSSSPPPPCHAEPVSSFPPTAGIMFSHTILEKMDTKNYRLWGQKVELDIKGHCLHHYLDGSDESSLTTEFGRSMNLGATETWAGFGRFNHVSSTNTPPIIMQRLNGPSQAFTNVEMGSLPMHDLQATYVPSMSKHFHLMPHILQNSPSRFGYQSVQRFTHGRPPHGAEWNQIKIQAPSSGFSSVDPRSPRNNSFTNSMTWGRRMNPPVSSMPPTSGTRKDYARID

SEQ ID NO: 166189 - protein, 213 aa, Glycine max
  Coding DNA Sequence Number=SeqID_74504
SLEGFPIHDIGGTALVDKDPKHHEVCNDNGDNHGVVLVDRFDTLEVVSHAIIDGVFIYLILPLFFYLLHGSYAAPLGVLCDLLLLGGWVCNARTWALWGEAGASIHTSFLLESGHFLHLNGKEYGMQYYLEVKISDLDDSAPKSIHEFSKRLVVCLSQTGRGSQGHAMRPVGGILHTELSNKGVEVVYGPRWESTILGIQMLVWIYCPIIPLK

SEQ ID NO: 166190 - protein, 155 aa, Glycine max
  Coding DNA Sequence Number=SeqID_74505
MASRKRKSIATRPTTQYDTRRFHSFEAWNRYMDNILGRHILPERKVEIYHTELDKFKAELERRNFHKRLTNLVDNNIDLALVKEFYANLYRSEDPPPKHAKVRGHLVKIDADNLNTFLETPVILVEGETLPAYSRYCRLLTNYKEIEAALCIPGR

SEQ ID NO: 166191 - protein, 123 aa, Glycine max
  Coding DNA Sequence Number=SeqID_74506
  Gene Ontology: Mol. function=RNA-directed DNA polymerase activity
  Homolog annotation: Hit_ID=A5C9E2; Match level="QueryCoverage=53%, HitCoverage=8%, E-value=9e-12, Identity=58%"; Hit description =Putative uncharacterized protein
  Subcellular localization annotation: CTP_CleavageSite=68; ConfidenceScore=5.21e-01
MAGRITLINAVLTALPMFNLSFFRASTALINRLTAIQRQFLWGGSFEGKKIASVAWRQVSASRDLGAKASEVVALGKLKTLTESTIRERALTAQHSSMITISKFEYEYLTNHAASVEEIADKK

SEQ ID NO: 166192 - protein, 242 aa, Glycine max
  Coding DNA Sequence Number=SeqID_74507
  Gene Ontology: Mol. function=small conjugating protein ligase activity; Cellular component=cytosol; Biological process=regulation of protein metabolic process
  Homolog annotation: Hit_ID=A3AYE9; Match level="QueryCoverage=50%, HitCoverage=55%, E-value=1e-51, Identity=81%"; Hit description =Ubiquitin carrier protein
  Pfam annotation: Domain name=UQ_con; Domain location=29-160; Score =161.7; E_value=1.9e-45; Accession=PF00179.17; Description=Ubiquitin -conjugating enzyme
MGTDASFGALDWKGKGVHDDSLDQMASKRINKELKDLQKDPPTSCSAGPVADDMFHWQATIMGPADSPFAGGVFLVSIHFPPDYPFKPPKVSFCTKVFHPNINSNGSICLDILKEQWSPALTISKIPTQMILWCPRLLTCIRLTEPIAGTVVNFCIFAYFHRTTAETIGKPYDCIYVGLQEQARKEKEDPERMLEENRRKVEEAQRTEALEKKEGRKKDMKRCKDRSKKPCEGRNRRRSKNV

SEQ ID NO: 166193 - protein, 212 aa, Glycine max
  Coding DNA Sequence Number=SeqID_74508
MASRKYNVLGRNILPERKVEIYHSELDEFKAKLERRNFHKRLTNLVDGSIDLALVKEFYANLYSSEDHPPKQSKVRGHLVKINADSLNTFLETPVVLAEGETLLAYSRYCKLPTDYREIEAALCIPGRGFILNSEGHPGKILRKDMTTLAQVWSVLSYSNLAPTSHTSDLTVDRARLIFGLVSRLDMNIGALISGQMTSIAQSNTSRLGLNA

SEQ ID NO: 166194 - protein, 66 aa, Glycine max
  Coding DNA Sequence Number=SeqID_74509
SAKHYTSGLSARKTLEEDELYMFAKRTASVHPLREKGALSQKSLMCAKRSIHLQSPELKAGASLRA

SEQ ID NO: 166195 - protein, 81 aa, Glycine max
  Coding DNA Sequence Number=SeqID_74510
MSGKAIREILIRWLDDLAEQQGGGEAKAKENETRDVVEDQGGVEKAIRCQFLGGSSIPRAQQRRGTSSTCGGCSRGLGGIN

SEQ ID NO: 166196 - protein, 79 aa, Glycine max
  Coding DNA Sequence Number=SeqID_74511
MKVAAATPERSLEATSEPSAQGEDIPSTQHAADPSTPFLEMLEDLTTSVLAMDTSPPATLVLHLIDEEDVQTQDTQDQP

SEQ ID NO: 166197 - protein, 72 aa, Glycine max
  Coding DNA Sequence Number=SeqID_74512
  Subcellular localization annotation: CTP_CleavageSite=46; ConfidenceScore=5.07e-01
MHFDYFVKKIVSVKKIQAEALPRRFRKQIREGFPSFFTVLHSFFVRSSFFNGSDFLFDRGYVGEKAPLLSTS

SEQ ID NO: 166198 - protein, 224 aa, Glycine max
  Coding DNA Sequence Number=SeqID_74513
VPQNKDKELRGITNGPVGGYRKWLKAHMQGLDWLPSLRIAKREEVEVPEEDEEVQALRAELEQAQTVKERARKEEHGREKFRGALWGSNSELKLRREERDQSRAHGMVLKEELAACSRSKRNLSQRLCETESNMLAIVSKYQEELNLATAHGHKVADEYAQVYKEKEARGRVIDSLHQEAAMWMDRFALTLNGSQELPRLLAKAKAMADTYSAPDEIHGFLIYC

SEQ ID NO: 166199 - protein, 143 aa, Glycine max
  Coding DNA Sequence Number=SeqID_74514
  Gene Ontology: Mol. function=nucleotide binding; Biological process =defense response
  Homolog annotation: Hit_ID=Q6L477; Match level="QueryCoverage=45%, HitCoverage=10%, E-value=5e-10, Identity=36%"; Hit description =Putative uncharacterized protein OSJNBa0009L15.8
  Subcellular localization annotation: CTP_CleavageSite=26; ConfidenceScore=5.79e-01
MGSPPASTTPPPPSSPPRPPPTSDASASTFAVKRARKASRLLSLSTRPPGFERPVVHVDPATGKADGPHKKKLRTYLWIVARDKVDITYKNWKEVPTAQKDLIWEDIQAKFDIPEASDSRTKKKLLQTVGERWMQFKLDLIRK

SEQ ID NO: 166200 - protein, 68 aa, Glycine max
  Coding DNA Sequence Number=SeqID_74515
MSLHSSSSVNGEGSTPKDPLERRIHGYPPVEYWNDLKSALRKRHIPSYYEREFMDKFHRLRHGTMSVE

SEQ ID NO: 166201 - protein, 177 aa, Glycine max
  Coding DNA Sequence Number=SeqID_74516
  Gene Ontology: Mol. function=uroporphyrinogen-III synthase activity; Biological process=tetrapyrrole biosynthetic process
  Homolog annotation: Hit_ID=Q9L6Q3; Match level="QueryCoverage=92%, HitCoverage=66%, E-value=9e-58, Identity=69%"; Hit description =Uroporphyrinogen-III synthase
  Pfam annotation: Domain name=HEM4; Domain location=2-175; Score=23.2; E_value=2.6e-07; Accession=PF02602.6; Description=Uroporphyrinogen -III synthase HemD
RFTAAAQRVAGILDYYAIGRSTALALHTVSNLKVDYPHARETSEELVRLNRLQQVSGKRALILRGSPGRELLAETLIARGADVQYCECYQRCEKQYDGAIEGRRWRDRGITTLVVTSGEMLQQLFALFPPIDRREWLLHCRLLVVSERLATQAAELGWQEIEVADGADNDALLRALR

SEQ ID NO: 166202 - protein, 151 aa, Glycine max
  Coding DNA Sequence Number=SeqID_74517
  Homolog annotation: Hit_ID=A5ATL8; Match level="QueryCoverage=56%, HitCoverage=68%, E-value=2e-20, Identity=65%"; Hit description =Putative uncharacterized protein
RRQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSREGELTPKTRPQFGL

SEQ ID NO: 166203 - protein, 220 aa, Glycine max
  Coding DNA Sequence Number=SeqID_74518
  Subcellular localization annotation: CTP_CleavageSite=46; ConfidenceScore=5.93e-01
MGSSPATTSSPPPPPPPSPPPPSPPPPPPPTSNASASLSAVKRTCKASRLRSLSTRPPGAERPVVHVDPVTGKADGPHRKKLRTYLGIVVRDKVDITYENWKEVPTTQKDLIWEDIQAEFDILGLLTVGRKGSSWGRDGGSLNQTSRANGPLQPIRTVSRTLSDVRMKAQAIQKQNTAPHVLSRGGYDYLEQKLLTEKTKKLQEAAQSGSVDGVIDPPSP

SEQ ID NO: 166204 - protein, 147 aa, Glycine max
  Coding DNA Sequence Number=SeqID_74519
LATLQELCSTPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 166205 - protein, 82 aa, Glycine max
  Coding DNA Sequence Number=SeqID_74520
MVFFQSYLDYKAQNAQMTNALGNGNVAHTPDVCSKIPMRQTTFREDPMVNKGWAAFLPRQIHVASLRSFIKRLPREASSWLL

SEQ ID NO: 166206 - protein, 44 aa, Glycine max
  Coding DNA Sequence Number=SeqID_74521
MASIIVAICSFMASMLAFICSCTSSTSPITLVLARVRGKRKGHA

SEQ ID NO: 166207 - protein, 132 aa, Glycine max
  Coding DNA Sequence Number=SeqID_74522
PTNGLGSPKLRSIGRSSKLTNGLHPLPVKVENPDESSETSNNSFQNCPIPYQLDLAPYASEPYNAQWNAPGLLRDKHTLRSSRILGKMEVDEPWLGLWLPLNYQVDMGASQHKTLELGVVFVIGSAVGRLCG

SEQ ID NO: 166208 - protein, 168 aa, Glycine max
  Coding DNA Sequence Number=SeqID_74523
MSSSLSALLQVIKHATSTHPLSETRALQSVEIQVGELAEAVTQFMVRQEKSFVEVEAQKKSPVKEHESREKDEEKDEEQAQQQWEKYSTVENQQENILQSNNLPHQLIDKKGRQREHEEILSAILSLITNTFLEMIWNVLPDYMKVMKFLAKRRNFKEDVFFVTFMPP

SEQ ID NO: 166209 - protein, 92 aa, Glycine max
  Coding DNA Sequence Number=SeqID_74524
  Pfam annotation: Domain name=zf-CCHC; Domain location=20-37; Score =13.3; E_value=0.015; Accession=PF00098.14; Description=Zinc knuckle
MERRHNFNNGKISQEGSLTLKFYKCNRPGHIKAHCPTNESWPEKNEKKSHEEKRSNKAYIAWDDNDSSDGSEKEINLLSKDYESDENISRED

SEQ ID NO: 166210 - protein, 288 aa, Glycine max
  Coding DNA Sequence Number=SeqID_74525
  Gene Ontology: Mol. function=oxidoreductase activity; Cellular component=integral to membrane; Biological process=potassium ion transport
  Homolog annotation: Hit_ID=Q5PNE8; Match level="QueryCoverage=37%, HitCoverage=32%, E-value=3e-49, Identity=83%"; Hit description =Putative ion-channel protein
MAEIAVAERMMHAVALLLGVAGGSADDVNHRHIFGVTAGDAVNRAEFTDAKGGQQRGRAVAATVTIGRIGCIEFISAADPGNTGMVNDAVEKLQVVVAGYAEQMADTRLVQTMQSISDVAELARFSPSSRCHAWQAFVTTTENSVSCDLCRVTAQCKRIHCYADATFSHLRQERCMSTFPHAERYHQMQYRRSGRSGLKLPAISLGLWHNFGDSTRVDNSRTLLRHAFDRGITHFDLANNYGPPPGSAESNFGRILREDFHGLRDELVISTKAGYTMWDGPYGDWGSR

SEQ ID NO: 166211 - protein, 116 aa, Glycine max
  Coding DNA Sequence Number=SeqID_74526
EYILCGTSRGYIYLGLTENKRGYISCGSVLVEGTSTRFKENKEGLLQDHDKDQVNLCLMTKSDENNKEDFVRKSGTSTVDVTKHMTGDVSKFTTFSPRKVDMLHTATTILVKSQKR

SEQ ID NO: 166212 - protein, 206 aa, Glycine max
  Coding DNA Sequence Number=SeqID_74527
LHVLTFKGLHVLTFRGLHALAFRGLDVLAYRGLHALAFIGLHALAFRGLHALAFRGLYVLAFRGLHVQTFRGLHALTFKGLHVLAFRGCTPSLLEGYIPSPSEDYTFSPSEDYTSSPSEGYASSPSEGYTPSPSEGYMSSPPEDYTTSPSEDYTSSPSEDYYDWSVAYIPWPASKRPSPKPRVSKGTMSVTDKSSRAQLKTLKKRY

SEQ ID NO: 166213 - protein, 101 aa, Glycine max
  Coding DNA Sequence Number=SeqID_74528
MAPKKLFAKRSGRDAAAEGTSAAPEFDSHHFRSAEHQQRFEAIKGWSFHRERRVQLKDDEYMDFQEEIARRHWTSLVTPMAKFDPDIVLEFYANVWPTEEG

SEQ ID NO: 166214 - protein, 20 aa, Glycine max
  Coding DNA Sequence Number=SeqID_74529
MVATAKFDLEGCSQIKIKEE

SEQ ID NO: 166215 - protein, 461 aa, Glycine max
  Coding DNA Sequence Number=SeqID_74530
  Homolog annotation: Hit_ID=A7QIY9; Match level="QueryCoverage=95%, HitCoverage=95%, E-value=2e-88, Identity=46%"; Hit description =Chromosome chr2 scaffold_105, whole genome shotgun sequence
MMRRTNANDARADNNTLDTINAAAFAIASAQNRVSQPSTQKKRWGSWLGKIGCFGYKKTRKRIGHAVLVPEPTTNGADPAAAASSIQAPSITLPFVAPPSSPASFFQSEPPSTAQSPIGKVSHTCVSASIYSPGGPASIFAIGPYAHETQLVSPPVFSASSTAPFTPPPESVHMTTPSSPEVPFAQLLDPNNKNSETFQRFQISHYDFQSYQFHPGSPVGQLISPRSAISVSGTSSPLPDSEFNATFAHILDFQRADPPKLLNLDNKLSSCENQKSNHGSGSLTPDAARSTTQSGFLSNHWVSEIKMSPHPSNNRLNEISINHRVSFELSAQKVLKSLENKPAASAWTNVLPKLKNDAPTTDKEEKSEESALDDKQVVSEAHNDQPLETTLGGDKATTVHEKDQSLTLSSAKEFNFDNADGGDSLAPNIVADWWANEKVAGKEREASKDWSFFPMIQPGVS

SEQ ID NO: 166216 - protein, 26 aa, Glycine max
  Coding DNA Sequence Number=SeqID_74531
PRTGEDEDAQRREDDNGGEEKRRRGS

SEQ ID NO: 166217 - protein, 540 aa, Glycine max
  Coding DNA Sequence Number=SeqID_74532
  Gene Ontology: Mol. function=nucleoside-triphosphatase activity; Cellular component=intrinsic to membrane; Biological process=innate immune response
  Homolog annotation: Hit_ID=A7R2A6; Match level="QueryCoverage=95%, HitCoverage=51%, E-value=0.0, Identity=74%"; Hit description =Chromosome undetermined scaffold_411, whole genome shotgun sequence
MKIVVWERGSPAYQEIQELVNQNLVLEFAYRFHQRYKMVLWIGGESRHIRQNYLKLRSVLEVDASVENSLEKTRIKGFEEQEEAAVSGIRKELMRNIPYLVIIDDLESEKDWWDHKLVMDLLPRFGGETHVIISTRLPRVMNLEPQKLSYLSGVEAMSLMLGSGKDYPVAEVDALRTIEEKLGRLTLGLAIVSGILSEIPITPSRLLDTINRMPLKDMSWSGKEARSFRQNTFLLQLFDVCFSIFDHADGPRSLATRMVLVSGWFAPCAIPVSLLALAAQKIPEKQKGTCFWRKLLQSITCGFTSSNTKKSELEASSLLLRFNIARSSTKQGRIHFNEIIKQYARKREVTGSAQAMVQAVISQGSISESIEHLWAACFLLFAFGHNPPAVELEVSELLYLVKKVVLPLAIHTFITYSRCTAAIELLHLCTNALEAADQAFVTPVDKWFDKSLCWRSIQTNAQLNPCLWQELALCRATVLETRGKLMLRGAQFDIGDDLIRKAVYIRTSICGEDHPDTISARETLSKLARLIANVQIRASI

SEQ ID NO: 166218 - protein, 154 aa, Glycine max
  Coding DNA Sequence Number=SeqID_74533
  Gene Ontology: Mol. function=DNA binding; Cellular component =intracellular
  Homolog annotation: Hit_ID=A7QNL5; Match level="QueryCoverage=44%, HitCoverage=12%, E-value=2e-16, Identity=56%"; Hit description =Chromosome chr2 scaffold_132, whole genome shotgun sequence
MQLPETVTACLCVRRKYRIRRHSPFRLRNCWEGRSVRASSLLRQLAKGGCAARRLSWVTPGFSQSRRCKTTASAKLASSILSKKTRRNLVSYYFNAFLIQLRTYQNRVSPKSVDSDDDEVEFGSFSDGFGMEAVKGPDDDFLECSLNKQCTDFE

SEQ ID NO: 166219 - protein, 245 aa, Glycine max
  Coding DNA Sequence Number=SeqID_74534
  Gene Ontology: Mol. function=DNA binding; Cellular component =intracellular
  Homolog annotation: Hit_ID=A7QNL5; Match level="QueryCoverage=62%, HitCoverage=27%, E-value=1e-17, Identity=37%"; Hit description =Chromosome chr2 scaffold_132, whole genome shotgun sequence
  Pfam annotation: Domain name=ARID; Domain location=43-149; Score =18.7; E_value=2.3e-06; Accession=PF00098.14; Description=ARIDBRIGHT DNA binding domain
MEEWPTFSNGSSLDCLGGVETVGAFPGNVCCPGKDHVDNGADHGKLKQKYLFYQLFPAYLKDSCSMDGVRPLPVLVDGQQLDLYKLFSLVKERGGYARVSKKGLWGSVTKELGLNPVVCWSVKLVFDKYLNDFERWLKKTFEEKNLKNGNHGCDWGLKWLPLDIEKEFRALLCSNLKDKDDDRLVKSKSIKKKKNADLVNHKNGNNLLDTNDQNNKSKDVQRIEGDNDEKSANGIKGNPATLGAE

SEQ ID NO: 166220 - protein, 205 aa, Glycine max
  Coding DNA Sequence Number=SeqID_74535
  Homolog annotation: Hit_ID=A7QNK6; Match level="QueryCoverage=42%, HitCoverage=74%, E-value=3e-10, Identity=40%"; Hit description =Chromosome chr2 scaffold_132, whole genome shotgun sequence
MSILILRLRKRMRRDNKRGRVALISILQRISDPRGSPESLNKSTLHFVRYKGRSAKRAGSLIVPHPTVQTSSVEYVTTIRQPSDLIVFLELAQTHRARLRGIHQLPELHHRQDFPDERGRHGFELFGHSGLGFGPGNVGLEEVVEAHEAEEAANQLPEEAQEGEDVKEKLREEELRVPHWETHQNSDVVSFRVKRKSEREREREK

SEQ ID NO: 166221 - protein, 74 aa, Glycine max
  Coding DNA Sequence Number=SeqID_74536
MLSLDEDIPRVSKVKWRLSCNEKDFSRLVDPFVPYKIPANRTLMSACTLFFPRNTSHQWLQIHCKTQRLFLRSY

SEQ ID NO: 166222 - protein, 140 aa, Glycine max
  Coding DNA Sequence Number=SeqID_74537
  Homolog annotation: Hit_ID=Q9SLF1; Match level="QueryCoverage=64%, HitCoverage=17%, E-value=3e-11, Identity=43%"; Hit description =Nodulin-like protein
MAKSVWVHPWPQHVGVKSIGGGFVGYVDVLVLEELISEKENETVLAAEKAEAKIVKRTPVVGDVEHTKMEALRSMDFWTLFVSFLCGVGTNLVVVNNMVQGTFNLEEKMLLDLFNDDLSRCMMAVVSEQIMVLRGKKNIF

SEQ ID NO: 166223 - protein, 67 aa, Glycine max
  Coding DNA Sequence Number=SeqID_74538
MLGSPICKAVEIAAKKSHRCFLVTPKWLNALRVIEHRPVMRKMMTLNFKICRGMDQIWILSVCLKDV

SEQ ID NO: 166224 - protein, 276 aa, Glycine max
  Coding DNA Sequence Number=SeqID_74539
MDLGLDELISLIKGGPSVWAAHALAYVSLPEVACIENIVHVGETWIILSVDCASGPPIDHVPMSSMATEGGLELLKGISLPRLDHVLTMGEREIWQETSGAKAIELTSIAHHTGMYLVRDGSRKPRKTISSHTGAQTDTTVAYKSIATGSLAIIDCSTLERVTGVEGKRGRRSRLNCESRLTSGNMRHPVMTSNCQYPFRLNLNQSGGRGRNRERQRRRIATPASPSVTSVTRLNSACPLNVKDSLLKPVMWAAKGIIQDPINQNAVVQRSITCIV

SEQ ID NO: 166225 - protein, 77 aa, Glycine max
  Coding DNA Sequence Number=SeqID_74540
MDYYVPLVVFYSTATRDGTVVMQPVEGRHTMLVGHNDARGGGVVDLVWYDVWVLHQMVMKGMKVERTGYRKYCKDEH

SEQ ID NO: 166226 - protein, 297 aa, Glycine max
  Coding DNA Sequence Number=SeqID_74541
  Homolog annotation: Hit_ID=Q5S4T6; Match level="QueryCoverage=92%, HitCoverage=90%, E-value=1e-51, Identity=41%"; Hit description =Putative uncharacterized protein
  Pfam annotation: Domain name=DUF1191; Domain location=25-290; Score =263.4; E_value=4.6e-76; Accession=PF06697.3; Description=Protein of unknown function (DUF1191)
MGSKIDWDFIWVLLLTLCCCGSLVHSLDNTAAACESLNSLVQDFAFRSLVKHRPQTGALYDALLPRNLSGMDVSVVRLRSRRLWNKGANFSYFQIPPRTMSIPHVRRLAIVYQNLGNWSSHYFNLPGYSLISSVVGFMVFDASNVTDTSERNITLNTMGQPISVQFPNVTFMGRGSINTRVRCVAFNANGTFQLTEMSSPGVCNSRDQGHFSVVLPLEKKRGTWYLWVIGFVVGFFGLIIAGYAVFSSMRLLKTKRIQAMEKQAGEDQVLESRWVGNSKMPSAAVTRTQPVLESGVL

SEQ ID NO: 166227 - protein, 345 aa, Glycine max
  Coding DNA Sequence Number=SeqID_74542
  Gene Ontology: Mol. function=beta-alanyl-histamine hydrolase activity; Biological process=penicillin biosynthetic process
  Homolog annotation: Hit_ID=A7QNE2; Match level="QueryCoverage=93%, HitCoverage=98%, E-value=1e-108, Identity=63%"; Hit description =Chromosome chr2 scaffold_132, whole genome shotgun sequence
  Pfam annotation: Domain name=AAT; Domain location=128-345; Score =28.6; E_value=3.5e-07; Accession=PF03417.7; Description=Acyl -coenzyme A:6-aminopenicillanic acid acyl-transferase
MGSCSVDRLEVFEVGPCKDGYQMGLLIGQRFSETIRSRVASDLILQNQLRPFAHSPHSQSLLKPLFYNNQTKFPRYWDELLGTAAGSGVPFLDILLINLRKEILAFIQKEGAKSANSDTSDDCSDVLVVSESMAIAAHNEDANVALVGHTYIIKGILPDGLFFVGYTYAGELPSCAFGFNSHGLAFTLDSVPPAEDEIVAGGIGRNFISRDLLEATSMDDAMNRIKSSEISVGHSYNLFETSTRRIVNVETASRKRISVYEVQDENSISRHKRAAVLTKESKGDFLSLLGDMDDKKYPIYMTGPLLHTLCTALIDLDKQTLSIIEGNPKKGDVSHVFSIAPQKSP

SEQ ID NO: 166228 - protein, 201 aa, Glycine max
  Coding DNA Sequence Number=SeqID_74543
  Homolog annotation: Hit_ID=Q2HTA0; Match level="QueryCoverage=46%, HitCoverage=15%, E-value=3e-12, Identity=44%"; Hit description=IMP dehydrogenase/GMP reductase, related
  Pfam annotation: Domain name=DUF1723; Domain location=117-166; Score =54.5; E_value=3.6e-13; Accession=PF08330.1; Description=Protein of unknown function (DUF1723)
MVRTRSLGRTLGKVIRRVLGREVSHDADEAPKRQRPIAFAYGQREVALVGEDIHHMDHADDEDHEQPEEAAVDDECPELKLCSHGKNVDKFSRPAPEIEGSVAVTGLIPLIACSLDIGDRGLMSAFVERWHTKISSFHLPVGEVTITLDDAASLLHLPITGTFHSFEPLHVDHVVLLLVELLEVSVEEARAKTVQCHEAYV

SEQ ID NO: 166229 - protein, 200 aa, Glycine max
  Coding DNA Sequence Number=SeqID_74544
  Homolog annotation: Hit_ID=A7QU98; Match level="QueryCoverage=85%, HitCoverage=68%, E-value=4e-43, Identity=54%"; Hit description =Chromosome chr2 scaffold_176, whole genome shotgun sequence
MYAWSPDVKDIIIIVWGWGKGWVNVMDDGPAKLNIIPDHFQVPTASIESPESRTSSIAEPGTDQSSSGCHGVPVLEVRKRSDLSSFYAVHLLSLVKVELTAAELESLRSELADIAEREAHSKAQLEHIDEVLRSARLSGYLYIRTVLTAHPTPRWATLPGEPPPLDDTEVDDWLPRFVVLHGACIFLYLLCTGIAISSQK

SEQ ID NO: 166230 - protein, 600 aa, Glycine max
  Coding DNA Sequence Number=SeqID_74545
  Gene Ontology: Mol. function=protein binding; Biological process =small GTPase mediated signal transduction
  Homolog annotation: Hit_ID=A7QUA7; Match level="QueryCoverage=82%, HitCoverage=74%, E-value=1e-129, Identity=52%"; Hit description =Chromosome chr2 scaffold_176, whole genome shotgun sequence
  Pfam annotation: Domain name=LRR_1; Domain location=118-140; Score =4.0; E_value=56; Accession=PF00560.24; Description=Leucine Rich Repeat
  Pfam annotation: Domain name=LRR_1; Domain location=142-164; Score =4.2; E_value=50; Accession=PF00560.24; Description=Leucine Rich Repeat
  Pfam annotation: Domain name=LRR_1; Domain location=187-209; Score =2.8; E_value=94; Accession=PF00560.24; Description=Leucine Rich Repeat
  Pfam annotation: Domain name=LRR_1; Domain location=211-231; Score =11.9; E_value=1.9; Accession=PF00560.24; Description=Leucine Rich Repeat
  Pfam annotation: Domain name=LRR_1; Domain location=323-345; Score =8.9; E_value=7; Accession=PF00560.24; Description=Leucine Rich Repeat
  Pfam annotation: Domain name=LRR_1; Domain location=348-369; Score =5.7; E_value=27; Accession=PF00560.24; Description=Leucine Rich Repeat
  Pfam annotation: Domain name=LRR_1; Domain location=372-395; Score =2.8; E_value=92; Accession=PF00560.24; Description=Leucine Rich Repeat
  Pfam annotation: Domain name=LRR_1; Domain location=418-440; Score =6.4; E_value=20; Accession=PF00560.24; Description=Leucine Rich Repeat
  Pfam annotation: Domain name=LRR_1; Domain location=442-464; Score =2.6; E_value=1e+02; Accession=PF00560.24; Description=Leucine Rich Repeat
  Pfam annotation: Domain name=LRR_1; Domain location=490-513; Score =2.8; E_value=95; Accession=PF00560.24; Description=Leucine Rich Repeat
  Pfam annotation: Domain name=LRR_1; Domain location=68-91; Score =11.1; E_value=2.7; Accession=PF00560.24; Description=Leucine Rich Repeat
  Pfam annotation: Domain name=LRR_1; Domain location=93-116; Score =3.3; E_value=74; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1; Domain location=118-140::142-164::187-209::211-231::323-345::348-369::372 -395::418-440::...
  Pfam module annotation: Domain location=442-464::490-513::68-91::93 -116
  Subcellular localization annotation: CTP_CleavageSite=43; ConfidenceScore=5.39e-01
MADAEPQSRSLAFSSRRLSPPPPHRPPPPLPLSPRVSTLIFTVAEEVDVRGDNSVDAEWMAYLGAYRHLRYLNLSDCHRVSTSALWPITGMSSLQELDLSRCFKVNDAGINHILSIPNLERLRISETSVTAKGVKLLASLKNLSLLDLGGLPVDDVALTSLQFSTASDVAAVKDCFMSLYSSQVLKRLHYIDLWGSKISNKGASVLNTFPKLTYLNLAWTSVTKLPKLSFLEYLNMSNCTIDSILEDDKAPLAKLILSGAMFMNEAEALLYANTNFLSFLDVANSSFHRFFFLSKMKVIEHLNLSSCMMGDDSVEMVACAGGNLKSLNLSGTRVSSAGLGILAGHVPHLEILSLSQTPVDDTAISFISMMPSLKDVDLSNTNIKASYPVIRIFNSGFLHQGRTDVNSLLSLMALQNLKLERLNLEHTQVRDEALYPLSSFQELRYLSLKSASLADISLYYLSSIPKLTNLSICDAVLTNYGLDMFKAPETLKLLDLKGCWLLTEDTILSFCRNHPQVEVRHELGTLFPVNQNGLNHSSPSRSTSKTMQMTKKKDQIPLSPYFVDQRLKYSRDELLALQFTSLPLASSSESGNSIFEKQLG

SEQ ID NO: 166231 - protein, 531 aa, Glycine max
  Coding DNA Sequence Number=SeqID_74546
  Gene Ontology: Mol. function=catalytic activity; Cellular component =endoplasmic reticulum membrane; Biological process=metabolic process
  Homolog annotation: Hit_ID=A2Y9K6; Match level="QueryCoverage=97%, HitCoverage=99%, E-value=1e-133, Identity=44%"; Hit description =Putative uncharacterized protein
  Pfam annotation: Domain name=AMP-binding; Domain location=80-400; Score=141.4; E_value=2.5e-39; Accession=PF00501.19; Description=AMP -binding enzyme
MAEKRFIVEVEKATEGGEGRPSMGPVYRSIFADDLLPPPIEGLNTCWDIFRMSVEKYPARKMLGVREIVNGNPGKYKWQTYKEVYDLVMNVGNSIRACGYGEGVKCGIYGANCPEWIVSMEVTPEQKQEVEEFGLAMYSWDEFLQVGHNQSFDLPVKKKSDVCTIMYTSGTTGDPKGVLISNESIITLLAGIQQLLKSCNEKLNEKDVYISYLPLAHIFDRVIEEAMIMHGASIGFWRGDVRLLLEDIGELRPTIFVAVPRVLDRVYNGLTETCAGTFVSLPNEKDMLGTVGPPVPYVDVRLESIPEMGYDALATTPRGEICVRGSTVFTGYYKREDLTKEVMIDGWFHTGDIGEWLPNGTMKIIDRKKNIFKLSQGEYVAVENLENIYVQASSVESVCLVNPSLLINLSAFIMNDIKSFESYLVAIVNPSKQALDKWAEENDITADFNSLCEDSRTKSYIIGELTKIAKDKKLKGFEFIKAVHLDPVPFDMERGLMTPTFKKKRPELLKYYQNTIDNMYKTQNTQNKSSA

SEQ ID NO: 166232 - protein, 151 aa, Glycine max
  Coding DNA Sequence Number=SeqID_74547
  Homolog annotation: Hit_ID=A7QU94; Match level="QueryCoverage=76%, HitCoverage=23%, E-value=2e-34, Identity=57%"; Hit description =Chromosome chr2 scaffold_176, whole genome shotgun sequence
MEPPTSPLPTYWTNNSSSDDALQIIADNSSGFSGRIPFGKIVKCPSCRIAVGVAQPQQGSPPAERSMDITAWERGLRYVKLMKQSIPAAVHSIVVQTPSGLTRTHRFATETVDLPAQEGERVTVAVAALSNVYRKRIQAEANDEAERLLSS

SEQ ID NO: 166233 - protein, 131 aa, Glycine max
  Coding DNA Sequence Number=SeqID_74548
MIRTIFACFNGKVSHKKVKVEPLEVTKPVYRDELTRKQRPRKAVQKTVRFAESEPTILGEDSEKEFEKTRFGSGNEVGEKEEMRVRIKLTKEEAARLLSKCNNGGVLQFKDVAHELAFLVNRVNIVPDAQC

SEQ ID NO: 166234 - protein, 1350 aa, Glycine max
  Coding DNA Sequence Number=SeqID_74549
  Gene Ontology: Mol. function=metal ion binding
  Homolog annotation: Hit_ID=A7QU82; Match level="QueryCoverage=70%, HitCoverage=98%, E-value=0.0, Identity=49%"; Hit description =Chromosome chr2 scaffold_176, whole genome shotgun sequence
  Pfam annotation: Domain name=PHD; Domain location=131-185; Score =41.9; E_value=2.3e-09; Accession=PF00628.20; Description=PHD-finger
  Pfam annotation: Domain name=zf-C3HC4; Domain location=33-71; Score =17.0; E_value=0.001; Accession=PF00097.16; Description=Zinc finger, C3HC4 type (RING finger)
  Pfam module annotation: Pfam domain module=PHD::zf-C3HC4; Domain location=131-185::33-71
MEADFVTSDMLTLTQDAFYANDNDDVAVEGERCGICMDMVIDRGLLDCCQHWFCFVCIDNWATITNLCPLCQNEFQLITCVPVYDTIGNNKVEDDSFFRDDDWSIEEKNNTLSFPSYYIDENAVICLDGDGCKVRNGLATIEGDSDLDTSIACDSCDIWYHAFCVGFDTEGTSDSTWLCPRCVADEVSKGTSNSVERTTVECNADNRNSNSECHAEDSFSGKVSVSVADTGETAVVVSMVDQTIWVPATSEKSLLSFEVGGYPMTESCILMSDTNGQQSGEVKTETNTLRIMEEEELELSLSNNISCSITSKSLVHNDLKKSVSGARDDPSGFDGTKLFNESLTKTSPSRIESEMGLQLGLSVGSFLSVDSADKNETKDQATDVLCLSSEECFLKGDEIEANACKDNARVAGGKRKHTDYRERENVKMLWDEAHFALVLTPHAYYTLTDDSNMDTRPNTNTDALTWSIDEQVYIKADDGDVKPELPEEDDKPELPDEIGQKKIRATGSQMTSTNDSADAHPLENAQKCPALKHSPTKAIVKSNIMNIVKGTNRRQSKGRTDTNACDKLSENKGNMAGLRVKKIMKRVSDDGESSLVVQNLRQEIREAVRNKSSINFEDNHFDPKLLEAFRAAITGPKTELVNKLSPAAIKAKKSMLQKGKVRENLTKKIFGTSNGRRKRAWDRDCEIEFWKYRCMRATKPEKIETLKSVLDLLRKGSDSPESKQASECQAKNPILSRLYLADTSVFPRKEDVKPLSVLKTIANSEQTKHNNPSDKAPNLFVDNNTKATNVYNLLSKNSVCSSEKKVDKKLVHGPVGDNSTSGKVRSNNHSERTSVSSAGAKTSTKELGLKLGCMKSDKRKWALEVLARKTAATSRNTANGNQEDNAVFKGNYPLLAQLPIDMRPVLAPCRHNKIPISVRQAQLYRLTERLLRNTNLAVIRRTADTELAVADAVNIEKEVADRSNSKLVYLNLSSQELLHRTNNTKTNVATDTSPPASSAMLTDQQSELNTDDLSTDPEVETALKNAGLLSDSPPSSPHESRETCNSDMSGPDNILELDSHPDLDIYGDFEYDLEDEDYIGASVTKVSNPKQEQNESKVKLVFSTMNLKKSDIALDCADWEGSERIEVPGDASCSPNCHNDAVLRDRASTIDEEMGQPSVSSELLPCEAAVEPPDSEFEELYGPDKEPLIKKFPVSESRSLLGDGKTENLSVANDCHNDETEVLDDAVNASELENENLTEKVSVTTITDKSSNVSEGGENSQKKEEKSNVIAKQTDSVNHVEAYIKEHIRPLCKSGVITADQYKWAVAKTTEKVMKYHSKAKNANFLIKEGEKVKKLAEQYAEAAQQNRKN

SEQ ID NO: 166235 - protein, 572 aa, Glycine max
  Coding DNA Sequence Number=SeqID_74550
  Gene Ontology: Mol. function=beta-amylase activity; Cellular component=extracellular region; Biological process=polysaccharide catabolic process
  Homolog annotation: Hit_ID=A7QU41; Match level="QueryCoverage=91%, HitCoverage=93%, E-value=0.0, Identity=65%"; Hit description =Chromosome chr2 scaffold_176, whole genome shotgun sequence
  Pfam annotation: Domain name=Glyco_hydro_14; Domain location=93-531; Score=320.5; E_value=3.1e-93; Accession=PF01373.8; Description =Glycosyl hydrolase family 14
  Subcellular localization annotation: CTP_CleavageSite=49; ConfidenceScore=5.73e-01
MAILSQSTASFSFSFSFVSTRTDSTRLTRFPSRVTFRARSPPRRHALVSSRLNSSRSPDAGGSLSPDNGSGDVAYQLHHDFSPRRRRRGSPVFVTLPVNSVGREGRVARPKAMMFSLKALATAGVEGVVIEIWWGLVEKNKPRVYDWRGYEELVAMACKCGLKVRAVLAFHQHGTGPDDPNWYVLIIENHTFTPIGRIPLPLWVLDEIQKDIELAYCDRFGRRNIEYISLGCDILPVLHGRSPIQAYADFMRNFRDTFGSLLGVIITGVQIGMGPGGELRYPSFSSQEPNLAWPHELGEFQCYDKYMLASLNASARNIGKREWGNGGPFGSGSLMQNPEHTDFFKNDGGSWDTPYGKFFLEWYSDMLLLHGERICREAETIFRGSEVHISAKLAAIHWHYVTQSHPSELTAGYYNTSNRDGYLPIARMFSKYGFSMCCSCFEMQDAVMQKINPDGSPEGFLRQLLLAARLCDISLEGQNFSTNLDDGAFTQVLKMSKFYSDGIEKRSFSFNFVRMDKRLFESRNWDRFTRFVRQMSNGNIFRARLNSVRDVRLKTTPVVAAVGLLYHLYQHS

SEQ ID NO: 166236 - protein, 999 aa, Glycine max
  Coding DNA Sequence Number=SeqID_74551
  Gene Ontology: Mol. function=protein transporter activity; Cellular component=nuclear pore; Biological process=protein import into nucleus, docking
  Homolog annotation: Hit_ID=A7QF13; Match level="QueryCoverage=86%, HitCoverage=99%, E-value=0.0, Identity=88%"; Hit description =Chromosome chr16 scaffold_86, whole genome shotgun sequence
  Pfam annotation: Domain name=HEAT; Domain location=216-252; Score =7.5; E_value=2.1; Accession=PF02985.13; Description=HEAT repeat
  Pfam annotation: Domain name=HEAT; Domain location=298-336; Score =14.6; E_value=0.17; Accession=PF02985.13; Description=HEAT repeat
  Pfam annotation: Domain name=HEAT; Domain location=343-379; Score =20.8; E_value=0.0051; Accession=PF02985.13; Description=HEAT repeat
  Pfam annotation: Domain name=HEAT; Domain location=491-527; Score =17.4; E_value=0.053; Accession=PF02985.13; Description=HEAT repeat
  Pfam annotation: Domain name=HEAT; Domain location=533-570; Score =16.8; E_value=0.079; Accession=PF02985.13; Description=HEAT repeat
  Pfam annotation: Domain name=HEAT; Domain location=583-617; Score =1.9; E_value=14; Accession=PF02985.13; Description=HEAT repeat
  Pfam annotation: Domain name=HEAT; Domain location=628-667; Score =7.7; E_value=1.9; Accession=PF02985.13; Description=HEAT repeat
  Pfam annotation: Domain name=HEAT; Domain location=730-766; Score =3.9; E_value=7.1; Accession=PF02985.13; Description=HEAT repeat
  Pfam annotation: Domain name=IBN_N; Domain location=152-232; Score =83.0; E_value=9.3e-22; Accession=PF03810.10; Description=Importin -beta N-terminal domain
  Pfam module annotation: Pfam domain module=HEAT::HEAT::HEAT::HEAT::HEA T::HEAT::HEAT::HEAT::IBN_N; Domain location=216-252::298-336::343 -379::491-527::533-570::583-617::628-667::730-766::152-232
MKIDIEQAFQNRAVDGRIVAWRLTLFESTADIVRVCCTANIKKQVLKNRKNLKHWRLCFFPHSARVSESPRSLTWLRLALSIADSTRYLVVTKKCRTSICSSSCIFDLLGHLQTVFECAEAYFLSNGVQMAMEVTQILLNAQAVDGTLRKQAEESLKQFQEQNLPSFLFSLAGELANDDKPAESRKLAGLILKNALDAKEQHRKIEFVQRWLSLDPTLKSQIKAFLLRTLSSPSLDARSTASQVIAKVAGIELPHKQWPELIGSLLSNAHQLPAPTRQATLETLGYICEEVSPDVVDQDHVNKILTAVVQGMNSTEENNDVRLAAIKALYNALGFAQANFSNDMERDYIMRIVCETTQSPELKIRRAAFECLVAISSTYYEKLAPYIQDIFNITAKAVREDEEPVALQAIEFWSSICDEEIDILEEYGGDFSGDSEVPCFYFIKQALSFLVPMLLETLLKQEEDQDQDEGAWNIAMAGGTCLGLVARTVGDDIVPLVMPFIEENITKPDWRQREAATYAFGSILEGPSPDKLVPLVNMALNFMLTALMKDPNNHVKDTTAWTLGRMFEFLHGSALDTPIITPANCQQIITVLLQSMKDVPNVAEKACGALYFLAQGYEDAASASSPLTPFFQDIVHALLTVTHREDAGESRLRTAAYEALNEVVRCSNDETAPMVVQLVPLIMMELHQTLENQKVSSDERQNELQGLLCGCLQVIIQKLGSSEPTKYHFMQYADQIMGLFLRVFASRSATAHEEAMLAIGALAYATGADFAKYMTEFYKYLEMGLQNFEDYQVCAITVGVVGDVCRALEEKVLPYCDGIMTQLLKDLSSNQLHRSVKPPIFSCFGDIALAIGENFEKYLLYAMPMLQSAAELSAHTSGADDDMTEYTNSLRNGILEAYSGIFQGFKGSPKTQLLMSYAPHVLQFLDSLYMEKDMDDVVTKTAIGVLGDLADTLGSSAGPLIQQSVSSKDFLKECLSSDDHLIKESAEWAKLAISRAISF

SEQ ID NO: 166237 - protein, 219 aa, Glycine max
  Coding DNA Sequence Number=SeqID_74552
  Homolog annotation: Hit_ID=A7PXS9; Match level="QueryCoverage=73%, HitCoverage=83%, E-value=5e-15, Identity=36%"; Hit description =Chromosome chr15 scaffold_37, whole genome shotgun sequence
MGNCSMKGTTGECHHSIRVMCDSGAILQLKAPKTVAQVLQHYPGYGIFRQGHASAPLPEQESLSYDLFYYLLPLKEVQVEHQKSCCDKVQQVVQRSEEMCKSAACDYVENLSNGSALEVLPTAKNGVWRVKLLIDPRQLEEILSEQVNTEALIEKMRMAATSCSTTSPSPSRSPSPTTSSKKVGWKTTLFNGKIAKDTIPVPAPAVVNVGVKKSELSSL

SEQ ID NO: 166238 - protein, 778 aa, Glycine max
  Coding DNA Sequence Number=SeqID_74553
  Gene Ontology: Mol. function=binding
  Homolog annotation: Hit_ID=A7PKW2; Match level="QueryCoverage=86%, HitCoverage=56%, E-value=0.0, Identity=81%"; Hit description =Chromosome chr7 scaffold_20, whole genome shotgun sequence
  Pfam annotation: Domain name=HEAT; Domain location=181-217; Score =3.4; E_value=8.4; Accession=PF02985.13; Description=HEAT repeat
  Pfam annotation: Domain name=HEAT; Domain location=555-591; Score =13.2; E_value=0.29; Accession=PF02985.13; Description=HEAT repeat
  Pfam module annotation: Pfam domain module=HEAT::HEAT; Domain location=181-217::555-591
MALELSSPFLPLMIFRLVMLSKSERKAYLGLKVVIKTTLQKGGNTVAPEFMIAGTDNTASEAPIYHPKQSTICCLECSEKTPSGSWESSISALCCTRFSNLKTRVDCRISFADPVAVRHALEIVSEIATMDPYAVAMALGKHVQPGGALQDVLHLHDVLARVSLARLCCTISRARALDERSDIRSQFNSVLYQLLLDPSERVCFEAILCVLGKYDNAERTEERAAGWYRLTREILKLPDASSKESSKDKQKTKRPQLLIKLVMRRLESSFRSFSRPVLHAAARVVQEMGKSRAAAFALGIQDVEEGAHVNTFAEATDYNDSDESTHPESIRRTSSVSNLTAGRDTVSGMLASLMEVVRTTVACECVYVRAMVIKALIWMQGPFDSFDELESIIASELSDPAWPAALLNDVLLTLHARFKASPDMAVTLLQIARIFATKVPGKVDADVLQLLWKTCLVGAGPDGKHKALEAVTIVLDLPPPQPGSMLGLTSVDRVSASDPKSALALQRLVQAAVWFLGENANYAASEYAWESATPPGTALMMLDADKMVAAASSRNPTLAGALTRLQRCAFNGSWEIRIIAAQALTTMAIRSGEPFRLQIYEFLHTLGQGGLQSQFSDMHLSNGEDQGASGTGLGVLLSPMIKVLDEMYRAQDDLIKEIRNHDNAKKEWTDDELKKLYETHERLLDLVSLFCYVPRTKYLPLGPISAKLIDIYRTRHNISASTGLSDPAVATGISDLVYESQPPAAEPDTLDDDLVNAWAANLGDDGLWGNNAPAMNRV

SEQ ID NO: 166239 - protein, 34 aa, Glycine max
  Coding DNA Sequence Number=SeqID_74554
MKVGKGNRNGMDSEVKSRNGEAKIVSESKEYPCR

SEQ ID NO: 166240 - protein, 1204 aa, Glycine max
  Coding DNA Sequence Number=SeqID_74555
  Gene Ontology: Mol. function=protein dimerization activity; Cellular component=nucleus; Biological process=regulation of transcription, DNA-dependent
  Homolog annotation: Hit_ID=A7PFD6; Match level="QueryCoverage=89%, HitCoverage=99%, E-value=0.0, Identity=60%"; Hit description =Chromosome chr11 scaffold_14, whole genome shotgun sequence
  Pfam annotation: Domain name=Auxin_resp; Domain location=258-341; Score=190.9; E_value=3.2e-54; Accession=PF06507.4; Description=Auxin response factor
  Pfam annotation: Domain name=B3; Domain location=131-236; Score =105.0; E_value=2.3e-28; Accession=PF02362.12; Description=B3 DNA binding domain
  Pfam module annotation: Pfam domain module=Auxin_resp::B3; Domain location=258-341::131-236
MKAQPPDGAAAVAPNAGEGGEKKTINAELWQACAGPLLNLPSPGTHVVYFPQGHSEQVAASLKKDVDAQVPNYTNLPSKIPCLLHNVTLHADPDTDEVYAQMTLQPVPSFDTDALLRSDIFLRSSKPQPEFFCKQLTASDTSTHGGFSVPRRAAEKIFPPLDYSVQPPAQELVARDLHDNVWRFRHIYRGQPKRHLLTTGWSLFIGGKRLLAGDSVLFVRDEKQQLLLGIRRANRQPSNLSSSVLSSDSMHIGVLAAAAQAVANNSPFTVFYNPRASPSEFVIPLAKYSKAVYSHHISPGMRFRMMFETEDSGTRRYMGTIIGVSDLDSVRWKNSLWRNLQVGWDESTAEERQSRVSVWEIEPVTTPYFICPPPFFRSKIPRLLGMPDDEPDFNNLFKSTVPWLGDDMCVKGPQALPGLSLVQWMNIQQNPALASSLQPNCGPSMSGLVLQNLPGADIANPLGFSTSQISQSNNVSVDAQNILQTSQQLDHIQKPPCPSSALGAVTQPLQQLGDITQQPRNLTNQTLPHDQAHTQLLNPQRVVQTNNIHQQQQSSIQKQQLLRSLSQNRAQKHQQTTLGLNERQIVFQSPMPDHFNQQLQMSDNQVRFQLLQKLQQQQQTLLAQQSALQQPALIQIQDQQRQLLDVANNSSSPIPGQVLENLPTLQNSLPEANSITHQITMPSSQKNFHYSHLSQQPALLSEMSGHVGLPPTVTTNPLSASGGSILTGVGQSVITDDVPSCSTSPSTNNRASVLPPVVSSQIHRSTTIGDDMAQSAVTISGASTLETMSSNANIVQPKYEVKASLNISKNQNQGNVAPQTYLNGVVQTDYLDSSSSTTSLYHFRSDTHMHQNTNPFSYNPQLVYCRDNSQNVEVQADARNNVLIGNNVNGQMGMPSNLDSLLTKGTVGLGKELSNKFASGGLLRDLENNKGVPPEISSSMVSQTFEVPDMSFNSIDSTIDGSSFLNRGPWDLPPPPPPQQQQVQRIRTYTKVYKRGAVGRSIDITRYSGYEDLKQDLALRFGIEGQLEDLQRIGWKLVYVDHENDVLLVGDDPWEEFVNCVRCIKILSPQEVQQMSLDGDFGNGGLPYPAGSSSDGHIHQCCPKGCGVGRQMILSCCSRLGNICGYNLLGEICLCHVQANLKSQKKKKVEKFAALNLRLTFKVVNLVMNEILGPHAHGTSQQRCVKPYACDDVEKLSRSSLGSV

SEQ ID NO: 166241 - protein, 390 aa, Glycine max
  Coding DNA Sequence Number=SeqID_74556
  Gene Ontology: Mol. function=metal ion binding; Cellular component =nucleus; Biological process=regulation of transcription, DNA -dependent
  Homolog annotation: Hit_ID=A5BME3; Match level="QueryCoverage=100%, HitCoverage=100%, E-value=2e-91, Identity=48%"; Hit description =Putative uncharacterized protein
  Pfam annotation: Domain name=SBP; Domain location=94-172; Score =170.5; E_value=4.4e-48; Accession=PF03110.5; Description=SBP domain
MDWNLKALSWDLSEVDQANLPNMETMEGSSRYGMYRTKGEFSVDLKLGQVGNSGTESVLTKSKDAVGVSKMTSSSTSGSSKRARALSNGTQTVSCLVDGCHADLSNCRDYHRRHKVCEVHSKTAQVSIGGQKQRFCQQCSRFHSLEEFDEGKRSCRKRLDGHNRRRRKPQPESLTRSGSFLSNYQGTQLLPFSSSHEYPSTTVVNPTWGGVLTTSGDVRLHGHNQHHHQVHLADKQDLFLGSSPAGYKEGKQLAFMQGDHTLNNRSPHLPGASVGQAQMFLRTSLYSESDGLRCKMFCDSLTSSIQDNNTSRALSLLSSPPQPLSPGNGLNLMVNSHSPLMQPLGLSLHDNSLGSVDPVLGPNDSSSMYNIGSNGSQGNEAPPLFPFQWE

SEQ ID NO: 166242 - protein, 318 aa, Glycine max
  Coding DNA Sequence Number=SeqID_74557
  Gene Ontology: Mol. function=metal ion binding; Biological process =metal ion transport
  Homolog annotation: Hit_ID=A7PHJ6; Match level="QueryCoverage=52%, HitCoverage=55%, E-value=2e-56, Identity=68%"; Hit description =Chromosome chr17 scaffold_16, whole genome shotgun sequence
  Pfam annotation: Domain name=HMA; Domain location=160-222; Score =50.8; E_value=4.9e-12; Accession=PF00403.17; Description=Heavy-metal- associated domain
  Pfam annotation: Domain name=HMA; Domain location=61-124; Score=45.2; E_value=2.3e-10; Accession=PF00403.17; Description=Heavy-metal -associated domain
  Pfam module annotation: Pfam domain module=HMA::HMA; Domain location =160-222::61-124
MIEGVLEISKTAQEEKKLEESKEENKKAEEPKKEEEKKEERKTEESKDDKESKEKVAPSEIVLKVFMHCEGCARKVRRSLKGFPGVEDILTDCKSHKVVVKGEKADPLKVLERLQKKSHRKVELLSPIPKPPTEEEKKPQEEQEKPKPEEKKEEPRVITVVLKVHMHCEACAQEIKRRIEKMKGVESAEADLKKSEVSVKGVFETAKLVEHVYKRTGKHAVIVKQEAEKKEEEKKAEEEVEKKMEKGSGEGEENKEKKEGGEGEAKAEEASTVLEVKKSEYYYNPPPRYGGMEFYAYSGPAYPPQIFSDENPNACSVM

SEQ ID NO: 166243 - protein, 309 aa, Glycine max
  Coding DNA Sequence Number=SeqID_74558
  Gene Ontology: Mol. function=nucleoside-triphosphatase activity; Cellular component=chloroplast; Biological process=transport
  Homolog annotation: Hit_ID=Q2PER0; Match level="QueryCoverage=100%, HitCoverage=95%, E-value=1e-119, Identity=74%"; Hit description =Putative ABC transporter like ATPase
  Pfam annotation: Domain name=ABC_tran; Domain location=68-261; Score =92.2; E_value=1.6e-24; Accession=PF00005.18; Description=ABC transporter
  Subcellular localization annotation: CTP_CleavageSite=33; ConfidenceScore=5.34e-01
MALSLPTHPSPTVNPLRRSPKPTLRRVNHRVCVASAATPLLQVNDLRAKIVESNVDILHGVNLTINQGEVHAIMGKNGSGKSTFAKVLVGHPDYEVTGGSVVFKGENLLEMEPEERSLAGLFMSFQSPVEIPGVSIDLFLAMAYNARMKKLGRDEVGPIEFLPYLMEKLQLVNMKPDFLNRNVNQGFSGGERKRNEILQLAVLGADLAILDEIDSGLDVDALRDVANAVNRILTPEKSLLMITHYRRILDLLNPTHVHVMVLVLSIQVKDELEEVDFLKKDKGKIARTGDISVVEAIESDGYEAVSALT

SEQ ID NO: 166244 - protein, 156 aa, Glycine max
  Coding DNA Sequence Number=SeqID_74559
  Gene Ontology: Mol. function=caffeoyl-CoA O-methyltransferase activity; Cellular component=integral to membrane; Biological process=lignin biosynthetic process
  Homolog annotation: Hit_ID=A7PEC1; Match level="QueryCoverage=84%, HitCoverage=44%, E-value=4e-46, Identity=70%"; Hit description =Chromosome chr11 scaffold_13, whole genome shotgun sequence
  Pfam annotation: Domain name=Methyltransf_3; Domain location=26-156; Score=95.9; E_value=1.3e-25; Accession=PF01596.8; Description=O -methyltransferase
MDNISKPEVCPNPVILQSEGLVKYILETGVYPREVEILKELRNATAEHPLGFMGAAPDSGQLMAFLLKLLNAKKTIEVRVFTGYSLLLTALTIPNDGKIIAMDLDRKAYEIGLPFIKKPGLEHKIDFIESQALPVLDKLLEDVTESLSADVFADMI

SEQ ID NO: 166245 - protein, 232 aa, Glycine max
  Coding DNA Sequence Number=SeqID_74560
  Gene Ontology: Mol. function=DNA binding; Cellular component=nucleus; Biological process=regulation of transcription
  Homolog annotation: Hit_ID=Q09GS3; Match level="QueryCoverage=93%, HitCoverage=100%, E-value=1e-45, Identity=45%"; Hit description =Transcription factor MYBJ6
  Pfam annotation: Domain name=Myb_DNA-binding; Domain location=14-97; Score=33.7; E_value=6.8e-07; Accession=PF00249.22; Description=Myb -like DNA-binding domain
MGRAPCCDKANVKRGRWSPEEDETLKNYLKKHATPGNWITLPQKAGLISSMEASHMRKTNLSAPFMPPSEPGKWSLIAAQLPGRTDNDVKNHWNTKLKKMFLAANTNATGNTVFSTPTSQPQVEDCSVFDDHENSAEYHVLGLEQTPLPLGSDVSGLGSSCSVPLSNEAVSASLVKEENENGTQWFGEDESFLLDFVYEDNGFVSLENSSEVAPSFGSLYAPNTTEKRKRDN

SEQ ID NO: 166246 - protein, 45 aa, Glycine max
  Coding DNA Sequence Number=SeqID_74561
MKQLVRHIVPKITWCRPTTRLTFQRGTLYKYNFCTSMHSAYGDNQ

SEQ ID NO: 166247 - protein, 299 aa, Glycine max
  Coding DNA Sequence Number=SeqID_74562
  Gene Ontology: Mol. function=mitochondrial processing peptidase activity; Cellular component=mitochondrial respiratory chain; Biological process=electron transport
  Homolog annotation: Hit_ID=A7PEE5; Match level="QueryCoverage=98%, HitCoverage=50%, E-value=1e-104, Identity=67%"; Hit description =Chromosome chr11 scaffold_13, whole genome shotgun sequence
  Pfam annotation: Domain name=Peptidase_M16_C; Domain location=2-179; Score=128.3; E_value=2.3e-35; Accession=PF05193.12; Description =Peptidase M16 inactive domain
MKHQENYTAPRIVLAASGVEHEELLSIAEPLLSDLPSVPRPEEPKSVYTGGDYRCQKESGRTHFALAFELPGGWHKLKDAMVLTVLQMLLGGGGSFSAGGPGKGMYSRLYQNVLNEYPQVHEISAFNNIYNDTGIFGIQVTTGSDFVSKAIDIAANEILAVATPGQVDQVQLDRAKQATKSAILMNLESRMVVSEDIGRQILTYGERYGSHFIFFGGLVSWCIAILFCNEYKSADMMLKDVFSLLRKPVEDFLKAVDEVTSKDITSISRKLICSPLTMASYGDVLYVPSYESVSLKFRA

SEQ ID NO: 166248 - protein, 143 aa, Glycine max
  Coding DNA Sequence Number=SeqID_74563
  Gene Ontology: Mol. function=actin binding; Cellular component=actin cytoskeleton; Biological process=actin cytoskeleton organization and biogenesis
  Homolog annotation: Hit_ID=O49894; Match level="QueryCoverage=90%, HitCoverage=86%, E-value=7e-43, Identity=66%"; Hit description =Profilin
  Pfam annotation: Domain name=Profilin; Domain location=3-138; Score =187.7; E_value=2.9e-53; Accession=PF00235.10; Description=Profilin
MKENVIGWQELNGGHHLTAAAIIGHDGSVWAQSSSFPQARNNFLFILFAHSTPIRPQEITDIMKDFDEPGHLAPTGLHLAGTKYMVIQGESGAVIRGKKGPGGITIKKTGQALVFGVYEEPVTPGQCNMVVERLGDYLIDQGL

SEQ ID NO: 166249 - protein, 60 aa, Glycine max
  Coding DNA Sequence Number=SeqID_74564
  Gene Ontology: Mol. function=actin binding; Cellular component=actin cytoskeleton; Biological process=actin cytoskeleton organization and biogenesis
  Homolog annotation: Hit_ID=Q6RG01; Match level="QueryCoverage=53%, HitCoverage=59%, E-value=3e-10, Identity=90%"; Hit description =Profilin
MERWSTTELRKKSRNTGPGGVTVKKTGAALIIGIYDEPMAPGQCNMVVERLGDYLIEQGL

SEQ ID NO: 166250 - protein, 42 aa, Glycine max
  Coding DNA Sequence Number=SeqID_74565
MCISGAPGHSRAPISRQRDNSRYFLSIGTLGFTSQLSQQQQS

SEQ ID NO: 166251 - protein, 90 aa, Glycine max
  Coding DNA Sequence Number=SeqID_74566
MEYKIKRGVGVHIAKIKFWKGKGNSKVGKGKGGGSEKKEMGRFNSKKRTQNSPIVKSLSSSVLWSDVSSKRKIPQCPKTSDTLVSREGIP

SEQ ID NO: 166252 - protein, 410 aa, Glycine max
  Coding DNA Sequence Number=SeqID_74567
  Gene Ontology: Mol. function=transferase activity; Cellular component= mitochondrial outer membrane; Biological process=glycolysis
  Homolog annotation: Hit_ID=A7PEG5; Match level="QueryCoverage=64%, HitCoverage=54%, E-value=1e-116, Identity=79%"; Hit description =Chromosome chr11 scaffold_13, whole genome shotgun sequence
  Pfam annotation: Domain name=Hexokinase_1; Domain location=13-220; Score=180.1; E_value=5.7e-51; Accession=PF00349.12; Description =Hexokinase
  Pfam annotation: Domain name=Hexokinase_2; Domain location=227-376; Score=-78.6; E_value=4.6e-07; Accession=PF03727.7; Description =Hexokinase
  Pfam module annotation: Pfam domain module=Hexokinase_1::Hexokinase _2; Domain location=13-220::227-376
MGKVAVGAAVVCAAAVCATAALVLRQVADAMDVEMHAGLASEGGSKLNMLISFVDNLPTGDEEGLYYALDLGGTNFRVLRVHLGGKDKGVIGQEFEEVSIPPNLMTGSSEALFDFIAAALAKFVGSEPEGFHPPPGRQRELGFTFSFPVRQTSIASGTLIKWTKGFNIEDVVGEDVVGELTKSMEKIGLDMRVAALKFGVIRFYGVNDTIGTLAGGRFYNQDVVAAVILGTGTNAAYVERAHAIPKWHGLIPKSGDMVINMEWGNFRSSHLPLTEYDLALDAESLNPGEQRELLPRIVANPKFIVVVATGVDGGKSSHYLCYCGTLLRTNIRPNSSAGEEHLCFWQTQGSGVVSNFPVNPYPCSVVPPYCSGLSYIALCPFLSNSTLCSLSNRLTHVFHFIVLSFFPLSS

SEQ ID NO: 166253 - protein, 661 aa, Glycine max
  Coding DNA Sequence Number=SeqID_74568
  Gene Ontology: Mol. function=oxidoreductase activity, acting on the CH-OH group of donors, NAD or NADP as acceptor; Cellular component =cytoplasm; Biological process=malate metabolic process
  Homolog annotation: Hit_ID=P51615; Match level="QueryCoverage=92%, HitCoverage=100%, E-value=0.0, Identity=78%"; Hit description=NADP -dependent malic enzyme
  Pfam annotation: Domain name=Malic_M; Domain location=359-630; Score =435.5; E_value=7.4e-128; Accession=PF03949.6; Description=Malic enzyme, NAD binding domain
  Pfam annotation: Domain name=malic; Domain location=168-357; Score =421.5; E_value=1.2e-123; Accession=PF00390.10; Description=Malic enzyme, N-terminal domain
  Pfam module annotation: Pfam domain module=Malic_M::malic; Domain location=359-630::168-357
MWKHRKRALGMGHWCLSNLGFSGCCGTNSSKRKISKDQHYNTGEDKKVIGREMESTLKALRDGESVLDLSPRSTVSGGVEDIYGEDRATEDQLVTPWIFSVASGYSLLRDPQYNKGLSFTEKERDAHYLRGLLPPTVSTQQLQEKKLMNSIRQYQVPLQKYVAMMDLQERNERLFYKLLIDNVEELLPVVYTPTVGEACQKYGSIFRRPQGLYISLKEKGKILEVLKNWPERSIQVIVVTDGERILGLGDLGCQGMGIPVGKLALYTALGGVRPSACLPITIDVGTNNEKLLNDEFYIGLRQRRATGQEYYDLMHEFMTAVKQNYGEKVLVQFEDFANHNAFELLAKYGTTHLVFNDDIQGTASVVLAGVVAALKLIGGTLPEHTFLFLGAGEAGTGIAELIALEMSKQTKAPIEESRKKIWLVDSKGLIVSSRKNSLQHFKKPWAHEHEPVNSLLEAVKVIKPTVLIGSSGVGRTFTKEVVEAMTSNNDVKPCVTLLVDEYLCEYLDKPLILALSNPTSQSECTAEEAYQWSEGRAIFASGSPFDPVEYKGKVYASGQANNAYIFPGFGLGLVISGAIRVHDDMLLAASESLAKQVSEENYKNGLIYPPFSNIRRISANIAANVAAKAYELGLATRLPRPQNLVKCAESCMYTPVYRNYR

SEQ ID NO: 166254 - protein, 435 aa, Glycine max
  Coding DNA Sequence Number=SeqID_74569
  Homolog annotation: Hit_ID=A7PEI9; Match level="QueryCoverage=96%, HitCoverage=44%, E-value=1e-123, Identity=56%"; Hit description =Chromosome chr11 scaffold_13, whole genome shotgun sequence
  Pfam annotation: Domain name=DUF810; Domain location=18-435; Score =29.9; E_value=1.4e-19; Accession=PF05664.2; Description=Protein of unknown function (DUF810)
MHEHAVEFEDLPFPFAPNLSESEIRETAYEMLVGACRSSGPKPLTFFSHSEQSNRGGQRIPSPSLYRSLTVTASSKVKKKLGLRLRTTSSSSGNRRAATTGELMRVQMKVSELTDTRVRRALLRVAAGQLGRRIESMVLPLELIQQLKCSDFPSEQEYEAWLRRNLKVLEAGLLLHPRLPLDKADTSALRLQQIIHEGLEKPMDIGKDSESMLALRSVVMSLAWRSFDGSVPDTCHWADGFPLNLRIYQTLLEACFDNHDETCVIQEVDEVLELIKTTWAMLGVNEMLHDVCFSWVLFQRYVANGQVDNDLLFASSNLLAEVEKDAKAMKDPFYAKSLSYALNLMLSWAEERLLAYHDTFHNGNIESMQSVVSLAVSSAKILAGDISLECNKEADVSCTKVENYITSSLHAVFVQACSAIQTPLLSLSTNITFLS

SEQ ID NO: 166255 - protein, 113 aa, Glycine max
  Coding DNA Sequence Number=SeqID_74570
  Homolog annotation: Hit_ID=A5BP71; Match level="QueryCoverage=66%, HitCoverage=19%, E-value=1e-12, Identity=48%"; Hit description =Putative uncharacterized protein
  Pfam annotation: Domain name=zf-CCHC; Domain location=86-103; Score =19.9; E_value=0.0015; Accession=PF00098.14; Description=Zinc knuckle
MTSTPQACGYVSLNYYQYIDVVYTNEHILKAYSAQWWPLGNEAAIPPSNDAWTLIPDPTTIRAKGRPKSTRIRNEMDWVEPSEHRIKCSRCGAEGHNRRRCPMQSERGSCSNN

SEQ ID NO: 166256 - protein, 48 aa, Glycine max
  Coding DNA Sequence Number=SeqID_74571
MIATVMVMMVIEVTKVRDDDNECGGGGDNSNNDDDCGGMITMKITPIV

SEQ ID NO: 166257 - protein, 459 aa, Glycine max
  Coding DNA Sequence Number=SeqID_74572
  Gene Ontology: Mol. function=protein serine/threonine kinase activity; Cellular component=cytoplasm; Biological process=protein amino acid phosphorylation
  Homolog annotation: Hit_ID=A7PEK4; Match level="QueryCoverage=96%, HitCoverage=96%, E-value=0.0, Identity=75%"; Hit description =Chromosome chr11 scaffold_13, whole genome shotgun sequence
  Pfam annotation: Domain name=Pkinase; Domain location=9-276; Score =131.4; E_value=2.7e-36; Accession=PF00069.16; Description=Protein kinase domain
  Pfam annotation: Domain name=Pkinase_Tyr; Domain location=9-273; Score=-104.7; E_value=5.4e-06; Accession=PF07714.8; Description =Protein tyrosine kinase
  Pfam module annotation: Pfam domain module=Pkinase::Pkinase_Tyr; Domain location=9-276::9-273
MERIVGGKYKLGRKIGSGSFGEIYLATHIDTFEIVAVKIENSKTKHPQLLYEAKLYNILQGGSGIPNIKWSGIDGEDNVLVIDLLGPSLEDLFVYCGRKFSLKTVLMLADQMITRIEYVHSKGFLHRDIKPDNFLMGLGRKANQVYIIDFGLAKRYRDSTTNRHIPYRENKNLTGTARYASCNTHLGIEQSRRDDLESLGYVLLYFLRGSLPWQGLKAATKKQKYDKICQKKLSTPIEVLCKSHPVEFASYFHYCHSLTFDQRPDYGFLKRLFRDLFARDGYDFDYVFDWTILKYQQSQKNVMLPPLSFEAEEEGYYLFGNLNLPVLLTILNYVISQPVPGASNSRAIPMDIDNHQGLNSYSGHVKERIRAGDATGSGVKIQFKSPVGKNLSYEKPLDKNIFGEANIPSTSFSPASTSQRNSLKQSLSAEASNPGHAQGSKIGPSSSLMSSLQHMSSAK

SEQ ID NO: 166258 - protein, 122 aa, Glycine max
  Coding DNA Sequence Number=SeqID_74573
MKVEEERRKKKDRKGILNFLEVQEVSTDNKGLARTLNPIYLCLGLGALQIFVRVKSPVAARLDSAVKRAEPKSFIIVSFMSFGVERPLRVVLPNVNIEISATLTKAKEIIGVRALNTSNQCA

SEQ ID NO: 166259 - protein, 141 aa, Glycine max
  Coding DNA Sequence Number=SeqID_74574
  Gene Ontology: Mol. function=protein-tyrosine kinase activity; Cellular component=plasma membrane; Biological process=protein amino acid phosphorylation
  Homolog annotation: Hit_ID=A7QIW3; Match level="QueryCoverage=73%, HitCoverage=20%, E-value=3e-31, Identity=67%"; Hit description =Chromosome chr2 scaffold_105, whole genome shotgun sequence
MVLSKKGPLGKFDSFLANWNLPMIYRVGMGCGFSKYTACCTGSEQDGLAAEAQVDGGNEDNVVEGVDLPWFHEFTIDQLRKATSGFAIENIVSEHGEKAPNVVYKGRLDNQMRIAVKRFNRNAWPEAQPFLRWILWGLGSG

SEQ ID NO: 166260 - protein, 249 aa, Glycine max
  Coding DNA Sequence Number=SeqID_74575
  Gene Ontology: Mol. function=protein-tyrosine kinase activity; Cellular component=plasma membrane; Biological process=protein amino acid phosphorylation
  Homolog annotation: Hit_ID=A7QIW3; Match level="QueryCoverage=99%, HitCoverage=52%, E-value=1e-113, Identity=78%"; Hit description =Chromosome chr2 scaffold_105, whole genome shotgun sequence
RVTPESVTYSFGTLLLDLLSGKHIPPSHALDLIRDKNLQMLSDSCLEGELTNDDGTELVRLASRCLQSEPRERPNPKSLVAALIPLQKDSEVPSHVLMGIPDGTAAFPLSPLGEACLRMDLTALHEVMEKIGYKDDEGAATEETLNSKKKGDAAFRHKDFKTAIDSYTMFIDVGTMVSPTVYVRRSLCYLMSNMPDEALNDAMQAQVISPVWYIAFYLQAVALLALGKENDAQVALKEGSSLETKKNTN

SEQ ID NO: 166261 - protein, 760 aa, Glycine max
  Coding DNA Sequence Number=SeqID_74576
  Homolog annotation: Hit_ID=A5BH79; Match level="QueryCoverage=96%, HitCoverage=80%, E-value=0.0, Identity=48%"; Hit description =Putative uncharacterized protein
MQHYANFVKWNWVCLSMSLDSSMGQELELDLDDKSSVGLSPNTVLPPHQYCVNVKKRSKKGKPTGKDDFFTLKEGFAGIKFARFRSSSCKSHLSRPHELEGNTETRRSSMYQSSEEVKSIKKMGTMVEGRRKIEISRRSDTSFVGSIVDSLCGSDDEGSGLRSSEISRSRTCKAPDSPNSFIEICINSDVKNKNSATVQGRESINLKSRSDKVSDSVINGNYHVEKDMVHWLQKSLSAKAGISHMPSPLGSDCSSRSSPKVQVTHCRKRLNHFTKSKSLRSPVSKILENSEIKSNGIANIARHRTYQKSLLNDLSNKGKHSDIISEFISREIQYSGIASSPVHLHGNLKMENKHGVLFFEFKVKCPEDVFVAKTWRTGNAFNWVYTFHSIDNRKKSNANGLGSHDFDKDSSIVAQMLVSCNLGSELEDKVFDNFMVTEFVLYDFTHSRQSVSREKKSFCELDGSKTPKASHVGLKEETLGLDGNHVVKNKLQDKPLSSSVEFDDLNSYPYLSTECYPNLEIAAIVLQIPFSKRESLKYKRGERKSAKECSNRSDLSAVKDRKSLHYDQIQEQVKVVIPTGNHGLPNAESQAPSSLLDRLRHGGGCDCGGWDMACPLILLGNPTIQFAEDCSLMEEHQPLELFVQMYAALTPPGAKGSSPTFSMTRIEEGHYAVDFHAQLSTLQAFSICVAILHGTSAFSNASHQKNQQLSQCSSLKMLLEEDVDFFFKSVTTEKETGCKNQKGIPRSYVLNPPFSPIARV

SEQ ID NO: 166262 - protein, 707 aa, Glycine max
  Coding DNA Sequence Number=SeqID_74577
  Gene Ontology: Mol. function=DNA binding; Cellular component=nucleus; Biological process=transcription
  Homolog annotation: Hit_ID=A7QIW8; Match level="QueryCoverage=86%, HitCoverage=82%, E-value=1e-142, Identity=65%"; Hit description =Chromosome chr2 scaffold_105, whole genome shotgun sequence
  Pfam annotation: Domain name=BAH; Domain location=137-251; Score =61.1; E_value=3.8e-15; Accession=PF01426.9; Description=BAH domain
  Pfam annotation: Domain name=TFIIS_M; Domain location=403-498; Score=- 19.7; E_value=0.027; Accession=PF07500.5; Description=Transcription factor S-II (TFIIS), cen
  Pfam module annotation: Pfam domain module=BAH::TFIIS_M; Domain location=137-251::403-498
MGNRRFTQVATSDDEDEAPPAPAPPPKQQSSVSASEENCSKQQQQQQRKRKRMKLQEEEEEEKEEEKKKKRKIKDKQEERSNEEEEPPQEDAKPIGEPVRLSGKGRGRKKHYESFEYDGNQYTLVSAMKLACALFEEDPILLTPEDKDQKPYVAIIKDITQSLNGSMMVTGQWFYRPEEAERKGGGSWQSCDTRELFYSFHRDDVPAESVMHKCVVHFVPIHKQLPNRKQHPGFIVQKVYDTVERKLWKLTDKDYEDNKQQEIDELVQKTLQRLGKLLDIEPEEPVADQEDLMKNKRILRKKSISPLDVSKEEETTRQGDQPLKPETPWSCVNNASEHYRILVDFNALTGDTHRDKCLEKLLQSVQFMFNSDDSIKKEEKGNDNSGAANNGSNNKSLESANECEDKVQKSSKPFVWPDDAVPAVVALEKASHDTLSSDYQKYNQKLRQLVFNLKNNAILARRLLNGELEPSIILNMTPNELKGLAVEFVWVGMSACSSQLVVLSILEFVNQFEGGFGIMQSNQSTLKSDTNTFYRTPVKTKARRTVTEESATNRSVNKYRSFHGSCSLAEVYRLQALDGVKGVIGFMFSSISVLEKEGLTAEETTKKEPDESQHMQMTGARCHRCTEGKVGLRDIIHAGHGDRYQLECTACGHSWFASRDEVSELTIDASDSKRSVGTAPWATAKFEDVEKKLSRKDGNIQASKLAD

SEQ ID NO: 166263 - protein, 131 aa, Glycine max
  Coding DNA Sequence Number=SeqID_74578
MRDAHLGVGRRWQRRVLGGTRSSGSRGPQRRQGKPGGAPHSGRAWWGGGGGEPRELQVHAHQDAVGGGQAHGGDEELGDGGGLGVGRWGTRWRGVSGGSRRRTLPWASKAATRRHAQYKVSVNWGRFASSI

SEQ ID NO: 166264 - protein, 135 aa, Glycine max
  Coding DNA Sequence Number=SeqID_74579
  Gene Ontology: Mol. function=protein binding; Cellular component =membrane coat; Biological process=intracellular protein transport
  Homolog annotation: Hit_ID=A7P5C4; Match level="QueryCoverage=44%, HitCoverage=7%, E-value=6e-16, Identity=70%"; Hit description =Chromosome chr4 scaffold_6, whole genome shotgun sequence
MKSNLAYLMNLTVCLVYTKRALVYYRLLQYNVLVAKSVVNPQKQAILVFTDTHSNEIKYHIFDEFNSLSIVYQKVTLKFISVGEEILLIVFESIHLFITITVNEPAPGLEAIFSFKFLTKGLERWKFTTCMTMLE

SEQ ID NO: 166265 - protein, 542 aa, Glycine max
  Coding DNA Sequence Number=SeqID_74580
  Gene Ontology: Mol. function=oxidoreductase activity; Cellular component=cytoplasm; Biological process=metabolic process
  Homolog annotation: Hit_ID=Q9SXZ7; Match level="QueryCoverage=69%, HitCoverage=99%, E-value=1e-136, Identity=79%"; Hit description =NADPH oxidoreductase homolog
  Pfam annotation: Domain name=ADH_N; Domain location=230-301; Score =26.9; E_value=4.8e-06; Accession=PF08240.3; Description=Alcohol dehydrogenase GroES-like domai
  Pfam annotation: Domain name=ADH_zinc_N; Domain location=330-489; Score=123.1; E_value=8.3e-34; Accession=PF00107.17; Description=Zinc- binding dehydrogenase
  Pfam annotation: Domain name=Epimerase; Domain location=9-225; Score=- 54.2; E_value=0.0039; Accession=PF01370.12; Description=NAD dependent epimerasedehydratase family
  Pfam annotation: Domain name=KR; Domain location=8-159; Score=-86.9; E_value=0.027; Accession=PF08659.1; Description=KR domain
  Pfam annotation: Domain name=adh_short; Domain location=7-187; Score =51.4; E_value=3.1e-12; Accession=PF00106.16; Description=short chain dehydrogenase
  Pfam module annotation: Pfam domain module=ADH_N::ADH_zinc _N::Epimerase::KR::adh_short; Domain location=230-301::330-489::9 -225::8-159::7-187
MEIKPGLSALVTGGASGIGKGLALALAEKGVFITIVDFSEEKGRQAAILVEKINSNFHSKLGFPSAIFVKCDVSNARDLAAAFEKHFLTYGGLDICINSAGISSSVPFRDDQTDGTRTWRYTVNVNFTAVIDSTRLAIKIMEASKRPGVIINLGSASGLYPMVADPIYSGSKGGVVMFSRSLRLYKRQGIRVNVLCPEYYNAKSLVQFVETEMGNKIDPKIINLSGGFVPMEMVVKGRYFGGNNNDVVSRLPFDAGFEAVGIIAAVGDSVTDLKVGMPCAFMTFGGYAEFLMIPSKHALPVPRPDPEVVAMLTSGLTASIALEKAGQMESGKVVLVTAAAGGTGQFAVQLAKLAGNTVVATCGGGAKAKLLKDLGVNRVIDYHSEDVLREEFPKGIDIIYESVGGDMLNLCLNALAVHGRLIVIGMISQSVRRVYDTGLEIAYQGEKGWTPSKYPGLLEKLLAKSQTVSGFFLVQYGHLWQEHLDRLFNLYSSGKLKVAIDPKKFIGLHSAADAVEYLHSGKSVGKVVVSVDPSFLPQVAKL

SEQ ID NO: 166266 - protein, 175 aa, Glycine max
  Coding DNA Sequence Number=SeqID_74581
  Homolog annotation: Hit_ID=A5BAD7; Match level="QueryCoverage=57%, HitCoverage=59%, E-value=3e-26, Identity=64%"; Hit description =Putative uncharacterized protein
MDPRISFSYDFVVSQQAIKHENIYREDPVSSDFEFSVKNNSMISADEVFFQGMLLPLKSDCSNKKVTLRDELLVNDDHYEEELPRLPKSSSRWKERLGLRKGSSKKDKNKNNEGFQQTRVAGEKGFSSGQGDKTEQVNSIEAGFISQGEGMAYSTNIYIKTLIVRILGADFLFNC

SEQ ID NO: 166267 - protein, 577 aa, Glycine max
  Coding DNA Sequence Number=SeqID_74582
  Gene Ontology: Mol. function=receptor activity; Cellular component =plasma membrane; Biological process=protein amino acid phosphorylation
  Homolog annotation: Hit_ID=Q9LJK6; Match level="QueryCoverage=73%, HitCoverage=85%, E-value=1e-142, Identity=57%"; Hit description =Similarity to receptor protein kinase
  Pfam annotation: Domain name=LRRNT_2; Domain location=375-414; Score =14.3; E_value=0.029; Accession=PF08263.3; Description=Leucine rich repeat N-terminal domain
MTITIFQESLGGVNPCGAVAFDSMSPSVFLLWIITISLLAHSALASIPLGYFLDCGGTKEVTIDNNLTYIPDGSYIKVGKTTTISKPDLLPILSTLRYFPDMWAKKYCYSLPVIKGSKYLVKTMYYYGGFDGRNKQPPVFDQIVEGTRWSVVNTTEDYAKGLSSYYDIVVVPPGKTLSVCLARNAHTGGASPFISALEVKMLDASFYNPIDFNKYALLTVARNTFGDDKFNRMWQPYKDQNPVVESNSNVTSSDFWNQPPVKAFSSAVTTSRGKTLEIQWPSMSLPSTYYYISLYFQDNRHPSPYSWRVFNVSINGHTFYSSLNATTNGVTVYATKWPLSGKTKITLTPGSGIPVGPLINAGEIYQVLPLGGRTHTRDVIAMEDLARSIQNPPVDWHGDPCLPKGNSWTGVTCSNGFHARVTIVNLTNAGVSGSLPPTLGHLSALEHLPSSFRCRAAAGDLSAGPSFIQSVAGGLRIGQFPDGAGLAVEGRRGGGGNEPIRVKKWSRKNESYLDNDAEPLPLPMTYPDSSPVSQEEIDKRLQCDPQIQVLASTDYLIVKRWCMNGLGSAVVAKDRDM

SEQ ID NO: 166268 - protein, 223 aa, Glycine max
  Coding DNA Sequence Number=SeqID_74583
  Pfam annotation: Domain name=Transposase_23; Domain location=1-71; Score=1.0; E_value=0.00091; Accession=PF03017.5; Description =TNP1ENSPM transposase
MGDSDRCSLYIEADPARLVTMGRVYEGSTVVHNTPLLPGQVKVSVEEVTDADAPVPVPTDEVSLVGQTLHTFLAWPTHLVKSLSQQVLIVLTISVSPAKPPPKPDSEVDDPLYLMTLTIPELFLRPYQVRWDATVFGVFNPDFPLYIKHEDLSEIAHGGQCLSISVLQLWILQKGSTECGYYVMHWMSTIIFGTFRNNWEAPERLKALRIHWAQFYLRVRDQA

SEQ ID NO: 166269 - protein, 213 aa, Glycine max
  Coding DNA Sequence Number=SeqID_74584
  Gene Ontology: Mol. function=phosphoprotein phosphatase activity
  Homolog annotation: Hit_ID=A7PJZ4; Match level="QueryCoverage=42%, HitCoverage=19%, E-value=3e-12, Identity=41%"; Hit description =Chromosome chr12 scaffold_18, whole genome shotgun sequence
MTLEDVVVQLGLPIDGEVITSISSGDLVAWCEPLLGYLPPTGCASGNMIKLSWLNNEFQQLPNDVDKVAFAQHTQAHILSLIGGLLMQNTISSWIMGLILSKKTLKGVAPPIMVLYTYDIFYGHSNMFATYSTTPPSAYNPTSLMDCYHPTLPTQMRNTNDYKDDGDEDNNNNDGSSLRASNDGDDTTTKGAQPTQRGHRPREQQAEPTQQQQ

SEQ ID NO: 166270 - protein, 361 aa, Glycine max
  Coding DNA Sequence Number=SeqID_74585
  Gene Ontology: Mol. function=peptidyl-prolyl cis-trans isomerase activity; Cellular component=cytoplasm; Biological process=protein folding
  Homolog annotation: Hit_ID=A7P9E4; Match level="QueryCoverage=100%, HitCoverage=100%, E-value=1e-153, Identity=73%"; Hit description =Peptidyl-prolyl cis-trans isomerase
  Pfam annotation: Domain name=Pro_isomerase; Domain location=5-173; Score=362.8; E_value=5.5e-106; Accession=PF00160.12; Description =Cyclophilin type peptidyl-prolyl cis-tr
  Pfam annotation: Domain name=TPR_1; Domain location=212-245; Score =3.8; E_value=1.9; Accession=PF00515.19; Description=Tetratricopeptide repeat
  Pfam annotation: Domain name=TPR_1; Domain location=298-331; Score =43.2; E_value=9.4e-10; Accession=PF00515.19; Description =Tetratricopeptide repeat
  Pfam annotation: Domain name=TPR_2; Domain location=212-245; Score =13.6; E_value=0.61; Accession=PF07719.8; Description=Tetratricopeptid e repeat
  Pfam annotation: Domain name=TPR_2; Domain location=298-331; Score =39.6; E_value=1.1e-08; Accession=PF07719.8; Description =Tetratricopeptide repeat
  Pfam module annotation: Pfam domain module=Pro_isomerase::TPR_1::TPR _1::TPR_2::TPR_2; Domain location=5-173::212-245::298-331::212 -245::298-331
MGRGRCFLDISIGEELEGRIVVELYDDVVPKTAENFRALCTGEKGIGSNTGVPLHFKGSCFHRVIKGFMIQGGDISAGDGTGGESVYGLKFEDENFELKHERKGMLSMANSGPDTNGSQFFISTTRTSHLDGKHVVFGKVVKGMGVVRSVEHVATGDNDRPTLDVKIVDCGEIPEGEDDGISNFFKDGDTYPDWPADLDESPNELEWWMKSVDSIKAFGNDYYRKQDYKMALRKYRKALRYLDICWEKEGIDEEISSGLRKTKSQIFTNSSASKLKLGDIKGALLDTEFAMREGDNNAKALFRQGQAYMALHDIDAAVESFKKALTLEPNDAGIKKELAAARKKIADRRDLEKKAYSKMFQ

SEQ ID NO: 166271 - protein, 242 aa, Glycine max
  Coding DNA Sequence Number=SeqID_74586
  Gene Ontology: Mol. function=nucleic acid binding; Cellular component= plasma membrane
  Homolog annotation: Hit_ID=A7P6I6; Match level="QueryCoverage=30%, HitCoverage=13%, E-value=3e-14, Identity=53%"; Hit description =Chromosome chr9 scaffold_7, whole genome shotgun sequence
MGVISSNLGDYYYSKGEQPNNVNPQLLAFWAPIFLIHLGGPDTITAYALEDNELWLRHFVGLLSQTTLVVYIIIFVLESTNSSETREHQGVDHIITYLLLSQTLFLGPCLRFCYDHPSFVVHAPSPRSVVREGVCWEIIQVPHRLKICFIITVRNNILKFFEQIKVSPQQDNLAETCRILLQHVDTATSEDDEDSESEMQSASVLFHACAVAKQLIAVEDRLPTWAFVQNLWIEIELCWWSM

SEQ ID NO: 166272 - protein, 442 aa, Glycine max
  Coding DNA Sequence Number=SeqID_74587
  Gene Ontology: Mol. function=nucleic acid binding; Cellular component= cytosol; Biological process=regulation of mRNA stability
  Homolog annotation: Hit_ID=A7P9G1; Match level="QueryCoverage=71%, HitCoverage=77%, E-value=1e-136, Identity=75%"; Hit description =Chromosome chr3 scaffold_8, whole genome shotgun sequence
  Pfam annotation: Domain name=RRM_1; Domain location=102-173; Score =46.5; E_value=9.3e-11; Accession=PF00076.13; Description=RNA recognition motif. (a.k.a. RRM, RB
  Pfam annotation: Domain name=RRM_1; Domain location=196-268; Score =71.3; E_value=3.3e-18; Accession=PF00076.13; Description=RNA recognition motif. (a.k.a. RRM, RB
  Pfam annotation: Domain name=RRM_1; Domain location=315-394; Score =52.8; E_value=1.2e-12; Accession=PF00076.13; Description=RNA recognition motif. (a.k.a. RRM, RB
  Pfam module annotation: Pfam domain module=RRM_1::RRM_1::RRM_1; Domain location=102-173::196-268::315-394
MAQPSSNGDLNNNQQQGQVQQQQQQGQWAAAAQPHQYQQQWMAMQYPATAMAMMQQQMLMYPQHYMPYAHPHYPPPPPPPPSSHHHHHHKQAAASSDEIRTVWLGDLHHWMDENYLHNCFAHTGEVVSAKVIRNKQTGQSEGYGFVEFYSRGTAEKVLQNYNGTMMPNTDQAFRLNWATFSAGERRSSDATSDLSIFVGDLAIDVTDAMLQDTFAGRYSSIKGAKVVIDSNTGRSKGYGFVRFGDENERTRAMTEMNGVYCSSRPMRIGVATPKKTYGFQQQYSSQAVVLAGGHSANGAVAQGSHSEGDINNTTIFVGGLDSDTSDEDLRQPFLQFGEVVSVKIPVGKGCGFVQFADRSPAPAVIVLGGAARKNAEEAIQGLNGTVIGKQTVRLSWGRSPGNKHWRSDSNGGHYGGHQGYGGHGFAVRQNQDIAMQPAAAIQ

SEQ ID NO: 166273 - protein, 280 aa, Glycine max
  Coding DNA Sequence Number=SeqID_74588
MDVMDWCEDFAQVQKNTRHLLVVERAVQNEFWMFASRSQRSKLRKAVILVDVLSRVLCLCSVLLGCDSLCCLNVVLLGCCGSLGGLMGTRGWWVYARIVDVENLLCTIARPPPSTTCDGVKLPAFIVDHRVVPGDMSRGSGDLGDVRRAPGSQQIKGKQDHKARRLVVAGQLLENEVRKLRKPLVIDYQGIVMAAQLIRDRVEMECLEGAWETLKGNTRCRFRGTIRFTATSLVHPDEPARTLQRTEFDDCILVAEATTMDTFALDDTIYFVKLPYFGQL

SEQ ID NO: 166274 - protein, 77 aa, Glycine max
  Coding DNA Sequence Number=SeqID_74589
MWWKGSNVDYETVRDFSNDQDAMDLASIPDPPYEEPYTNFKEMHDLETGYEIEEMYSDVESEDDTTKLGKRFPMFRK

SEQ ID NO: 166275 - protein, 60 aa, Glycine max
  Coding DNA Sequence Number=SeqID_74590
  Homolog annotation: Hit_ID=A5BH93; Match level="QueryCoverage=58%, HitCoverage=3%, E-value=3e-08, Identity=80%"; Hit description =Putative uncharacterized protein
MPFGLINAPSTFTRLMNHVKKEFIGVGAVLLQGMHPIAYFSEKLHGATLNYPTPDKELMP

SEQ ID NO: 166276 - protein, 252 aa, Glycine max
  Coding DNA Sequence Number=SeqID_74591
MAKFDPEIVLEFYANAWPTEEGVRDMRSWVRGQWIPFDVDAIGQLLGYPLVLEEGQECEYGQRRNRSDGFDEEAIAQLLCIPGQDFARTAAGRRVRIMRTNMTTLTHIWMTLLLSNILPTDHNSDLPMPKCQLVYGAYQHPLDPDKSNRALGFPALITGLCQSFGVPLHLPRRAPTPHQAGQAGAFDMEQYLRHLVRQQAANHRAHGRGCMARRLAEAQAGEAPPEAPGDGEEAHEDEEMADLLDFLGGSGD

SEQ ID NO: 166277 - protein, 97 aa, Glycine max
  Coding DNA Sequence Number=SeqID_74592
VVAPPGSISSVVQFLERVAWPGAQPCLHKEDEGPTAQVTRGHIRSTHTSGGPILTSSCSRPLHSYTRDTRGPTTPVLTLNTSPPATPVLHLTDEEDV

SEQ ID NO: 166278 - protein, 301 aa, Glycine max
  Coding DNA Sequence Number=SeqID_74593
  Gene Ontology: Mol. function=motor activity; Cellular component=cell projection
  Homolog annotation: Hit_ID=UPI00006A2D9E; Match level="QueryCoverage =69%, HitCoverage=85%, E-value=7e-18, Identity=17%"; Hit description =UPI00006A2D9E related cluster
GLRAITFRGLHVLALRGLHAIAFRGLHVLPFGGLQVFAFSGLHVVAFRGLHVVAFRGLHALTFRGLHVLTFRGLHVLALRGLHVLAFRGLHVVTFRGLHVLAFRGLHVLPFRGLHALSFRGLHILTFRGLHAFTFRGLHALAFRGLHTLAIRRLHILTFRWLHALAFRGLHILPFRGLHALAFKGLHTLTFIGLHALALRGLHILAFRGLHPFAFRGRHVLDFGVLHAPSPLKGYGSSLSSLGYPPDLRGWPTVQAQPEGGYRATTMHTGARFHPCCYKETSVDHAHQHDHSYTDMDDVAT

SEQ ID NO: 166279 - protein, 21 aa, Glycine max
  Coding DNA Sequence Number=SeqID_74594
MELTSRLASKGESGKASTRQA

SEQ ID NO: 166280 - protein, 172 aa, Glycine max
  Coding DNA Sequence Number=SeqID_74595
MAENLHGFAYGNVTDELRKRLDLDFLHGNDFFTDFKKIGEELATQLAQASQVTSSISNLLLEEHLGRPKVPSTSKRSNKGCMPSNNGPRTTLGYDTTSATNLVTSKKIVPQSSNGLRRMRRTVMKNEDPRRPILHRMTITHPMVRRRRSTFYPRTMRAMTTSLKKITQKAKV

SEQ ID NO: 166281 - protein, 340 aa, Glycine max
  Coding DNA Sequence Number=SeqID_74596
  Gene Ontology: Mol. function=aspartate-tRNA ligase activity; Cellular component=cytoplasm; Biological process=tRNA aminoacylation for protein translation
  Homolog annotation: Hit_ID=Q1GYN8; Match level="QueryCoverage=100%, HitCoverage=57%, E-value=1e-172, Identity=89%"; Hit description =Aspartyl-tRNA synthetase
  Pfam annotation: Domain name=GAD; Domain location=216-316; Score =138.1; E_value=2.6e-38; Accession=PF02938.5; Description=GAD domain
  Pfam annotation: Domain name=tRNA-synt_2; Domain location=25-309; Score=295.7; E_value=9.1e-86; Accession=PF00152.11; Description=tRNA synthetases class II (D, K and N)
  Pfam annotation: Domain name=tRNA-synt_2b; Domain location=48-191; Score=-25.6; E_value=0.0019; Accession=PF00587.16; Description=tRNA synthetase class II core domain (G, H, P, S and T)
  Pfam annotation: Domain name=tRNA-synt_2d; Domain location=34-249; Score=-176.3; E_value=0.094; Accession=PF01409.11; Description=tRNA synthetases class II core domain (F)
  Pfam module annotation: Pfam domain module=GAD::tRNA-synt_2::tRNA -synt_2b::tRNA-synt_2d; Domain location=216-316::25-309::48-191::34 -249
MLATEIEVLNASLTPPFMLDDDNLTETVRLEHRYIDLRRPAMQKNLMLRYKVAKNLRDYLDENGFIEVETPMLTRSTPEGARDYLVPSRVHHGMFFALPQSPQLFKQLLMVSGFDRYFQITKCFRDEDLRADRQPEFTQVDIETSFLEENEIMDIVEEMIRRMLKKVQNVDLPAKFPRMPFSEAMNRYGSDKPDMRVTLEITELSDVMKDVDFKVFAGAANMAGGRVAAIRVPNGAAISRSEIDAYTEFVKIYGAKGLAYIKINDITKLNEEGLQSPIVKNIHVNALQAIIERTGAQNGDIVFFGADKAKIVNEALGALRTKVGHEKGHVDGRQWAPLWV

SEQ ID NO: 166282 - protein, 74 aa, Glycine max
  Coding DNA Sequence Number=SeqID_74597
MAAEWRRKRERRRHFKEKMSLEEARHHRRPWIRAWRKKEMNKGRGREEQEILRSKRALKSEPTNPRSSPRFSTK

SEQ ID NO: 166283 - protein, 222 aa, Glycine max
  Coding DNA Sequence Number=SeqID_74598
  Subcellular localization annotation: CTP_CleavageSite=53; ConfidenceScore=5.56e-01
LPSLGTDVWGANTFPVRKYNSRTFHLKVRRSRLFRFFRRFPQINVGGDSARIPFMELASRESRVALPPKEQFIEKLSWLGTLPSIVRKGEDPSAQVPQQVQDASSEATIPRAFYLSSAGVEMRPDEAVFPEPIVPAIHGTMEAGESQLRQEVPTPERTSQTPEDPPSPGVADPPAPVHERLADPSTPTMEMPEDPTTLVLRLSSTPPATPVLHLTDEEDMQD

SEQ ID NO: 166284 - protein, 65 aa, Glycine max
  Coding DNA Sequence Number=SeqID_74599
  Homolog annotation: Hit_ID=A7Q6V9; Match level="QueryCoverage=49%, HitCoverage=10%, E-value=5e-07, Identity=78%"; Hit description =Chromosome chr12 scaffold_57, whole genome shotgun sequence
MAKLSFPVITALVTLLKAELVILKYYQACICLQMIGLNKPTSGTAFVQGLDIRTHMDGIYTSIGV

SEQ ID NO: 166285 - protein, 57 aa, Glycine max
  Coding DNA Sequence Number=SeqID_74600
MGFLVFGVFNPDSPSKSEVLSESHTVYFNDPRPLEPERLKALQIQWAQYYLRVRDQT

SEQ ID NO: 166286 - protein, 137 aa, Glycine max
  Coding DNA Sequence Number=SeqID_74601
MSLASPSHRRVGCNSIQDGPSQALRLNAPLPYPHLVTLFLQHFNIPLDSEPYVPIKRSFLIGTSVIASFGYQKEHDGSWVKKGARHVDEEGHGGEDSSLLSKILDRFDGLQTFVGERFDTLKLQVDLRFNEMESRIT

SEQ ID NO: 166287 - protein, 227 aa, Glycine max
  Coding DNA Sequence Number=SeqID_74602
  Homolog annotation: Hit_ID=Q8FJ67; Match level="QueryCoverage=84%, HitCoverage=89%, E-value=6e-34, Identity=42%"; Hit description =Putative uncharacterized protein
MRIICGWQRECCGGRSAAGGVTDCMAEGRRTAQCPVAVGEAQQAQQADKDVVQRDIQADGGANVVGFTALNDVAGFPQNGTGREQNKQGADRQVQRGQLQEDIGNHGHQQHHKAGHHHAAKERHVATRGQDIGGTAEEHQRGAAQRHGDNITHTGGEERAENRAEAVTEEAGKGKRGQNTRRTVRQAIGQEHQSVKAHQHQNQSRRGQGVDGAERGGDGGKRQRQAK

SEQ ID NO: 166288 - protein, 100 aa, Glycine max
  Coding DNA Sequence Number=SeqID_74603
FSQERKVFSFQLPLEQLVNDKHKYKPHITKVFTCKHPRGANHPTVTTHPKGVNHPKGARSKDVNQGDMTLGNSHNQPKGDMTLENSHNQSKKCESRGHDP

SEQ ID NO: 166289 - protein, 106 aa, Glycine max
  Coding DNA Sequence Number=SeqID_74604
MTWGNPVDLQPFDPKTDRTIHRLFRHSVHFEHSEHFVHSVASDFEHSDFEHSAANFHTKNMAQSPPRERTLREMAAPDFTYESLCIQYPNEDVPYVLKTGLIHLLP

SEQ ID NO: 166290 - protein, 117 aa, Glycine max
  Coding DNA Sequence Number=SeqID_74605
GVEVLVIKISILANMGWGSGWIKFYVRLLARMPDRRKEAIPLFWVLSFYGENNRSGQDLGTRIRSSEAKKEWSSRNTKEVLGGEGGNCGKPRRVGVIHRRISMTSVWDNTISKCRRA

SEQ ID NO: 166291 - protein, 76 aa, Glycine max
  Coding DNA Sequence Number=SeqID_74606
  Homolog annotation: Hit_ID=A6FJQ2; Match level="QueryCoverage=50%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGEEKECDTQSRFLLQRNHIEEAEENQSPDF

SEQ ID NO: 166292 - protein, 110 aa, Glycine max
  Coding DNA Sequence Number=SeqID_74607
MIWAFPSFGTIWLNRYPDIHCVPPLAGVSTCPMAGAQHEAQLSVFQGRKTPGVSTNVYLRKMLEKPKGKRSVYFENEGSRVVYAQGRIRLLQHPSSSYPFLPLKDTRISM

SEQ ID NO: 166293 - protein, 382 aa, Glycine max
  Coding DNA Sequence Number=SeqID_74608
  Gene Ontology: Mol. function=motor activity; Cellular component=cell projection
  Homolog annotation: Hit_ID=P15305; Match level="QueryCoverage=99%, HitCoverage=81%, E-value=6e-16, Identity=19%"; Hit description =Dynein heavy chain
PIAFRGLHVLPFRGLNVLAFRGLHALAFRGLHILSFRGLHVLAIRGLYVLGFRGLHVLAFRGLDVLLFRGLHVLYFRGLHVLAFRGLGLHSLTFRELHALAFRGLHVFAFRELHTLAFRGLHFLAFRGLHVLAFWGPHLFAFRKLDVLAYRGPHVLAFRGLHAFAFRGLHILAFRGLHAFVFRGLRVLACRGLHTLAFTGLHALAFRALHALPFRGLHVLAFRGLHALTFRGLHILAFRGLHTLALRGPHALGFKRLHALTFRGLHVLAFRGLHVFAFRGLHVLACRGLHAFAFTGLHALAFIALHALPFRVLHVLAFRGLHALTFRELHVLAYRELHALALRGLHALGFKGLHALALRGLHVLTFRGLHVLAFRWLHTLTF

SEQ ID NO: 166294 - protein, 402 aa, Glycine max
  Coding DNA Sequence Number=SeqID_74609
  Gene Ontology: Mol. function=motor activity; Cellular component=cell projection
  Homolog annotation: Hit_ID=UPI00016621D1; Match level="QueryCoverage =80%, HitCoverage=40%, E-value=9e-23, Identity=34%"; Hit description =UPI00016621D1 related cluster
  Subcellular localization annotation: CTP_CleavageSite=27; ConfidenceScore=5.01e-01
DYTSSPSEGCTPSPFRGLHVLTFRGLRALTFRGLHVLTLRGLHALTFRAINILTFRGLHALIFRGLHVLAFKRLHALSVKGLHVLTFRGLHTLTFRGLHILTFRGVHALTIRALHVLPFRVLHALTFRVLYALTFRGLHILTFKSLLTLNFQGLHVPTLIGLHAVTFKRLHALDFRVLHAFTFNGLHVVTFRGLRAFTFRGLHVLTFIRLHVLTLRGLGLHILTFRGLHALTNRGLHVLAFRGLHALTFRGLHVLTFRGPRALTFRGLHVLTLRGLHALTFRAINILTFRGLHALTFRGLHVLAFKRLHALSVKGLHVLTFRGLRTLTFRGLHILTFRGRTARPNLQSATRPQLPRTTRPHLDRATRCYLQKTTRPRLQSVARLHLQWTPRRHLQRITRLHL

SEQ ID NO: 166295 - protein, 917 aa, Glycine max
  Coding DNA Sequence Number=SeqID_74610
  Gene Ontology: Mol. function=metal ion binding; Cellular component =plasma membrane; Biological process=embryo sac development
  Homolog annotation: Hit_ID=A5B7Y9; Match level="QueryCoverage=100%, HitCoverage=100%, E-value=5e-87, Identity=31%"; Hit description =Putative uncharacterized protein
  Pfam annotation: Domain name=zf-C3HC4; Domain location=865-903; Score= 5.4; E_value=0.022; Accession=PF00097.16; Description=Zinc finger, C3HC4 type (RING finger)
MASSQIEIASSSPFGCALRDRNHREACSRESGNVKSTHHHHHANFQRNMKNFVMDLNMCMAVSSDSKANENENNSSSSSSINNHRKAPKNKQLERLLITRANPFINNSNVASNETSLASLISPRHSGLLDRWATRQACQMVSNLENEAELLSMDGNDMLPRTSSSSEEESSFSSETRNGGGASSLVQIWEKRLNQSSVSKPNTPRERIGSTSSSINENANAFSPENVNAFSGEEQCFDGPSGNEESFTSSSFPDWESSDQSLSPSRRSESDRVRVADIIKKLTSTSQNQCPTPSFADDNEHEGYGSSVTGSPCRERECDQQHSEQNRRVNCSLRIRGRRAYIDLLAQMENDRLGELNNLVERGAVSKFPQRGRIQAMLRLRLLQRGVAANDQPRQKSTASEVNNSQPHGYAIMQLSGAELRTPVQTELANPRSPQRETVNKTTQLDNSVTTDQLSKDTSNKKGHGNANHATESTQKSASQTRIDHSTEEAHPSSDIKAPQNDSRETTEATTSTIDSNLNEMTADREETSNQQNAMAKSSNDETVNEEEESNQQHAETSYEETIEEASNQNYAESSYDDEMEEEVEEIDQNCYETNYDWISEISRPRSYWEECRQAWYREMLETGTQNEDIRRLLERRTVSSFLSSDFRGRMDRLMESHRGTQTHLVNSQDREEDSQGLMAFLQERLHSTRASQDGSNAREEEDESRNQDEEEEDNTDEQEQEHEEEHEKESLISGSYHEVGDYSNQSSSWSYRDNEAGDDFDRVVSSSPQPYQSQSFYSECRHSSSTNHHSIEMELIYDLRGHMEQLYSEISELRKSIKGCLEMQMELQQSIKQEVQTVMQCKHTITVKKEEKKSNDTTLKKGNCCICYEMKVDSVLYRCGHMCTCLKCANELQWNSGKCPICRAKIVDVVHVYVDS

SEQ ID NO: 166296 - protein, 569 aa, Glycine max
  Coding DNA Sequence Number=SeqID_74611
  Gene Ontology: Cellular component=cytoplasm
  Homolog annotation: Hit_ID=Q9LTZ9; Match level="QueryCoverage=100%, HitCoverage=100%, E-value=1e-157, Identity=51%"; Hit description =Genomic DNA, chromosome 5, TAC clone:K15C23
  Pfam annotation: Domain name=DUF23; Domain location=264-546; Score =67.3; E_value=5.1e-17; Accession=PF01697.18; Description=Domain of unknown function
MAKEREKKLYVALLGNYAAELKLLLTTLLLLCAVATLLQFLPSRFTISASDLRVCISRVTQTTQTIPNSTNATSPPVTATASASASASPLVASLSSTTSPSPPPPSPPPPSPPSSEQILPDGTIKRVFNPYGSAAYNFVTMGAYRGGLDTFAIIGIASKPLHVYAKPTYECAWFSLAGDKKKLSTTVGYKILPDWGYGRVYTVVIVNCTFPIPVNADNSGGKLVLFASTSGGGDASFNTTDRIEALTEQPRTLDTTLFSSKPKYDYLYCGSSLYGNLNPQRVREWIAYHVKFFGPRSHFVIHDAGGVHPQVLEVLKPWMDLGYVTLHDIRDQERFDGYYHNQFMVVNDCLHRYKFMAKWMFFFDVDEYIYVPPKSTIKSVLDSLSEYSQFTIEQMPMSSKLCLTSDYGKTYSLGMRESWMVVGECKEHLLRVVGFDLVLYEFGVAHSCGQVKMWKWGFEKLVYKDSKKGIRRDRKYAVQPRSLYATGVHMSQNLAGKTTHKTEGKIMYYHYHGTIAEKRESCKMLINSTEITYDKTPYVLDTTMRDIAGVIKKFELKMIGDRLQHKTRQ

SEQ ID NO: 166297 - protein, 309 aa, Glycine max
  Coding DNA Sequence Number=SeqID_74612
  Gene Ontology: Mol. function=kinase activity; Biological process =carbohydrate metabolic process
  Homolog annotation: Hit_ID=A7NW56; Match level="QueryCoverage=83%, HitCoverage=45%, E-value=1e-97, Identity=72%"; Hit description =Chromosome chr5 scaffold_2, whole genome shotgun sequence
  Pfam annotation: Domain name=CBS; Domain location=122-256; Score =19.5; E_value=0.00065; Accession=PF00571.19; Description=CBS domain
MHAGPYDNLKDIAMKILQKEVSTVPIIHSSSEDASFPQLLHLASLSGILKCMLDPYQIDFSGICRYFRHCSSSLPVLQLPICAIPVGTWVPKIGESNRRPLAMLRPTASLASALNLLVQGVNFLSDPEHSVSKRKATERKDEEIAQVSSIPIVDDNDSLLDIYCRSDITALAKNRAYTHINLDEMTVHQALQLGQDAYSPYELRSQRCQMCLRSDPLHKVMERLANPGVRRLVIVEAGSKRVEGIVSLSDIFKFFIGDFRLRKRPVNSEYLIAQNLFISPHSYYLQMYCAPDIDTSKVGEHNFCNHSML

SEQ ID NO: 166298 - protein, 295 aa, Glycine max
  Coding DNA Sequence Number=SeqID_74613
  Gene Ontology: Mol. function=kinase activity; Cellular component =nucleus; Biological process=protein amino acid phosphorylation
  Homolog annotation: Hit_ID=A7PS73; Match level="QueryCoverage=61%, HitCoverage=36%, E-value=8e-70, Identity=69%"; Hit description =Chromosome chr14 scaffold_27, whole genome shotgun sequence
MRSALNWRGIHLNLQRGSRSCDEVWCLEGILKVALNSRLNVWSEHGFCKGCCGWCGRDSANSHAFCVAIWRKECVSQWFFHTVLNFVDCFMNVVMFLLECFSLILLISLDLLPMSPVEGCPTVFQVIYNLPPGYHQYKFFVDGEWRHDEHQPYVPGEYGIVNTVLLATDPNYMPVLPPDVASGNSMDVDNDAFRRMARLTDGTLSEVLPRISDTDVQISRQRISAFLSSHTAYELLPESGKVVALDVDLPVKQAFHILHEQGVFMAPLWDFCKGQFVGVLSASDFILILREIEEV

SEQ ID NO: 166299 - protein, 1506 aa, Glycine max
  Coding DNA Sequence Number=SeqID_74614
  Gene Ontology: Mol. function=zinc ion binding
  Homolog annotation: Hit_ID=A5BJN7; Match level="QueryCoverage=99%, HitCoverage=89%, E-value=1e-171, Identity=32%"; Hit description =Putative uncharacterized protein
  Pfam annotation: Domain name=zf-CW; Domain location=632-680; Score =70.7; E_value=4.9e-18; Accession=PF07496.6; Description=CW-type Zinc Finger
PRARKFWWVVEMKENTDIEEGEACYYNVDDEANIDPDSFSYIDEKIQHFLGHFQKDFEGGVSAENLGAKFGGYGSFLPTQERSPCLCSHPRTPQRNHSSPELSINLHMEAVSHNTKASSNGLPARPENASHSSYSFRDLKEASVNDSVKKEQGISSSDIAERCTSKDDSTKKTGNSTDQRPLKFRIKMKSNILAPNNAEIYSGLGLDNSPSSSMGNSPVESEGMPPVSQENAEDSPNGIIQVMTSFPISGGVLISPLHDSLLYMIKNEKVIRDSKYLSSLKGHQDTCSMSTDESDSFVGDEHLKKKTVRIMRESEKQLELKHTNGTFSEKDLTLHTKKRLGNRTPDCKDFLSNDLKRTPLSSSICDAGETAEVTAKAFEASKDFNESGVQGRMVPVEALKEESLESISGQDFEKTEKQNAGNGFMKNALEHKLENSRKDNFTDPMNNNMRNTFMNKFESDAVKHKVDHKYENHQKVKAVSERKTKSKGDLSPGKAEAVGRKDSFGGTNNAMVIDKGIAGFDNTCKSKMNKSMSLKGKKFSNSNGDSLKEKKSEQKVASVASIGAIKNGNIGNGKKSAFGTKVKERLSGHKVANQLLAGPCIKDTSAALPIAENNLAPEMISSAVGVPQVIAEDWVCCDSCQKWRLLPNGMKPEHLPEKWLCSMLNWLPGMNSCDFSEDETTKALYASYQIPISDGQNNMQSHGTETAIGVSCTLQYGLNHKMSTFDMLSDREKKKHVIKEKTMSGSNNDVLQFPNSAKINVQVSGKNRSLNAMNHHPADLNPMKKTSSSKHLSRLDNMIEEKNVPKEKEKQVNEGDRKHAKLKRKMDADQYKLGTPKKPKVENVFYTDKQLNPGMDLEKVSLYSRNGLPTKASGKEMRKYDEYCLSDDIQDRLPVTVKNEGDHAQVSSGGGSLDVKNRSKSGLMKKRKLKEHMDDEKHNNSYSSHGEKQYGEEGNASEIRKQKKYRILSKEAKLVTEGDDKLSKDGMRQVCLSGNRDQMAVGTEVRFVDKGNQPRKHRKNVASLHASDSIDQLGKGLGSRPLSLAATSSSSKISGSHKAKTNFEDVRGSPVESVTSSPLRAFNLDKNILAIGDTSVKDDATKGYLSSVGSRRSVDNREGKLSVKLKAGRISHDLHPASHKLSSIEARFEDAKDTARVQAKKSSELKNNHLLEAGVHVEQPGYCANGIRYEEKVNKDNQESELSWQKSGKVSSLHRKEKGRKSGSHVGMNKMKISVSDIGGYSKTSGKHDSAVNPSNHASGAEAKNNAKYISLKSKSEIDCIIQKSALRHGPNETGKQTEIKERDFENSILKMNAQCSTDNKTISRQNLTQDFKGENKANLTESRVGESKVLPSAVDEVKREALNVSSRTVPQYQKGGMSNERPVHVSGNDDLAKSMRNYADVSNNAGVNYSSGNFAPDQQLTLSSPLRTNSSQTATGTLEEAAKLKDRADNYKNSGFDFESNETYFQAGLKFLHGASLLENCHNESSKHGEMSQMKIFATAAKLFK

SEQ ID NO: 166300 - protein, 423 aa, Glycine max
  Coding DNA Sequence Number=SeqID_74615
  Gene Ontology: Mol. function=nucleotide binding; Cellular component =mitochondrion; Biological process=response to cold
  Homolog annotation: Hit_ID=A7NW61; Match level="QueryCoverage=83%, HitCoverage=95%, E-value=3e-67, Identity=39%"; Hit description =Chromosome chr5 scaffold_2, whole genome shotgun sequence
  Pfam annotation: Domain name=mTERF; Domain location=82-354; Score =67.1; E_value=5.9e-17; Accession=PF02536.5; Description=mTERF
  Subcellular localization annotation: CTP_CleavageSite=59; ConfidenceScore=5.26e-01
MFNKLLYLKDVTFTATSRYPFIHHHSPLLFPLRFYTTTTSNSHSFAVSYLIHNFGFSPESASRTCDSYRICFRTPEKPDSAIRFLRDHGFSNSQINSMVRRVPWLLSCDPCKRVLPKFQFLLSKGVSSSTIVDIVSKSPAILSRSLENTIVPSYDLVFRFLKSDDHTISCLFGNCIYYGRRDYIERNIRVLLDNGVGETNIARLLRNRCRAVFTSDILKVVEEVKDLGFDPSKSAFVTALLALKSMSQTSWKEKVGVYKKWGWSDEACLEAFRRHPHCMLASIDKINTVMNFWVNQLGWDSLDLVRSPKILGLSMEKTIIPRALVVQYLVAKGLRKKSACFHIPFAVSKKAFMEKLYQLSSDNFRIQHCRLVLAWGEPWHNGKKLPLCSLGLGFIHLTLQSPNSHNSESLVNWAVIYNRGAKD

SEQ ID NO: 166301 - protein, 40 aa, Glycine max
  Coding DNA Sequence Number=SeqID_74616
MAPSYPNKDPPLGINNNDGNSHNNVDLVMVNINVIMMVSL

SEQ ID NO: 166302 - protein, 193 aa, Glycine max
  Coding DNA Sequence Number=SeqID_74617
MGLTVTVTVIDREEDELCFLFEGSLKEGLAFSHNGADGYSSYIVCLSWTRQEHLGIVVVSVSGSVSEHLGSGVDPQRAWFPEKLTLPNLVSMESGIWRQSSLLVTLSTVRLRREAERSGTWSERALFCNLNVRRWVSFASCVGIGPRMLLLEMSRRRRRQSEDISAGISPEKSLQERYSSSMLVQFKRGEMVD

SEQ ID NO: 166303 - protein, 70 aa, Glycine max
  Coding DNA Sequence Number=SeqID_74618
MPSFAQADIMVFLILALISMVFREGHIVKCNAEEDGHVGNQQIKGYRVAYPNINVIIKFFRAEGHKKVNN

SEQ ID NO: 166304 - protein, 57 aa, Glycine max
  Coding DNA Sequence Number=SeqID_74619
  Subcellular localization annotation: CTP_CleavageSite=18; ConfidenceScore=5.08e-01
MRTTKGKGRRSLPPSSPRQAQLAQNFTNCLTMGAKYLKVVKRGSHPNNGWSPDEIRV

SEQ ID NO: 166305 - protein, 271 aa, Glycine max
  Coding DNA Sequence Number=SeqID_74620
  Gene Ontology: Mol. function=rRNA (uridine-2'-O-)-methyltransferase activity; Cellular component=cytoplasm; Biological process=rRNA processing
  Homolog annotation: Hit_ID=A1G2C2; Match level="QueryCoverage=76%, HitCoverage=98%, E-value=7e-94, Identity=86%"; Hit description =Ribosomal RNA methyltransferase RrmJ/FtsJ
  Pfam annotation: Domain name=FtsJ; Domain location=29-208; Score =185.7; E_value=1.2e-52; Accession=PF01728.10; Description=FtsJ-like methyltransferase
MATRSKSSQRWLKEHFSDPFVKKAQAEGMRSRAAYKLEELLERDRLLKPHMVVVDLGAAPGGWSQQVRRQIGDTGRVLALDILDMPPLAGVEFLHGDFREEAVLSQFEAMLGDQPVDLVLSDMAPNKSGVGAVDQPRMMHLAELALDFADNHLKTGGAFLIKLFQGEGFDDYVRDMRRRYDKVSIRKPEASRKRSPEVYALVRPQRNASTERNTGANEDERLDQEPPAMGGRRRRADGGLPELLAQVLRGRGAGRVVFAVPGPGGQRQRAE

SEQ ID NO: 166306 - protein, 99 aa, Glycine max
  Coding DNA Sequence Number=SeqID_74621
MPHPIVAECTQVMTVDEGSHVRALTVYQASLGGEFDIDPRYDTFNRGLKPIEDLAQDLFAHEYRCLADMLRKNIDLFASQPSEMSRIHLDIIFHQLGIL

SEQ ID NO: 166307 - protein, 66 aa, Glycine max
  Coding DNA Sequence Number=SeqID_74622
  Subcellular localization annotation: CTP_CleavageSite=45; ConfidenceScore=5.45e-01
PLGPSGIFLQKAVASGGSNPARLGELSSPGRAAEALPKRFRNVFREESRKGFNRSSTFFIRSSIFN

SEQ ID NO: 166308 - protein, 40 aa, Glycine max
  Coding DNA Sequence Number=SeqID_74623
MLKSRLSNTKVIKSKACLVAKGYSQKKLKRYLNELKQSPR

SEQ ID NO: 166309 - protein, 129 aa, Glycine max
  Coding DNA Sequence Number=SeqID_74624
MGEAEEVQEKMKADMEAMKEQMATMMEAMMSMKKIMEANAVAIAATSAVAKVNPMPPSGLNQMNHPTSNMVGKDLGSTGGPHYAQIQNERTFPPYGLPPNYTPPNVAYTPSENVNNSTPILIESQQPQI

SEQ ID NO: 166310 - protein, 88 aa, Glycine max
  Coding DNA Sequence Number=SeqID_74625
MASYGEAKESIDEEYPRPTSSNGAYIRWCVVLQGKTIGVNVEDDDSYMDTYVSPLSTQITPNIVGEEEADDVHANRNDHDEGELINIV

SEQ ID NO: 166311 - protein, 70 aa, Glycine max
  Coding DNA Sequence Number=SeqID_74626
  Homolog annotation: Hit_ID=Q5CDC4; Match level="QueryCoverage=40%, HitCoverage=21%, E-value=1e-07, Identity=100%"; Hit description =LacOPZ-alpha peptide from pUC9
MELGLIYDTSNGNLSNVVLGMTLREHPLPMSTLATMGTELEFVIMVIAVSCVKLLSAHNSTQHTSRKHKV

SEQ ID NO: 166312 - protein, 77 aa, Glycine max
  Coding DNA Sequence Number=SeqID_74627
MKNVEERLKPFAKFFTETFRKRLGLDFLHGNNFSKQIRKRENKIGEMLAAQLAQASQVASSRSNSLLEESSGRPKWA

SEQ ID NO: 166313 - protein, 63 aa, Glycine max
  Coding DNA Sequence Number=SeqID_74628
MKGIGFGSILGMIDFLLRENVVDSDDAGPADLRKNPLQEGGDDVTLPRRGPITRAMARRLQED

SEQ ID NO: 166314 - protein, 63 aa, Glycine max
  Coding DNA Sequence Number=SeqID_74629
MSTVQREGDIFGSDTLGMTLGEIEGKMESDPTSHHKHSAIFNGDDATRAYQNSDEVKPGICSN

SEQ ID NO: 166315 - protein, 330 aa, Glycine max
  Coding DNA Sequence Number=SeqID_74630
  Homolog annotation: Hit_ID=Q2QNX8; Match level="QueryCoverage=43%, HitCoverage=13%, E-value=8e-08, Identity=25%"; Hit description =Retrotransposon protein, putative, unclassified
TLSSQSERPTGHYERKSSPWVKTRELQVHQGQQSTQAGSGQGQHVTEVLSLILPALYLGCAIWWDCLAQTPPSIPELQQLAEATQIGEPASSSAEVRQLVDHLSEQAREVASEASMERTPRALAMWMAGLTLAFAISIALAQKTSENGKRKVEVDLLCDRCGMEPESTIHVLKGCPWASGIWLLCPLALHTQQMQALNFSDWVKEMGKCLDEEQLELMLVVAWALWSDRNLLLFQDIQNYPVDVVNKAISFFEEYKKEKLKIVQTPIGWQAPPHGVYKINTDAAIFNQQGIGCLLHPALPSLTSRKATREGVKPAKGGLQGDNSNRVAKR

SEQ ID NO: 166316 - protein, 381 aa, Glycine max
  Coding DNA Sequence Number=SeqID_74631
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=74%, HitCoverage=99%, E-value=1e-150, Identity=94%"; Hit description=Beta- lactamase TEM precursor
  Pfam annotation: Domain name=Beta-lactamase; Domain location=31-280; Score=186.5; E_value=6.7e-53; Accession=PF00144.15; Description=Beta- lactamase
  Pfam annotation: Domain name=Peptidase_S11; Domain location=29-263; Score=-122.5; E_value=0.033; Accession=PF00768.11; Description=D -alanyl-D-alanine carboxypeptidase
  Pfam module annotation: Pfam domain module=Beta-lactamase::Peptidase _S11; Domain location=31-280::29-263
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHCVRPRRKDQRIFLRSFFSARNLLLANKKTTATSGGLFAGSRATNSFSEGNWLQQSADTKYCSSSVAVVRPPLQELCSTAYIPRSANPVTSGCCQWR

SEQ ID NO: 166317 - protein, 335 aa, Glycine max
  Coding DNA Sequence Number=SeqID_74632
  Homolog annotation: Hit_ID=Q2HW90; Match level="QueryCoverage=67%, HitCoverage=49%, E-value=1e-14, Identity=29%"; Hit description =Putative uncharacterized protein
DFQLVPTVKEFEEILGCLLGGRKPYLFSGFYPSSTRVAKVVKISAQELDRANGLSFIDILALLIFGVVLFPNMEGLVDLVVIDAFLAFQHGKESPVVAILAMYDTFDRGCEKSGTRIVCCALALYVWLVSHPFLQEGRPVYPLQGHRSCVEKGKANWDQLLASIEGRLLIGSLARRKEDQDSIFMRRMSKCSLDGTRGCIKYNPVLAIRQLGYPMRGVPSDESITPFIARGFSDHNARDRELRGSSNGIIGDYHKWLRVRTQGLDWLPNLKTVRDNEVKASEESDEVQALKAKLERARVVKQKFKAAIVSSNSEEVKGIITGQRHDLEGRAKGLP

SEQ ID NO: 166318 - protein, 55 aa, Glycine max
  Coding DNA Sequence Number=SeqID_74633
MGAKFLEVVKRGSHPNNGWSPDEIKLCKSVLKRMLATGNRLLPSGNRLPESKTLW

SEQ ID NO: 166319 - protein, 207 aa, Glycine max
  Coding DNA Sequence Number=SeqID_74634
MPTDIREIEAALCIPSRGFILNAKGHPGKILRKDLTTIAQVWSVLSYSNLAPTSHTSNLTVDRARLIFGLVTQLDMNVEALISRQITSMAQSNSSRLGFPALITILCRSRGVASDSLVFECLSPVINLAYIRKNYWNLDDPIVIIRGARRPRVRLAEAPSTSAGPHPTSTSAACHPASTSATPPPARMIAALSTLPPTDFQRFEAML

SEQ ID NO: 166320 - protein, 111 aa, Glycine max
  Coding DNA Sequence Number=SeqID_74635
NETSAQSRLEDSDIFGEAKVTFSQSRPENADFFGKGAEDADIYGEEDVDILRKGEGDESRPKDAYVSGKGAANETLSKSRPEDANISGKGKVLMMAQATACYRALSLTDSK

SEQ ID NO: 166321 - protein, 139 aa, Glycine max
  Coding DNA Sequence Number=SeqID_74636
MRCLMVADGNSHCLSWERRMQIAIDAAEDELSTQDKNMEESILKKVSEESSHLRRNSNNIRNTSSSNAASLNKRNDQTTVDKDLPLFSQERKQGLSVSKDYMKKEHLGVAKRMFARALGMHSGKDGSVPRSRSGEIKKN

SEQ ID NO: 166322 - protein, 116 aa, Glycine max
  Coding DNA Sequence Number=SeqID_74637
  Homolog annotation: Hit_ID=B0HC01; Match level="QueryCoverage=26%, HitCoverage=65%, E-value=2e-09, Identity=100%"; Hit description =Putative uncharacterized protein
MENASNAAFTVLAFAGFCSHVLLRYPLILWITVLPPLSELIPLAAAERPSAASHWHDRFPDWKAGSERNAINETAMTMITNSSSVPASLPQSVREDSRFDRSGGIYGSCRIPRPIL

SEQ ID NO: 166323 - protein, 58 aa, Glycine max
  Coding DNA Sequence Number=SeqID_74638
MWYHGDQSGSQCFARMLQPYGINIGLKEHSNRVTPKAYTPKSLSGPFPPDSGPTQKTF

SEQ ID NO: 166324 - protein, 277 aa, Glycine max
  Coding DNA Sequence Number=SeqID_74639
FLGHPLVLEKGQECEYGQRRNQADGFDEEAIAQLLCIPGQDFARTAARRRVRIMRTNMTTLTQIWMTLLLSNIQPSDHNSDLPLPKCQLVYAVLTRMSIHVAQLIADDIYLFAGMAPTRHPLDPDKSNRALGFPALITGLCHSFGVPIAPSKVIRPPITRAFIEKYCTQRPAQGDAPQAANAPPPHQAGPAGSFDSEQYLRHLVCQQAANHRAHSQGFTSFPCPTPDQFRAEIAWPGDWLEAQAGEAPAEAPGEADEAHEDEEMTDLLDFLGGSGAT

SEQ ID NO: 166325 - protein, 44 aa, Glycine max
  Coding DNA Sequence Number=SeqID_74640
STLEDPLRRQAQGETPQQPEDGRQRATDAPPSPLEFTSAHPQKG

SEQ ID NO: 166326 - protein, 188 aa, Glycine max
  Coding DNA Sequence Number=SeqID_74641
MTQELVARGDTLRLSAPRHSVTPSVIDEQRPMWSSAPFPEMSASSDGDFSSLTSYLELRRGGGPDDTRRYLTVIRTLVSSRGGGPDDTRRYLTVIRTLLSSRGGGPDDTRRYLTAAGPMTRRDKIWSFCTLVSSRGGGPDDTRRYLTVIRTLVSSRGGGPDDTRRYLTVIRTLLSSRGGGPDDMQRLT

SEQ ID NO: 166327 - protein, 104 aa, Glycine max
  Coding DNA Sequence Number=SeqID_74642
MWSWESILHSDSSGGRRFDTEKKNGNGIIEGNVLPVELGCLESMMPFHSVVASARLVSSLSIESLGWGLVPQELELCCVEDFYRVYHMISTWALEVFIFVIEFT

SEQ ID NO: 166328 - protein, 207 aa, Glycine max
  Coding DNA Sequence Number=SeqID_74643
MVVGEVMELGTVEEILDVSEVSSEMGARWRDQICDDGYWGTFTLLAVISRRCGWVLLVVVGRGICGKSLQVWAHIRDLAPFRRRFTSLQRITDSLIRGRFTSGVQGKLRCLESSLLHLHHSILTTTAFSSLSSAFSNIDDNMAGKATSSFPATARYDKIELSTLLFGIRGEKGSPMLMMRLKQMNNFLSLFFDDNSMTPLRCLDFED

SEQ ID NO: 166329 - protein, 25 aa, Glycine max
  Coding DNA Sequence Number=SeqID_74644
MALHIQGRVVGAEKLKVEFRTEAVN

SEQ ID NO: 166330 - protein, 96 aa, Glycine max
  Coding DNA Sequence Number=SeqID_74645
  Homolog annotation: Hit_ID=A7PGQ2; Match level="QueryCoverage=52%, HitCoverage=12%, E-value=4e-10, Identity=59%"; Hit description =Chromosome chr17 scaffold_16, whole genome shotgun sequence
MDIDGTADVDENSGADKNKGKCKLNVGSQSLGYRRDYMEVLSPLKNGVVVDWNIYFVCTILPKHASSLKIITSGLWFQGPFRVRKNSIENWEEEGK

SEQ ID NO: 166331 - protein, 505 aa, Glycine max
  Coding DNA Sequence Number=SeqID_74646
  Gene Ontology: Mol. function=hydrolase activity; Cellular component =mitochondrion; Biological process=metabolic process
  Homolog annotation: Hit_ID=A7PET8; Match level="QueryCoverage=99%, HitCoverage=98%, E-value=1e-125, Identity=79%"; Hit description =Chromosome chr11 scaffold_13, whole genome shotgun sequence
MAEEFVKGTVHQNGVAVITLDRPKALNAMNLDMDVKYKSYLDEWESDPRVKCVLVDSSSPRAFCAVLGKVLRVTIGGQCRPHGILTPEGVCMAMARRPHKVSSLLKVCDQSLCSGVGMAMTRRYAGSYLAHGLEIYPKTHENPRAYPWISSPIYLESSTQCPYGLVSVLKADLLKQPWNHNFERVHLILVEFTQVWSGEVQVSLGVIAFLDLNPRQVFTAEYSLICKISDYKKPYISFMDGITMGFGIGLSGHGRYRIITERTVLAMPENGIGLFPDVGFAHIAAQSPGEGSVGAYLGLTGKRISTPSDAIYLGLGTHYVPSGKLGSFKEALLATNLYDPHQDIKVLLARYESNPESEAQLKLLLPQIVSTFGGNKSVTEIIEELKKHQSSTDPNVVEWANEALQGLGKGAPFSLFLTYKYFSLVASAVGNNDGELSTLSGVMKTEYRIALRSSLRHDFSEGVRAVLVAKDQNPKWKPSSLEEVDPSEVEAVFKPLGPEVGELRV

SEQ ID NO: 166332 - protein, 362 aa, Glycine max
  Coding DNA Sequence Number=SeqID_74647
  Gene Ontology: Mol. function=anion channel activity; Cellular component=membrane of vacuole with cell cycle-independent morphology; Biological process=malate transport
  Homolog annotation: Hit_ID=A7PGR9; Match level="QueryCoverage=84%, HitCoverage=53%, E-value=1e-120, Identity=69%"; Hit description =Chromosome chr17 scaffold_16, whole genome shotgun sequence
  Pfam annotation: Domain name=UPF0005; Domain location=63-360; Score =440.8; E_value=1.9e-129; Accession=PF01027.11; Description =Uncharacterised protein family UPF0005
MGPKLAKTGSFRHGLAEKKEKLLSASAKSSSSYSEIGIDITTREEDEEQSWWNTFKRVAGKALEMGRSDPRKIIFSAKLGLALTILSLLIFLKEPFADLSSYCVWAILTVVVVFEFNIGATLSKGVNGGMGTMLAGGLAVGMAELSTLGGKWEELIIIMCTFIVGFCATYTKLYPTLKPYEYGFRMFLITYCFITVSGYQTGEFVDTAINRFVLIALGAAVSLGVNICIYPIWAGEDLHDLVTKNFMGVATSLEGVVNHYLHCVEYKKVPSKILTYQAADDPIYSGYRSAVESTSKEDSLMGFAVWEPPHGHYKMLKYPWKNYVKLSGALRHCAFMVMAMHGCILSEIQVSLLRSDPLNKAF

SEQ ID NO: 166333 - protein, 228 aa, Glycine max
  Coding DNA Sequence Number=SeqID_74648
DAGAFWRGDPFCRVGFQTALTDQPVEETAQGREPERQARRAEIFFTATHDEPAYRGGVTLLPAFQADFIGNLHDGIKLTLIVEQRNRAELAPSVIRAQSSAPAAQAASGRSPATVACPAPHHQQFWPVKRPQIVVLMAQTLNAQRLKRLTAQRQMVNPGRRANAPAVRKETDRRACQPKLARPAMETAEELFEAVRRRQTRLQMEQTVEQTFVRTRLFHQQRHVSQAD

SEQ ID NO: 166334 - protein, 68 aa, Glycine max
  Coding DNA Sequence Number=SeqID_74649
MKGLFVKKFESNEMLLSPICGSNAFQDYFYDAKDLSQGSRVKQVSRIKESFNQDQDLRIKRRLNQDKY

SEQ ID NO: 166335 - protein, 234 aa, Glycine max
  Coding DNA Sequence Number=SeqID_74650
MADEPRRVTLEDYSSSSVPQFFTSIARPEVQAQNITYPHSLIQLIQNNLFHGLPNEDLYAYLATYIEICNTVRLAGCVICGGEHDFGCCIPTEDAAHEVNYMGNHPRPNFNAGGYSGFQHGQQFNQQLGQWRTHPSNQFNKDQGRPSNRPQQQGPNLYDRTTKLEETLAQFMQVSMSNQKSTESAIKNLEVQVGQLAKQLADRPSSSFGANTEKNPKEECKVVMTRSKMVSMNE

SEQ ID NO: 166336 - protein, 63 aa, Glycine max
  Coding DNA Sequence Number=SeqID_74651
MESGGRWRYLVVIRTLRQPRFTLVVRRRSSPTTHEIILCWVRAIKFDSVGKCHGCPTLSLSRH

SEQ ID NO: 166337 - protein, 67 aa, Glycine max
  Coding DNA Sequence Number=SeqID_74652
LSLAHQWAKRASTAKYSFSVLSAIEESDRALISRTHAKREISALNATVIFSQAQRIIGTKLKSTYSR

SEQ ID NO: 166338 - protein, 81 aa, Glycine max
  Coding DNA Sequence Number=SeqID_74653
MEEAEKKILETFRKVKVNIPLLDAIATCPFAGERRRGSRVRFPKEERCAESPPTFICGKRQKNRRKPAQNENSKFGSCIYA

SEQ ID NO: 166339 - protein, 60 aa, Glycine max
  Coding DNA Sequence Number=SeqID_74654
PFVKRKPRAKRIFVHALSRESQALSAQPLNLRLIWCAELAKAELSQLQFDLDLAKRKPNH

SEQ ID NO: 166340 - protein, 63 aa, Glycine max
  Coding DNA Sequence Number=SeqID_74655
  Subcellular localization annotation: CTP_CleavageSite=51; ConfidenceScore=5.02e-01
MSPVATYPSAGGRRGAHGCIFHGRKMRGVTSNVYSRKTSEKPEKTWSTNIKCERFGSCICAWG

SEQ ID NO: 166341 - protein, 234 aa, Glycine max
  Coding DNA Sequence Number=SeqID_74656
MALRKLASKRSRKDKAAEGTSSTPEYDSHRFRSAEHQQCFEAIKGWSFLRERRVQLRNDEYTDFQEEIVRRQWASLVTPMAKFDPDIVLEFYANAWPTEEGVRDMRSWVRGQWIPFDADAISQFLGYPLVLEEGQECEYGQRRNRSDGFDEEAITHLLCIPGQDFARTAAGRRVWIMRTHMTTLTQIWMTLLLSNIQPSDHNSDLPLPKCQLVWRLPGTLWTRISPTGPWDFPH

SEQ ID NO: 166342 - protein, 94 aa, Glycine max
  Coding DNA Sequence Number=SeqID_74657
  Homolog annotation: Hit_ID=A5ALZ7; Match level="QueryCoverage=89%, HitCoverage=12%, E-value=1e-19, Identity=56%"; Hit description =Putative uncharacterized protein
MYLYLLHSKNEALDAFKVFKAEVEKQCGKQIKIVRSDRRRMDKHGGWTSTRFICEISSRTWDCCPIHYAWFSKSEWCRRTKKSNLIRHDEKHEE

SEQ ID NO: 166343 - protein, 212 aa, Glycine max
  Coding DNA Sequence Number=SeqID_74658
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=82%, HitCoverage=16%, E-value=3e-94, Identity=98%"; Hit description=DNA -directed RNA polymerase subunit beta
  Pfam annotation: Domain name=RNA_pol_Rpb2_1; Domain location=14-198; Score=135.9; E_value=1.2e-37; Accession=PF04563.6; Description=RNA polymerase beta subunit
MLGDGNEGMSTLPGLNQIQFEGFCRFIDRGLPEGLFKFPKIEDTDQEIEFQLFVETYQLLEPLINEKDAVYESLTYSAELYVSAGLIWKSSRDIQEQTIFVGNIPLMNSLGTSIVNGIYRIVINQILQSPGIYYRSELDPSGISVYTGTIISDWGGRLELEIDRKARIWARGQKKMPFWSFIDNLLVLVEIQYFLNLYVKNYNKNFFNKDVN

SEQ ID NO: 166344 - protein, 242 aa, Glycine max
  Coding DNA Sequence Number=SeqID_74659
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=1e-31, Identity=31%"; Hit description= UPI00006A17C9 related cluster
  Subcellular localization annotation: CTP_CleavageSite=42; ConfidenceScore=5.33e-01
MWSPLKVRTRSPLKARACSPLKLRTCRPLKARACNPLKLRTCCPLKARACSPLKVRACNPLKTTPCSPLKARVCNPLKVRTCSPQKARTCSPLMARMCSPLKVRTCSPLKVRTCSPLKARACSPTMVRACSPLKVRACSPTMVRACSPLKASGCSPTIMRACSPLRVRSCSPMKARTCSPLKVRARSPTMARTCSTLKVRACIPLKVRMCGHLKLRACSPYEGTTIDSLTGRTGHPFKKIGH

SEQ ID NO: 166345 - protein, 106 aa, Glycine max
  Coding DNA Sequence Number=SeqID_74660
  Homolog annotation: Hit_ID=Q1RU80; Match level="QueryCoverage=84%, HitCoverage=85%, E-value=7e-12, Identity=40%"; Hit description =Putative uncharacterized protein
MDDVVSLLHLPIVGAFHSFEQLHVDDIVDMLVELLEVSAVESGTYSWSVAALVHMYDNLNEASKSTARQLVRYITLLQYWIYEHFPSVSSTLTVEEYDEMRPRACR

SEQ ID NO: 166346 - protein, 118 aa, Glycine max
  Coding DNA Sequence Number=SeqID_74661
MSNHKSTESALKNLKVQVGQLAKQIADKSSNSFVANTEKNPKEECKVVMTRSKRFMEAKDEDSVVYKKKDAEKKGAEVPYPVVPSKKEKDQHLARFVDIFRKLEITMPFGEALQEMPL

SEQ ID NO: 166347 - protein, 121 aa, Glycine max
  Coding DNA Sequence Number=SeqID_74662
MFIDGLRPQTKQLLDASAGGKIKLKTPEEATELIENMSANDHAILRDRVHQPTKKSLLQVVPSVVRLMKQANVFPLKKTLKKFTIWEIHRDKDILKEDFQASNRVLIINKDSGGHTWKLVQ

SEQ ID NO: 166348 - protein, 85 aa, Glycine max
  Coding DNA Sequence Number=SeqID_74663
MVIDYMPMASGIDYYLMCLALLSFKRLAKILLKHKHLDNEGKLELLHMMSNVMSRNEIGLHNAQCKIKVNCRSEVAGSTMSDTMS

SEQ ID NO: 166349 - protein, 42 aa, Glycine max
  Coding DNA Sequence Number=SeqID_74664
MDKSLKVGEDDWRERGRRSTKFCGSNEPTNPRSSPRFSTKCT

SEQ ID NO: 166350 - protein, 208 aa, Glycine max
  Coding DNA Sequence Number=SeqID_74665
MARVARVFKISERELDQLKQSRNGVAGIPRKCLEEKVETLASQGEWVSFMDVLALLVYRTVLFPNMDGLVDLAGIDVFLAYHHSKESQYVCPLQGHRMYSRKDKANWEEVIELLHKEGMKWMDRFSLTLNESQELPKLLARAKTMADTYSAPDEVHSLFNYYQHMVELMTHIITSFKNQDSRTINIKIQESREDLIKISTKKVFQNIE

SEQ ID NO: 166351 - protein, 85 aa, Glycine max
  Coding DNA Sequence Number=SeqID_74666
METCSAVRDLLQWMIDQGRLKVGSERKEEQHVYMQSADEEGPKKPKPLVIHFTRNTAPQRPQHPSVVSGGRSILFPYENSRTVPW

SEQ ID NO: 166352 - protein, 330 aa, Glycine max
  Coding DNA Sequence Number=SeqID_74667
  Gene Ontology: Mol. function=oxidoreductase activity; Cellular component=membrane; Biological process=electron transport
  Homolog annotation: Hit_ID=A6EGP8; Match level="QueryCoverage=100%, HitCoverage=75%, E-value=1e-127, Identity=65%"; Hit description =Cytochrome bd ubiquinol oxidase, subunit I
  Pfam annotation: Domain name=Bac_Ubq_Cox; Domain location=1-329; Score=181.4; E_value=2.2e-51; Accession=PF01654.8; Description =Bacterial Cytochrome Ubiquinol Oxidase
MLSFELGLLWPQFMKHAGPIFGMPFSLEGTAFFIEAIAIGFFLYGWDKFNKWFHWFCGFLVGLSGLASGILVVAANAWMNSPAGFDYINGQYVNIDPIKAMFNEAWFPQALHMTVAAFCATGFAVAGVHAFLIMRKRNVEFHTKAFRIAAGFALIGAFGAPLSGDIAAKSVAERQPIKLAAMEAHFKTEKGASFVIGGIPDEKKGEIKYALKIPKLLSFLVSNDFNAEVKGLNDFSRDEWPPVAVVHYSFQIMIFFGVIMICIGSLYVYSLFFKKEWLSKNWLLKTFLIATPFGYIALEAGWTVTEVGRQPWIIYGIMRTVDAVTPMPGI

SEQ ID NO: 166353 - protein, 91 aa, Glycine max
  Coding DNA Sequence Number=SeqID_74668
MPLRHFTEHLVGALLGTNSKVMGAMWLAPIISEHNLGLRPSPTTPQFNESKHKFTPNCLTKLVKSCRNLKDTRLPPSSASRLSGAGRGMTI

SEQ ID NO: 166354 - protein, 68 aa, Glycine max
  Coding DNA Sequence Number=SeqID_74669
MQSLHGLGLPSIMSMDEFYAQVAWLGAQPSPSGGGGASAAQEPVPEEPVAAAEGEDELTPQEEETSID

SEQ ID NO: 166355 - protein, 139 aa, Glycine max
  Coding DNA Sequence Number=SeqID_74670
MKKKLEEAAQSGSIDGVINPPSSVRRHVKWNMARTKKTWEMTTEAAKEIAEKIGSFVPHGRQDVIAAAIGRPEHLGRVRAAGAGVTIKQYFGSAPWTSRNASSLPFEKLQQLTQQIRDQLKESITEKVTRQVMASFSHM

SEQ ID NO: 166356 - protein, 178 aa, Glycine max
  Coding DNA Sequence Number=SeqID_74671
  Gene Ontology: Mol. function=transition metal ion binding; Cellular component=endoplasmic reticulum membrane; Biological process =electron transport
  Homolog annotation: Hit_ID=A5Z1Y7; Match level="QueryCoverage=60%, HitCoverage=97%, E-value=7e-31, Identity=60%"; Hit description =Cytochrome b5
  Pfam annotation: Domain name=Cyt-b5; Domain location=41-117; Score =34.6; E_value=3.5e-07; Accession=PF00173.19; Description=Cytochrome b5-like HemeSteroid binding
MAKYTVSTVTCLAPSENRQSNWLHPVHDYIASTSNETTGYSVSGSGVFATCCMQRLLTYNTSGLHVYDVTPFLDDHPGGDEVLVTATEKDATTDFEDIGHSDSATEMMEKYFVGEVDTNTLPAQVTSSSSVRPPTQAPVYNNQSSGFVVKILQYIVPLLILAFAFGLQYYGKKSKSEN

SEQ ID NO: 166357 - protein, 178 aa, Glycine max
  Coding DNA Sequence Number=SeqID_74672
MALALVVHLVGDGVDVAEVLAEDAAFISFSDLENEGGNPVRFGFLVEPIESGPEEAVLDGLVRVEAQNDVALVIRLHIGFVKFGDFEELVHVEPIHDPWEAYSYGVYQSRFEQEPPNRETYDDTEDYEEHRAVTRHDGRFLQDPICVSSVSRLSPSSSLFAATSVFCSIQRLRVYYSP

SEQ ID NO: 166358 - protein, 635 aa, Glycine max
  Coding DNA Sequence Number=SeqID_74673
  Gene Ontology: Mol. function=calmodulin binding; Cellular component =nucleus; Biological process=glucosinolate biosynthetic process
  Homolog annotation: Hit_ID=A7PXS6; Match level="QueryCoverage=84%, HitCoverage=98%, E-value=1e-162, Identity=60%"; Hit description =Chromosome chr15 scaffold_37, whole genome shotgun sequence
  Pfam annotation: Domain name=IQ; Domain location=127-147; Score=30.5; E_value=6.2e-06; Accession=PF00612.18; Description=IQ calmodulin -binding motif
  Pfam annotation: Domain name=IQ; Domain location=149-169; Score=17.9; E_value=0.038; Accession=PF00612.18; Description=IQ calmodulin -binding motif
  Pfam module annotation: Pfam domain module=IQ::IQ; Domain location =127-147::149-169
MGKKGSGSSWLTAVKRAFRSPTKDSDKRSGRRREDCDQEEDEEKKREKRRWIFRKTHMSHEGGNNNNNTQQKLKHDVAASGGGSRTDQDQKHAVAVAVATAEAAMATAQAAVEVARLSKPASHAREHYAAVVIQTAFRGYLARRALRALKGLVKLQALVRGHNVRKQAKMTLRCMQALVRVQARVLDQRIRSSLEGSRKSTFSDTASVWDSRYLQDISDRKSISREGSSITDDWDERHHTVEEVKAMLMQRKEAAAMKRDKTLSQAFSQQIWRNGRTSSIGNEDELEERPKWLDRWMATKPWENRGRASTDQRDHIKTVEIDTSQPYSYLGTNYRRSHPNYQYNPNHHQPQRHSIASPLHRSHQNGSSLHQSPATPSPAKSRPIQVRSASPRCIRDDRSYHTSQTPSLRSNYHYAGNLYQNGRVVGTGTSNGGATATLPNYMAATESAKARIRSQSAPRQRPSTPERDRVGSAKKRLSFPAPDPYGVGVSYGNYGHSLRSPSFKSVSGSHFGGLEQQSNYSSCCTESIGGGQVSPSSTDAKIKSEPYVVAYLTWDVVLMLKELPRPSEIAFNGLSCHNNIFKPRYLFFPNSSSRLVRASLAVYNGLQLDNLFFTETHNQRYLGIMSCLGSHPTEH

SEQ ID NO: 166359 - protein, 51 aa, Glycine max
  Coding DNA Sequence Number=SeqID_74674
MTWHYYEGEGDEVVKMKLWDQCVDIIKDDVQEAMHSAVALQESQRLRECNP

SEQ ID NO: 166360 - protein, 102 aa, Glycine max
  Coding DNA Sequence Number=SeqID_74675
MGFRKASVNYERRGELIEIGGGANSNFQILIWAFQTVFRSWVASGSNPAHLGELGGNLLPLFPINRLKGAVLRIPDPPNDVFQLFWVKKVFSVKKIQAEMLP

SEQ ID NO: 166361 - protein, 359 aa, Glycine max
  Coding DNA Sequence Number=SeqID_74676
DDEYTDFQEEIVRRRWASLVTPMAKFDLDIVLEFYANAWLTEEGVRDMRSWVRGQWISFDADAISQFLGYPLVLEEGQECEYGQRRNQSDGFDEEAIAQLLCIPGQDFARTAAGRRVRIMRTNMTTLTQIWMTLLLSNILPSDHNSDLPLPKCQLVYAILARMSFHVVQLIADAIYLFAGMAPTRHPLDPDKSNRALGFPALITGLCQSFGVPVAPTKVIRLPITRAFIEKYCTQRQAQGDAPQAAGAPPPPHQAGPAGSFDMEQYLRHVVRQEAANHRAHVRTNETLYQLSLSMQSQGFTSFSCPTPDQFRAEVAWPGDWPEAQAGEAPPEAPDDGEEAHEDEEMADLLDFLGGSGAT

SEQ ID NO: 166362 - protein, 43 aa, Glycine max
  Coding DNA Sequence Number=SeqID_74677
MEECHHIVQGDRQLFYWKVEGAGCHDITLQNMQLVYDRMNRLN

SEQ ID NO: 166363 - protein, 145 aa, Glycine max
  Coding DNA Sequence Number=SeqID_74678
  Gene Ontology: Mol. function=acyltransferase activity
  Homolog annotation: Hit_ID=A1RI16; Match level="QueryCoverage=100%, HitCoverage=77%, E-value=3e-48, Identity=64%"; Hit description =Transferase hexapeptide repeat containing protein
  Pfam annotation: Domain name=Hexapep; Domain location=124-141; Score =13.7; E_value=0.7; Accession=PF00132.15; Description=Bacterial transferase hexapeptide (three rep
  Pfam annotation: Domain name=Hexapep; Domain location=14-31; Score =0.4; E_value=1.3e+02; Accession=PF00132.15; Description=Bacterial transferase hexapeptide (three rep
  Pfam annotation: Domain name=Hexapep; Domain location=34-51; Score =15.0; E_value=0.29; Accession=PF00132.15; Description=Bacterial transferase hexapeptide (three rep
  Pfam module annotation: Pfam domain module=Hexapep::Hexapep::Hexapep; Domain location=124-141::14-31::34-51
MAILTREEIEQMGFASVGNNVFISTKASFYGTSKIHIGNNVRIDDFCVISAGEGGVYIGNYIHIAVYSSLIGSGRITLMDYSNISSRVSIYSSNDDYSGNYMSNPMVPSDFTNVTHDAVVVGKHVIVGSGSIVLPGVILDEGCAI

SEQ ID NO: 166364 - protein, 128 aa, Glycine max
  Coding DNA Sequence Number=SeqID_74679
  Subcellular localization annotation: CTP_CleavageSite=34; ConfidenceScore=5.55e-01
MYLLLFSVTTTQVDVPSTCTTKDVPSNVLRKSSQAQREKRMKKMKSTLLFSVKEQSLETRKLRKLLAKEEEEDVQRDSKKNHWKSYDLEKNLKTIGRATSLDFYSELVTGNRLPKPCNRLHKAFYEKL

SEQ ID NO: 166365 - protein, 119 aa, Glycine max
  Coding DNA Sequence Number=SeqID_74680
RVLGDLEGNERCRFRGTIRLTATSLVHPEEPARTLQQSVEWILVEPVQVIEVSSSEEDLEEDPEELPPEPTVDDLDLPEDDEDPLPDVDFPEDIMLASEADSTEESGPGGTTNSDNSSS

SEQ ID NO: 166366 - protein, 110 aa, Glycine max
  Coding DNA Sequence Number=SeqID_74681
  Subcellular localization annotation: CTP_CleavageSite=39; ConfidenceScore=5.86e-01
MGSPPASTTPPPPSPPSPPPPLPTSNALASTSAVKWTRKASRLRSLSTRPPSVERPVVHVDPATGKADGPHKKKLRTYLGIVARDKVDITYENWKEVPTAQKDLIWEDIQ

SEQ ID NO: 166367 - protein, 254 aa, Glycine max
  Coding DNA Sequence Number=SeqID_74682
  Homolog annotation: Hit_ID=Q2PEW8; Match level="QueryCoverage=90%, HitCoverage=61%, E-value=8e-59, Identity=44%"; Hit description =Putative uncharacterized protein
  Pfam annotation: Domain name=SURNod19; Domain location=1-254; Score =73.2; E_value=8.8e-19; Accession=PF07712.3; Description=Stress up -regulated Nod 19
MSLNPKLHCPGDAFFKRNEGTCNGGILPHYWGFRVESRGTPSNILDPFAIEQGNPTKIKKGYEEKWLFNIMVIDTRGAQDKKCCIECRCDHMNLPKDFYNVTRDIHNQPLTTNYKGGFQGSRRMVSLRYKISWVDWNKHQVPVKVYILDSTNRIRSNGSKIIHDCQAEYTILENGDGDSPHVQKANIPVEKGGYLIYGTAHIHSGIVNVTLYGQDGRTLCTSTPKYGTGNEAGNEKGYLIGVRQVASDILRRGG

SEQ ID NO: 166368 - protein, 112 aa, Glycine max
  Coding DNA Sequence Number=SeqID_74683
MVTARPERVVRKFGYIQSIPPAPVSARLSHDDIDDRWMHFAEHVLSVGELCLVSGQVSADYMEWFFRISHPFMISTQAGDQPRDAPAADPEEYIQPPSPQVPVAFDPPPHAV

SEQ ID NO: 166369 - protein, 115 aa, Glycine max
  Coding DNA Sequence Number=SeqID_74684
  Homolog annotation: Hit_ID=A5C9B4; Match level="QueryCoverage=49%, HitCoverage=29%, E-value=1e-17, Identity=78%"; Hit description =Putative uncharacterized protein
  Subcellular localization annotation: CTP_CleavageSite=5; ConfidenceScore=5.04e-01
MRVAVAAVVRAGTRNWARWASSGASSPSLSIWRRKKEMGKEGLVVAKELKRFRSDPVRLDRFIRSSVSRLLKSDLVAVLAEFQRQNQFFLCVKVPSFDNKTSHYFNLSSNLNKLY

SEQ ID NO: 166370 - protein, 71 aa, Glycine max
  Coding DNA Sequence Number=SeqID_74685
MPECAQMPREAAQRVQKDKAAEGTSPLLSMTITALGVLYTSSASRPSRDGRFSGSDASSSGTTSILISRRK

SEQ ID NO: 166371 - protein, 51 aa, Glycine max
  Coding DNA Sequence Number=SeqID_74686
MAGTFFLLKQQNNLENYERWIASGGSNPARLGEVSSPGRAGRQPPPPFSYK

SEQ ID NO: 166372 - protein, 90 aa, Glycine max
  Coding DNA Sequence Number=SeqID_74687
MKVLMTNTSTPYHRGGMMNAPRHVHAMRDKCVYLRIQELERPSLLTHNALGIMVHLQSLPRCPMHAIKKAMQTFWLLVKKMTKTNARHEQ

SEQ ID NO: 166373 - protein, 79 aa, Glycine max
  Coding DNA Sequence Number=SeqID_74688
MNSVITVLYFNGRVYEDNDDVIFEDSKKAIQIKRGISFNAFKYKIGDKCHENILPCKFAMTKTLKRCWKVLNYYKKCQF

SEQ ID NO: 166374 - protein, 65 aa, Glycine max
  Coding DNA Sequence Number=SeqID_74689
MNIEESIHVTFDDSNAILSRKNMLDDIADSLEHMNIHEQDSKVSYPNFVRGPLLDDMRPFFGPCE

SEQ ID NO: 166375 - protein, 54 aa, Glycine max
  Coding DNA Sequence Number=SeqID_74690
MDKSLKKGEDAWRERERRSTEYCASNELWFNPLIQDQVQDSPLSVLRCHEACKT

SEQ ID NO: 166376 - protein, 44 aa, Glycine max
  Coding DNA Sequence Number=SeqID_74691
MATHVDGRKAEKKMEEHKQQLADELALEPIDDLVELEEIVEEAE

SEQ ID NO: 166377 - protein, 108 aa, Glycine max
  Coding DNA Sequence Number=SeqID_74692
MVQKKDKELRGSNNGPIGGYRKWLKAHMQGEEVEAPEEDEEVQALRAELEQAQTVKERFKSAALKIRKKNAGLRDANIATTKALEQETKRARREEHGRNKFRGALWGQ

SEQ ID NO: 166378 - protein, 110 aa, Glycine max
  Coding DNA Sequence Number=SeqID_74693
  Gene Ontology: Mol. function=aspartic-type endopeptidase activity; Biological process=RNA-dependent DNA replication
  Homolog annotation: Hit_ID=Q6WAY3; Match level="QueryCoverage=52%, HitCoverage=2%, E-value=5e-09, Identity=48%"; Hit description =Gag/pol polyprotein
MPSRFPTRKLAGGGTPRRLRDKHNVTICSFKTLRSDDESREGTNTGDPTVDFEQEASQTENEEDEDVGLPPELERITAQEDREMRPHQEETELVDLGTGSGKKEVKVGTG

SEQ ID NO: 166379 - protein, 50 aa, Glycine max
  Coding DNA Sequence Number=SeqID_74694
MKTSLLLELELEDGNAGYGEGFHYALLLLVFPSQSSLLEVGSVHECNSLN

SEQ ID NO: 166380 - protein, 188 aa, Glycine max
  Coding DNA Sequence Number=SeqID_74695
MALVMGPLLERITSEMPHAPSHRFILIRRWEEVSVGNGSEVCGYDEEVMVGSFGSNSLGLDSSTLVGESSTKRESSDFSTFINQLPERVGENITTLVAVVAAQLRPLTEVRSQPKEHLALKEASVPLPIMLLRYTWVDGEENEERRLHSSSPRRAAYFLQKQPRSPKRAGCFIPKLSSGPKGWKMSPK

SEQ ID NO: 166381 - protein, 260 aa, Glycine max
  Coding DNA Sequence Number=SeqID_74696
MGIQKNSQAGEGRHKRIQAVSPSFFWKREKRDTKRIQAGKDDKVCQKYSIRKEKWNQFCQNCRDPSWEDVRKKAQAIQKQNPAPHVLSRRGYDFLEQKQKKRLEVATQSRSTDTVVDPPSPIRRHDVLTAAIGRPKHPSRVHAPRAGALALAPNIEVHPFVACVSKKESCVDPSGQNPKMVHNVPLSNDQVKVGVEEDKQEAEGLTKPVDMLDPDVDPMYLMTLTILQLFLKSLQVLWDTTVFGLACGASMEAGSLSFNE

SEQ ID NO: 166382 - protein, 128 aa, Glycine max
  Coding DNA Sequence Number=SeqID_74697
  Subcellular localization annotation: CTP_CleavageSite=49; ConfidenceScore=5.24e-01
MATPPSSHPPLPPLELVAPSPSTSKKTRKSTQLRPLATRLVGEEKPMVHVDHVTGKANGPHRKKLRMYLVIVTRDKGRLRQLATPLGIVFRELGLLGEAEEAHTDEDMTDLLGYLGEGGATRSRSPHL

SEQ ID NO: 166383 - protein, 95 aa, Glycine max
  Coding DNA Sequence Number=SeqID_74698
MKRKEMSNMSNPWVHQESSGGSNSSHGRACCFKLKPPARLSELGGKLLLHFPYKMALEAEGKGFSPFGNQISLKISEEKKKEGENPSRGASVMLL

SEQ ID NO: 166384 - protein, 99 aa, Glycine max
  Coding DNA Sequence Number=SeqID_74699
  Subcellular localization annotation: CTP_CleavageSite=16; ConfidenceScore=5.24e-01
MGGLAGACTLSATLSRLAHISEFRLSARLFAQRMDSNGYLSGMIPRSVNMYNSSFLTLSQRSGALSGWLAKPADWLSEQIKISTSQTCLINLKLRANDY

SEQ ID NO: 166385 - protein, 71 aa, Glycine max
  Coding DNA Sequence Number=SeqID_74700
  Subcellular localization annotation: CTP_CleavageSite=50; ConfidenceScore=5.10e-01
MAQKYIMKHSQQNMLSNKTPHIYSQNNSKAPKFLKVKEASARIKPRLLCKESMGKNTPKDYDDGWLKFSQR

SEQ ID NO: 166386 - protein, 63 aa, Glycine max
  Coding DNA Sequence Number=SeqID_74701
MHWIWNIITNDIKSDWSMPFDDDYRSHHGCLHPFRKNISWRLISGVIRAILIVMGLHSFRLKL

SEQ ID NO: 166387 - protein, 74 aa, Glycine max
  Coding DNA Sequence Number=SeqID_74702
MSIPTLGRKRVGESKKRKEGKFPNQRVGESKKKKRMKIPKSKSGRKKRKERKFPIKDRRKTEERCRKVVGPDDI

SEQ ID NO: 166388 - protein, 110 aa, Glycine max
  Coding DNA Sequence Number=SeqID_74703
MSLEQTNQWLAPTFQWKQRCNCEGMREKEDSTSDSPQISASSHQLDLAPYASGPYNAQWNAPGLLHDKHTLCSSCILRVMEVEKPWLGLWLPLNYRVDMGASQHRTLKLG

SEQ ID NO: 166389 - protein, 257 aa, Glycine max
  Coding DNA Sequence Number=SeqID_74704
  Gene Ontology: Mol. function=subtilase activity; Biological process =proteolysis
  Homolog annotation: Hit_ID=A5AWV0; Match level="QueryCoverage=70%, HitCoverage=12%, E-value=1e-14, Identity=30%"; Hit description =Putative uncharacterized protein
MATPPSFPPPPPPPTERPLIHVDPATRKADGPHKKKLRTYLGIITRDKVEFDIPEACDLRTKKKILQIVRERWRQFKSDLTLKWALVADKESVNDTVCEKYDISKEKWAQFFQTHKDPSWEDVRKKAQAIQKQNTTPHVLSRGGYEYLENNTDTVIDPPSPIRRHMKWKMAHTKKTGQMTSEAVKEIVEKIDSLEGQASQGSFVAHGRQDVLTAAIGRPEHPGCVRATGAGVTIKQYFGPAPRTSLTSSSMAPEDLE

SEQ ID NO: 166390 - protein, 325 aa, Glycine max
  Coding DNA Sequence Number=SeqID_74705
FDEFKEELERRHWDEDLTDFLDGNIHVAIVKEFYANLYDPDDKSPKQVRVRGHLIKFDEDTLNTFLKTPIVLEEGENLCTYSRFALLRPDPQELAAKLCIPGRGFELNVDGRPLKILRKNMTTLAQTWSILSFSNLIPTSHTFDVTLDRAKLIYGIIMKMDINMGSLESLSPAINLAYIKKNCWNLDDPTVTFRGPKKARGKRSEAPSTSAPSEAPTPSSSPVPPFSSTQILVIPPAPLHMPFPAPLSAEPSGLGLALHYEHGGEPMTEEPPAPAPVPVATEEETTLDQTQPSSPVAKPEQLIQDSTVTPALDLNEDQPHEEQDV

SEQ ID NO: 166391 - protein, 78 aa, Glycine max
  Coding DNA Sequence Number=SeqID_74706
MALEVMAAHPGELLLQPEVTLLAQASCDLAVEAMPSKIVLMMPKNQESNKFQESRSRFKIQVKNQDSRFKNQEKTQSR

SEQ ID NO: 166392 - protein, 91 aa, Glycine max
  Coding DNA Sequence Number=SeqID_74707
MTPTHDACQNEFVGYSFTEKNLKKFDIPSGCTMDELKDLIKQVAPHGILPYGIHETHTLMDHLRQLRIKYSFCGSTKTYVNHAIAYADQAE

SEQ ID NO: 166393 - protein, 212 aa, Glycine max
  Coding DNA Sequence Number=SeqID_74708
  Gene Ontology: Mol. function=microtubule motor activity; Cellular component=microtubule associated complex; Biological process =microtubule-based movement
  Homolog annotation: Hit_ID=A5C3L5; Match level="QueryCoverage=99%, HitCoverage=25%, E-value=5e-87, Identity=71%"; Hit description =Putative uncharacterized protein
  Pfam annotation: Domain name=Kinesin; Domain location=14-212; Score= -24.7; E_value=1.3e-13; Accession=PF00225.14; Description=Kinesin motor domain
MEASEICSVKVALHIRPLIADERQQGCIECVSVTPSKPQVQIGSHAFTFDYVYGNGGSPSVDMFEECVAPLVEGLFQGYNATVLAYGQTGSGKTYTMGTGYNDNCRSGLIPQVMNAFFNKIETLKHQTEFQLRVSFVEILKEEVRDLLDMVSMGKPETSNSNGHSGKVTVPGKSPIQIRETSNGVITLSGITEVPGSLSRATGSTNMNNQSR

SEQ ID NO: 166394 - protein, 462 aa, Glycine max
  Coding DNA Sequence Number=SeqID_74709
  Gene Ontology: Mol. function=microtubule motor activity; Cellular component=microtubule associated complex; Biological process =microtubule-based movement
  Homolog annotation: Hit_ID=A7PLF1; Match level="QueryCoverage=93%, HitCoverage=36%, E-value=1e-106, Identity=52%"; Hit description =Chromosome chr7 scaffold_20, whole genome shotgun sequence
MVTLSSACISPADINAEETLNTLKYANRARNIQNKPVVNQDFISNEMQQLRQQLKYLQAELCFQGGVPADEVRVLKERIAWLESTNEDLYRELHEYRSRCAFVGRCEIDEPDGHIYLMKTDGLERRFQSLDSSDHSLVGSLSGEDSRETDEAAKELEHVLFQNTMDKEMNELNKHLEQKEIRLFAISFSIMITDSQQRDEISTEYLILSPLFFLQSEMKLIAVDTETLKQHFGKKILELEEEKRKVQEERDRLFHEVENLAANSDGLAHKTQDVRGQKLKALEAQVQLQHKMKQEAEQFRQWKASREKELLQVYFVSGRYSNPQPLPPPSPFNHQVNLMTPRCIYVTHTSLPKGGYVRGHGNCKPFLKKEGRKNEYERHKLEALNQRQKMVLQRKTEEATMATKRLKELLEARKSSPRDNSVYSNGHLQPALVITYTWPIYYAICQLKSQPKMFCWLTLNQP

SEQ ID NO: 166395 - protein, 150 aa, Glycine max
  Coding DNA Sequence Number=SeqID_74710
MARAGDNGGVYHQLDESQRLFLDAWTTQMQHLLNRNKEKPYRRIAKSSSFTLKPLSPREVCDDQIRMREQEKENSEAPQRNMKKKSDTPEEKSDTHKRKSDTHERKFNYFAEASEVRKVLPAHEPLNLQYCKDSKISTDNSNEFTISILL

SEQ ID NO: 166396 - protein, 100 aa, Glycine max
  Coding DNA Sequence Number=SeqID_74711
  Gene Ontology: Mol. function=tRNA-pseudouridine synthase activity; Cellular component=ribonucleoprotein complex; Biological process =ribosome biogenesis and assembly
  Homolog annotation: Hit_ID=A7PNL4; Match level="QueryCoverage=47%, HitCoverage=8%, E-value=3e-18, Identity=87%"; Hit description =Chromosome chr8 scaffold_23, whole genome shotgun sequence
MVLVLSCVLINFCHQALAPDSDHLRNHMQELRRVRSRIMGEKDNMATMHDVMDAQWVYDNYRDETYLRKVVMPLEILLLAIRGLLSRILLSMLFVLVLSS

SEQ ID NO: 166397 - protein, 63 aa, Glycine max
  Coding DNA Sequence Number=SeqID_74712
MRYDVEPLHVVQYTLSRSNTNLTHRCKIKMEQQGVEEWSAHNQIVTTLFSSVVSNIFGARSKN

SEQ ID NO: 166398 - protein, 170 aa, Glycine max
  Coding DNA Sequence Number=SeqID_74713
MTSNSFFHPPEFGVPRGRGDGHRAGEIVVGQVEEFQGGLVEGRKRAGEVVGVETERDEAVEEGDVSGEGTGEAVVGEGESEEAVEEEEGGREGAGEAVVVEEEGLEGVVAEAEDSELVQTCESVRREWASQAHGLGHEADHSALRALHALPLAVVVPLVEGVEELVVLVR

SEQ ID NO: 166399 - protein, 403 aa, Glycine max
  Coding DNA Sequence Number=SeqID_74714
  Homolog annotation: Hit_ID=A5B5G7; Match level="QueryCoverage=52%, HitCoverage=14%, E-value=2e-08, Identity=26%"; Hit description =Putative uncharacterized protein
MASRKRKSSTSRSQEPYDTTRFVFEVAWEHYEQNVHARNIFPERNVDLYLTQYDEFRKELEMRRWHKALTRQPDGRTDVALVKEFYANLFDPEDKSPRQVRVWGKLIKFDPATLNTFLETPVVLEPGERYSTYSRFCHSHPDPQELASKLYIPGRGFVLNTKGAPWKLLRKDLTTLAQTWSVLSYSNLTPTSHTSNLNMDRARLVYGLVMKMDMDVGSIISGQISQMAQSNSSRLGFPAIITAMCIARGNPDYPMITFSGTRKTRARGPYDTTTSAPASISAPAPPPAPAPAPPTLIAPSGPSAQSSDILVPMLQSLHHGLCLVAWTGVHPSPVGGGEAPTAQEPQPEETLEDTPVTTPLEAIEEEDVVADTDYVADMIADTPMPAQDAPSPPCDDPAPAQEE

SEQ ID NO: 166400 - protein, 59 aa, Glycine max
  Coding DNA Sequence Number=SeqID_74715
MSKAGCYNQKAHLYRRCHARHDRTYQPFGDEVMFFFRFDEHVWEVLFRKQVIWDEDLPV

SEQ ID NO: 166401 - protein, 159 aa, Glycine max
  Coding DNA Sequence Number=SeqID_74716
  Gene Ontology: Mol. function=binding; Cellular component =intracellular; Biological process=RNA processing
  Homolog annotation: Hit_ID=A7Q1K9; Match level="QueryCoverage=79%, HitCoverage=22%, E-value=6e-43, Identity=64%"; Hit description =Chromosome chr7 scaffold_44, whole genome shotgun sequence
  Pfam annotation: Domain name=DUF946; Domain location=1-158; Score= -346.7; E_value=1.9e-05; Accession=PF06101.2; Description=Plant protein of unknown function (DUF946)
MEIPGVYFWLPEPPEGYKALGYLVTNKHDKPLLDEMCCVRADLTDKCEPYRQILATGSRIPEFSFQVWSLRTCDRGMLGKGVSIGTFFCSNGWTMGEELLPVACLKNLNLVLPAMPDSQQIHALIKHYGPTVPQLAVAASHPSLLSPPIPPAPKAGLPT

SEQ ID NO: 166402 - protein, 159 aa, Glycine max
  Coding DNA Sequence Number=SeqID_74717
MVIDQSLFYDLTQLSSEGVPFEGTLDDDWKFDFSVHDARRLVCTNQADMTGRLFAGSLALESCILHYLIVRILLPRSSNLAQVSEEDLTVIYFLIGAAVVASFGYRKERDGAKWMYPPLELIHKRCTLSCSQSNPNRCTLYLYHKGCTLQCVETKISGC

SEQ ID NO: 166403 - protein, 246 aa, Glycine max
  Coding DNA Sequence Number=SeqID_74718
MAPMRLCYLSVAGCGGAEQDAGGDAEVCAVQLQVALFDAAADGGEGHQVVQAVADDGEFQALEVGGAVVAAGAEFFGDGGDLGHPLADEVALGQGLGVVEEGADAAAGGVAEDDDVLDVQAVDGEFDGGAGAVVGDVAHDEHFAGAGVEDGFGRDARVATANDQDFRALPSFGQFFVAAAFRVEAAGEKGLIAFGESFGKHDLFTSLITGPGMPACRRTLLGASCGSPFCRVGCGIFPQLDLRRLD

SEQ ID NO: 166404 - protein, 163 aa, Glycine max
  Coding DNA Sequence Number=SeqID_74719
MSHHSSSVNGEGTSHKDPLSRILDELSSLKLWKEKLERKEKGKERVEINQDEREQIRKEERRKIMKEMKREKHVSYSSHDSCKSLSEELSNYYRGHHSSHTKHHSQIKETDRRPQEVNISLPYFHGKDNVEAYLDSEMKVEQLFVCHHITEERKVPLATHSFQ

SEQ ID NO: 166405 - protein, 63 aa, Glycine max
  Coding DNA Sequence Number=SeqID_74720
MSERIVIIKKGEIVEAMSSKVILMMPKNQESSKIQRFKNQVSRIKIQDSSFTNQDSRIIQIKI

SEQ ID NO: 166406 - protein, 94 aa, Glycine max
  Coding DNA Sequence Number=SeqID_74721
DNEPFVKVKHSFAIGAEELTPSPPPQRDDSSALMHEVLSELRGFRTYVGECFDSLDGRIDAIDALFARMDTRITQLEEDISYVRQCFDLPPPSS

SEQ ID NO: 166407 - protein, 126 aa, Glycine max
  Coding DNA Sequence Number=SeqID_74722
IATTRHPVDPEKSNKALGFPALVTGLCLSYRVPVPPARDRARKTPCGPKVVQQGPGVSSSDYGPRSVLRSACRPQQGRYTIIAWGWPAVGNRRTAATSRAPQLIHKKIRALPTTHGRPIGDQVQTQ

SEQ ID NO: 166408 - protein, 267 aa, Glycine max
  Coding DNA Sequence Number=SeqID_74723
  Gene Ontology: Mol. function=hydrolase activity
  Homolog annotation: Hit_ID=A7MRM2; Match level="QueryCoverage=98%, HitCoverage=84%, E-value=5e-95, Identity=64%"; Hit description =Putative uncharacterized protein
  Pfam annotation: Domain name=Lactamase_B; Domain location=72-238; Score=23.5; E_value=0.00064; Accession=PF00753.18; Description =Metallo-beta-lactamase superfamily
MITICTACGTSYQQQQPALTQCRICQDERQFVPPGGQQWIDQSALRASHQNQWQQLEPGLLSLQTVPDFAINQRAIVLQTPHGNILWDCIAHLDDATVTLLRALGGLHAIAISHPHYYSTMQDWADAFDAPVYLHASDSEWIMRASPRLQPWHGDSCDLLPGVRLLRLGGHFAGGTVLHWAHDGGVLLSGDILQVTPGASAVSFMWSYPNMLPLAGATVTAMLQRLQGVKFTRLYGAFAGREILARADEAVQQSGRRYLACLQHPQP

SEQ ID NO: 166409 - protein, 380 aa, Glycine max
  Coding DNA Sequence Number=SeqID_74724
  Homolog annotation: Hit_ID=Q6Z8F0; Match level="QueryCoverage=16%, HitCoverage=58%, E-value=6e-21, Identity=79%"; Hit description =Putative uncharacterized protein P0459B01.18
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGCSREVSIHPAQQHCYMFALGKRCVTPRQACPRPNGFGRNLRSKTRWFTGFCNSHQVSHFATFFIDARAEISVAESHCM

SEQ ID NO: 166410 - protein, 149 aa, Glycine max
  Coding DNA Sequence Number=SeqID_74725
  Homolog annotation: Hit_ID=Q6WAY3; Match level="QueryCoverage=50%, HitCoverage=3%, E-value=1e-07, Identity=42%"; Hit description =Gag/pol polyprotein
MNFAVRKPIEFTPIPVSYADLLPYLLDNSMVAITLTKVHQPPFLREYDSNATCACHGEAPGHSIEHYRGLKHKMQGLIDAGWLKFEENRDKVDIYVPRPLTNASLLIQLSPECGCKPLVHLLKRPVLLSLDFQDHSIRDYSSCTLGGLP

SEQ ID NO: 166411 - protein, 110 aa, Glycine max
  Coding DNA Sequence Number=SeqID_74726
MPLQGEDESSTSSPPKEAMDKSLKEEKMRGGKRREEAILLSWVMENSSLTVNHLIQPYFNLLSENQLRGELPGNHITSETSKRVGLRPQKGNNTRKSSLPWIQRENAIET

SEQ ID NO: 166412 - protein, 154 aa, Glycine max
  Coding DNA Sequence Number=SeqID_74727
  Pfam annotation: Domain name=G-patch; Domain location=43-82; Score =10.4; E_value=0.01; Accession=PF01585.14; Description=G-patch domain
MKFIVEGHLVILSGKEDILVVSIASVDSFSGQPCLSDAAVMMARVMLGNGYEPGMGLGKDNGNITSLISAKGNRGKFRLGYKPTQANIKKGITGRKSRDQGSPLGQEVKRGPPCHISRSFIRAGLGHEVKLLRYVKMICQVGRSWYDHVLLVSD

SEQ ID NO: 166413 - protein, 332 aa, Glycine max
  Coding DNA Sequence Number=SeqID_74728
  Homolog annotation: Hit_ID=Q9AVH2; Match level="QueryCoverage=43%, HitCoverage=63%, E-value=6e-50, Identity=60%"; Hit description =Putative senescence-associated protein
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPRDESKRQGLNLSGSCSKPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTD

SEQ ID NO: 166414 - protein, 225 aa, Glycine max
  Coding DNA Sequence Number=SeqID_74729
  Gene Ontology: Cellular component=cell outer membrane
  Homolog annotation: Hit_ID=A8GFE1; Match level="QueryCoverage=96%, HitCoverage=85%, E-value=3e-71, Identity=58%"; Hit description=MltA -interacting MipA family protein precursor
  Pfam annotation: Domain name=MipA; Domain location=15-225; Score =206.4; E_value=6.7e-59; Accession=PF06629.3; Description=MltA -interacting protein MipA
MCPCYFAAFSTYAEPVSLGASVIYAQSPYRGGQDRYLPIPVINYEGENFWFRSLQGGYYLWKDPQNQLSLTLLGSPQQYDPKDNDLGDMKGLDKRRMTLMAGATYRHVADWGIVRTALLGDVLNNSNGMIWDLTYLYRFDFGAFSLTPGIGAMWNSANQNRYYYGVSGHESARTGIDRYHPDDSWSPYVEMNASYQISESWNASLSGRYTRFASEIKDSPMVDKD

SEQ ID NO: 166415 - protein, 303 aa, Glycine max
  Coding DNA Sequence Number=SeqID_74730
  Gene Ontology: Mol. function=transcription factor activity; Cellular component=cyanelle; Biological process=regulation of transcription, DNA-dependent
  Homolog annotation: Hit_ID=A6TBX5; Match level="QueryCoverage=99%, HitCoverage=98%, E-value=1e-116, Identity=71%"; Hit description=NADH dehydrogenase transcriptional regulator, LysR family; modulates SprE(RssB) activity
  Pfam annotation: Domain name=HTH_1; Domain location=13-72; Score =64.1; E_value=4.8e-16; Accession=PF00126.18; Description=Bacterial regulatory helix-turn-helix protein, lysR family
  Pfam annotation: Domain name=LysR_substrate; Domain location=94-289; Score=116.6; E_value=7.3e-32; Accession=PF03466.11; Description=LysR substrate binding domain
  Pfam module annotation: Pfam domain module=HTH_1::LysR_substrate; Domain location=13-72::94-289
MINANRPILNLDLDLLRTFVAVADLSTFAAAAAAVCRTQSAVSQQMQRLEQLVGKELFARHGRNKLLTEQGIQLLSYARKILRFNDEACMSLMFGSLQGTLTIGASDETADTILPYLLNRIGSFYPKLTLEIKVLNYADIVAKLGSGEIDLALTTHQTGEFDVLTLRTSPTLWYCAADYVLAQGESVPLVLLEESGPFREDIISALNAAQVPWHLAHAASSLAGVKAAVKAGLGVTARPVEMMSPELRVPGKSDGLPGLPDTHYVLSCNPQRENELAQAIFQSLSQDHNPWTQETLYTPEGGD

SEQ ID NO: 166416 - protein, 170 aa, Glycine max
  Coding DNA Sequence Number=SeqID_74731
MEELFKRWNEYLNSTRSRVSQPPLINCDFCGGEHYNDNFHLYSMNDSRWEQELSPYNQYEEEKTPNLESVFEEFMAYHASSKANQNSMKNHEIHFGKSYSIENFQGGPKLQPYYQNEAERGSNLDNLLMQFKETTKSTQQALQSVKIQVSELAEEVTPFMSRQEKYFVEV

SEQ ID NO: 166417 - protein, 164 aa, Glycine max
  Coding DNA Sequence Number=SeqID_74732
MGGLWMEFPSGNKKFEEAMNLEVGRRRQTQEFCTGSATTHAYIQSPSNHRFLRFLQPCKILYSKDPQGIQTQVDVPSTCTTKDVPSNVLRQRSQAVKPLILCEWGYKRILKREKGDTKEFRRLVLRSFGKGRRETQKEFRRLVLGEFFSAKGEENEEMNSTSFP

SEQ ID NO: 166418 - protein, 234 aa, Glycine max
  Coding DNA Sequence Number=SeqID_74733
  Gene Ontology: Mol. function=transferase activity, transferring phosphorus-containing groups; Cellular component=chloroplast; Biological process=regulation of transcription
  Homolog annotation: Hit_ID=O54458; Match level="QueryCoverage=100%, HitCoverage=80%, E-value=1e-119, Identity=92%"; Hit description =Putative phosphotransferase in ppsA-aroH intergenic region
  Pfam annotation: Domain name=DUF299; Domain location=2-234; Score =359.3; E_value=6.4e-105; Accession=PF03618.5; Description=Domain of unknown function (DUF299)
MSTERSVFYISDGTAITAEVLGHAVLSQFPVNTNSVTLPFVENVQRAQAVKAQINALFQQSGVRPLVFFSIVTPEVRDIILESEGFCQDIVQALVAPLQSELGVASMPVAHRTHGLTASNLGKYDARIAAIDYTLAHDDGISLRGLEDAQVILLGVSRCGKTPTSLYLAMQFGVRAANYPFIADDMDNLKLPPALRAHQHKLFGLTIDPERLAAIRQERAENTRYASMRQCRLE

SEQ ID NO: 166419 - protein, 137 aa, Glycine max
  Coding DNA Sequence Number=SeqID_74734
  Subcellular localization annotation: CTP_CleavageSite=44; ConfidenceScore=5.41e-01
MHLTDRCKALLCPLPSTGISLSAKVRNIVASSANIYLLLKSSPSSFAVGPVFSLSPISAFASPLSLDLHREWILWVVLGRSLWLIGHARSDKRQAGGRFDIGRVIVLVQGILAWASPSFFFAPPILVLLLPTLFEVV

SEQ ID NO: 166420 - protein, 105 aa, Glycine max
  Coding DNA Sequence Number=SeqID_74735
MAPKKLFVKRSRRGATTEETSVALEFDSHRFRSAEHQQRFEAIKGWSFHQERRIQLRDDEYIDFQEEIARRRWTSLVIPMAKFDPDIVLEFYANAWPTEEGVRDM

SEQ ID NO: 166421 - protein, 283 aa, Glycine max
  Coding DNA Sequence Number=SeqID_74736
MDPWVHVLTFGGLHVLTFRGLHVLTFRGLHALTFRGLHVLTFKGLHVLAIRGLHVLAFRGLHTLSFSGLDALTFKGFLLSVPGPPPDIGGRPTVRAHPEREAITQLLCIPGQDFTRTAAKRRVWIMRTNMTTLTQMTLLLSNILPSDRNARISPEGPTGPWSIQLWLGPTRHPVDPEEPNRALEFPALVNGLWITPARHSVDPEKSNRVLELLALITGLFQFYGVSVAPSKVIRPPTTRAFIKKYCTLRQVQGKTPQQPGDDRQQATDAPPPPLEFTSAHPQK

SEQ ID NO: 166422 - protein, 621 aa, Glycine max
  Coding DNA Sequence Number=SeqID_74737
  Gene Ontology: Mol. function=nucleoside-triphosphatase activity; Cellular component=intracellular; Biological process=electron transport
  Homolog annotation: Hit_ID=A7MGU7; Match level="QueryCoverage=59%, HitCoverage=75%, E-value=1e-169, Identity=70%"; Hit description=GTP -binding protein engA
  Pfam annotation: Domain name=Dynamin_N; Domain location=258-373; Score=-41.0; E_value=0.023; Accession=PF00350.14; Description =Dynamin family
  Pfam annotation: Domain name=GTP_EFTU; Domain location=253-414; Score= -46.6; E_value=0.00012; Accession=PF00009.18; Description=Elongation factor Tu GTP binding domain
  Pfam annotation: Domain name=MMR_HSR1; Domain location=256-374; Score= 168.9; E_value=1.3e-47; Accession=PF01926.14; Description=GTPase of unknown function
  Pfam annotation: Domain name=MMR_HSR1; Domain location=461-582; Score= 154.9; E_value=2.2e-43; Accession=PF01926.14; Description=GTPase of unknown function
  Pfam annotation: Domain name=Miro; Domain location=257-374; Score =28.1; E_value=2.4e-05; Accession=PF08477.4; Description=Miro-like protein
  Pfam annotation: Domain name=Miro; Domain location=462-582; Score =25.8; E_value=3.9e-05; Accession=PF08477.4; Description=Miro-like protein
  Pfam annotation: Domain name=NOG1; Domain location=323-374; Score= -9.1; E_value=0.04; Accession=PF06858.5; Description=Nucleolar GTP -binding protein 1 (NOG1)
  Pfam annotation: Domain name=PQQ; Domain location=122-159; Score=5.4; E_value=2.9; Accession=PF01011.12; Description=PQQ enzyme repeat
  Pfam annotation: Domain name=PQQ; Domain location=33-70; Score=17.1; E_value=0.066; Accession=PF01011.12; Description=PQQ enzyme repeat
  Pfam annotation: Domain name=PQQ; Domain location=84-121; Score=35.9; E_value=1.4e-07; Accession=PF01011.12; Description=PQQ enzyme repeat
  Pfam annotation: Domain name=cobW; Domain location=256-401; Score= -75.3; E_value=0.043; Accession=PF02492.10; Description=Cobalamin synthesis proteinP47K
  Pfam module annotation: Pfam domain module=Dynamin_N::GTP_EFTU::MMR _HSR1::MMR_HSR1::Miro::Miro::NOG1::PQQ::PQQ::PQQ::cobW; Domain location=258-373::253-414::256-374::461-582::257-374::462-582::323 -374::122-159::33-70::84-121::256-401
GLDQSSGAVKWSVNLDMPALSLRGESAPAVAFGGAIVGGDNGRVSAVIMNQGQLIWQQRISQPSGATEIDRLNDVDTTPVIVNGVVYALAYNGNLTALDLRSGQILWKREIGGVKDLIVDAGRIYLVDQDDRVIALNADGGVAIWRQSDLLHRNLTSPVLFNGYLVVADSEGYVHWINTLDGRFVAQQKLDSDGFQTEPVVAGDKLLIQAKGGEVYAITLRHDILGACGLNLTANAVIITPFGRFIFKTEASVMVPVVALVGRPNVGKSTLFNRLTRTRDALVADFPGLTRDRKYGRAEVEGREFIVIDTGGIDGTEEGVENRMAEQSLLAIEEADVVLFLVDARAGVMPADQQIANHLRSRDKATFLVANKTDGLDPDAAVLDFYALGLGEIHPIAASHGRGVTSLLETALLPWMDDIAPREVSEEDENEAYWAALAAEENGEALEEEEEEAFDPTGLPIKLAIVGRPNVGKSTLTNRILGEDRVVVYDMPGTTRDSIYIPMERDDREYILIDTAGVRKRGKITDTVEKFSVIKTLQAIEDANVVMLVIDARAGISDQDLSLLGFILNSGRSLVIVVNKWDGLSQEIKDEVKETLDFRLGFIDFARVHFISALHGSGVGN

SEQ ID NO: 166423 - protein, 540 aa, Glycine max
  Coding DNA Sequence Number=SeqID_74738
  Gene Ontology: Mol. function=transferase activity, transferring glycosyl groups; Cellular component=peptidoglycan-based cell wall; Biological process=peptidoglycan-based cell wall biogenesis
  Homolog annotation: Hit_ID=A6TCD8; Match level="QueryCoverage=99%, HitCoverage=75%, E-value=1e-152, Identity=50%"; Hit description =Penicillin binding protein 1C
  Pfam annotation: Domain name=BiPBP_C; Domain location=448-537; Score =74.0; E_value=5e-19; Accession=PF06832.3; Description=Penicillin -Binding Protein C-terminus
  Pfam annotation: Domain name=Transpeptidase; Domain location=112-352; Score=-24.4; E_value=0.00013; Accession=PF00905.13; Description =Penicillin binding protein transpeptidase domain
  Pfam module annotation: Pfam domain module=BiPBP_C::Transpeptidase; Domain location=448-537::112-352
RGEAALLAVLPQAPSRLRPDRWPQRAEAARNKVLDRLAQYQVWPAHTVAEIKQEPVWLPPRQLPQLAPLLARRLLSLSPDSKITSTLDVSLQRELENLAASLQTRLPPRTSLALLVVDHSTMKVRGYVGSVSFNDDSRFGHVDMIASVRSPGSLLKPFVYGMALDDGLIHGESLLQDVPRRFSDYRPGNFDSGFHGPVSASEALQRSLNLPAVQLLEALGPKNVAARLRNVGLNLRFPAGGEPNLSLVLGGTGARLDDIVAAYSAFARHGNAAAAALAATAAAAAAPVTVARRGVDCAPHSRRPDATPVAGQFGYASAVPVMQQVNHLLAGHLPARGVPGDPRPATVSAVSICWPGGQPLPAGDENCRQRRYSWVLNQTVPPTLLAPGQEGVNGLRQRFWQNSKGLRVAADCPDAQSRERVMWPLPLEPWLPPGERRAQRLPPVDVTCPPLNQGDSAPLLVTGVINGQRVQPLPGKVVLLLPVAVQGGQGTQRWWFLNGQPVELAAGKSSASLVLREPGRYQLVVMDEAGQLASVSFTRG

SEQ ID NO: 166424 - protein, 199 aa, Glycine max
  Coding DNA Sequence Number=SeqID_74739
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=96%, HitCoverage=53%, E-value=2e-36, Identity=49%"; Hit description =Chromosome chr13 scaffold_17, whole genome shotgun sequence
TCPKTQQTLVHTALTPNYVLKSLIALWCESNGIELPKKQGNCRTKKCGGSSLSDCDRTAIGALLDKLTSNDIEQQRAAVGKKDAATALIKLLCEDEALAIMAILASHHEGRVAIGQAKPIHILVEVIRTGSPCNRENAAAVLWSLCTGDPLQLKLAKEHGAEAALQELSENGTDKAKRKAGSILELLQRMEGVDNLQSS

SEQ ID NO: 166425 - protein, 153 aa, Glycine max
  Coding DNA Sequence Number=SeqID_74740
MPRRPLSGDLSIWYFDLLLGWRQVRFVFNLLPNQSLFISFVVLLAQWSNLEEGSWMFFSIYHHYGPYGQIDVVRIIVCPFEKDECPTHVISAKGFVSEGLTSDVWKYVVEVNSSEMQPEGNLSFDPVCIWLWFRYRLKTFFRALISVEVEYCS

SEQ ID NO: 166426 - protein, 84 aa, Glycine max
  Coding DNA Sequence Number=SeqID_74741
MDKSYNLFDSFISAQNVRQVYYVSYPTTRRDKCDLRGGVEEVNPVDLLTNEEESTNLNRESNNIEQDNEGELDYDFEVYNSEED

SEQ ID NO: 166427 - protein, 151 aa, Glycine max
  Coding DNA Sequence Number=SeqID_74742
  Homolog annotation: Hit_ID=A5BYP7; Match level="QueryCoverage=80%, HitCoverage=69%, E-value=2e-09, Identity=34%"; Hit description =Putative uncharacterized protein
  Pfam annotation: Domain name=PMEI; Domain location=21-145; Score=3.7; E_value=0.0076; Accession=PF04043.6; Description=Plant invertasepectin methylesterase inhibitor
MNSLALCSLCLFLIAQSPWLTNATVFGDDPTVLGAKNLLQLSEAILNLAVNKTEKAEDFLKGLANTTDVPAIANCALYYENAVERFMSSLQVLKHQDLEVANYLAAIAGDEPSSCETELSAAHIVNHAISAVNHQTSLLSYIAFVATGKLS

SEQ ID NO: 166428 - protein, 844 aa, Glycine max
  Coding DNA Sequence Number=SeqID_74743
  Gene Ontology: Mol. function=molecular_function; Cellular component =integral to membrane; Biological process=biological_process
  Homolog annotation: Hit_ID=A5C2C6; Match level="QueryCoverage=51%, HitCoverage=94%, E-value=1e-126, Identity=53%"; Hit description =Putative uncharacterized protein
MEFRHRNYSAELESHALPRLRAGAHPLSAPPPPPPLSQVDAIDCGNTDFYDPLRGTNNDANAAPPDHDNLNEAADHQPTKEWTSFRRLLTQRFPVSKMVSVASIIDVNFDTAGKLGSTSVNLDITSFCKVLEKSSTNMHLEELEDPQKFADEGVKTITWQEYVSRLHELKDEITRSWLAEDRVTSLKLSIKVAKLLMDTSVFEFYPTLFVLVTDIMDMLGNLVWQRIKRKAEFSEDGALRCNLAENFQARDICADAKETCYNWFNKIGAVQELLPRIYLELAILPCWRFLLEQPLDSLRRLVMMIRGLGDPVASAYCRLYMAHCAQKLPSHDIVWLTVLKRQVNEVLSEFGLMKNQQDLGSVSCVSIILHHLLKELPIEVVSSNVVQILHLIEFSKDNSFDQHMNYRLLGFRLYERKSPVDIVDAVLDKVIQVIALYDSLDEYLKVVDAYTDLILQNQMDNHLKIILEGISKRTWNKGVTEDEMPSLQSLVVKLLSHFKHLEDVFSLDQFPEILDVMYGKSQDVVFLHILNMATRCKREGKGEREREREKRDAEMKEAQKRDRREREGGVEEKGRDSERCGRESGVKEKKGERCKSDRVCTRVLGNGRISDPTSIQLLFEISLALHNNIEFMNMKDDDGQVACSIARFVHMVDYGTEMEHHLAFLVDCRGAFGRLNELKETLVHSSNSLAIQALKCAKKHLNFVKSCVTFSEVTIPSISAHRQFDLFLETAEVAFLGGLVSHSDGLIDSAISCLHTLDIIDGNDMLYYGDSSYNQELVSLSKLVLENLLSAVQQEPSQAARGIMALEACNCIASSFMVSSSIVVLNLVLTIIDVGRKYKGKKED

SEQ ID NO: 166429 - protein, 153 aa, Glycine max
  Coding DNA Sequence Number=SeqID_74744
MVHGFSRGAIVDEGGREESVEALMTMEDLALPLTTTLEFFRIFSMHSCTTPASNEIPEVASLTILLMFVAVCTRVFATPMPPSTYHSQPHQKHLVLKVLGTKHRNGNNLASRVRNLHRRRGRERARERTKGRTFLIYFQHHIAEALLTLHKGY

SEQ ID NO: 166430 - protein, 357 aa, Glycine max
  Coding DNA Sequence Number=SeqID_74745
  Gene Ontology: Mol. function=double-stranded RNA binding; Cellular component=intracellular; Biological process=RNA processing
  Homolog annotation: Hit_ID=A7P0L3; Match level="QueryCoverage=93%, HitCoverage=82%, E-value=2e-84, Identity=52%"; Hit description =Chromosome chr19 scaffold_4, whole genome shotgun sequence
  Pfam annotation: Domain name=Ribonuclease_3; Domain location=57-166; Score=138.3; E_value=2.1e-38; Accession=PF00636.17; Description =RNase3 domain
  Pfam annotation: Domain name=dsrm; Domain location=241-301; Score =39.1; E_value=1.5e-08; Accession=PF00035.16; Description=Double -stranded RNA binding motif
  Pfam module annotation: Pfam domain module=Ribonuclease_3::dsrm; Domain location=57-166::241-301
MKSESVSECLCLLGCAGEMEVSLLEEVENILRYRFRNKKLLEEALTHSSFLDGVSYERLEFVGDPVLSLAISNYLFLAYPDLDPGQLSALRAANVSTEKLARVAVRIGLHRFVRHSAPPLVDKVERFVDAVKLEINPVAHGGSVKAPKVLADVVESVAAAIYVDVNFDLQTLWVVLYLFIRIHHQVYVFRMECHTLTQKQKLKVQVDRSYLHSIFSLLIDIMRGVLEPIVTPDALEKQPQPVTMLYEMCQKKGKQVDIKPSREGDLSVAKVFVDGEFVASASSSQKDHAKLEAAKIALGKLAHLVPSTDKKSATNMKLNFAADENGTWVVEAPKNKLRELCAVKKWPIPEYMYCSLT

SEQ ID NO: 166431 - protein, 420 aa, Glycine max
  Coding DNA Sequence Number=SeqID_74746
  Gene Ontology: Mol. function=mismatched DNA binding; Cellular component=synaptonemal complex; Biological process=mismatch repair
  Homolog annotation: Hit_ID=A7P0N5; Match level="QueryCoverage=80%, HitCoverage=40%, E-value=1e-138, Identity=73%"; Hit description =Chromosome chr19 scaffold_4, whole genome shotgun sequence
  Pfam annotation: Domain name=MutS_V; Domain location=45-298; Score =138.5; E_value=1.9e-38; Accession=PF00488.12; Description=MutS domain V
MERAITRDLFSRILLFQTHLIKVATFAAELDCFLSMALVARQNNYVRPSLTEENLLDIKNGRHVLQEMTVDTFIPNDTKILHDGRINIITGPNFSGKSIYLKQDFDHTVLNSNYVEKVAIIVFLSHIGSFVPADAATVGLTDRIFCATGSRLMTAEQSTFMIDLHQIGMMLRHATSRSLCLVDEFGKGTLTEDGIGLLAGTINHFVTTDEPPKVFVCTHLMDLLHGHSLTKSEQIKFYTMSILRPDGNSTHIEDIVFLYRLVPGHAHHSYGLHCALLAGVPEEIIKRATAVLDTVSNNKHVERLSNENISAQDRQYKDAMEKLLEFDIDKGDLKIFFEDHTDPNVATSTLGSIPPGLGWIKVNVDAAVRMSDNEAVCGGVLRDHYGVFLHGFMANFGTCYILEAKLWAILNGLQLALDRG

SEQ ID NO: 166432 - protein, 697 aa, Glycine max
  Coding DNA Sequence Number=SeqID_74747
  Gene Ontology: Mol. function=GTPase activator activity; Cellular component=cytoplasm; Biological process=regulation of GTPase activity
  Homolog annotation: Hit_ID=A7P0N2; Match level="QueryCoverage=94%, HitCoverage=94%, E-value=0.0, Identity=59%"; Hit description =Chromosome chr19 scaffold_4, whole genome shotgun sequence
MEEEQQTFVSKARTAFHSAAAKAERVLLDFKSDRALTQFVDREEDHDKQSSPNTFTGQQPEAESPHTDENDSKLHSESKHIKWRPPHLGIKQDWQDKIKNIRRGRKEVEDTDKVGDASMAIPFYDDNLYLLNVKNDLEAKASEAMPSVEGLTAATKDPIPPSSVLKQLAIAVEAGSKAKSMKDVIASPGGSSPARERAGLSLSAVKALVLREKEDKLTSEFTSNEKVVQLINSLFDPEGDFLRRKIDSNLEETAMTSLPRDIHGAPPESLVVKLAEILGNYKTLRKMALFWCRVVAELRKLWFEEQYLPGVPQDEIPDLKSCLLYQQFQVINCCISRKRFRIIATESLDSMMMQANSDIKESTDCSAEASASPVLYARLNSGELVLRLGADHPAGDMTLLETGEPVYSPITQEGPLLTEDLIRETEEFVLRTGSVGAGCSQLLSDMQAFKAANPGCILEDFVRWHSPPDWTDNEASTEDSDVFDSGEPLSARGNLWRELWETSKPVPAVKQAPLFDEDLAVEGILNAFEEMHPSDLFGQLFVSLLGLGFGIAEPMLSGNSDFSKLFYDCKEYIITACQNNKLNEKVDGLVQVYETVEKMLLNPEEALKMIKQTEESTTVTGEPRSPFKRLSLIFGGKDKLLRKSVSKDQTNDEEKSGRQSFSSFFDSKSSLFGKKPPKSGSPSPSEKSSIDTGWPVV

SEQ ID NO: 166433 - protein, 398 aa, Glycine max
  Coding DNA Sequence Number=SeqID_74748
  Homolog annotation: Hit_ID=A7P0P0; Match level="QueryCoverage=94%, HitCoverage=54%, E-value=2e-86, Identity=46%"; Hit description =Chromosome chr19 scaffold_4, whole genome shotgun sequence
MQFNAAETIYHKQARSIQELARKKFEKLRIDYERSQSKLKSEQKTRSNSLTKKLGKRPLGQASQEPVGYDFTSGPTHATIEDVLPTSLPMQGAVCEGPGNIDGLLEGNAFLIDSNQEKVEDYIPGRDLLSKLGRKPSVQDNMSNLPATRSDSLFTTFEGEVKPQLVSVGPQDEYSYARSLARFAATLGPTAWKVASQKIRQALPPDCKFDRGWVGEYEPLPTPVSMLNNHAQQQPSLATKLQSTTEFIEVEKNCKNVESTMEQYSVNGPMHEGKQPTACSSSGLTSDEKSSLFGSDGPRPNSPVNLFYQQLNVQTRNLDKYENKGSKQVEFNSLPSSDQNNASLVAKLTSNNTPAAVSKPREMVPSNMNIGSQSPGSPAKQSSGVLVDSQQPDLALQQ

SEQ ID NO: 166434 - protein, 165 aa, Glycine max
  Coding DNA Sequence Number=SeqID_74749
  Gene Ontology: Mol. function=microtubule motor activity; Cellular component=microtubule associated complex; Biological process =microtubule-based movement
  Homolog annotation: Hit_ID=Q2HU33; Match level="QueryCoverage=24%, HitCoverage=3%, E-value=1e-12, Identity=87%"; Hit description =Kinesin, motor region
MIIKSFQVLDEHSELWRPPAMTVPLDSAYGTTKIKVVGQNSVLSTQVLSGPREVQVSLTRSNSSLTRSLRPLSEDETRLHTPVVISCNEDRREVLAVQNIANKQIDRTFAFDKVLSSFRYLKREERDGVGGEERTQIRQRKGFRRFPQRAQGWRLPVCPFSFLRS

SEQ ID NO: 166435 - protein, 141 aa, Glycine max
  Coding DNA Sequence Number=SeqID_74750
  Gene Ontology: Mol. function=protein binding
  Homolog annotation: Hit_ID=A7Q7U4; Match level="QueryCoverage=97%, HitCoverage=37%, E-value=4e-23, Identity=35%"; Hit description =Chromosome chr18 scaffold_61, whole genome shotgun sequence
  Pfam annotation: Domain name=LRR_1; Domain location=28-50; Score=4.8; E_value=39; Accession=PF00560.24; Description=Leucine Rich Repeat
  Pfam annotation: Domain name=LRR_1; Domain location=52-74; Score =14.2; E_value=0.48; Accession=PF00560.24; Description=Leucine Rich Repeat
  Pfam module annotation: Pfam domain module=LRR_1::LRR_1; Domain location=28-50::52-74
MGDQNFYNDSVAVVMKGQCMELERVLTIFTTIDLSNNMFEGKLPKVIGELHSLKGLNLSHNAITGIIPNSWNQLKGEIPMALINLNFLPHSTFHHEESRFGWKAIPVGHACGLLFGMLLGYNVFMNGKPQWLARLVEGVLS

SEQ ID NO: 166436 - protein, 60 aa, Glycine max
  Coding DNA Sequence Number=SeqID_74751
MKNLKAKEERKSNGGQNTNGDDKCLRVETGSGGDAVKEQNGVDDLWRGKEREGVEEHGER

SEQ ID NO: 166437 - protein, 205 aa, Glycine max
  Coding DNA Sequence Number=SeqID_74752
  Gene Ontology: Mol. function=peptidyl-prolyl cis-trans isomerase activity; Biological process=protein transport
  Homolog annotation: Hit_ID=A7P0J7; Match level="QueryCoverage=47%, HitCoverage=18%, E-value=1e-36, Identity=76%"; Hit description =Chromosome chr19 scaffold_4, whole genome shotgun sequence
  Pfam annotation: Domain name=Trigger_N; Domain location=93-205; Score= -3.9; E_value=0.00059; Accession=PF05697.4; Description=Bacterial trigger factor protein (TF)
MGVRGSSVLAMLVLGGISAETETEGILGTTPTPFEYGDNKAIGLKCGRYVSRIGPKEPPSQACCQSLEGADIPCLCQYFTIYALLFSLEKDYLEDVKNMNGGGRVRLHVEVPSLVCEDCYKRVIAEFMKQAKIPGFRPGKKVPESILISYVGSQNVQKATIESILRRTLSHAMTSVTGRALQESVRIVTKFSEMEETYSSLGSLG

SEQ ID NO: 166438 - protein, 106 aa, Glycine max
  Coding DNA Sequence Number=SeqID_74753
  Subcellular localization annotation: CTP_CleavageSite=38; ConfidenceScore=5.63e-01
MGVQIATKPTWALQKIPPEGCCFWRKSKPRRFRNVSVRNFAKVSTVLRRSSSFFDLQRRKVIKVYSKVFKLMLHLETLSTTTSNCYILSFCSGKYYTSLFFAIPRH

SEQ ID NO: 166439 - protein, 210 aa, Glycine max
  Coding DNA Sequence Number=SeqID_74754
  Homolog annotation: Hit_ID=Q5QJQ3; Match level="QueryCoverage=15%, HitCoverage=25%, E-value=1e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPTRVLEVVANYGYTRRTVFGICRSAEGSYLEKELVALDPG

SEQ ID NO: 166440 - protein, 53 aa, Glycine max
  Coding DNA Sequence Number=SeqID_74755
MGHAADRGGADRPVRPGVGQLPRCQQHHQYPAFDRHRDGELASLGVSIRCRSA

SEQ ID NO: 166441 - protein, 197 aa, Glycine max
  Coding DNA Sequence Number=SeqID_74756
MAVMLCCNTDYAVGNQQNGITAVENALAGRGATRVRLRRCEKRSEGGGSVCADDAADARRGIAEAVRNAGVDGVTLAGGQAVALAVDGQHDLALQQGADLFALVLDLFTGGGAGLVGFQHHRQVTRRAAVVHQPHRYPLAADLNQILGVDHHARLVDGFRFGKEFRQRQAIHLQQLLQRADGRADLVLFDGADRTVG

SEQ ID NO: 166442 - protein, 804 aa, Glycine max
  Coding DNA Sequence Number=SeqID_74757
  Gene Ontology: Mol. function=protein kinase activity; Biological process=protein amino acid phosphorylation
  Homolog annotation: Hit_ID=A7ZNH9; Match level="QueryCoverage=12%, HitCoverage=89%, E-value=3e-41, Identity=87%"; Hit description =UPF0265 protein yeeX
  Pfam annotation: Domain name=DUF496; Domain location=143-237; Score =229.6; E_value=7.2e-66; Accession=PF04363.3; Description=Protein of unknown function (DUF496)
ALHGFLKCMDHLSAKVLIDPVNHSRNLHPAADAEFAGIAGGADARRAAGTAAGGGGAAGGDRRRAENADAGGQPRPARRSADLRLCLAQYGAGAATGRAGGSAPGLHRRRARIRGQIMKAALWVLAAGAKWGIKMDNANKPSFQDVLEFVRMFRRKNKLQREIVDNEKKIRDNQKRVLLLDNLSEYIKPGMSIEDIQGIIANMRSDYEDRVDDYIIKNADLSKERRELSKKLKAMGEDLQVTAGERLLLLRTVHVEVEILVVDFLVSAVGADRLQRGVEGVKQRGILFAHPDAVADAEVFAVVQFGADKGEIFAAGRFEELAGADAGQQRRIQPAVGQIFVHLLLALVGDHVNAGRAPQRVGIGLLAGALLYADRFALQRGGGRLQAAALMRHQPRRGVGDFAGEGDLLLALRCDGHRRGDGVEFLRLQAGDHAVPAAFHPHAFGLHLIAQRLGDVDAEAGQLALRVFIFQRRKGGIDAQLDHLAAEFAAQRGKARGQRQQQQQPFDGFHVVVIEVIAGVVQGIARRCGAVADRDVAAWALLQHKGEIFAGGKRPQRGDNLALSGPVQRHRARQLGFCRVVHQHRVAVPVVDLRAGAEAGGLRRDQLGDALFQPRAHHRRQRAHAERQGGGRRDYVGGLAGLHRSHGDDRRFLRIDIARHDGLQAHDDGRAGHHRIDGALRHCAVAAVAVQGDVHRIGRAHQGAAGEAQVAGGEAGHVVHGEHRVAGEALKQAVFNHHSGAAAAFFRRLKDQVQRAAEVRLPRQTARRRQQHGGVPVVAAGVHHPGMGAGMRQAGRFGDRQGVH

SEQ ID NO: 166443 - protein, 77 aa, Glycine max
  Coding DNA Sequence Number=SeqID_74758
  Subcellular localization annotation: CTP_CleavageSite=47; ConfidenceScore=5.29e-01
MLQPYGINIGLKEHSNWVTPKAYTPKSPFNSKGLSINLSPMKGLSINSSPLKGLSINSSPLKGLNINSSPLKGLIVM

SEQ ID NO: 166444 - protein, 362 aa, Glycine max
  Coding DNA Sequence Number=SeqID_74759
  Homolog annotation: Hit_ID=Q6WAY6; Match level="QueryCoverage=94%, HitCoverage=60%, E-value=4e-38, Identity=32%"; Hit description =Putative uncharacterized protein
MGTNQTGKRFYQVKVKSPNTTSIKELGRLMEPLQMQAFRKTYGKILELTIAEVSIEAIASLTQYYDQPLRCFTFGDFQLVPTIEEFEEILGCPLGGRKPYLSSGIQQRFGPHKTDSERHSGPTTEVPRRQGEGYGQSRRLVPFMDVLALLIFGVVLFPNVDGLVDLAAIDAFLAYHHSKESPVVAVLADLFDTFDRRCEKSSARIICCLPALCVWLVSHLFQQDTRHPCPLLSHRSCTEKRRIDWDQLLAGIGGRTISWFPRWKEGKEGVLFSCGRYPNIPLVGTRGCINYNPALAIRQLGYPMRGAPTEESMSLFLVRDFGAQNSKTIQRIHKAWETPLRKDQELRGIRNGIIGGYHEWLK

SEQ ID NO: 166445 - protein, 209 aa, Glycine max
  Coding DNA Sequence Number=SeqID_74760
  Homolog annotation: Hit_ID=A5ATL8; Match level="QueryCoverage=34%, HitCoverage=58%, E-value=7e-19, Identity=68%"; Hit description =Putative uncharacterized protein
AVRIDPCNAVANALSIPPGEYRRTLPGLDMPRILLKERGAFGNADTGGAWLSSARATAGDKPEEGEDDVKSSCPLMPWATHAANSACMKPEIASKSPGQPYGGEFVPRALYTPPVTLWELAMPEVARTGKVAAGITSFFRRANACGELLFSPPSMSPHGGDMDGGEKRKERDGVSLAFGIAGPGGRPARRAISSVVERAPDNCVVVPGL

SEQ ID NO: 166446 - protein, 57 aa, Glycine max
  Coding DNA Sequence Number=SeqID_74761
MEENSPNFPSSPRHTPSKGPPMTEWSVQFVHQSKDALPKSRGESRISIRYYARWHTM

SEQ ID NO: 166447 - protein, 155 aa, Glycine max
  Coding DNA Sequence Number=SeqID_74762
MRGALTEEIIAPFIARGFNEANVKILQRIRKVWNRVEIKDKEFRGSSNGVIGDYHKWLKSRKQGITWLPKLKGLNGKEAEIPEESEEVQALKAKLERTRVVKEKLKVAVTRVRKECDELKNINMTTVEVLEWERKKGPKGRMEKEQVSGGFVGQQ

SEQ ID NO: 166448 - protein, 115 aa, Glycine max
  Coding DNA Sequence Number=SeqID_74763
  Subcellular localization annotation: CTP_CleavageSite=52; ConfidenceScore=5.35e-01
SLLYNKEKNKMKDCKNTSGEDVSFTSRISQSLTNSSQALKPAPASSSGGLVRARALSALMDRLAHIIEFWLRGGVVCARQGDLDSYCLIFLSESVVWTHVGYFLEDGITLHLRVE

SEQ ID NO: 166449 - protein, 91 aa, Glycine max
  Coding DNA Sequence Number=SeqID_74764
MPRAQNSTDTIVPILGKELWRHQDEQLLQRYLGFVTLALGNVLLPYNLIEAGLKLSLIRGIYGLSFGFNYVVTIMLFSLGLVLQEGSTDEA

SEQ ID NO: 166450 - protein, 145 aa, Glycine max
  Coding DNA Sequence Number=SeqID_74765
MGRREEQKCLTLLVSENHLKLVRKIVSVKNPSKPRRFRNDYVGDFGKIFKCSLSFVVCSSSFFGLQPAASLVTNAWGANAFPVRKYNSRTFHLKFVDNVFFRFFRCFPQINVGGDSARIPFLEDAPASHASPSRRRVGCDSWRLH

SEQ ID NO: 166451 - protein, 61 aa, Glycine max
  Coding DNA Sequence Number=SeqID_74766
MYPPLELIHKRCTLSCSQYNNPQVDVPSTCTTKDGEERHKRIQAISLSVLLAKGEENEKDE

SEQ ID NO: 166452 - protein, 26 aa, Glycine max
  Coding DNA Sequence Number=SeqID_74767
MHARDEMCLPSPWPWLTIGEVLDSRS

SEQ ID NO: 166453 - protein, 83 aa, Glycine max
  Coding DNA Sequence Number=SeqID_74768
MATPPSSPPPPLESATPSSPYTNWGGETLVVHVDPVTGKADGPHRKKLRTYLGIVARDKVDVTHDNWKKVSVAQKDLIREDIQ

SEQ ID NO: 166454 - protein, 29 aa, Glycine max
  Coding DNA Sequence Number=SeqID_74769
MAEEQMKVSETMAERHSKAVINNRLRMYE

SEQ ID NO: 166455 - protein, 121 aa, Glycine max
  Coding DNA Sequence Number=SeqID_74770
MKCLTIPVREEEDCEDVKLKPNDRSFRTYLSNEEIDANSQIDSSEDVSAKANTNGAALSADCRTSSGSDITLSMERNELVSEIGLLKKEAERSLDELTRMKNLKYEKEMVGTVLQSELEAL

SEQ ID NO: 166456 - protein, 82 aa, Glycine max
  Coding DNA Sequence Number=SeqID_74771
  Subcellular localization annotation: CTP_CleavageSite=28; ConfidenceScore=5.50e-01
MASPPASPPLPPPLDASASLSAVKRTCKASLLRSLSTRPPGADRPVVHVDPTTNKADGPHRKKLRTYLGIVARDKVDVTYEN

SEQ ID NO: 166457 - protein, 150 aa, Glycine max
  Coding DNA Sequence Number=SeqID_74772
MVAVVRVICFLQWVWIIPNNNKVLRWLFFCNWNLTGVKGLRDGYLKYNNVNYIVKKKKLEKELNKCTKILLRPCKSCVGDLEKSEAKLPCYPITFVHTKGGSVSNLMPPDALPSPGMSPIGEVIPLVKPPAVAASKQSRQQQERDAPRRH

SEQ ID NO: 166458 - protein, 117 aa, Glycine max
  Coding DNA Sequence Number=SeqID_74773
MSGPRVVRKAQGSRTKRRTSFGEEAEEVNGDGLLDGEHGFEERCERFRCSSEEEGSGEGDKSFVQDQRCAAAKAGLDAIREVAKEHPYPTQEVHPQAETQGPSRTQPVHQNPPQESR

SEQ ID NO: 166459 - protein, 156 aa, Glycine max
  Coding DNA Sequence Number=SeqID_74774
  Homolog annotation: Hit_ID=A5BAP9; Match level="QueryCoverage=50%, HitCoverage=9%, E-value=1e-14, Identity=50%"; Hit description =Putative uncharacterized protein
MTKYNKLLAKWERSNTLNLIAIKKTISKHLLSGLPKKAIVKEFLDALGKRYQGSENQVKGQHRNVGGPKPTIFKKSIILSTREKKPAIGDDFQVYLSEYACDIRDIVDPKIDQEVVSCPQSQIWKHVMNKEMQSMLVNGVWKLVELLQNFKAIDCK

SEQ ID NO: 166460 - protein, 128 aa, Glycine max
  Coding DNA Sequence Number=SeqID_74775
MLTDHLIRKQLQASLLRHQWRKTIEMPTSTIDADDARRWTLEEDEDGSARGRTMAGCKKNATKKKKNATKKNDFVGGKKKNARKKRLQGRKKTNAGKKKSAGCARRRERVAGERESDVFFLKLTQGHN

SEQ ID NO: 166461 - protein, 120 aa, Glycine max
  Coding DNA Sequence Number=SeqID_74776
MEVPLVITVHLGLVACFVILWKIGFQDTWTLVIFQQIPPLQSFIQYGLKVAKEVDCIHELYMVVYPYASIVDAIRYFMQFSWDLSFKHTLRQYNFVADSLAKKGAKCSFFTIPFVSHKTA

SEQ ID NO: 166462 - protein, 581 aa, Glycine max
  Coding DNA Sequence Number=SeqID_74777
  Gene Ontology: Mol. function=transcription initiation factor activity; Cellular component=transcription factor TFIID complex; Biological process=transcription initiation
  Homolog annotation: Hit_ID=A5ARH4; Match level="QueryCoverage=98%, HitCoverage=66%, E-value=1e-109, Identity=41%"; Hit description =Putative uncharacterized protein
DETMHSGVDVEAFQAALNRDIGGAGSTSQFSGSDAVLILYAAIIAAVLSQGSNNISSQSLSQWPTSNHDTQTDCQKQESKTAQQQEQPSSEVELKQHGSLAEQLQHVASQDINTPHLSQKQSQDECHQAPAVQVSLPNSQAIGIQNSGKDPVLNNEVVKNHNPSSESQYAKLQQMSNQQATVSEQPSSQGNRSTSKQVPFGMLLPILLPQLAKDRAMQLQTLFAKLKKEEIPKDSFVRLMKGIVGDQMLRLALAKVQVQPQIRPNQASAGQQHPMRMPTVGSGARQLNDPHALAQMHQRSMNAAVDQSRMGSSAGHTMESNARKSQELDVKLESQGLQPSQLTSSSSNTVGQEIERTSVHIQGLNKQQQQHLHFPSAYGNSGVNYNPFSGTTSSSTSSIKSQSHDSHMSQILHQSIGSNHHLSGSTHGLNVIGMPKLEQQNSFNDPKRLPGGSVSPAVNNTVSQQTKNAWQPSTNKEQNLGLMSSVSYVKKEPSDLSTEQQNRHSLSKLHGYSPVNSAQLEQGGASQGTVKDEFSRGQAPPSMPPTSTGLLPQSSASPSVMTQLDPSVSVSLRPTDVCDLV

SEQ ID NO: 166463 - protein, 774 aa, Glycine max
  Coding DNA Sequence Number=SeqID_74778
  Gene Ontology: Mol. function=identical protein binding; Cellular component=extracellular region; Biological process=negative regulation of catalytic activity
  Homolog annotation: Hit_ID=Q2HRK7; Match level="QueryCoverage=99%, HitCoverage=99%, E-value=0.0, Identity=80%"; Hit description =Protease-associated PA; Proteinase inhibitor I9, subtilisin propeptide
  Pfam annotation: Domain name=PA; Domain location=369-468; Score =112.8; E_value=1e-30; Accession=PF02225.13; Description=PA domain
  Pfam annotation: Domain name=Peptidase_S8; Domain location=124-609; Score=19.8; E_value=8e-08; Accession=PF00082.13; Description =Subtilase family
  Pfam annotation: Domain name=Subtilisin_N; Domain location=38-114; Score=85.4; E_value=1.8e-22; Accession=PF05922.7; Description =Subtilisin N-terminal Region
  Pfam module annotation: Pfam domain module=PA::Peptidase _S8::Subtilisin_N; Domain location=369-468::124-609::38-114
MKKPPIFEPLQIFLLLLIFYGSNTKAEKQTTHDHANKKTYIIHMDKSTMPLTFTDHLSWFDSSLKSASPSAEILYTYKHVAHGFSTRLTPEDADTLSKQPGILSVIPELKYKLHTTRTPSFLGLDKATTLLPASEQQSQVIIGVLDTGVWPELKSLDDTGLGPVPSTWKGQCEIGNNMNSSNCNRKLVGARFFSKGYEAALGPIDTTTESKSARDDDGHGSHTLTTAAGSVVPEASLFGLASGTARGMATQARVAVYKVCWLGGCFTSDIAAGIDKAIEDGVNVLSMSIGGSLMEYYRDIIAIGSFTATSHGILVSTSAGNGGPSQGSLSNVAPWITTVGAGTIDRDFPAYITLGTGKTYTGASLYRGKPLSDSPLPLVYAGNASNSSVGYLCLQDSLIPEKVSGKIVICERGGNPRVEKGLVVKLAGGAGMILANSEAYGEELVADSHLLPAASLGQKSSEILKNYVSSSPNPTAKIAFLGTHLQVQPSPVVAAFSSRGPNALTPKILKPDLIAPGVNILAGWTGAVGPTGLTVDSRHISFNIISGTSMSCPHVSGLAAILKGAHPQWSPAAIRSALMTTAYTSYKNGETIQDVSTGQPATPFDYGAGHVDPVAALDPGLVYDANVDDYLGFFCALNYSSFQIKLAARRDFTCDSKKVYRVEDFNYPSFAVPLETTSGIGGGSDAPKTVKYSRVLTNVGAPGTYKASVVSLGDLNVKIVVEPETLSFTELYEKKGYMVSFRYTSMPSGTTSFARLEWTDGKHRVGSPIAFSWT

SEQ ID NO: 166464 - protein, 260 aa, Glycine max
  Coding DNA Sequence Number=SeqID_74779
MADAELSPASMDRLEAALAKLILSQLNLATAASIPAAIISTPFMLTPRLMLTPPPMSTPLPMSTLSPTSTPPLMPPSIPMPTGPPCPAPVQPFLPPLLGPLPMPALYLPNLGLVRTAISFNKRINTIPLYDHATVSNDKPWKNKDMALFEMGHVSYETSMVVYKLQPVAFALCTTAKQGAIRRNRPWDPGIVFGSHSLKPQHLEDKVFLMGQRMLGSDKEPKTAAENIFTKPEARVQGEMQEVNKPKRKITKSSYFKDFV

SEQ ID NO: 166465 - protein, 95 aa, Glycine max
  Coding DNA Sequence Number=SeqID_74780
MVLLFLTNGILDHDNNGIDGENHVGCLNLGVKEPNVPSQRSLQNLGVGGDEARNDGMGIAKCIFPSSPAVVVYVDGSRVRVMWLVGGDKSKLLVI

SEQ ID NO: 166466 - protein, 341 aa, Glycine max
  Coding DNA Sequence Number=SeqID_74781
  Homolog annotation: Hit_ID=A7NU91; Match level="QueryCoverage=76%, HitCoverage=68%, E-value=3e-75, Identity=53%"; Hit description =Chromosome chr18 scaffold_1, whole genome shotgun sequence
  Pfam annotation: Domain name=F-box; Domain location=4-51; Score=45.3; E_value=2.2e-10; Accession=PF00646.24; Description=F-box domain
  Pfam annotation: Domain name=Kelch_2; Domain location=231-282; Score =30.2; E_value=7.7e-06; Accession=PF07646.6; Description=Kelch motif
  Pfam module annotation: Pfam domain module=F-box::Kelch_2; Domain location=4-51::231-282
MDPIIWSKLPPEILEYILSFLPLKTFLNLRSTCKGFWSLIFSPPFISKHCSPTASSPFSSFLLLSHPQFHRHFPLYDCTLGTWRNFSLSLSDSFHSFPSFSTLISSGGLFCLSDSTSCSLLVCNLLAKSSRKIQYPSFSLHLEHLTFVTTPTGYTIFVLFSEAASNCAFVYDSKVQTWKRFRGFAPVLGDNHQQQGVLFNGGLYFATPEPFSVVMFDLKSGRWERPVWELPSHHLTFVRLVSDGGGKLYLVGGVGSNGISRSIKLWELGGDGNYWVEVQSLPDLMCRKFVSVCYHNYEHVYCFWHEGMICICCYTWPEILYYLLSRRTWHWLPRCWDCVRS

SEQ ID NO: 166467 - protein, 77 aa, Glycine max
  Coding DNA Sequence Number=SeqID_74782
MESNGTLPSAPETNTIKSDSGNERAMQTTFNNKPYPTRPEMSKKKDSHLGCYYCVTATSIKGIKTSLCPSICCPFKS

SEQ ID NO: 166468 - protein, 392 aa, Glycine max
  Coding DNA Sequence Number=SeqID_74783
QLEWTSFIDVLALLVFEVVLFPNVDGLVDLAAMGAFLAYHHIKESLVVDVLANAYDTFDRRCEKSSVRIVCCTPAIYVSLVSHIFHHESRPVCPLQGHRMCAKKGKANWEQLLADVLAIRQLGYPMSGVPSEERIAPFIARGFSDPNAKMLQRVRKARNAVQRKDKELRGSSNGAEVPEESEEVQALKVKLERTRVVKEKFKKTTIRVRKEYDELRDGLYGAATTDSSFGGLKGTSPRSKSSLTEQLSRTKENMWAIIDQYKEKLNLAASHEQRLEDEHAKVSVLQEEREARESVIDSLHREAMMWMDRLTFTLNGSQDLPRLLAKAKVMANVYSAPEEADMEAMKDQMTSMMEAMKDPTHPSAINQANQPILDMVRQGGKVLGSTSGPFMG

SEQ ID NO: 166469 - protein, 144 aa, Glycine max
  Coding DNA Sequence Number=SeqID_74784
  Homolog annotation: Hit_ID=B0HC01; Match level="QueryCoverage=22%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTQGMYPPLFSLNLVDVPSTRTDPQEMYPLLFSVKPK

SEQ ID NO: 166470 - protein, 150 aa, Glycine max
  Coding DNA Sequence Number=SeqID_74785
MGSSQSPSLKKRFYQVKVKSLGVTSLKELGQLMGQLQQQALRKAYGKIWDLAMAEVSTEAIASFVQYYDQPLRCFTFGDFQLSPMEMFGSKSKSLGRQRSTLFSPFMTARKAQLSIYMTPSTEDVKRAVQGLFVVLWPSTYGWFSTFSAK

SEQ ID NO: 166471 - protein, 79 aa, Glycine max
  Coding DNA Sequence Number=SeqID_74786
MVMDMADTFGEDFGIHFNQWSSNIRAGFNHIHFKERFSEQNPCRPTLEGIQISSLDQRQKESLVDRLTELEIKSAVWPC

SEQ ID NO: 166472 - protein, 20 aa, Glycine max
  Coding DNA Sequence Number=SeqID_74787
MAGTPHKASSSIQEESDKDD

SEQ ID NO: 166473 - protein, 37 aa, Glycine max
  Coding DNA Sequence Number=SeqID_74788
MEGTVKEEEERAYPITAKASSNRLQPMVIDYNGLVLW

SEQ ID NO: 166474 - protein, 129 aa, Glycine max
  Coding DNA Sequence Number=SeqID_74789
MQRYIMIIHTFCQPEASEPVDTQRLMSSSAPFSSRDGESDDISRYLMVIRTFCQPEASELVDTQRLTSSSASLSSRNGQSDDMWRYLMVIRTICQPEASEPIDTQRLTSSSAPLSSRDDESNDMRRYIM

SEQ ID NO: 166475 - protein, 335 aa, Glycine max
  Coding DNA Sequence Number=SeqID_74790
  Gene Ontology: Cellular component=membrane
  Homolog annotation: Hit_ID=Q7D1Y6; Match level="QueryCoverage=82%, HitCoverage=99%, E-value=1e-124, Identity=83%"; Hit description =Putative uncharacterized protein
  Pfam annotation: Domain name=DUF6; Domain location=161-285; Score =43.9; E_value=5.7e-10; Accession=PF00892.11; Description=Integral membrane protein DUF6
  Pfam annotation: Domain name=DUF6; Domain location=20-143; Score =34.2; E_value=4.7e-07; Accession=PF00892.11; Description=Integral membrane protein DUF6
  Pfam module annotation: Pfam domain module=DUF6::DUF6; Domain location=161-285::20-143
MIKKLSPTGLGVAVMLLGMLLFALNDAMGKWLVSTYSQGQVILIRSAAALVILVPIVWRAGLSGLVKIERPGLQAARVFFSTAELFCFYFAVAALPLADVMTYWLAAPIYVAALSPFLLGEKVGWRRWTAIGIGFVGVLIALKPSSASLTSAALFSILGSAAFAFMMLSGRQLRNTPDTVLAFWQIIGAALAGIVAVLVTPSGWLPVQSGFDLAFLGLLGVVAMAAHVLVNRALKLADAATVAPLQYTLLLWAVIFGWLFFGDVPQTSIVVGAGLIVLSGLYIFFRENTLKRRRETAEDLAAQQGVRRGPAMICLARADETKVPGPSGESFTALS

SEQ ID NO: 166476 - protein, 130 aa, Glycine max
  Coding DNA Sequence Number=SeqID_74791
MKPPDVQEDHIFLKAFPHSLEGVAKDWLYYLAPRWPPTPSSLAPENDAIVIRGVHEVATNPSASSETKKLEGKLDALVNLVTQLALNQKSVPIARVCGLCSSADHHTDLCPSMQQPGAIEQPEGYAAGIL

SEQ ID NO: 166477 - protein, 152 aa, Glycine max
  Coding DNA Sequence Number=SeqID_74792
  Gene Ontology: Mol. function=protein serine/threonine kinase activity; Biological process=protein amino acid phosphorylation
  Homolog annotation: Hit_ID=A7P3Y4; Match level="QueryCoverage=59%, HitCoverage=10%, E-value=6e-19, Identity=54%"; Hit description =Chromosome chr1 scaffold_5, whole genome shotgun sequence
GHCKEVRACKVLKVVTFSPLVLAMCSQGASCSQGRDAEFWAEVTIIARMHHLNLVRLWGFYAEKGQRVLVYEHIPGGSLDKYLFRVNKYHNNNNLKEQSSMQAWHWPSFYNVVTGKTLALPNLIALQHIPLSPAGVIAKRPAPIALPNSCAA

SEQ ID NO: 166478 - protein, 54 aa, Glycine max
  Coding DNA Sequence Number=SeqID_74793
MKISPNCTRSSMSQHICYTVVDSYFNDVRPLEVERLKALHIQWAQFYLKVRNQS

SEQ ID NO: 166479 - protein, 109 aa, Glycine max
  Coding DNA Sequence Number=SeqID_74794
  Homolog annotation: Hit_ID=UPI0000ECBAF8; Match level="QueryCoverage =37%, HitCoverage=48%, E-value=1e-16, Identity=100%"; Hit description= UPI0000ECBAF8 related cluster
RKRKSAQYANRLSPRVGRFINAAGTTGFPTGKRAGAVGDGHRPILNSDMNGLVALPRMQAWHWPSFYNVVTGKTLALPNLIALQHIPLSPAGVIAKRPAPIALPNSCAA

SEQ ID NO: 166480 - protein, 146 aa, Glycine max
  Coding DNA Sequence Number=SeqID_74795
MSEGERNLPVRGRKATERELVARDAAERERESHACALRGRERESWWCAEREIALLRRKRERELVVCFYGRRNFNFFFFCTKPQDNGGEKVCGMTIICLRPALDLLFLNDKGHRLVSTCLSPNLQNLNDKGRRIYLCAFITRHAAPE

SEQ ID NO: 166481 - protein, 120 aa, Glycine max
  Coding DNA Sequence Number=SeqID_74796
MGMSGYINYNPMLAIRQLGYPMRGAPSEEIIMPFISRGFNEANAKILQKIYKAWNRVGRKDKELRGSSNGAEIPKESKEVQAFKGELEKTRVVKEKLKTAVTRVRKECDELKDINMTMVE

SEQ ID NO: 166482 - protein, 65 aa, Glycine max
  Coding DNA Sequence Number=SeqID_74797
MTGATAEWRRKRQRTRQFKEKMSLEEAHHHRRSWIRAWRKKEMNEGSEREEHEILCSKRALKSEF

SEQ ID NO: 166483 - protein, 172 aa, Glycine max
  Coding DNA Sequence Number=SeqID_74798
MHILLSYDKNRIVLGNGQMSGWIQRQRPIKVSSPGRAELAWVIAWVYAILTRMSAHVAQVIANAIYFFAGMPPTRHPLDPDKSNKALGFPALITGLCHSFEVPVTPSKVIQPPITRAFIEKYCTPRQAQGDAPQAADSPPPPHQADPAGSLGMERYLQHLVRQQAANHRGQV

SEQ ID NO: 166484 - protein, 243 aa, Glycine max
  Coding DNA Sequence Number=SeqID_74799
  Gene Ontology: Mol. function=serine-type endopeptidase activity; Biological process=proteolysis
  Homolog annotation: Hit_ID=A8GD50; Match level="QueryCoverage=77%, HitCoverage=27%, E-value=2e-98, Identity=90%"; Hit description =Oligopeptidase B
  Pfam annotation: Domain name=Peptidase_S9_N; Domain location=3-241; Score=-27.6; E_value=2.3e-10; Accession=PF02897.6; Description =Prolyl oligopeptidase, N-terminal beta-propeller domain
MMTPPKAEKRPYPITIHGDTRVDDYYWLRDDERADRQVLDYLQAENAYTDAMLKPQQALRETLYEEMVARIPQQEHSVPYVRHGYRYQTRYEPGNEYAISVRQPQAESERWEVLIDGNQRAENHEFYTLGGLDVSPDNQRLGVAEDFLSRRQYDIRFKNLADGSWADEVLENTSGSFEWANDSSTVYYRSAAGRADLRRAGRYLLRRAGEDHLRALYPDPPEQHHHLGDPAAGRRPCGRQAAA

SEQ ID NO: 166485 - protein, 28 aa, Glycine max
  Coding DNA Sequence Number=SeqID_74800
MSSEMAPKTCSLLASAPDHASSIKRCVN

SEQ ID NO: 166486 - protein, 34 aa, Glycine max
  Coding DNA Sequence Number=SeqID_74801
MEKGRRSANFENEGSGVIYARGRVYNTNDRSKLI

SEQ ID NO: 166487 - protein, 29 aa, Glycine max
  Coding DNA Sequence Number=SeqID_74802
MARYQRLTTTAVALPPVRDPHKVAPLPPV

SEQ ID NO: 166488 - protein, 189 aa, Glycine max
  Coding DNA Sequence Number=SeqID_74803
  Gene Ontology: Mol. function=potassium ion transmembrane transporter activity; Cellular component=integral to membrane; Biological process=potassium ion transport
  Homolog annotation: Hit_ID=A7Q2E3; Match level="QueryCoverage=86%, HitCoverage=20%, E-value=3e-62, Identity=73%"; Hit description =Chromosome chr1 scaffold_46, whole genome shotgun sequence
  Pfam annotation: Domain name=K_trans; Domain location=23-189; Score= -441.8; E_value=3.8e-05; Accession=PF02705.7; Description=K+ potassium transporter
MDLERAIVQNSDKRKESWKTVLTLAYQSLGVVYGEISTSPLYVYRNTFAEDIGHSETNEEIYGVLSLVFWTLTLVPLVKYVFIVLKADDNGEGGTFALYSLLCRHARVGLLPNCQLADEELSEYRRNDCGVAPERSLAFRLRSLLERYKVLQRILLVLALLGTCMVIGVGVLKPAISGDYEKFSFLFLI

SEQ ID NO: 166489 - protein, 134 aa, Glycine max
  Coding DNA Sequence Number=SeqID_74804
MKDTRGEWDDRVFDAKTKGVSSGAVSSGAVNIGEDVCPINTWGPFGCLGCTIKSNMVSEQALTLGPRLRFCCDKHPPFVVHAPSPISVGREGGVLEKYPSPTSAASILGGDRYGDEVPTWKKSDTSPLSSWKAS

SEQ ID NO: 166490 - protein, 305 aa, Glycine max
  Coding DNA Sequence Number=SeqID_74805
  Gene Ontology: Mol. function=mannosyl-oligosaccharide 1,2-alpha -mannosidase activity; Cellular component=membrane; Biological process=transport
  Homolog annotation: Hit_ID=A7QMQ1; Match level="QueryCoverage=74%, HitCoverage=24%, E-value=1e-91, Identity=78%"; Hit description =Chromosome undetermined scaffold_127, whole genome shotgun sequence
  Pfam annotation: Domain name=Syja_N; Domain location=1-192; Score =90.9; E_value=4.1e-24; Accession=PF02383.9; Description=SacI homology domain
MASFSLHENAPPVILMIHAGAISHAHVGSASVLVGDIDDALDSEKRYLKRGVNDRGRVANDVETEQIVLDEESGSCKGKMSSVVQMRGSIPLFWSQEASRFSPKPDIILQRYDPTYQATKLHFEDLAKRYGNPIIVLNLIKTVEKRPREMMLRREFANDVGYLNQILPVENHLRFIHWDFHKFAKSKSANVLAVLGAIASEALDLTGFYYSGKPSIIKRANKSNQTSTGRDTSLRDLRASSVDLVRIGNSNEMINSVVNQDKETDMNLNIAPSLSKKRVNGSVIHSPSEFDAASMAFEIPLLTYG

SEQ ID NO: 166491 - protein, 434 aa, Glycine max
  Coding DNA Sequence Number=SeqID_74806
MSAATPTTMSTTTIEATIGTGLHSQPSAHHRLRFVDNGVTVIKLLAVCSTFAALNAGHKPNLLHLHGTYQPQPHIAQELLNFPDENLTVKQIQQFLGINKKEKRIIASGLFKEAEKHYPITFKEALAMPPDPQILRLKDWFSKYDFSVKHIQRKNNLILDFLSRPNNKIVKVITFTHSFPLIFMAKPLSEIAKTIKVFPLRLITHTPAHILEYAKSHYSHFLHETMRFKYTPAQIFDPEIPFGVQYSILIAMKPLMTYNMLTDPCKDEYLLWTMLEWFSPLAWWRMKLKQILDIERQRGISEDHIGKLVGETSLCLGKKLKFRKLLKHIPWKKVMATSWRDISVKSTITHTDLWIQIYQIYVPDPEFQEVEDLVDDYSALEQEWEDYNAQLMEELLHKKRYPYHHPVYGSLTRSKDKDDRNPILVIVCHMSVVV

SEQ ID NO: 166492 - protein, 319 aa, Glycine max
  Coding DNA Sequence Number=SeqID_74807
  Gene Ontology: Mol. function=catalytic activity; Cellular component =cytoplasm; Biological process=metabolic process
  Homolog annotation: Hit_ID=Q8S4Q4; Match level="QueryCoverage=98%, HitCoverage=68%, E-value=1e-160, Identity=93%"; Hit description =Nodulin 6l
  Pfam annotation: Domain name=Amidohydro_2; Domain location=117-319; Score=-26.0; E_value=0.054; Accession=PF04909.5; Description =Amidohydrolase
MDFSELRKAVEEVELVDGHSHNIVALNSTSISGFVQAFTVGAFVDADAIAFAQTSLSFKRSLRDVAELYGTEVSLQGVEEYRKASGIESISSTCLKAAKFSAILIDDGIEMDKKHDMQWHKNFTPFVGRILRTERVAEQILEQGLPNGSSWTIDSFTEAYVSKLDESKKKSINVLALFLSITVTVAKEIHALKSIAAYYGGLEINLNVTKTDAEESLKEVLTNTTKPIFLLKYKNYKNLVDYLFLQSLEIALSYDLPMQIHTGFGDRLLDLRKTNPLHLRSVLEDKRYSKCRFVLLHASHPYSKEASYLASVYSQANIL

SEQ ID NO: 166493 - protein, 69 aa, Glycine max
  Coding DNA Sequence Number=SeqID_74808
  Subcellular localization annotation: CTP_CleavageSite=28; ConfidenceScore=5.38e-01
MPLMLNKLGLSESISLSLRQFSCSKFCSCAKRVHSLSMASRKRKTTTSRPQQPYDTTKFISEGAWERYE

SEQ ID NO: 166494 - protein, 133 aa, Glycine max
  Coding DNA Sequence Number=SeqID_74809
MAASDQAILHDRSHVPTKKSLLELSLQDALLAQNKLLAKQLEILTETLIMQVGGCSIYGGAHESGYCIPLEYAAKEVDYMGNQHRPGFNVDGFLGYQQGSNFNQNQGQWRSHPRNQFSKDQGGSSKMPQNQRA

SEQ ID NO: 166495 - protein, 98 aa, Glycine max
  Coding DNA Sequence Number=SeqID_74810
MEVGQNSRMAETKGGIPTGGGTLESCILSLTTTSFIKIWLGSWRWDMKWRRNLFDHENDLAVDFMEEITSIPIQRHVKDTMLWKAEPSGGGGSSLLQL

SEQ ID NO: 166496 - protein, 160 aa, Glycine max
  Coding DNA Sequence Number=SeqID_74811
  Gene Ontology: Mol. function=triose-phosphate isomerase activity; Cellular component=chloroplast; Biological process=reductive pentose- phosphate cycle
  Homolog annotation: Hit_ID=Q9M4S8; Match level="QueryCoverage=93%, HitCoverage=47%, E-value=3e-71, Identity=87%"; Hit description =Triosephosphate isomerase, chloroplast precursor
  Pfam annotation: Domain name=TIM; Domain location=1-150; Score=130.4; E_value=5.3e-36; Accession=PF00121.9; Description=Triosephosphate isomerase
MYNILTEDCKLQFIGKKAVYALSEGLGVIACIGELLQEREAGKTFDVCFQQLKAFADVVPSWDNIVIAYEPVWAIGTGKVATPEQAQEVHAAVRDWLKKNVSAEVSSKTRIIYGGSVNASNSAELAKQEDIDGFLVGGASLKGPEFATIINSVTSKKVAA

SEQ ID NO: 166497 - protein, 595 aa, Glycine max
  Coding DNA Sequence Number=SeqID_74812
  Gene Ontology: Mol. function=solute:hydrogen antiporter activity; Cellular component=integral to membrane; Biological process =regulation of pH
  Homolog annotation: Hit_ID=A7QFG5; Match level="QueryCoverage=69%, HitCoverage=78%, E-value=1e-39, Identity=31%"; Hit description =Chromosome chr8 scaffold_88, whole genome shotgun sequence
  Pfam annotation: Domain name=p450; Domain location=205-563; Score= -214.2; E_value=0.098; Accession=PF00067.13; Description=Cytochrome P450
MLGNKNILGQALFPVKGVVVVEKVASFGLMFFFFICCVKMNISTLMKIEKLAITVAISVFALTLVIPTGLAILLRKYATMDRSLAQALPFMALSQALIVFISIAMLLKHVKFLNTDIGRLTMSAAMFVDIAGFTFTVIIFVALQNQSGSFLTLAGLLQFIVARRDSKIGVTTLVIVKLQGRPRPILVDNQNQPHHDLRSMSCNASHIDNALRQYGQQNERCVSVQSFTSISTFETMYGDICRISLDSGSNILILLFHKRWVSDDTVEISHRTIQTMNINVLQTAPCLVGILVDKSMFNPSPSLLMARASFYVAVFFIGGQDVMETLAYATRMGRHQCVYVTVVRFLLFGEENSKDRKRDGNLIDEYRYYKARNGRFQILEELEKDEIDMSTCITTLIDYFDLVMVGNEHPESYNREIKSIGSRNSYGNDLLGILLDEMKKEGATFNVQLVMDECKTFFFVGHETTALLLTWTTMLLASNPYWQDKVRLEVKELFKGEIPSVDQLSKLTLGHDEWSECEELGVIGDMLPSPNFVTKASLLVVQQQRIRGREMLGVSEKDVASCVTGNPIDDCWKCDPDWANNRQRLADGAIGFGQN

SEQ ID NO: 166498 - protein, 186 aa, Glycine max
  Coding DNA Sequence Number=SeqID_74813
  Homolog annotation: Hit_ID=A7QJF2; Match level="QueryCoverage=97%, HitCoverage=38%, E-value=2e-53, Identity=58%"; Hit description =Chromosome chr8 scaffold_106, whole genome shotgun sequence
MDEAKRMEEGLKTTYNDYHKGELKHEIERTNGNGDSIEHDKDARITQEGESVQQIVEQEQPLLMVLEDDADAGGAYPRIDHSPWNGCTLADFVMPFFLFVVGVAIALALKRIPKVKYAVKNIILRTLKLLFWGILLQGGYSHAPDDLSYGVDMRFIRWCGILQRIALVYCAVALIETYTTKLRPLP

SEQ ID NO: 166499 - protein, 99 aa, Glycine max
  Coding DNA Sequence Number=SeqID_74814
MTIKPPSCGRCDHHNPNIVIVTSIPSPQRRVCTSLPQICGPNAVACLHHHYITICDLDSVMHAVLVGAGGGVTQRRWVGYLTGWSCGGQGCGDDDMREF

SEQ ID NO: 166500 - protein, 125 aa, Glycine max
  Coding DNA Sequence Number=SeqID_74815
MASELSTDTTKTSTSSDSSSATSKDIIEVPSFYHRQWAPEYPKFVNLRYDGTIYQIRLRQHQAKVYYAEGLKEFRKDLSIFESVMIKFLACNNKSMFDLYFVPSLECHTCGRSEVMSRQQTYLDN

SEQ ID NO: 166501 - protein, 124 aa, Glycine max
  Coding DNA Sequence Number=SeqID_74816
MSFEKDGKSIVLVRNSNKNSTGSKHAHTHKYDMVQQFYNIVIVKEILMGVVKRREKYLDSSGLEYASQKKEGGLGSNVDLWTWRSGSHKSYPVCDIDIETCIGVGHVLVLNDDNMHRLLQKGGF

SEQ ID NO: 166502 - protein, 38 aa, Glycine max
  Coding DNA Sequence Number=SeqID_74817
MASIVVAICSFMTFMSAFICSCTSSISLITLTLARVRT

SEQ ID NO: 166503 - protein, 140 aa, Glycine max
  Coding DNA Sequence Number=SeqID_74818
MSPPPLEPHNHSQTHIMLSRWLPLQAQFSAILHTAKLSKLSGTWTFLSLEISKHARASRISQTTSPFLISGLRWPCWCLFFLVLSGWLAEQAKWLSERMKISTSQTCLINLKGIGKEDWCYPLKNLSQEARGQPPYELLD

SEQ ID NO: 166504 - protein, 152 aa, Glycine max
  Coding DNA Sequence Number=SeqID_74819
  Pfam annotation: Domain name=G-patch; Domain location=8-52; Score =6.5; E_value=0.031; Accession=PF01585.14; Description=G-patch domain
MRPRISVAAMMVARVMLGHDYEPEMGLAKNNDGVANLVDIKENRGKFGLGYEPTWTDVRKSIVERRNRGASLQLRPQPREVPPCHISKSFVSAGLRHEEKVAVIYDGVPQERSDWVWPCLPDFQLGNWQVVEQPEVSMAGTCNALVLLYSWA

SEQ ID NO: 166505 - protein, 204 aa, Glycine max
  Coding DNA Sequence Number=SeqID_74820
NLRSSALKCLTETCAPGYGASSFLLSVPGPPPNIGGRPTVRAQPEREAITQLLCIPGQDFTRAAAKRRVRVMRTNMTTLTQIWMTLLLSNIPPDDHNVDLPPMEVSVGLCRHDIGITPTRHLGDPEKSNRALGFPALVTGLCQSYRVPIPPASSCHRDIGITPVRHSVDPEKSNRVLGFPALIMGLCQFYGVPVTPQQGHQAPY

SEQ ID NO: 166506 - protein, 97 aa, Glycine max
  Coding DNA Sequence Number=SeqID_74821
  Subcellular localization annotation: CTP_CleavageSite=83; ConfidenceScore=5.19e-01
MPEPEAFVSTTKGMLKSGRASTGAVEMAVFNCSKAAMASGVHRKGVVLMGRPMKIASTFFGTALTPSPETMCPKYLMQSYPARASDKRLQEDWAKDA

SEQ ID NO: 166507 - protein, 78 aa, Glycine max
  Coding DNA Sequence Number=SeqID_74822
MTMSRDIDGWIGSIAPQEGASMEHATRGTARRTRQQQGSAPDAGASGSALLLGATGSAQRVGATGSAPDAGTTQACIF

SEQ ID NO: 166508 - protein, 22 aa, Glycine max
  Coding DNA Sequence Number=SeqID_74823
CLAPIIRQFVKFRDMPEIKRKY

SEQ ID NO: 166509 - protein, 183 aa, Glycine max
  Coding DNA Sequence Number=SeqID_74824
MSCLAITTPISLSLSAIWCMVPTRYPLDPDKSNRALGFPALIPGLCQSYGGLVTPSKVIRPPITRAFIEKYCMLRRAQGDAHQAAGAPPPPRQADPAGPLGVERYLQHLVRQQAANHRGQGQGSSPFACPTPEQFGAEVTRPRDWPDAKAGEKPAGSPGELDESHMDEDMIDLLGFLGGSGAT

SEQ ID NO: 166510 - protein, 52 aa, Glycine max
  Coding DNA Sequence Number=SeqID_74825
GLRDRGSLAVQHSKHKGRVVLVWFRTCKGLLQDSGTLKRVAGRRHKGVAEPV

SEQ ID NO: 166511 - protein, 200 aa, Glycine max
  Coding DNA Sequence Number=SeqID_74826
MSNHKSTESALKNLEIQVGQLAKQIADKLSNSFAANTEKNPKAEFKDVMTRSKRFMEAEEEESIVHKEKTAEKKGTDGKKNEETGNNHALQRSFTSNATLLQILEGYILPPKHKDPGSVTIPCSIGEVTVTMSNHKRTESTLKNLEVHVGQLAKQIADKSSNSFVANTEKDPKEECKASVGLKKKVVEEKGTDGKENDER

SEQ ID NO: 166512 - protein, 86 aa, Glycine max
  Coding DNA Sequence Number=SeqID_74827
MMTKWMNKSSEIKEHPSQENLEQVKEFKNQEEFKTQEQSLQQESRFKISRIEIKIQDLRDSRSQESRSRFKTQDSRMKKRLNQDKY

SEQ ID NO: 166513 - protein, 141 aa, Glycine max
  Coding DNA Sequence Number=SeqID_74828
  Homolog annotation: Hit_ID=A6FJQ2; Match level="QueryCoverage=26%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPQAGLVADLGTTFVVDWVVGPLMVVFHHGDAAEDKGEEGRGGAIH

SEQ ID NO: 166514 - protein, 723 aa, Glycine max
  Coding DNA Sequence Number=SeqID_74829
  Gene Ontology: Mol. function=transferase activity; Biological process= D-ribose metabolic process
  Homolog annotation: Hit_ID=A7MRP8; Match level="QueryCoverage=30%, HitCoverage=87%, E-value=1e-49, Identity=48%"; Hit description =Putative uncharacterized protein
  Pfam annotation: Domain name=Metallophos; Domain location=441-630; Score=57.2; E_value=5.5e-14; Accession=PF00149.19; Description =Calcineurin-like phosphoesterase
KLAEYGVKSVLENAHGDNGWCLALVEPDGERTFLSVSGVENQWDAALLRTLPQPAQRWIYLSGYQLTSKSGEVLIDWLEQQAQPYQLLVDFGPRLADIGEAQFARIMALQPLITVNRQEAELLWHERLRESEPFDAHQLMARWQQQFGGAMVLRLDSEGAGYIDAEAQGWVPALATTVVDTIGAGDSHAGGLLAGLASGWSLAESVALGNAVASYVVSRRGGDLADAVLQRIALCVECQLLNHQHRHIGGQGNLLLQGFVRHTRTDPALGFHRQDLLAMKIVIQRNTNLIGIGNVARRYPRLFNRDRLAVNIANTFQQIDIAARAQPQLFGDLCATGNFAFIDPHDLRAVAAGTKHDALFFQLVHGFTHGDARNVQRLAELALARQDLLVHQRAIAHCLFNRTGKAFIQRRAALYRQRGGQPRQQRIVVSHSGQGTHSDIMLIAQISDIHAAPDNDHLLRLARALAWLTHVQPDALVLTGDLVDGEWRQGYWQIAEQLRQQHYPAFILPGNADDRRLMQTTWHENHWAKNTPADALHFVQDMGGLRMLGLDSTVNKQNFGSVGDHLEWLERQLSNTPALPALLFLHHPVIASGIPTLDESMCRGLDKLESTLRRSRVRILAIAAGHVHRPAAGMFAGVPAYICGSICPANPLWFGSQRVPPANGRVLLATARCASTRYRKPASERDRRPAWPHAESRGSDEVFQPSDEIRRLNRNNATYPEKN

SEQ ID NO: 166515 - protein, 392 aa, Glycine max
  Coding DNA Sequence Number=SeqID_74830
  Gene Ontology: Mol. function=pyridoxal phosphate binding; Cellular component=cytosol; Biological process=viral envelope fusion with host membrane
  Homolog annotation: Hit_ID=A9IJZ0; Match level="QueryCoverage=99%, HitCoverage=87%, E-value=1e-143, Identity=64%"; Hit description =Putative aminotransferase
  Pfam annotation: Domain name=Aminotran_3; Domain location=15-367; Score=380.2; E_value=3.3e-111; Accession=PF00202.12; Description =Aminotransferase class-III
MSRIIHRSLRSVPAVATRAHGAYIFDAQGKQYLDACGGAAVSCLGHAHPDVLAAMHRQIDQLAYAHTSFFTSDTVEQLAEQLTRTAPGDLNYAYFVSGGSEAVETALKLARQYFVEIEQPARTRFIARKQSYHGNTLGALAVGGNEWRRRQFAPLLIDVIRVSACNEYRDRRADETQQQYTQRLLSELEQAIVDAGPETIIGFCAETVVGATSGATPPTPGYLQGVRRLCDKYGILFIADEVMCGMGRTGTLHAFEQDGVVPDLVTIAKGLGGGYQPIGAVLASEKIVSALQAGSGLFQHGHTYICHATAAAAALAVQQVIERDHLLEAVQQQGAYLHKALRDVLGELPHVGDTRGRGLFAGVELVRDKATKSPFDPAVKLHAAIKANCMAR

SEQ ID NO: 166516 - protein, 84 aa, Glycine max
  Coding DNA Sequence Number=SeqID_74831
MTKARQKGVRKFDFGNLPVEDRRTIKERLKIFAKSPTKTLRTRKIGEELASQLAQASSARPGELGCSSRSNRLLEKHPGRPKWA

SEQ ID NO: 166517 - protein, 70 aa, Glycine max
  Coding DNA Sequence Number=SeqID_74832
MLNGMPQGSSTISTRCVRVVSSEKWRLRNLGWGFVVDLGMAFVDNWVVGKEEVCYWLSNDIVGLVGNLAV

SEQ ID NO: 166518 - protein, 383 aa, Glycine max
  Coding DNA Sequence Number=SeqID_74833
  Gene Ontology: Mol. function=DNA-directed DNA polymerase activity; Cellular component=cytoplasm; Biological process=DNA replication
  Homolog annotation: Hit_ID=Q1H1X2; Match level="QueryCoverage=93%, HitCoverage=30%, E-value=1e-133, Identity=66%"; Hit description=DNA polymerase III, alpha subunit
  Pfam annotation: Domain name=DNA_pol3_alpha; Domain location=251-383; Score=-287.0; E_value=0.0011; Accession=PF07733.3; Description =Bacterial DNA polymerase III alpha su
  Pfam annotation: Domain name=PHP; Domain location=14-229; Score =135.8; E_value=1.2e-37; Accession=PF02811.10; Description=PHP domain
  Pfam annotation: Domain name=Phage_term_smal; Domain location=93-211; Score=-49.8; E_value=0.042; Accession=PF05944.3; Description=Phage small terminase subunit
  Pfam module annotation: Pfam domain module=DNA_pol3_alpha::PHP::Phage_ term_smal; Domain location=251-383::14-229::93-211
MEALETPTLQPAFIHLRCHSEYSIVDGTVRIDDYVKAAKSDAMPAIALTDLANLFGAVKFYKAARGKGLKPVLGCDVWVENTIQRDQPHRLLLLVQNQQGYRNLCELLSRAYLENQYRERAEIKPEWLLEKNAGLLMLSGFAAGDVGQALQAGNQALALQYAGQWAKTFAGRYYLEVQRVHEAASAEAYTQEQLIQQTVLLAQQLDLPIVATHPVQFQTPDDFMAHEARTCIAEGYVLADNRRPRRFLASQYVKTQAEMQALFADMPLALQNSVEIAKRCNLTLTLGKNYLPDFPTPNGESLDAYLVDQSKAGLEHRLAYLYPDEQQREAKRAEYEERLQFECNIIVQMGFPGYFLIVADFINWAKTTVCLLALAGVPVLAPW

SEQ ID NO: 166519 - protein, 140 aa, Glycine max
  Coding DNA Sequence Number=SeqID_74834
MAKYDAELVMEFYVNAWPTKEGVKDKANAVNSVRGGARPWGLFPKHGRETGITPPRHLVDPEKSNRALGFSALVTGLCQFYGVPDLNPFPWHTPEQFGATVAWPGDRPSVQTGAGSVGTSRDGDGAQDDDDIADGMDFFL

SEQ ID NO: 166520 - protein, 51 aa, Glycine max
  Coding DNA Sequence Number=SeqID_74835
MEAPEAHNISRRAEIEQRKLLSNSNGHNFSLGGPIQAHNISRRSKLSNGSS

SEQ ID NO: 166521 - protein, 282 aa, Glycine max
  Coding DNA Sequence Number=SeqID_74836
  Homolog annotation: Hit_ID=A4W8P5; Match level="QueryCoverage=83%, HitCoverage=73%, E-value=1e-111, Identity=82%"; Hit description =Putative uncharacterized protein
  Pfam annotation: Domain name=DUF535; Domain location=27-277; Score =83.3; E_value=7.8e-22; Accession=PF04393.4; Description=Protein of unknown function (DUF535)
  Subcellular localization annotation: CTP_CleavageSite=70; ConfidenceScore=5.57e-01
MSSIVDTPFSNLPQPKSGWQLFKNLAFGTLTPGLAWQNPAYRRKFMLRSLATPISTARLLTSLAKQPRLMQMLQVQPGLPCRLHRPWLTVKMDRQHALESLNWHYQTLSRQLPATLLAGYLSKPGYTLLTLTGKEEQQFTVRLCADAFLDKEGEATLAFCDRHNTVLTEMTFTLCQFAGKTTLFIGGLQGAKAHVPHELIQGATKACHGLFPKRLLLEAAMTLGTAFPVEQIVAVIFGSRSAVKNRITVTSCCRLPCRVNRWKRSRAKSAPSIAAVMNCWIA

SEQ ID NO: 166522 - protein, 130 aa, Glycine max
  Coding DNA Sequence Number=SeqID_74837
  Subcellular localization annotation: CTP_CleavageSite=34; ConfidenceScore=5.26e-01
MWVQAIGLFAQATCAPEFGLPRSFSQRLLVLHVGGGAVKQRVKFPTSRVQSFWMTGPLDESISCFLIKVGPWVLVPNTFRGLYVLAIRGLHILACRGLHALAFRGLRVLIFSVLHIHSLGEYKGPLPLDA

SEQ ID NO: 166523 - protein, 41 aa, Glycine max
  Coding DNA Sequence Number=SeqID_74838
MDGQDSLPATGGTGRHGLIGNMGDRRIIIRRDDEVETKGSM

SEQ ID NO: 166524 - protein, 87 aa, Glycine max
  Coding DNA Sequence Number=SeqID_74839
MSQNMFGMGKKIGNYISDELSPRIKGKNKFQSKFFLFFDNPCFDRKMEAGNTYVAHEMRRVYYYSPRHLCIVRYTCGWFTINRSNKS

SEQ ID NO: 166525 - protein, 180 aa, Glycine max
  Coding DNA Sequence Number=SeqID_74840
  Gene Ontology: Mol. function=mismatched DNA binding; Cellular component=intracellular; Biological process=mismatch repair
  Homolog annotation: Hit_ID=Q1XBQ8; Match level="QueryCoverage=49%, HitCoverage=7%, E-value=4e-42, Identity=95%"; Hit description=DNA mismatch repair protein
  Pfam annotation: Domain name=MutS_V; Domain location=1-128; Score= -165.1; E_value=0.005; Accession=PF00488.12; Description=MutS domain V
MKISDLLPYWFHIAEGVVCNDVDMQSLFLLTGPNGGGKSSLLRSICAAALLGICGLMVPAESALIPYFDSITLHMKSYDSPVDKKSSFQRLFKIGAKGKNEIIENNSNSIKYTSKILACQFESLLINQLFGQGFQLSNIANESEILRIEEAIAIQGNSSFEERAIVLYKIFSEESKTERG

SEQ ID NO: 166526 - protein, 374 aa, Glycine max
  Coding DNA Sequence Number=SeqID_74841
MSSFLSDSTTGLGGSDSRGSIEQLIMDREAISIGGSSFEDTRRGPRAELVGALLSFAEGHDLLRILGSQSHVSVGSPLSILDVAGYEWVRDNVLKYKSCLTLVASVTGLQCEVKLANPEDSCPKCHSTLDRFSVCFVGALECGPFPAPPKIRPSYQISNLDGCAPKSVREFSEELVICLSQIGQGGRGHVVRPTSGVLCIESFDEGVKAVYGPRWKSIALGIQMLVWIYCPIISLEVEWLSPQGVAYALGVRFPLRAFRVFVSTIAVGRGWESVRGVSYLRPDQVLTMDGCERIDKRPWGYIIYGQVEDTSTWVVVTENKRWYISCGSVLVEGTSTRLFKENKGGYIPCGSLLVKDFTRLKRNLKDRRSLGDWM

SEQ ID NO: 166527 - protein, 216 aa, Glycine max
  Coding DNA Sequence Number=SeqID_74842
  Gene Ontology: Mol. function=protein serine/threonine kinase activity; Cellular component=cytoplasm; Biological process=protein amino acid phosphorylation
  Homolog annotation: Hit_ID=A7P9D9; Match level="QueryCoverage=62%, HitCoverage=37%, E-value=9e-68, Identity=91%"; Hit description =Chromosome chr3 scaffold_8, whole genome shotgun sequence
  Pfam annotation: Domain name=Pkinase; Domain location=23-205; Score =7.4; E_value=4.5e-09; Accession=PF00069.16; Description=Protein kinase domain
  Pfam annotation: Domain name=Pkinase_Tyr; Domain location=23-198; Score=-123.1; E_value=7.2e-05; Accession=PF07714.8; Description =Protein tyrosine kinase
  Pfam module annotation: Pfam domain module=Pkinase::Pkinase_Tyr; Domain location=23-205::23-198
MDRAALTVGPGMDMPIMHDSDRYDLVRDIGSGNFGVARLMQDKQTKELVAVKYIERGDKIDENVKREIINHRSLRHPNIVRFKEVILTPTHLAIVMEYASGGELFEKICNAGRFTEDEARFFFQQLISGVSYCHAMSSYNMSLHEASMSSGLEAGKHFAGWKLGTSFKDMRFWVLQDLDCDDGNELLLKLLKDCFGNLGYWKRHISTRLLMVNFII

SEQ ID NO: 166528 - protein, 68 aa, Glycine max
  Coding DNA Sequence Number=SeqID_74843
MEGEASPPRECILAASIYSLGHRLSLEVLKVVVALTIWAQRASTAKRSFSALSAQRMTGAKLKSTNSC

SEQ ID NO: 166529 - protein, 258 aa, Glycine max
  Coding DNA Sequence Number=SeqID_74844
  Gene Ontology: Mol. function=DNA binding; Cellular component=nucleus; Biological process=regulation of transcription
  Homolog annotation: Hit_ID=A5BM31; Match level="QueryCoverage=31%, HitCoverage=17%, E-value=5e-27, Identity=73%"; Hit description =Putative uncharacterized protein
MMLVAMPLLKCFIRLSRQDMEMELREMGALKNMGWEWNFKWRRNLFDNEIDMAASFLGGVEGTQIQINRRDEWTWLAETSGEYSTKSAYDEMWGADIEGNQLQELKDIWKVEEDAAHLFLHCDKILPLWWECMSWVNILGAIPQHRRQHFSQHVKALGRGGQDNRWKCWWMALTCYLEEIKHHYEVFVEDVNQIESGCVPLPSYNSSTEGSTSHASDEGASKKGGHSWNSNNECNHGTKASRSDQERRKGIACTEDEH

SEQ ID NO: 166530 - protein, 173 aa, Glycine max
  Coding DNA Sequence Number=SeqID_74845
MGGQQRPYDNFQQKGFQNIHGNYNQAGDNKPQQRQNLWDHIAKLEESLTKLTEVIITNHKNREAIIKSMETQIGQLAKQFQTSLSGFSATIKENPKGHCKAIISTLECDVGGEEEEVEESTMLEEEMKAQANPSTQGMQSSLNPPLFDFSKLSIHKQGDNERMAKFEKYMEML

SEQ ID NO: 166531 - protein, 138 aa, Glycine max
  Coding DNA Sequence Number=SeqID_74846
  Homolog annotation: Hit_ID=Q0ZCD0; Match level="QueryCoverage=51%, HitCoverage=5%, E-value=4e-07, Identity=36%"; Hit description =Integrase
MNQKSASAPVARVCGLCSSADHRTDLCPSLQQYGVNEQPEAYAANIYNRPPQQQNQQQQNNYDLSSNRYNPGWRNHPNLRWASPPQQQQPQQQQQQQQRQQATEAPSQPSLEELVRQMTIQNMQFQQETRASIQSLKN

SEQ ID NO: 166532 - protein, 221 aa, Glycine max
  Coding DNA Sequence Number=SeqID_74847
MRPTYEFKEIWVGYRSGLSGGSRGGVLGGLGMGILWVVGSSSSAMRRKTLEAHRCPMWNFSSQLKQRPRSLREAISSGDKRFKASGWGWEGVGKRGGRGIEDIGDAYPGTSLLASERGRLPTPESLVDGPAPPCVSPGHRASLGELKQRTDGIIVLRWGKASVQGLKENGPGGGGNGVGMDGVGDRAGETRWSSLLIFRVIALTDSPRYNCWLVRRMRASS

SEQ ID NO: 166533 - protein, 260 aa, Glycine max
  Coding DNA Sequence Number=SeqID_74848
MVEVLNAPLAENAFGRFQMELPLLQGPENAFQMIDVGLEITIAEWHHDIFVVALVCSESGLGNVMLLHANLMKALRECAVIHAEPPRPILFLDKEHRTRVWATAGAYELTTKHVVDLPFNLSLLGIGVSIGVDVNWFRIGLEVDGVVCWSGRREGCRSLKKVGVFGEEGTKGRGCGRLKVDASSIGACRPRIFFINGFLYFLEDEWKRNGERKRERRLHFNEKMSLEEAHHHRRPWIRAWRKKEMNEGRGREEHEILCSK

SEQ ID NO: 166534 - protein, 102 aa, Glycine max
  Coding DNA Sequence Number=SeqID_74849
GLVRARALSALMDRLAHISEFRLSACLSRIADELKRCFYKEEAPEPEIVAQALEVEMKPLSPFEAILLRKIDQIYSWKLKQNEAHNEYMENIVRGWKTLKRS

SEQ ID NO: 166535 - protein, 205 aa, Glycine max
  Coding DNA Sequence Number=SeqID_74850
  Subcellular localization annotation: CTP_CleavageSite=81; ConfidenceScore=5.46e-01
MALVTGPFLGRIASCWNVDDLTVNFRGVRKVKARLVDTPSSSAPPAPSTSATPTPTQPTSATPAPVAQDSQRFEAMLQSVRVEMRPDEAVLPEPIVPVIQETVEAGESQLRQEATTLKRTSQTPEGPLSPGMDLSFAQQVVDPSTPIQERQADPPTPIMEMPEDPTTPVLRLSSTPLATPILHLINEEDMQDQDTQGTQDQSQEF

SEQ ID NO: 166536 - protein, 111 aa, Glycine max
  Coding DNA Sequence Number=SeqID_74851
MKRHNLHKHLANLQDGSIDVTVVKEFYANLYSPEDQSPKQVRVRGHLIKISADSLNTILETPVVLEEGETLPTYSRFTRMRIDPQEFAARLYIPDVQCLLLQQPDSHFPHL

SEQ ID NO: 166537 - protein, 256 aa, Glycine max
  Coding DNA Sequence Number=SeqID_74852
  Subcellular localization annotation: CTP_CleavageSite=25; ConfidenceScore=5.00e-01
MENYAQTPFSLSPSLIQFCICIVFTASTIQKMHSVFCIFSRKRNELTQRACRAQRAHLYLLHICILWKTSLSTLIALSKCINPRAKPRISGLSEICCGKCWLSEPYFAKRWHREREQELKTSLHLPTYLLRQHPWRQLMIVYNQQELAHNRPVISMEQFLEKVAWPEAQLPLGRSPEAVPSSPVPARTEPRPAELQLPVADPPASTEVEILSPPPTPRAPPLIIIPDDSTNETAAPPDSPSCYLEDGLDFSDWMDC

SEQ ID NO: 166538 - protein, 239 aa, Glycine max
  Coding DNA Sequence Number=SeqID_74853
MPDRRKEAIPLFWVLSFYGENNINGQDLGMRIRLSEAKKESLVIAILADAYDTFDLTCEKSSARKDKANREELLAGMMGASISWFPWRKEGGAGVLCSCEGFPNAPLIGMRGSNTKILQRIHKAWNKVGRKDKELRGSSNGVIGGYHKWLKSRTRGITWLQKLKYLNREEAEVPKESEEVQALKAELEKTRVAKEKLKVAATRVRKECDELKDINMTTDEALEREMKKARKEEWSRNKF

SEQ ID NO: 166539 - protein, 141 aa, Glycine max
  Coding DNA Sequence Number=SeqID_74854
MGHYTSPSNNSYAVGLKDNGEKKNKEGVEKEKEKNDEVMANEKVEEKVVSEEEKHKSKKQATNKAYSPRLATARLGELVWQLLQKETRSKEEGVRKWSPSATEFLVAAEWRRKKDDWRRHFKEKMSQEEAHHHRKPWIRAL

SEQ ID NO: 166540 - protein, 58 aa, Glycine max
  Coding DNA Sequence Number=SeqID_74855
  Subcellular localization annotation: CTP_CleavageSite=41; ConfidenceScore=5.43e-01
MSRHYQVHIKTTTSPKVVLGASSDFPQINRSSTLRKNTHSEASLYATNNSLRMTLHSP

SEQ ID NO: 166541 - protein, 350 aa, Glycine max
  Coding DNA Sequence Number=SeqID_74856
  Homolog annotation: Hit_ID=Q2HW90; Match level="QueryCoverage=63%, HitCoverage=44%, E-value=1e-24, Identity=31%"; Hit description =Putative uncharacterized protein
MGSNQTPLLKKRFYQVKIKSLEVASLQELGKLMGQLQWQAFRKAYGKIWDLATIQVSLEAIASLTQYYDEPLRCFTIKDFQLVPTVEVFEEILGCPLGGRKPYLFSGFYPSMARVSKVVKISAQELDRVKQNRNVVVGVPRRCLEEKAKALANQGEWASFIDILALLIFGVVLFPNVEGLVDLAAIDAFLAFHDHRESLVVAILDDMYDTFDWRCEKSDARIVCCTPVLYVWLVSHLFRQESRHVCPLQGHHKIGAGDQLAQASVADFKLRTSSRKHPFLPPPFPQNPPQHSQTPPPPPTTTGGRREPPLCAVEPPHQEEHFNQSGILKILLKDLVEKVPPILHFIAFLR

SEQ ID NO: 166542 - protein, 233 aa, Glycine max
  Coding DNA Sequence Number=SeqID_74857
  Homolog annotation: Hit_ID=UPI00016621D1; Match level="QueryCoverage =71%, HitCoverage=40%, E-value=2e-12, Identity=34%"; Hit description =UPI00016621D1 related cluster
PSPSRGLHVLPSRGLHVLTFRELHALAFRGLHVLAFRGLHVLTLGTRTLTFRGLHVLAIRGLHVLTFRGLHALTFRGLDVLAVRGLHALTFSGLHILAIRGLHALTFRGLHVLTFRGLHTLTFRGLHVLAIRGLDAFTFRGLHVLAIRGLDVLTFRGLHVLAFRGLCVLTFIPGPPSDPGGATNCASTTREGGYHTATMHTGARFHPCHCKETSADRAHQHDHSFTDIDDVTT

SEQ ID NO: 166543 - protein, 170 aa, Glycine max
  Coding DNA Sequence Number=SeqID_74858
MLESFKQQEQMSVLELYIEKDVVGGSMFHSANSLTSCENYLSNDETQPTTNMSNLHIDEDDDDDDDDYLVSNSYVEESLDEDDSVDGISDTDDEVTNIPQPVRIVHPAEGAQRIENPFWNDDMHYNNINWSYPDEEDICGLELPSTFNIGQELYVGMEFDSKDAVKNAVK

SEQ ID NO: 166544 - protein, 163 aa, Glycine max
  Coding DNA Sequence Number=SeqID_74859
MTKARPKGVRKFNFENLPVEDQRTTNDEERLKIFAKSPTETLRKRYGGASAWIFFTETIFLTNFKWLQSTGRADLFSFTPPSIYWKIGEELATQLVQAIQLSECYGNSRIAYQYFLLISDMLQNFTDCETMLPFDFRHVSELHVLCNKGCQVPRSGQPKVACH

SEQ ID NO: 166545 - protein, 60 aa, Glycine max
  Coding DNA Sequence Number=SeqID_74860
MKCKTLESYLQVVSKIANTEPDTYTKNEVTLSKKGNRNEEKEGILKQAQPNSGAKREVSH

SEQ ID NO: 166546 - protein, 280 aa, Glycine max
  Coding DNA Sequence Number=SeqID_74861
  Gene Ontology: Mol. function=transcription factor activity; Cellular component=intracellular; Biological process=regulation of transcription, DNA-dependent
  Homolog annotation: Hit_ID=B0J7W0; Match level="QueryCoverage=100%, HitCoverage=97%, E-value=1e-135, Identity=91%"; Hit description =Transcriptional regulator, RpiR family
  Pfam annotation: Domain name=HTH_6; Domain location=1-97; Score=35.8; E_value=1.5e-07; Accession=PF01418.8; Description=Helix-turn-helix domain, rpiR family
  Pfam annotation: Domain name=SIS; Domain location=115-245; Score =63.3; E_value=8.2e-16; Accession=PF01380.13; Description=SIS domain
  Pfam module annotation: Pfam domain module=HTH_6::SIS; Domain location=1-97::115-245
EDKSRLSASESRIAEIIVNDFEFAVNASIIELAERAAVSPPTVTRFCRRLGCESFSDFKVQLARTAHIGVRYLKPESKSGDPADVAQDIITKAQNALFLLHRSLDLAAIEAAVGLISKAEMIYAFGSGGNSSMIADELQNRLFRLGLRITASSDHSMQLMMAAAAKSGDVIIGSSFSGRNAELVRAFALAREAKVKTIALTQTGSSVAKAAEVVVPIDLPEGTNIYRPTSTRIAYIATVDILASLVAYAIQPKATTTLRRIKQQLVTHRDGSDDKQLLGD

SEQ ID NO: 166547 - protein, 30 aa, Glycine max
  Coding DNA Sequence Number=SeqID_74862
MSAEKYQSWLYNDRCQEMFDRRHPVSLLLF

SEQ ID NO: 166548 - protein, 54 aa, Glycine max
  Coding DNA Sequence Number=SeqID_74863
MLQFTAVRAWRQGEQKADVTILLSPLQILLCLITLIMKVADPTCMTARPCSGSV

SEQ ID NO: 166549 - protein, 137 aa, Glycine max
  Coding DNA Sequence Number=SeqID_74864
PPTRHPPDLDKSNRALGFPVLITSLYQSFGVPVTPSKVIRPPITRAFIEKYCTPRQAQGDAPQVADAPPPPHQADPAGSLGMERYLQHLVRQQAANHRGQISLGLRSHGPEIGPRTRRRRHQQELPMMQRTPAWMRR

SEQ ID NO: 166550 - protein, 180 aa, Glycine max
  Coding DNA Sequence Number=SeqID_74865
MASRKHKSISSRPTAQYDTRRFSSLDAWTKYTDNVLGRNILPKRKRRNFHKRLTNLVDGSIDLALVKEFYANLYCFEDHPPKQSRVRVHLVKIDVDSLNTFLETLVVLAEGETLPAYSRYCRLPTNYREIEAALCIPGQGFILNSKGHPGKILRKDMTTPAQVWSVLSYSNLAPHHILLT

SEQ ID NO: 166551 - protein, 58 aa, Glycine max
  Coding DNA Sequence Number=SeqID_74866
  Homolog annotation: Hit_ID=A7PVN8; Match level="QueryCoverage=91%, HitCoverage=16%, E-value=4e-14, Identity=54%"; Hit description =Chromosome chr9 scaffold_33, whole genome shotgun sequence
  Pfam annotation: Domain name=zf-CCHC; Domain location=16-33; Score =11.9; E_value=0.024; Accession=PF00098.14; Description=Zinc knuckle
MTKPKNKRNKIDQTDVECFFSKEKGHWKRNCKHLDSLKNKKQGSSFNICNTLQETTDN

SEQ ID NO: 166552 - protein, 24 aa, Glycine max
  Coding DNA Sequence Number=SeqID_74867
ELLMMIASLANRELKRTFNDREME

SEQ ID NO: 166553 - protein, 41 aa, Glycine max
  Coding DNA Sequence Number=SeqID_74868
MTFLCKTRNALSSFMLVWNQRARTKRNLQVTRRGIRGVAHD

SEQ ID NO: 166554 - protein, 124 aa, Glycine max
  Coding DNA Sequence Number=SeqID_74869
  Subcellular localization annotation: CTP_CleavageSite=61; ConfidenceScore=5.40e-01
MEESLKKRKGSSFTAAGTSHRRHRPSDAPTTPIHPSLSSPRSSTLFSSDDQRLRHDAHRMVCNDQAEMTGRLLVRSLTFDNRIMHYIVVRILLPQSSNLAQASEENLILMWAFLTGRQIDWAHL

SEQ ID NO: 166555 - protein, 266 aa, Glycine max
  Coding DNA Sequence Number=SeqID_74870
  Homolog annotation: Hit_ID=A8UP46; Match level="QueryCoverage=99%, HitCoverage=46%, E-value=3e-39, Identity=38%"; Hit description=50S ribosomal protein L31 type B
MVSGLSPSTTYDFYVIAKDAGGNSSPQSNIAQGATLAAPAGGSCGTETFDAIPTAPNPSSYIDRTWTSNGITWNATSARTDETINGKSITIKNGVLTSSTISGGVQSLTLTTQLKYSGAAGTLNVEINGNLVGTIPYSASVQTTTINNINVTGNAVIKIITTSSPANRIAMDDLSWTCNSTLATVDVNKNSSSFVVYPNPVKNNELYVKGEQLNKVSKAEIYDLSGKLIRVINNPFKNSNRIHLNGLTKGNYILKTDNISAKFIVE

SEQ ID NO: 166556 - protein, 243 aa, Glycine max
  Coding DNA Sequence Number=SeqID_74871
FSSLSSFSIPLPFIFQEAKESIDEEDPRPTSSNGAYITRRPRARLVETPSTSAAPHPASTLVAPPPTRITEAPSTPLPARFQCFKAMLRSIHQGQIILLQSLQLVAPLDSIPTVEKFNEWVAWPGTQPPLHRDDEDPAAQVPHQPSDESSKSSTPEPLIRKRRVVVTQEAAATPKKSSEATLEPPAPLADTTSPQQAADPSMPEVQTTPVLSPNTSPVATLVLHLTDEEEVQTQDTQDQSQDL

SEQ ID NO: 166557 - protein, 118 aa, Glycine max
  Coding DNA Sequence Number=SeqID_74872
MEGFILGRSASVHPMAFLWPLNTYNNFFTCSGAQVVVLAPSVEAKLHDESRVFQRCFDDNKNDDKGDDKKLNGQSKNEFKMFKIESRTLQDSRGKLNSRIKNQEIKIQDLRFKNQEKA

SEQ ID NO: 166558 - protein, 146 aa, Glycine max
  Coding DNA Sequence Number=SeqID_74873
ISWRVRSWLRMNAGGMPYTCKSDGKWCFQWRTATLGLRHGPDSYGRQQWGIFRNGRKPDGAMPREGRRPTVRRQIPGLNPGQAVETTKLEYGRGRGNFRWSVKCVEIGKNTTAKALCWADTDTERRKLGERMGLDTPVVLAVNDGY

SEQ ID NO: 166559 - protein, 87 aa, Glycine max
  Coding DNA Sequence Number=SeqID_74874
MRGYLMVTRTFRQPGENEPIDGRRLTSSSAPFVVLTMKSGDMRSYLMVIRTFREPAENKPVDARRLTLSSAPFVVLTLEVSFCRPDP

SEQ ID NO: 166560 - protein, 66 aa, Glycine max
  Coding DNA Sequence Number=SeqID_74875
MMILGDACQKGKQVYIFMVKSTKAKEREMMQTFKLMKQKQVQIFQENEELQDTILLITSSVTYLKG

SEQ ID NO: 166561 - protein, 120 aa, Glycine max
  Coding DNA Sequence Number=SeqID_74876
VTSIGISQPLSGSVDGIIDPPSPVRRHVKWKMARTKKTREMTIEAAKEIVEKIAKHPGRVRAAGAADPANQGPARGVDHIKSDSTAYDIIRPDAVPVSSQMQSQGLALASGASEWSLQVL

SEQ ID NO: 166562 - protein, 193 aa, Glycine max
  Coding DNA Sequence Number=SeqID_74877
  Homolog annotation: Hit_ID=A6H5B3; Match level="QueryCoverage=34%, HitCoverage=84%, E-value=1e-27, Identity=88%"; Hit description =Putative ribosomal protein S3
MNGAKRSAEAVGCKKESVGERSALEGRTRASSAGRSGSENVGLSNANVGENPMPRKPKGSSARFVHGGLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 166563 - protein, 79 aa, Glycine max
  Coding DNA Sequence Number=SeqID_74878
MEKMDFHIITRGTPEARPGELKLSVEAMTSPRRAGARLGEPKASLGELGSRKTKDHLFCTVTGVQHRKSTSKDQKINER

SEQ ID NO: 166564 - protein, 61 aa, Glycine max
  Coding DNA Sequence Number=SeqID_74879
MASMFDMPFRGLKSEEKELRFLHFSGKCDELAKRACCAKQKCMVPLSAIGQVASDILRRGG

SEQ ID NO: 166565 - protein, 62 aa, Glycine max
  Coding DNA Sequence Number=SeqID_74880
MGETLMECALKGLDDTPQPKSKAAARWIVVKYFNVVRPLEAKRFKALHIQWTQYYLKIRNQT

SEQ ID NO: 166566 - protein, 100 aa, Glycine max
  Coding DNA Sequence Number=SeqID_74881
MKNGDVFVPKIKDKERKDAINVKTLVSSNTRRRTVENDRNKQIKLDTTKEYYHRILRQFQKAARDIYLSFSALLFHLRMSYKDFLVNIILRGKLSKPFIW

SEQ ID NO: 166567 - protein, 248 aa, Glycine max
  Coding DNA Sequence Number=SeqID_74882
  Gene Ontology: Mol. function=zinc ion binding; Cellular component =intracellular
  Homolog annotation: Hit_ID=A7PYC0; Match level="QueryCoverage=98%, HitCoverage=99%, E-value=1e-102, Identity=73%"; Hit description =Chromosome chr15 scaffold_37, whole genome shotgun sequence
  Pfam annotation: Domain name=PLATZ; Domain location=25-135; Score =256.1; E_value=7.3e-74; Accession=PF04640.5; Description=PLATZ transcription factor
MFVSSSSHVPRWLQVLLTEKFYNACIIHEGAKKNEKNVYCLDCCISLCPHCLSPHRSHRLLQIRRYVYHDVIRLGDAAKLIDCNSVQSYTTNSAKVVFLNQRPQTRNFRGSGNFCGTCDRSLQDPYHFCSLSCKINYLVRTTGSLCNYLFECNYLPLPESGLDDGLMTPDSVLEPAGSARTSSGSGGYGGVDCRTTLACTATTEIVRKKRTGGSTFRPPCRPACSPVSEISAGLMNRRKGNPQRAPLY

SEQ ID NO: 166568 - protein, 120 aa, Glycine max
  Coding DNA Sequence Number=SeqID_74883
MGSEIYPEVHENPRAFFSSSNSILLESSIQDPWGHEIEAIKKKMTHMNLDCTVVPQPFQAYAKALEAKLLRTREALRQALEDKNSMAAEGRRKKDDWRRHFKEKMSQEEAHHHKKPWIRA

SEQ ID NO: 166569 - protein, 115 aa, Glycine max
  Coding DNA Sequence Number=SeqID_74884
  Gene Ontology: Mol. function=aspartic-type endopeptidase activity; Cellular component=small subunit processome; Biological process=DNA integration
  Homolog annotation: Hit_ID=Q0KIN0; Match level="QueryCoverage=38%, HitCoverage=2%, E-value=1e-09, Identity=61%"; Hit description =Integrase core domain containing protein
MATIQHWPLDQLDIKNTFLHGELQEEAYMDQTPSFTASSKSRLLHNSTPTPAWSQILNYFPISNPLDIATQAISINGRELARLNQDHYIPRDNPKYILNSVGSSALRIIKKGGLN

SEQ ID NO: 166570 - protein, 73 aa, Glycine max
  Coding DNA Sequence Number=SeqID_74885
MGKHREEIKAQPKSCTQRATRAKRAAREGDALSARCQTTSAKQEELARLREFILNKTSKRVVLDPQEKTTLET

SEQ ID NO: 166571 - protein, 205 aa, Glycine max
  Coding DNA Sequence Number=SeqID_74886
MATFLQRKQLVNVERSDESLSEALDRFRGLLRKMPTHGYSEPVQLNIFIDGLRPQSKQLLAASPGEALTETLSKLPQQLQADSTKEGTLHKAQVGGITQRINTTRSTKISMSNYRSTETSIMNLEMKVGQLAKQVAERPSNSFGANMEKNPKEECKVMLTRSQKKVQEEEEAKEDQSGERRIDGEGEREEEKREEEGRRRDSLNS

SEQ ID NO: 166572 - protein, 114 aa, Glycine max
  Coding DNA Sequence Number=SeqID_74887
  Subcellular localization annotation: CTP_CleavageSite=33; ConfidenceScore=5.01e-01
MDMDLGSFISLQISQIAQSSTSRLGFPSLITTLCDMQGVVSNTLIFESLTPVINLAYIKKNCWNLADLSITFPGARRTRSRAVTPAPEASLPSQLDPRPPASTSAPLDMHIQML

SEQ ID NO: 166573 - protein, 239 aa, Glycine max
  Coding DNA Sequence Number=SeqID_74888
MARNPAKAKKKVKSLKRKQGECSQVALNKLGMWFIDENKKSDFKMIYAMKNGFNFPNLLKAQEMIIGAAVWKEVAGIDMGGVRKFEESMDGYSKMETYKGMLIDPARNLRNRLGVGGLTAKDRMLVYLITYILAPRSNHHAQVTDDNLEIVYGLKSEPPTTENINQMEEDMEEEAQQEPTQQWNPFESLMIQKLDAILHLHQEHQAKVLNSLENITTRLKNIEIRLSLSNLLNPDKDEA

SEQ ID NO: 166574 - protein, 210 aa, Glycine max
  Coding DNA Sequence Number=SeqID_74889
NLQDSGTLKRVAWGLDVGTREKKVEVSMEKCKTLILFSKNDGLNSYCNSLCASNHAKSFVLIPKEELYIKDQWAQQFGKEVVAYKEQDIHWAKIFYHYISRPNVLIDMQHVLILDLHDTFDVHDAYALHNLSLDNEHDGFFSHGEHLCKNMIFYVPKFALHDPLMRGTHGESLVRHDGLKFKDRWIVHIRGKEDFNSRTNPLKKGGDDEY

SEQ ID NO: 166575 - protein, 164 aa, Glycine max
  Coding DNA Sequence Number=SeqID_74890
  Subcellular localization annotation: CTP_CleavageSite=18; ConfidenceScore=5.05e-01
MRPLSFTFVSPKARFYICSNPASAPDRASSIKRLILIKHRPQIPLVGLNSTRTALRQTYKQLGGLVGACALSTTLARLARISEFRLSARLVAQRMDSSSALSGISPCLANMHNSSFFQILPRAQPRNVVLSEWLTKPKDWLSERMKISTSQIWLINLKLRGNDY

SEQ ID NO: 166576 - protein, 91 aa, Glycine max
  Coding DNA Sequence Number=SeqID_74891
  Subcellular localization annotation: CTP_CleavageSite=36; ConfidenceScore=5.07e-01
MTKLPRLSESASLSHRHLNRRMSVYPQKMNSLSTKMQKERKNTGCTDLGERENAGNALRILAKRTSALSESERCLVSQRGSLSGTACLAQA

SEQ ID NO: 166577 - protein, 172 aa, Glycine max
  Coding DNA Sequence Number=SeqID_74892
  Homolog annotation: Hit_ID=Q2HVF5; Match level="QueryCoverage=62%, HitCoverage=25%, E-value=7e-22, Identity=48%"; Hit description =Cyclin-like F-box; F-box protein interaction domain; Galactose oxidase, central
MNVNFHNSKIDVWVMREYNRGDSWCKLFTLEESRELRSFKCVRPLGYSSDGNKVLLKHNWKRLCWYDLRKKEVTLVRIQGFPNLNEAMICLGTLVTPYFLPREICRKLRTLGCEHPSICTGKDFTLTFNYRLTCMVMVESNDGSATVAAPGESVTESLKTNCGHRMVACPCR

SEQ ID NO: 166578 - protein, 16 aa, Glycine max
  Coding DNA Sequence Number=SeqID_74893
MLSGNRLPQCVIDYSK

SEQ ID NO: 166579 - protein, 63 aa, Glycine max
  Coding DNA Sequence Number=SeqID_74894
MGSSTRKLVERMGRVNLELNVRMVVLEVEKCEILRVRKAKFGVSGNWSLKKAWAEQMRKMGIL

SEQ ID NO: 166580 - protein, 192 aa, Glycine max
  Coding DNA Sequence Number=SeqID_74895
  Homolog annotation: Hit_ID=Q5XM22; Match level="QueryCoverage=21%, HitCoverage=22%, E-value=1e-07, Identity=61%"; Hit description =Resistance-like protein HAAS-2
MYDQLNEASQSTTRQIVGYLTLLQCWIYKHFPSVHDCVTDDGYDETSPRACRWLTTKAYMKGLPASLYQTCLDALTITNVSRDYMEWFFLISHPFITPTQASDQPRHPSVPQHEVYMEPDIPEVPVVAEGRSSQAFRPPIHEVDACEAIAERLECVLNLRMVTEGTELHEIMEDCLRIVRGVTSDGNVYVRA

SEQ ID NO: 166581 - protein, 149 aa, Glycine max
  Coding DNA Sequence Number=SeqID_74896
  Subcellular localization annotation: CTP_CleavageSite=41; ConfidenceScore=5.10e-01
MGIPNRHRFQGYNQGNSSRFHQGAAGFNHGPPGFNQGRNFTQGSGWRNQGNQYKEQRNQPPYQPPYQHPSQGPNQQEKPTNIEELLLQFIQETRSHQKSTDAAIRNLEVQMGQLAQDKAERPTITFGANTEKNPKEECKAVLTRGQRRA

SEQ ID NO: 166582 - protein, 70 aa, Glycine max
  Coding DNA Sequence Number=SeqID_74897
ALFGGVALEGKFLIALEPAPKWALPAGRVGVGVVAWGVSLWIGGGTLACIGAELEDSPTRVEKLGLCCAY

SEQ ID NO: 166583 - protein, 155 aa, Glycine max
  Coding DNA Sequence Number=SeqID_74898
  Subcellular localization annotation: CTP_CleavageSite=55; ConfidenceScore=5.33e-01
MSSPSEGRMSSPSLGYTPLPSKHYTPSPSEGCTSLLSEGSTSMPSENSRDRAHKTASGPEEVQQGPGVLALIMGLCQFYRVTTTPISPCQSDRARKTPSGPEEVQQGPGVLALIMGLCRFYRVPAAPNKVIRPPINRAFIKKYCAPRQAQGEAPR

SEQ ID NO: 166584 - protein, 315 aa, Glycine max
  Coding DNA Sequence Number=SeqID_74899
TTVTALGALYIQQRFEAIKGWSFLRERRVQLRDDEYTDFQEEIGRRRWAPLVTPMANDPVRCRRYQPAPGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVRTHDCLYQMSLSMQSQGFASFSCPTPDQFRAE

SEQ ID NO: 166585 - protein, 288 aa, Glycine max
  Coding DNA Sequence Number=SeqID_74900
  Gene Ontology: Mol. function=sugar efflux transmembrane transporter activity; Cellular component=integral to membrane; Biological process=carbohydrate transport
  Homolog annotation: Hit_ID=A8GGU2; Match level="QueryCoverage=48%, HitCoverage=34%, E-value=2e-49, Identity=72%"; Hit description=Sugar efflux transporter
  Subcellular localization annotation: CTP_CleavageSite=33; ConfidenceScore=5.07e-01
MYLAGAAAFVLCGLLVWKRLPSMPKTAATNAPLAAPRQHRRDSLLLFVACTLMWTANSMYLINMPLYVVHELRLPERLAGILMGAAAGLEIPIMLIAGMVAKRCGKRCLMRGAVVAGVLFYCGLLFITGSWPLIALQLLNARLSACWRASACSTFTGFDARSGRHGHHAVHQHHSGRLGHRRRHRRCGGGNLELPCGVLRRAGDGGRRDAVSVDVEGSLRRSVRFQPGEINQRLIAVIVAHVAARLQAAAHLRPQRRMKQATAQPFIQMNAAGIGGLAVRHAGDRAGY

SEQ ID NO: 166586 - protein, 575 aa, Glycine max
  Coding DNA Sequence Number=SeqID_74901
  Gene Ontology: Mol. function=transporter activity; Cellular component= periplasmic space; Biological process=transport
  Homolog annotation: Hit_ID=A8GGV4; Match level="QueryCoverage=96%, HitCoverage=92%, E-value=0.0, Identity=83%"; Hit description =Extracellular solute-binding protein family 5 precursor
  Pfam annotation: Domain name=SBP_bac_5; Domain location=116-527; Score=186.6; E_value=6.2e-53; Accession=PF00496.13; Description =Bacterial extracellular solute-binding proteins, family 5
MLCWAQVVLYSTAGAYRLMSVRIFAALVLSALSFGLRAEALNESYAFALLGEPKYATDFSHFDYVNPAAPKGGDVRLAAIGTYDNFNRFATRGVPGERTMELYDTLFTNSDDEPGSYYPLIAESARFPADMRWMELDINARARFQDGSPITAADVAFTFNKFMTEGVPQFRSYYKGVTVKAISRLTVRIELPKANREQILSLLSLRVLPESFWKNHKLNEPLSTPPLASGPYKIADYRLGQYITYQRVRDYWAANLPVNRGRYNFDSIRYDYYLDDKVSLEAFKAGAYDFRIEPSPKSWATQYQGGNFARNYIIKQDETNQAAQNTRWLAFNLQKPLFADRRVREAIGLAFDFNWMNKALYYNAYQRADSYFQNTAYAARGYPDAAELALLAPLKGQIPPEVFTSIYQPPSSDGSGNDRQNLLKATQLLKEAGWVVKNQKLVNAKTGQPFTFELMLLSGSNFQYVLPFRHNLQRLGIEMQIREIDASQYTRRMRERDFDMMSTVYMAMPFPSADLQILWDSQYIDSSYNTAGVKDPAVDSLVRQIAAHQGDEKALLPLGRALDRVLTWNNYLLPM

SEQ ID NO: 166587 - protein, 22 aa, Glycine max
  Coding DNA Sequence Number=SeqID_74902
MEKCKEASTPMATSTYLDLDEK

SEQ ID NO: 166588 - protein, 80 aa, Glycine max
  Coding DNA Sequence Number=SeqID_74903
MLAIISKYKEELDLATAHEHKVADEYARVYAKKEARGRESRSSPITGKGQSNGRRILRPRGNPRAPRLLSTYDRLDDPYN

SEQ ID NO: 166589 - protein, 119 aa, Glycine max
  Coding DNA Sequence Number=SeqID_74904
MGPSRGFWAISCLRLKQPRARLKGAVLRILDVPGEVFQLFWVKNNCFREENPSRGASVTLPRGFHKQIREGFPPLFTVLHPFFILRSSFFVLQRNRLLSFETNVRGANTFLKRKYNSRT

SEQ ID NO: 166590 - protein, 103 aa, Glycine max
  Coding DNA Sequence Number=SeqID_74905
  Homolog annotation: Hit_ID=A7Q5A7; Match level="QueryCoverage=41%, HitCoverage=59%, E-value=1e-11, Identity=79%"; Hit description =Chromosome undetermined scaffold_52, whole genome shotgun sequence
MVRCSGVLGVGGTTPIHPELGGYSGEQISSGDDGVGAVAQRIRARGYEPRAPDCGTKEYPEPTPSQLTADRSTTELLRNNGKFELIEFNSRSQPMTNMSSKFP

SEQ ID NO: 166591 - protein, 182 aa, Glycine max
  Coding DNA Sequence Number=SeqID_74906
  Subcellular localization annotation: CTP_CleavageSite=31; ConfidenceScore=5.30e-01
MAEPSKKRKGSSSRSQQSFGSQDTPIPSSISSSTLFSSEEQRIQYITLFSSHSIIDPKFMDMEFFSDEMFECVQAFQNSDLISFMSLKILVYPKLVKVFYSNLEIQEGSLISKKFDFSVSDARRLVCINQVDMTGRLLASSLTFDCRILHYLIVHILLPRSLNLARVFEEDLIIMWAFLTDC

SEQ ID NO: 166592 - protein, 132 aa, Glycine max
  Coding DNA Sequence Number=SeqID_74907
MGTNQTGKRFYQVKVKGLDVTSIKELGRLMGPLQMQAFRKTYGKILDLNIAENCNCGQGFSKRFGPRKTNSKRHSGPTTKVPRRQGEGYGKSRIVGPVYGCVSIANLWGRPLSKRGWFGGPSRNRRFPCIPP

SEQ ID NO: 166593 - protein, 68 aa, Glycine max
  Coding DNA Sequence Number=SeqID_74908
  Subcellular localization annotation: CTP_CleavageSite=54; ConfidenceScore=5.54e-01
DHTRKTPSGPGEAFVSSTKRSSPLTRSLGPPLTGLSSRSTAPPDKHRARHHSSLGMAGSGQQTHRHHL

SEQ ID NO: 166594 - protein, 229 aa, Glycine max
  Coding DNA Sequence Number=SeqID_74909
  Gene Ontology: Mol. function=transporter activity; Cellular component= integral to membrane; Biological process=transport
  Homolog annotation: Hit_ID=Q9K5K1; Match level="QueryCoverage=99%, HitCoverage=55%, E-value=1e-104, Identity=88%"; Hit description =Paraquat resistance protein PqrA
EFDRNRPELNTAFAFESAADELVYISGASLSVALAVSLFPEAGMLISTAFLAVGTVAFLLQRSSEPPVRALDRNHPQRSAIWSRPVQIITLALIFVGSTFATAEVSAVAITRELGEPGAASIVIGVYAIGSFLVGITLGALSIRIPLQRQLLIAVSVLALTALPLPFAGTSTALLATAVFVSGVAISPTFITAFGLIERRVPEAMLTEGITWVMTGIGIGMALGAFVSA

SEQ ID NO: 166595 - protein, 245 aa, Glycine max
  Coding DNA Sequence Number=SeqID_74910
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
VLQWLLFLSAVPPVQLLTGWCVTAKAPPDISAGKCSGHAARRVPFAIQAAQLLGRAIGAGLFAITPAGERGMCCKAIKLGNARVFPEFDHDHLFPFLGLAIYPKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 166596 - protein, 107 aa, Glycine max
  Coding DNA Sequence Number=SeqID_74911
MAKDQYMGFFFGGLREDIKMEDVLPGIDNHEIACQVLDYNAIDSTELLKSKTIKLEGVDWLEKHGNTTMDWKMRTLNFEDNGAIITFKGYQLSDGVVSSVLDRVASE

SEQ ID NO: 166597 - protein, 59 aa, Glycine max
  Coding DNA Sequence Number=SeqID_74912
MDILLPIVLKICAITAKKGKAFLPSSPWYFNSSASNHMTNNVAALTKDQHSGKIIAKGA

SEQ ID NO: 166598 - protein, 331 aa, Glycine max
  Coding DNA Sequence Number=SeqID_74913
  Gene Ontology: Mol. function=DNA binding; Cellular component=nucleus; Biological process=regulation of transcription
  Homolog annotation: Hit_ID=A7PGU1; Match level="QueryCoverage=99%, HitCoverage=99%, E-value=1e-104, Identity=60%"; Hit description =Chromosome chr17 scaffold_16, whole genome shotgun sequence
  Pfam annotation: Domain name=NAM; Domain location=5-131; Score=302.6; E_value=7.8e-88; Accession=PF02365.6; Description=No apical meristem (NAM) protein
MEENLPPGFRFHPTDEELITCYLTRKVSDSSFTSKAIAVVDLKKSEPWDLPGKASMGKKEWYFFSLRDRKYPTGLRTNRATESGYWKTTGKDKEIFRAGVLVGMKKTLVFYRGRAPRGEKSNWVMHEYRLENKNHFRPSKDEWVVCRVFQKSLQMKRPQQTPPSQPESPCDTASMVNEFGDVELPNLINNIANSSSDGITNNISGQTFFNADLINSVNTNMNLTMNWPVASEVIQVPTLPSLPWPSGLLNPSISVNSLLLKALQLRSYQQIEAAAAAATDHLIASYMPQGVSQHVGTNLISSSLTASSSSKVLECVPQQQQEQPFNLDSIW

SEQ ID NO: 166599 - protein, 85 aa, Glycine max
  Coding DNA Sequence Number=SeqID_74914
MNNCLLAKSMNTLEVSNLLKSLQVWAHIRDLAPFRRRFTSLQRITDSLIRGRSTSSVQEKLRCLAIAITVYCIWLSRNKLIFEDF

SEQ ID NO: 166600 - protein, 42 aa, Glycine max
  Coding DNA Sequence Number=SeqID_74915
MERSITHMMKKKGFSRAKGMGKIEADTNSYVRCKIDMILKEM

SEQ ID NO: 166601 - protein, 790 aa, Glycine max
  Coding DNA Sequence Number=SeqID_74916
  Gene Ontology: Mol. function=oxidoreductase activity; Cellular component=nucleus; Biological process=amine metabolic process
  Homolog annotation: Hit_ID=A7Q640; Match level="QueryCoverage=70%, HitCoverage=82%, E-value=0.0, Identity=77%"; Hit description =Chromosome undetermined scaffold_55, whole genome shotgun sequence
  Pfam annotation: Domain name=Amino_oxidase; Domain location=218-646; Score=315.5; E_value=9.9e-92; Accession=PF01593.15; Description =Flavin containing amine oxidoreductase
  Pfam annotation: Domain name=DAO; Domain location=210-544; Score= -45.3; E_value=0.01; Accession=PF01266.15; Description=FAD dependent oxidoreductase
  Pfam annotation: Domain name=SWIRM; Domain location=97-189; Score =85.4; E_value=1.8e-22; Accession=PF04433.8; Description=SWIRM domain
  Pfam module annotation: Pfam domain module=Amino_oxidase::DAO::SWIRM; Domain location=218-646::210-544::97-189
  Subcellular localization annotation: CTP_CleavageSite=92; ConfidenceScore=5.02e-01
MSDSTNTNPPPPPVAEPPPPPQSGSPENDVAMSPQNSSEDPDSSLPTQTTPEPAVPDSPDSATTRPDPNPPPRKRRRRKKFFTELTTGPSTRRNDVAKDCDVEALIAISVGFPVDSLTEEEIEANVVSTVGGSEQSNYIVVRNHILARWRSNVSVWLTHDRALRSIRSEHKGLVETAYRFLLEHGYINFGLAQEIQTLKLKPFDGSDRGTVIVIGAGFAGLVAARQLVFMGFKVVILEGRTRPGGRVKTKKMSGDGVEAAADFGGSVLTGINGNPLGVLARQLGLPLHKVRDICPLYLPDGRSVDSEVDSRVEVSFNKLLERVCKLRQAMIEEVKSVDVPLGTALEAFRRVYMVAEDKEERMLLNWHLANLEYANATLMSNLSMAYWDQDDPYEMGGDHCFIPGGNEKFVRALAEDLPIFYGRTVECVKYGSDGVLVYAGGQEFRGGMVLCTVPLGVLKKGDIEFVPELPQRKKDAIHRLGFGLLNKVAILFPYNFWGGDIDTFGHLTEDLSMRGEFFLFYSYSSVSGGPLLVALVAGEAAIRFEMMSPVESVKRVLDILKNIFNPKGIVVPDPVQAACTRWGKDHFAYGSYSYVAVGSSGDDYDILAESVGDGTVFFAGEATSKQYPATMHGAFLSGMREAANILRVAKRRSSMPIDTSKSVNQENDDLNKLFVKPDLTFGSFSALFDPNLNDLDSSSLLRVKIGGAVLDSGSLYLYALLPKKWVIELSQLEGDENRMRMLNRNFGVSLVGRKGLSSAAESLIASIKLSRPNLNEAENGLIMTGKENSQ

SEQ ID NO: 166602 - protein, 710 aa, Glycine max
  Coding DNA Sequence Number=SeqID_74917
  Gene Ontology: Mol. function=RNA polymerase II transcription factor activity; Cellular component=integral to Golgi membrane; Biological process=intra-Golgi vesicle-mediated transport
  Homolog annotation: Hit_ID=A7PGQ5; Match level="QueryCoverage=93%, HitCoverage=87%, E-value=0.0, Identity=65%"; Hit description =Chromosome chr17 scaffold_16, whole genome shotgun sequence
  Pfam annotation: Domain name=CASP_C; Domain location=503-690; Score =167.8; E_value=2.9e-47; Accession=PF08172.3; Description=CASP C terminal
  Pfam annotation: Domain name=Tropomyosin; Domain location=254-474; Score=-119.4; E_value=0.09; Accession=PF00261.11; Description =Tropomyosin
  Pfam module annotation: Pfam domain module=CASP_C::Tropomyosin; Domain location=503-690::254-474
MEAPPGGSGSGSGPERDKSTAPSSSPISVVSAFWKDFELEKEKSILDEQGLRIAENQENSQRNRRKLAENTRDFKKASPEDKLSLFNSLLKGYQEEVDNLTKRAKFGENAFLNIYQKLYEAPDPYPALVSIAEQDLKISELESENRKMKVELEEFRTEATHLKNQQATIRRLEERNRQLEQQMEEKVKEIVEIKQRSLAEENQKTMEVLKERYLFLTIAKVDYRKKGGKHRMENPCEPKKYWLQALPAHMAGEQALQDQLQHAKDSVSTMQKLHELAQNQLFELRAQSEEERASKQSEVNLLMDEVERAQSMLLSLEREKLLSADAFPCSIRLAVYCSDTSVSMQGVLRNQLQTANEETETKNSDNFDSNSALENSLNAKEKQISDLNMELHNIETALSNERDQHINEVKKLTAMLNEKEAALEEMKKELKARPTEKMVDDLRKKVKILQAVGYNSIEAEDWEVATSGEEMSKMESLLLDKNRKMEHELTQLKVTLSEKTSILETAEQKIAELTAKSNEQQKLIQKLEDDILKGYSSNSKDRKGNFLDDWDLSEAGGGEVSENTDQRQVSLDQDQSSMLKVICNQRDRFRTRLRETEEEIRQLKEKIGVLTVELEKSKVDNVKLYGKIRYVQDYNHEKVVSRGSKKYAEDLESGFMSDVESKYKKIYEDDINPFAAFSKKLDKIDSACPLNSRPREESPKIRRRRRIKIN

SEQ ID NO: 166603 - protein, 65 aa, Glycine max
  Coding DNA Sequence Number=SeqID_74918
  Homolog annotation: Hit_ID=A7PES9; Match level="QueryCoverage=50%, HitCoverage=4%, E-value=2e-08, Identity=81%"; Hit description =Chromosome chr11 scaffold_13, whole genome shotgun sequence
MASPMKEDEKNERVIRGLLKLQHNRRCVNCNSLNDSVLSESGSKASYSTDSDYSTLDASDASLFS

SEQ ID NO: 166604 - protein, 436 aa, Glycine max
  Coding DNA Sequence Number=SeqID_74919
  Gene Ontology: Mol. function=L-serine transmembrane transporter activity; Cellular component=membrane; Biological process=transport
  Homolog annotation: Hit_ID=A7PES8; Match level="QueryCoverage=85%, HitCoverage=88%, E-value=1e-137, Identity=64%"; Hit description =Chromosome chr11 scaffold_13, whole genome shotgun sequence
  Pfam annotation: Domain name=Serinc; Domain location=10-395; Score =2.6; E_value=1.1e-16; Accession=PF03348.6; Description=Serine incorporator (Serinc)
METGENNSTSSSNQSCAVMKDSKWYTQFRNVSNPWMARYVYGLIFLVANLLAWAARDELSSLSALTEMKASILTYIEPAGLKGCKVGKNCLGADGVLRLFYMIMFWSTAGTSKLKEGRDEWHSGWWLVKIVVLVLVTIFPFLLPSELIDLYGQIAHFGAGVFLLIQLISIISFINWLTDCFGSEKYAERCQIQVMLFATISYFICLVGIILMYIWYAPQPSCLLNIFFITWTLVLLQLMTSVSLHPKVNAGILSPGLMGLYVVFLCWCAIRSEPEGAECIRKSESANKTDWQSIISFVVAILALVVATFSTGIDSKCFQVLQCISNKSLQFRKSDPPAEDDVPYGYGFFHFVFATGAMYFAMLLIGWNSHHSMRKWTIDVGWTSAWVRIWTPPDTALRKKESTPCKFDVRSNGSAKNAHKLLGLLLEATQYLFIYP

SEQ ID NO: 166605 - protein, 344 aa, Glycine max
  Coding DNA Sequence Number=SeqID_74920
  Gene Ontology: Mol. function=secondary active sulfate transmembrane transporter activity; Cellular component=integral to membrane; Biological process=sulfate transport
  Homolog annotation: Hit_ID=Q0P7I2; Match level="QueryCoverage=100%, HitCoverage=52%, E-value=1e-146, Identity=73%"; Hit description=Sst1 protein
  Pfam annotation: Domain name=Sulfate_transp; Domain location=184-344; Score=-72.2; E_value=7.2e-07; Accession=PF00916.11; Description =Sulfate transporter family
MGSIGNSEVKNHNQHHEDGGDNGVNFSIQRGFGTKLKEALKEALFPDDPFRQFKKEQKPMRRVMKGVQYYIPIFEWLPTYNWRLFVSDLIAGLTISSLAIPQGISYAKLADLPPLVGLYSSFVPPLIYAVFGSSRHMAVGTIAGASLLIAQTIQTVADPVEDPTLYLHLIFTTTFITGVFQACLGLFRLGIVVDFFSHATINGFIGGTAVALILQQLKGVFGMKHFSTKSNMVEVVKSIVRNRHEIRWEPAVLGVILVAFLQFTKHLRNKNPKLFWVTAIAPMVTLVVSGVFTYLVKGQDHGIQIVGHLDKGLNPLSIHYLNFNSKYLPAVMQAGLITGVLSLA

SEQ ID NO: 166606 - protein, 69 aa, Glycine max
  Coding DNA Sequence Number=SeqID_74921
MNDVETNASSGTNLRLRKKNDMEQSFQWHLILLYLKMRRYDLRKGGDIWIECTSFGGKIVYRLEKSCTQ

SEQ ID NO: 166607 - protein, 1122 aa, Glycine max
  Coding DNA Sequence Number=SeqID_74922
  Gene Ontology: Mol. function=ARF guanyl-nucleotide exchange factor activity; Cellular component=intracellular; Biological process =regulation of ARF protein signal transduction
  Homolog annotation: Hit_ID=A7PER9; Match level="QueryCoverage=99%, HitCoverage=84%, E-value=0.0, Identity=58%"; Hit description =Chromosome chr11 scaffold_13, whole genome shotgun sequence
  Pfam annotation: Domain name=Sec7; Domain location=284-472; Score =281.5; E_value=1.7e-81; Accession=PF01369.11; Description=Sec7 domain
MHELIQVVFTRLPEIEAKDREGDSESDMEDGDEGGGLESGYGVRCAIDIFHFLCSLLNVVSIVEADGSTSHTADEDVQIFALVLINSAIELSGDEIGKHPKLLRMIQDDLFHHLIYYGTWSSSFILSMICSTVLNAYHFLRRFIRFQLEAFFGYVLFRIASFGSTIPLQEVAVEGIINFCRQPTFIVEVFANYDCDPCCRNVFEEAGRLLCKHSFALNGHLTSLHIQSFEGLLIMIHNIADNIDKDGHHLGPHTIQLPTYRPFWEEMDKEEEDLEDWVKHVRMRRLQKKKLLIAANHFNRDNKKGLEYLKHAKLISDPPDPKAYAYFFRYTPGINKKAIGEFLGDPDAFYLQVLKEFTATFHFQGMNLDTGLRFYLESFWLPGESQKIQRVLEAFAERFYDHQSSDMFASKDTILILCYSLIMLNTDQHNPQVKKKMTEEEFIRNNRAINAGKDLPREYLSELFQSISTCAFSLEKTTVSLDMNPSRWIQIINRSKVVQPFTQCDFDRRICRDMFACIAGPAVAALSSFFEHADEEEMLHECIEGLFSVARICQYGLEDTLDELITSFCKFTTLLNPYASIEETMFTFSHDLKPRMATVAVFTIANYFRDSIQGGWKNIVDCLLKLKRLKLLPQSVIDFESVDVPTTPESGVVSPTDDHKFGSQRVASMISRFLHLSSESMEDGLTLGSEFEQNTKMIKMCNIGSIFSNCSNIPKECLQSLGRSLIFAAAGKGQKFSTPVEEEETVEFCWDLITAISIANVHRFHIFWPNFHEYLLSVAQFPMFSPIPFVEKGILGLLKVCLKLFSAPRDEKQAEELIFKSVNLMWKLDIEILDTFHDVISHSSSKILIEYHANLQTQIGWKSVLNLLSPVWRHPENYDVGFEVLIALFSDGTRLSRTNYGDCVDFAFGFFLAKNIPGEKKKMILDLLVGSVKMLIQWHRNQYTDPGSNASIASYSSNSSIEDYSRGTVASANFMSQLSKLGEVFRRTCLSRQEEIHDKMLEYSKRENAERETRSMEGTLKLAVELLSDMYLQSFRQLTEIPGFRGIWLGLLRRMDTCMKADLGQYGSSNLGEIVRNLLRKIITQMKDEGILEPREEDDMWEITYIQIQWSCPSLKDELFPL

SEQ ID NO: 166608 - protein, 51 aa, Glycine max
  Coding DNA Sequence Number=SeqID_74923
  Subcellular localization annotation: CTP_CleavageSite=17; ConfidenceScore=5.30e-01
MASQGHGNKLIVSTSPKSDSGSGGGGASPTNWMKRSKSMPANKPVVSDSTC

SEQ ID NO: 166609 - protein, 64 aa, Glycine max
  Coding DNA Sequence Number=SeqID_74924
MENTKYDGMIDERYINNTLTMQQGRCTSTKEAWPLTPPGAGPDCTRLPQGHNDESGGTTRPCRS

SEQ ID NO: 166610 - protein, 790 aa, Glycine max
  Coding DNA Sequence Number=SeqID_74925
  Gene Ontology: Mol. function=microtubule motor activity; Cellular component=microtubule associated complex; Biological process =microtubule-based movement
  Homolog annotation: Hit_ID=Q9AVP4; Match level="QueryCoverage=88%, HitCoverage=84%, E-value=5e-92, Identity=51%"; Hit description=BY-2 kinesin-like protein 10
  Pfam annotation: Domain name=Kinesin; Domain location=88-331; Score =219.9; E_value=5.9e-63; Accession=PF00225.14; Description=Kinesin motor domain
MPRSSSAVHHHRQSSDNFMFDAHGRWLHSSAYAQELGTRSSSLRRNDDDRVLTSGLLDLHSFDTELLPEGQSFDGYESILSGNKLVPRSRGLPESHLLKSVSADKERANNVAKIKVVVDLTEYIEKHEFVFDAVLNEDVSNDEVYAETVEPIVPLIFQRTKATCFAYGQTEYRVSKVETIKEFIERGNSTRSTGTTGANEESSRSHAILQLCIKRSADGTESKPTRLVGKLSFIDLAGSERGADTTDNDKQTRIEGAEINKSLLALKECIRALDNDQGHIPFRGSKLTEVLRDSFVGDSRTVMISCISPSSGSCEHTLNTLRYADRVKSLSKGNTSRRDPLSSSNLRDSTVLPGSSVLSHDDTLEDETTYVSSDKNRFGWPKQLEREPSPPNNVDRVPSGRMGGNLIPSVYSDPQNGQRGSQKARTANEYDYLGPTYEQDRTRKTSKRVDNNQLSAVGDKRKIESRVKLVDELHFEANHSDPDDNLNALLKEEEDLVTAHRRQVEETIDIVRESLSKGNTSRRDPLSSSNLRDSTVLPGSSVLSHDDTLEDETTYVSSDKNRFGWPKQLEREPSPPNNVDRVPSGRMGGNLIPSVYSDPQNGQRGSQKARTANEYDYLGPTYEQDRTRKTSKRVDNNQLSAVGDKRKIESRVKLVDELHFEANHSDPDDNLNALLKEEEDLVTAHRRQVEETIDIVREEMNLLVGADQPGNQLDDYISKLNTILSLKAAGIFQLQTQLAQFQRRLNEYNVVVTSGILRSLRYCFYDFIAVDCFSIVKNFDVDKILRSTLD

SEQ ID NO: 166611 - protein, 148 aa, Glycine max
  Coding DNA Sequence Number=SeqID_74926
  Gene Ontology: Mol. function=alpha-N-arabinofuranosidase activity; Biological process=L-arabinose metabolic process
  Homolog annotation: Hit_ID=A0ZNJ6; Match level="QueryCoverage=37%, HitCoverage=8%, E-value=8e-15, Identity=66%"; Hit description=Alpha -Arabinosidase1
MDLLIGSPTVPPIAPHLMPPLRYLLLSSIASKVTWQHDLYADQHVAAAGYPAQGGRAASIEIGIKLYISNLDYGVSNDDIKLAEDLGTLPIWVFNAGFSLNDEIDTSSIESYVQGAFDGIEFARGSPTSQWDRLRKLRRLLVGTVLES

SEQ ID NO: 166612 - protein, 1046 aa, Glycine max
  Coding DNA Sequence Number=SeqID_74927
  Gene Ontology: Mol. function=subtilase activity; Cellular component =endoplasmic reticulum membrane; Biological process=proteolysis
  Homolog annotation: Hit_ID=Q0WUG6; Match level="QueryCoverage=94%, HitCoverage=92%, E-value=0.0, Identity=72%"; Hit description =Subtilisin like protein
  Pfam annotation: Domain name=Peptidase_S8; Domain location=178-467; Score=96.1; E_value=1.1e-25; Accession=PF00082.13; Description =Subtilase family
  Subcellular localization annotation: CTP_CleavageSite=41; ConfidenceScore=5.27e-01
MATTTQWSSLSLSLLLLSIALFQTLTPNSSPSPPPPNYIVAFSHYAAADRHRAYLESALRPGGWRWIPRQNPAAQFPTDFGLVAIDDSAVVDEIRKLGSVKYVSLDMSYNRGLMAKKDQRRNDKKVGAFEDGKKKRPGKIFTAMSFCEAEEGGGEEEHASNRSSSVKWGRELLMQRSQVTSMFGAKDLWAKGYTGAKVKMAIFDTGIRADHPHFHNIKERTNWTNEDTLNDNLGHGTFVAGVIAGVDAESLGFAPDTEIYAFRVFTDAQKSLQDFEKISFSLLQVSYTSWFLDAFNYAIATNMDVLNLSIGGPDYLDLPFVEKIWEITANNIIMVSAIGNDGPLYGTLNNPADQSDVIGVGGIDYSDHIASFSSRGMSTWELPHGYGRVKPDIVAYGRDIMGSKISAGCKSLSGTSVASPVVAGVVCLLVSVIPEPDRKNILNPASMKQALVEGAAKLSGPNMYEQGAGRVDLLKSYEILKSYKPRASIFPSVLDYTVCPYTWPFCRQPLYAGAMPVIFNATILNGMGVVGYVDSPPTWHPSDEEGNLLSIHFTYSEIIWPWTGYLALHMQIKEEGAQFSGKIEGNVTLRVSSPPAHGEKDPRISICVLQLKLNVVPTPPRSKRILWDQFHNIKYPPGYIPRDSLDVRNDILDWHGDHLHTNFHIMFNMLRDAGYYVETLGSPLTCFDARQYGTLLLVDLEDEYFTEEIEKLRDDVVNTGLGLAVFSEWYNVDTMVKMRFFDDNTRSWWTPVTGGANVPALNDLLAPFGIAFGDKILNGDFSLLGEQNRYASGTDIVRFPRGGYVHSFPFLDSSESGATQNVLQASGSTKADSPILGLTVMGEGRIAVYGDSNCLDSSHMVTNCFALLRKLLDFTNEDVRDPELFSDSNKQDSPLYEPDNQLPSRRTDVNFSAFSAIVGKELICRTDTRFEIWGTKGYNLQVRGRNRRLPGYPAIDLGRGLNSTSDASNIRRPRLTVRSNKDDFLGNRYLGLFYGDEPDAPMLVGGHWLIPFVVAVTGILLLSFWRIRQKRRRRRKGSNSGRLANI

SEQ ID NO: 166613 - protein, 192 aa, Glycine max
  Coding DNA Sequence Number=SeqID_74928
  Gene Ontology: Biological process=regulation of transcription
  Homolog annotation: Hit_ID=A7PEM5; Match level="QueryCoverage=18%, HitCoverage=6%, E-value=2e-11, Identity=80%"; Hit description =Chromosome chr11 scaffold_13, whole genome shotgun sequence
  Pfam annotation: Domain name=CXC; Domain location=128-159; Score= -2.1; E_value=0.028; Accession=PF03638.6; Description=TesminTSO1-like CXC domain
MGEGGEGEGDCAPKNASLSEVVAPAKKLARQLDFTGAPEHPQLSQPPQLPVAVLPLQPQAPHARVGGHGATMSEWRVQCYQWRNAKHSGRPKFCHINMPLCLMEPLWKPESPKSRSRPNFEIKDATPKKQKQCNCKHSKCLKLNEVGTQALKLKQRSTKLESLQTEEMVLFEALDPFQSCQLTNQEEERLFG

SEQ ID NO: 166614 - protein, 67 aa, Glycine max
  Coding DNA Sequence Number=SeqID_74929
MNISVTLNVTSSLNESESFDPSKPLRARSHIDIQLSRASAHLALNAWSLDLVEHVRSARGSRQAHKI

SEQ ID NO: 166615 - protein, 93 aa, Glycine max
  Coding DNA Sequence Number=SeqID_74930
MCFFVNANGNWDCERISTEIPDEIVQCINQMKPPCSSSRPDYMEWIHSDDGQFTTHDAYSKLSLRVASSGVVIRGNSGSFVRAYLEGWGTIQF

SEQ ID NO: 166616 - protein, 225 aa, Glycine max
  Coding DNA Sequence Number=SeqID_74931
  Gene Ontology: Mol. function=nucleotide binding; Cellular component =plasma membrane; Biological process=small GTPase mediated signal transduction
  Homolog annotation: Hit_ID=O82480; Match level="QueryCoverage=88%, HitCoverage=94%, E-value=1e-98, Identity=91%"; Hit description=Rac -like GTP-binding protein ARAC7
  Pfam annotation: Domain name=GTP_EFTU; Domain location=4-179; Score= -86.7; E_value=0.1; Accession=PF00009.18; Description=Elongation factor Tu GTP binding domain
  Pfam annotation: Domain name=Miro; Domain location=8-121; Score=57.3; E_value=5.2e-14; Accession=PF08477.4; Description=Miro-like protein
  Pfam annotation: Domain name=Ras; Domain location=8-179; Score=266.4; E_value=6e-77; Accession=PF00071.13; Description=Ras family
  Pfam module annotation: Pfam domain module=GTP_EFTU::Miro::Ras; Domain location=4-179::8-121::8-179
MNASKFIKCVTVGDGAVGKTCMLICYTSNKFPTDYIPTVFDNFSANVAVDGSIVNLGLWDTAGQEDYSRLRPLSYRGADIFVLAFSLISRASYENVLKKWMPELRRFAPNVPIVLVGTKLDLREDRGYVADHMGSNVITSAEGEELRKQIGAAAYIECSSKTQQNVKAVFDTAIKVVLQPQPPRRKEMARKKRHRRSGCSFVCWYPKKERKEKYCTKDHAAAEKA

SEQ ID NO: 166617 - protein, 352 aa, Glycine max
  Coding DNA Sequence Number=SeqID_74932
  Gene Ontology: Mol. function=protein dimerization activity; Cellular component=nucleus; Biological process=regulation of transcription, DNA-dependent
  Homolog annotation: Hit_ID=A7PEL3; Match level="QueryCoverage=83%, HitCoverage=96%, E-value=1e-113, Identity=72%"; Hit description =Chromosome chr11 scaffold_13, whole genome shotgun sequence
  Pfam annotation: Domain name=AUX_IAA; Domain location=30-299; Score =404.3; E_value=1.8e-118; Accession=PF02309.7; Description=AUXIAA family
MSVSLEQEGYVGLSEVPAMEGCSERTGGGLNLKATELRLGLPGSESPEREEGVEDKNVHPLGMVKCLVSGAKRGFSDTIDGGSGKWLLSGNSGSEVGLGKDGGFFSPRGVGVSVSAAKAECTNQQTCVVKDKVPQSPKPLNEKKPQISAPAAKEQVVGWPPIRSFRKNSMATQPQKNDDNAEAKSVCLYVKVSMDGAPYLRKVDLKNFGTYMELSSALEKMFSCFTISQCGSHGVCGRDKLTENRLMDLLHGSEYVLTYEDKDGDWMLVGDVPWEMFTDSCKRLRIMKSSEAIGLGEADTFNNHQEPWKNAKVATSKMVLIQKDELLLLPLNTYIIQESRGKCRAQAGAFLA

SEQ ID NO: 166618 - protein, 68 aa, Glycine max
  Coding DNA Sequence Number=SeqID_74933
MAQIEKLLVALFLFAVAQSIILVDATFSKSMYITWGSQHASMQGEDLQLVLDQTSDIFVLDNRKHLHL

SEQ ID NO: 166619 - protein, 291 aa, Glycine max
  Coding DNA Sequence Number=SeqID_74934
MLQPYEISIGLKEHSNPVTPKAYTLKSPSGPLPPDSDSSGFLRERKRLQYEGFFSHFRHDIEIPDGDNSRNYVANMILKFHDDPTVNGFKIVVFLRLDFLALALPPPDEEEVEPKNPVEHLCNEPLDISILSNSDDVSLHKAVSCPTENSNLSVPVVTDAASLPMKSCEAETTEDVMAISREPQMLPGTNNNSGSNIVDLYSDKFSGAADVSETSRSALCMEGILSLLEQAVEKGSALVLDDEYLDDDYIYQITVAFGKSAPPEPVYKLPRQGKKWIRVLKLEEKNMVRDL

SEQ ID NO: 166620 - protein, 114 aa, Glycine max
  Coding DNA Sequence Number=SeqID_74935
MTPKYLGGDMVLLMGLTDTRAEEMCREGAANGTTLFYSLEKWQSSMRTRLLIFDDWTRLRRHATVQTLVNGGLGAWWGRRRKSVPMVGSTEEMELPLTAAFELSVSKTTTAKME

SEQ ID NO: 166621 - protein, 34 aa, Glycine max
  Coding DNA Sequence Number=SeqID_74936
MAGEFSAFLYILKSLAPHRGVEENEEILLLGWAV

SEQ ID NO: 166622 - protein, 114 aa, Glycine max
  Coding DNA Sequence Number=SeqID_74937
MEGELEPSWHLLHSSGNMHSVTYNQDLVSPTLLAGWTELREFYELTRNHQITLTHHEQSVFLLTIFKSSSESKDMSSTMYSFMKVVAGFIHLNLEGIECRIVYNHHRKTKIGNG

SEQ ID NO: 166623 - protein, 193 aa, Glycine max
  Coding DNA Sequence Number=SeqID_74938
MESYNKEWNDSKVQIDEEILEFVNRPKKLKVWKFHRGVLQLWILKGKFSCEGQDMWDMLGAPSNIAGAPSNSMKASSLLSSPTSFFSASFSDSPWTRSLPEDPLGVLPEVPEERFPESFRKKCSSGSNQTSSGRTLLPEDFRKTSSGNFPEEVVHPEEFRKTRTSGRSFKLPEDLSGRTLLPECFRKNHFFRK

SEQ ID NO: 166624 - protein, 377 aa, Glycine max
  Coding DNA Sequence Number=SeqID_74939
  Gene Ontology: Mol. function=sulfotransferase activity; Cellular component=integral to membrane; Biological process=transport
  Homolog annotation: Hit_ID=A7QSR5; Match level="QueryCoverage=100%, HitCoverage=90%, E-value=1e-105, Identity=52%"; Hit description =Chromosome chr4 scaffold_162, whole genome shotgun sequence
  Pfam annotation: Domain name=Mem_trans; Domain location=9-377; Score =213.8; E_value=4.2e-61; Accession=PF03547.9; Description=Membrane transport protein
MGFIKLFSVASFPVIKVLLITALGLFLALDNISILGEDARKKVNQLVFYVFNPSLVGSNLAKTITFESVVKLWFMPVNILGTFILGSALGWILIKMTRPPKRMEGLILGCCSAGNLGNLPMIIIAAICKQEGSPFGEPDLCNQYGMAYAALSMAIGAVFLWSYVYNLMRISSSRIQNEDRTSNDSSMLKASADISVSHPHNFSKTLNTTKGTVDNAYTILLPETNSEEKVSFPSKIKHYVRMISSHLNFKSMFAPSTLGAIAGFIIGVVPQIRNFMIGNNAPLHVVEDSASMLGEAAIPTVTLIMGANLLKGLKGTTAPVWTIVGIVVVRYIFLPLLGIAVVKGAMHLSLVHSDALYQFVLLLQYALPPAMNIDVML

SEQ ID NO: 166625 - protein, 788 aa, Glycine max
  Coding DNA Sequence Number=SeqID_74940
  Gene Ontology: Mol. function=phosphoprotein phosphatase activity; Cellular component=nucleus; Biological process=protein amino acid dephosphorylation
  Homolog annotation: Hit_ID=A7QSS3; Match level="QueryCoverage=80%, HitCoverage=97%, E-value=1e-130, Identity=64%"; Hit description =Serine/threonine protein phosphatase
  Pfam annotation: Domain name=Metallophos; Domain location=214-418; Score=57.6; E_value=4.3e-14; Accession=PF00149.19; Description =Calcineurin-like phosphoesterase
  Pfam annotation: Domain name=zf-C2HC_plant; Domain location=526-567; Score=5.8; E_value=0.0088; Accession=PF07567.3; Description=Protein of unknown function, DUF1544
  Pfam module annotation: Pfam domain module=Metallophos::zf-C2HC _plant; Domain location=214-418::526-567
MKANAYLDGAAPTEKKNTQSRGDEEERATTMLKKNMQQQPRCRHPKNAQKKMKTNGIRRRKKEHAEERVLGESPIKIFLQLRSSTMTLQADSAPVPPPPPDSAATNGISPTAEEAPQPPSPPPPHPTPPPELRVPIWWPEDGNLSMDWVDNLMRCFDWSSRNVPPSELPSVLPVGVFDSLILVASKMLHKEPNCVTVDPFRPSSDDDNTPSAASSVVVVGDVHGQLHDLLFLLQDAGFPSRDRIFVFNGDYVDRGAWGLETFLLLLAWKKEVMVKYGDKGKHVYRKCLGCFEGLPLASIIAGCVYTAHGGLFRSVTVTPSKRFKGKKNRKINVNHESKILSLGSLEELSKARRSVLDPPWEGPNLIPGDVLWSDPSKNPGLAPNKERGIGLMWGPDCTEEFLKKYQLKLIIRSHEGPDAREKRDGLEGMDEGYTIDHVVDSGKLVTVFSAPDYPQFQGILTGYILKVYTDFADVENKIFVLGRGGLVVIAMLLVQTWLMLALLALVLVLQLVSFRLPRNAPGNTSDVAWKHGISVEETRRIQCKYCPKEGSVGHCLRCESKTEQKIKFNITGILKLVRKEKKSNEVVDVEKSGNICRIKGMSTQTTINILYKRNIREETCLAIVRFFSNDAIPFNVARGEEFPIMCELIAKHGQGFMPVSYHKIRVKYLKKEIGLTMQESQMPDEVVEEIGEENVVQATQERYNNKGAYVVLQPPNFENPIFHGFSAVTPRPKVNPYYDYKEVIDSDEELDLASMDSRQSNLGGGVATSKYDKVLIFGNGGDGRALKR

SEQ ID NO: 166626 - protein, 222 aa, Glycine max
  Coding DNA Sequence Number=SeqID_74941
  Gene Ontology: Mol. function=protein serine/threonine kinase activity; Cellular component=membrane fraction; Biological process =pollen maturation
  Homolog annotation: Hit_ID=A7R4D7; Match level="QueryCoverage=53%, HitCoverage=11%, E-value=3e-45, Identity=71%"; Hit description =Chromosome undetermined scaffold_658, whole genome shotgun sequence
  Pfam annotation: Domain name=C2; Domain location=104-184; Score =129.4; E_value=1.1e-35; Accession=PF00168.21; Description=C2 domain
MEAITNKKRDNRPYLDEEQKSRTSWKNGRSALEEGRSSSSRWRSTTTLRRRTTRERMRKEEERALGRRKKEKRLAEKKEEEEARGNAGSRERKKKEGKEAPGKLVVLVIEAKNLPPTDPNGLSDPYVRLQLGKHRFRTKVIKKCLNPKWDEEFSFRVDDLNEELVISVMDEDKFFNDDFVGQLKVPISIVFEEEIKSLGTAWYSLQPKSKKSKNKESGVLRC

SEQ ID NO: 166627 - protein, 79 aa, Glycine max
  Coding DNA Sequence Number=SeqID_74942
MGWFMMSQKNQLGTTVDMSLSTKNGGVGRGVRCEGTIGGLKERNDELVEGGRVWRSNQERNSRRTLTREAGERWLSAAR

SEQ ID NO: 166628 - protein, 404 aa, Glycine max
  Coding DNA Sequence Number=SeqID_74943
  Gene Ontology: Mol. function=calmodulin binding; Cellular component =integral to membrane; Biological process=response to biotic stimulus
  Homolog annotation: Hit_ID=A7PKU9; Match level="QueryCoverage=86%, HitCoverage=65%, E-value=1e-132, Identity=65%"; Hit description =Chromosome chr7 scaffold_20, whole genome shotgun sequence
  Pfam annotation: Domain name=Mlo; Domain location=3-339; Score=471.4; E_value=1.2e-138; Accession=PF03094.6; Description=Mlo family
MLKLARLHRSASKSSRSSAQRGSHERGLSVIVKTEELIRGWKAWEAETSSHGYEFANDPSRFRLTHETSFVKAHASFWTRYSIFFYIGCFFRQFYRSVGKADYLALRNGFITVHLAPGSKFNFQKYIKRSLEDDFKVVVGVSPVLWASFVVFLLLNVNGWHAMFWASLIPVVIILAVGTKLQAALANMAIEITERHAVVQGIPLVQGSDRYFWFGRPQLVLHLIHFALFQYSFGLRNCFHADYKLAVVKVALGLGVLCLCSYITLPLYALVTQMGSRMKKSIFDEQTSKALKKWHMAVKKKQGVKLGNSKVRAMDGSSTDSTIHSSGPTLHRYKTTGHSTHFVSNYDDQDDYHSDTELSSISPTPNLIVRVDHDEEEAKENEHHPTANNQEAPLHLSSLERSMK

SEQ ID NO: 166629 - protein, 347 aa, Glycine max
  Coding DNA Sequence Number=SeqID_74944
  Gene Ontology: Mol. function=sulfotransferase activity; Cellular component=integral to membrane
  Homolog annotation: Hit_ID=A7PKV3; Match level="QueryCoverage=99%, HitCoverage=82%, E-value=4e-95, Identity=47%"; Hit description =Chromosome chr7 scaffold_20, whole genome shotgun sequence
  Pfam annotation: Domain name=Mem_trans; Domain location=2-339; Score =173.6; E_value=5.2e-49; Accession=PF03547.9; Description=Membrane transport protein
MGWFMPVNIGCTFLIGGILGWILVKVLKPNLKVQGLIIASCSTGNMGNLPVVIIPAICDQKGGPFGAPDDCRNRALSYSFCSLALGGVFIWTYTYQLMQNTSLRYKAFEAAEILKIPSKDIDANAEARLLKQNDGYAVDTENQILVDQGPSIATKNMEKCFCHRMMETLVQILAELMSPPTIATRNFTCFHDQFLGFLFGGVKWLRNLIIGHDAPLKVIQDSIQLLGDGTIPCITVLLGGNLTQGMRSSSIQPLILICIIIARLFLLPAIGFFVVKAAANFGFLPLDPLFQYVLVMQYAMPPAMNISTMAQLFDVGTEEFSVILLWTYGASTIALTLWSTFLIWIFS

SEQ ID NO: 166630 - protein, 116 aa, Glycine max
  Coding DNA Sequence Number=SeqID_74945
  Homolog annotation: Hit_ID=Q0GPF5; Match level="QueryCoverage=75%, HitCoverage=26%, E-value=2e-07, Identity=40%"; Hit description=BZIP transcription factor bZIP131
MVKMILANRQSSAQLMKMRIRYIIEWRKLKKLKIKVAKLIAKLAMLKRDCIELAEENKESMMRLEALTQEAQLQDEVYQAQLEEIQSLKEKLNWTKLPPNLWTSISGEEARNNSSN

SEQ ID NO: 166631 - protein, 527 aa, Glycine max
  Coding DNA Sequence Number=SeqID_74946
  Subcellular localization annotation: CTP_CleavageSite=43; ConfidenceScore=5.13e-01
MLKSGGTCKKDSDKQVNDAQSSSTKSNSTAKDSELLAALNMLMQSEGSPISTGCEMLNTKLLEELFVVLFDELSSVVRHDGLRGSALIHLVKYSTVMRRNLTYPLAMGNGSRMSIPHMAKGQGDVMLWSASSGRSKWETSIHWEQSDLSIPRINSIVLFPVDTDQFFLLEMFQELFDKVVVLLYLCLFGLEDLVNLLRDELRVVPAPKLLLPVKLYLLLDGDVIWSFKGYACAAALAIRGFVHIQHPPVFTVVLGKGERIELIAESKIDRYSNNSTPDVDQDLLAAHGNDCFTLVWVGLDSPTGNSELGIHKCHQQVDRCKEAVHDFFDETDIDKLLSFFLYNLLALFSELLLPLCHGFGFRKNKEFVSLRMYRTSNVLDNSPLSKVVANFTASWDFPDVLIGDANRNHHWVILLGINSMNVMWFTLLIALNHGSDQELYSMIHHGIGGMKRSPFFPQQSWTLENTSSGTSPPPLPMSAMKEIALNQQDEGMWICNVGCLNFWSGYAGKILRKNEEDLEDEGLLSPR

SEQ ID NO: 166632 - protein, 218 aa, Glycine max
  Coding DNA Sequence Number=SeqID_74947
MKMNLSLMSGHPTPLIRPMSKCWTRITVVQEIGGHIKKREGGMWQPVSGADGVHRRDADNRGNHGYFGGEGINRCYENQTKPQNGKVSGSTNKNNGKQNRVTLKHQAVKSKDFAGETLLLQHLASHTKGLKTWHSQPTTKDGSYGIEQEFGAGPAHRPTNSKTHARERERTRICNNASTRGGLRESLRVSELQQRVRARERSVSVRSNGDFRFPFLLD

SEQ ID NO: 166633 - protein, 323 aa, Glycine max
  Coding DNA Sequence Number=SeqID_74948
  Gene Ontology: Mol. function=nucleic acid binding; Cellular component= ribonucleoprotein complex; Biological process=regulation of RNA splicing
  Homolog annotation: Hit_ID=A7QWN7; Match level="QueryCoverage=79%, HitCoverage=100%, E-value=1e-125, Identity=86%"; Hit description =Chromosome chr4 scaffold_205, whole genome shotgun sequence
  Pfam annotation: Domain name=RRM_1; Domain location=118-185; Score =25.0; E_value=0.00028; Accession=PF00076.13; Description=RNA recognition motif. (a.k.a. RRM, RB
  Pfam annotation: Domain name=RRM_1; Domain location=236-306; Score =43.4; E_value=7.9e-10; Accession=PF00076.13; Description=RNA recognition motif. (a.k.a. RRM, RB
  Pfam module annotation: Pfam domain module=RRM_1::RRM_1; Domain location=118-185::236-306
MENLRGTKDFGMKIVFLSFGSHKKEKERFTFRVITALDPYRVPPSTEAPFARSFAEHGSMYGPRGAMLGSGGVSDGYEVGSKRQRMMESNPYFAVSSGTGNLPYGYAGGFQPPPFPVVRLRGLPFNCTDIDILKFFAGLTIVDVLLVNKSGRFSGEAFVVFAGAMQVEFALQRDRQNMGRRYVEVFRCKKQDYYNAVAGEINYEGIYDNDYHGSSPPPSRLKRFNDKDQMEYTEILKMRGLPFQVTKSQIVEFFKDFKLIEDRVHIACRPDGKATGEAYVEFVSAEEAKRAMSKDKMTIGSRYVELFPSTPDEARRAESRSRQ

SEQ ID NO: 166634 - protein, 77 aa, Glycine max
  Coding DNA Sequence Number=SeqID_74949
  Subcellular localization annotation: CTP_CleavageSite=43; ConfidenceScore=5.04e-01
MDTRLRVIGDPMNGVQRSKSIGVHKVRGSFRCTRSEPTGCRILGEERNQNFLPVQWGRFLSKDSVYALQPRLFNFFP

SEQ ID NO: 166635 - protein, 521 aa, Glycine max
  Coding DNA Sequence Number=SeqID_74950
  Gene Ontology: Mol. function=RNA binding; Cellular component =endosome; Biological process=protein targeting to vacuole during ubiquitin-dependent protein catabolic process via the MVB pathway
  Homolog annotation: Hit_ID=A7PGV7; Match level="QueryCoverage=87%, HitCoverage=92%, E-value=1e-152, Identity=59%"; Hit description =Chromosome chr17 scaffold_16, whole genome shotgun sequence
  Pfam annotation: Domain name=Mov34; Domain location=363-465; Score =25.1; E_value=8.1e-05; Accession=PF01398.12; Description=Mov34MPNPAD- 1 family
MSEKKKSVPQYLKGEGFLSVHIGILKVACLGCSYLESAVGKWITLSYVMMGCKALTGLLVLEFHADIFRAEKNIIDLYVMLLRFSSLVSETIPRHRDYRSSPQRQKESLKKKLLISLNELENLKPVVQQKINELNNKFAYQQNGQGKFISNNSLDFSPVKKLTSASYGLIKAVRPTAGEFVYQGSRSQQFSYVRPVEEHVRRLSLTLPPPKEETLSRHSILGPNGLKGHWRPPIIDKGIKYPSNIDLSPVELPSLQQSMEDESLKKKDNSIAEHHKSELASILTQSEDCQLQPHPQPEPDQEPPSLISFETTETSAQIEVIRQPSPPPVLAEVQDLVPAVSPCVNEAGCKTEIPSLDNSVHAEDPLQLHISAALMESFMKLAKSNTKKNLETCGVLAGLLKNRKFYITALIIPKQESTSDSCQTTNEEEIFEVQDKRSLFPLGWIHIMLPESVAIVMAPRDSSRNHGIFRLTTPGGMSVIKQCDQRGFHPHSQPPDGGPIYKTCTDVYMNPDLKFEVIDLR

SEQ ID NO: 166636 - protein, 631 aa, Glycine max
  Coding DNA Sequence Number=SeqID_74951
  Gene Ontology: Mol. function=transcription coactivator activity; Cellular component=cytoplasm; Biological process=transcription from RNA polymerase II promoter
  Homolog annotation: Hit_ID=Q949K3; Match level="QueryCoverage=97%, HitCoverage=97%, E-value=0.0, Identity=56%"; Hit description =Suppressor-like protein
  Pfam annotation: Domain name=SGT1; Domain location=19-626; Score =902.7; E_value=1.7e-268; Accession=PF07093.2; Description=SGT1 protein
MEFPSSSSIFSPRPSDDTVFYAIYPDSPTTTSTATLRSLHLKILETLSPFTEDYIWQHQPFTLSVSTPPNPSCPCPSSSSHLLHLHGRLRFGDNLDDEWFAVFLLFRISQRFPSLSIRIWDSDGDFLLIEAAFHLPRWLNPDTAHHRLFLRNGSLHIVPRNRLTNPSLIDSLNFVASSPHESLASDAIQRAIKKRISNYPEQARNNMHRVRVRVPVSAASILKHEPRLISLAVEGFYDRDIDTMKFAARMERFVERGKTEELVCVSVKMSRAMYAQLAQQRFQAPKCYPEMPARSEREGFAEAELGMKIACGLEMMYQQRKRDGEEGKGSSWEAFRKSLENSGYFQGQLPGSSEYQRLMQSAQEYYRSTSLHSKASDLLNAPVRRIDEILALPHSVDDFKDQEVPPSDDDSWLYGGEEELNSVLMERQKEMELYDLKHKKKGKAKEGQDAGPSSASNADEFDPSDIAKTMQAFVHKLSSYKGAEAPEDRNKEVNLDVDQFIKDMESIMMHSDGEVANSNIEEGSSSDLDFDNSDDSDIVELDEDNEDREDIFMRSYSDAMNEELKATTLQKSFVRANEQIPKKDQGTSNASEHIMDEDFSPVDVDQGLPGPASNLLGLMGVQLPQDGKKGK

SEQ ID NO: 166637 - protein, 598 aa, Glycine max
  Coding DNA Sequence Number=SeqID_74952
  Gene Ontology: Mol. function=transcription factor activity; Cellular component=nucleus; Biological process=regulation of transcription, DNA-dependent
  Homolog annotation: Hit_ID=A7R177; Match level="QueryCoverage=86%, HitCoverage=96%, E-value=1e-109, Identity=48%"; Hit description =Chromosome undetermined scaffold_340, whole genome shotgun sequence
  Pfam annotation: Domain name=AP2; Domain location=410-462; Score =65.3; E_value=2e-16; Accession=PF00847.11; Description=AP2 domain
MARASTNWLSFSLSPMDMLRTPEPQFVQYDAASDTSSHHYYLDNLYTNGWGNGSLKFEQNLNHSDVSFVQSSSQSVSHAPPKLEDFLGDSSAVMRYSDSQTETQDSSLTHIYDHHHHHHHGSSAYFGGDHQDLKAITGFQAFSTNSGSEVDDSASIGKAQGSEFGTHSIESSVNEFAAFSGGTNTGGTLSLAVAQSSEKAVAAAAESDRSKKVVDTFGQRTSIYRGTDGQEDMKRIYGTIVAEGRVKLEKGVKTEKWLACIEGAINGLEYGKAAFDHITTHHSLLLKLVLAHIEVVERPLLHEGFVAVGGYDKEEKAARSYDLAALKYWGPTATTNFPKYALLGTQKVEAKVPQKGNIGSSDQRGMNEKRVVVWWVSNYSKEVEEMKHVTKQEFIASLRRKSSGFSRGASIYRGVTRHHQQGRWQARIGRVAGNKDLYLGTFATEEEAAEAYDIAAIKFRGANAVTNFEMNRYDVEAIMKSSLPVGGAAKRLKLSLESEQKALPVSSSSSSSQQQNPQCGNVSASINFSSIHQPIASIPCGIPFDSTTAYYHHNLFQHFHPTNAGTAASAVTSANANALTALPPTAAAEFFIWPHQSY

SEQ ID NO: 166638 - protein, 428 aa, Glycine max
  Coding DNA Sequence Number=SeqID_74953
  Gene Ontology: Mol. function=transferase activity; Cellular component= membrane; Biological process=RNA-dependent DNA replication
  Homolog annotation: Hit_ID=Q9SZK4; Match level="QueryCoverage=84%, HitCoverage=80%, E-value=1e-179, Identity=81%"; Hit description =Putative uncharacterized protein F20D10.160
  Pfam annotation: Domain name=Exostosin; Domain location=90-393; Score= 313.2; E_value=5e-91; Accession=PF03016.6; Description=Exostosin family
  Subcellular localization annotation: CTP_CleavageSite=52; ConfidenceScore=5.07e-01
MMTGKQGFFSLRGSLLFLAVLTLLSFTYLSLKYSTPTPQVTNLSVEKLNDAPGTEKEEEGGGEEEEVPDTFHSPRVFKLNYEEMEKKFKVYIYPDGDPNTFYQTPRKLTGKYASEGYFFQNIRDSRFRTENPDEAHLFFIPISCHKMRGKGTSYENMTIIVQNYVESLISKYPYWNRTLGADHFFVTCHDVGVRATEGLEFLVKNSIRAVCSPSYDVGFIPHKDVALPQVLQPFALPAGGNDIENRTTLGFWAGHRNSKIRVILARVWENDTELDISNNRISRATGHLVYQKRFYRSKFCICPGGSQVNSARIADSIHYGCIPGLILFCILSLLKLYTYVSSVILSNYYDLPFNDILDWNKFAVVLKESDVYQLKQILKNISDAEFVTLHNNLVKVQKHFQWNSPSIRFDAFHLVMYDLWLRHHTIKY

SEQ ID NO: 166639 - protein, 617 aa, Glycine max
  Coding DNA Sequence Number=SeqID_74954
  Gene Ontology: Mol. function=RNA binding; Cellular component =ribonucleoprotein complex; Biological process=gynoecium development
  Homolog annotation: Hit_ID=Q9ZQ53; Match level="QueryCoverage=92%, HitCoverage=97%, E-value=3e-82, Identity=35%"; Hit description =Putative RNA-binding protein
  Pfam annotation: Domain name=KH_1; Domain location=153-217; Score =52.5; E_value=1.5e-12; Accession=PF00013.20; Description=KH domain
  Pfam annotation: Domain name=KH_1; Domain location=292-346; Score =34.2; E_value=4.8e-07; Accession=PF00013.20; Description=KH domain
  Pfam annotation: Domain name=KH_1; Domain location=384-457; Score =23.5; E_value=0.00078; Accession=PF00013.20; Description=KH domain
  Pfam annotation: Domain name=KH_1; Domain location=51-126; Score =24.1; E_value=0.00051; Accession=PF00013.20; Description=KH domain
  Pfam annotation: Domain name=KH_1; Domain location=545-607; Score =45.3; E_value=2.2e-10; Accession=PF00013.20; Description=KH domain
  Pfam annotation: Domain name=KH_2; Domain location=153-202; Score =7.1; E_value=0.052; Accession=PF07650.8; Description=KH domain
  Pfam module annotation: Pfam domain module=KH_1::KH_1::KH_1::KH_1::KH_ 1::KH_2; Domain location=153-217::292-346::384-457::51-126::545 -607::153-202
  Subcellular localization annotation: CTP_CleavageSite=57; ConfidenceScore=5.87e-01
MQDPATSDTTDHQTTPSPSPSPKRKTTTTTTTTNRSNNKRPVFKVLPGQIAFRLVCHASIVGGLIGSSGSIVSQLRRETACKIHCEDSLSSAEDRVILVIGSVSPRKGLQLGDGGEVEVSSAQEAIVRVFERVWGLEAEKGVNSNRAVNSEVFSKLLAHTSQIGAVVGKGGKNITAIRNSTGAKIRVCPPPQCATKDEELVLITGGILAVKKALISVSHCLQDCPPLCKVPVSSSIPTVSSFDRSSSDPNAELFPRLNSLLTSMEGLSIYERTTNSNESSNRDSKGGEHEVVFRLLCSNNVAGSVIGKRGAIVRALESKTGASIIFAAPLSEHAERIVTISAIESLESCNSPAQDAVILVFARIIEDHIGKGFLQVSSMESPVTARLLVATSTVNSWSGNEGQVILELREVTGADIQILHGESVPNGASDDDVVVQRSGFVQITGEYRCVQNALYKITSRIRDNLSPNEAVTEARPKSNWKVNKDPVKGKPFSRGKSAFPSGRFLPRNAGVHAETILQNGELHTDLSENLERGRGNMFATVTNTTVEIIVSEHVFGSVYGEDGGNLDRIRQISGATVTVYDPSVGTSGGKVVISGTPDQTLAAQSLLQAFIQTGEVS

SEQ ID NO: 166640 - protein, 223 aa, Glycine max
  Coding DNA Sequence Number=SeqID_74955
  Gene Ontology: Mol. function=oxidoreductase activity; Cellular component=cytoplasm; Biological process=metabolic process
  Homolog annotation: Hit_ID=Q9ZRF1; Match level="QueryCoverage=77%, HitCoverage=47%, E-value=4e-60, Identity=63%"; Hit description =Probable mannitol dehydrogenase
  Pfam annotation: Domain name=ADH_N; Domain location=52-167; Score =111.3; E_value=3e-30; Accession=PF08240.3; Description=Alcohol dehydrogenase GroES-like domai
MKETQEMIDFAAEHYVKPDIEVIPVDYTFGWAARDTLGLLSPFNFSIRKTGEKDVRFKVLYCGICDSDLHMVKNEWAFCTYPVVPGHEIVGVVTEVGNQVEKFKVGDKVGVGGMVDSCRSCQNCDDNLEIYCPKYTFTFGAKHKDGTTTYGGFSDSMVADEHFVVRIPDGLPLDAAAPLLCAGITAYSPLRYFALDKPAIHVGVVGLGGLGSYGCQVCQSFWG

SEQ ID NO: 166641 - protein, 283 aa, Glycine max
  Coding DNA Sequence Number=SeqID_74956
  Gene Ontology: Mol. function=manganese ion binding; Cellular component=cellular_component; Biological process=defense response
  Homolog annotation: Hit_ID=A9YWS6; Match level="QueryCoverage=100%, HitCoverage=100%, E-value=7e-87, Identity=58%"; Hit description =Lectin
  Pfam annotation: Domain name=Lectin_leg-like; Domain location=53-281; Score=-86.5; E_value=0.0013; Accession=PF03388.4; Description=Legume -like lectin family
  Pfam annotation: Domain name=Lectin_legB; Domain location=44-280; Score=277.2; E_value=3.3e-80; Accession=PF00139.10; Description =Legume lectin domain
  Pfam module annotation: Pfam domain module=Lectin_leg-like::Lectin _legB; Domain location=53-281::44-280
  Subcellular localization annotation: CTP_CleavageSite=40; ConfidenceScore=5.14e-01
MAFSNSKPNLLQSLSPLIKFLIPFLLLQHSVNSQQPPSPMSAYETVGFGFGFFDKDDPNVFLLGNASVSGGALRLTNTDQLGKPVPHSVGRALHVTPIHLWNKNNGELADFSSGFSFVVNPKGSTLRGDGFAFFLAPANLNFPKNSSGGYLGLFNPETALDPSKNQIVAIEFDSFTNDWDPNSPNQSPHVGIDVDSIKSVATVPWPSELEPDNAVAHASLNYNSESKSLSVFVGYPDNRNATVSTIVDLRNVLPEWIRVGFSASTGDLVETHDILNWSFEAAL

SEQ ID NO: 166642 - protein, 271 aa, Glycine max
  Coding DNA Sequence Number=SeqID_74957
  Gene Ontology: Mol. function=sugar binding; Cellular component =cellular_component; Biological process=biological_process
  Homolog annotation: Hit_ID=A9YWS2; Match level="QueryCoverage=98%, HitCoverage=96%, E-value=2e-98, Identity=66%"; Hit description=Lectin
  Pfam annotation: Domain name=Lectin_legB; Domain location=27-268; Score=246.4; E_value=6.4e-71; Accession=PF00139.10; Description =Legume lectin domain
  Subcellular localization annotation: CTP_CleavageSite=22; ConfidenceScore=5.27e-01
MANHAAQNPISVFLMTFLLLITSSKSDSFSFNFPSFEPGVRNILVGDDAKTTGGVLQLTKKDQSGNPTQHSVGLSAYFGPLHLSDRRTGRVADFATEFSFVVNTKGAPLHGDGFTFFLASIDYEFPDKSSGGFLGLFNKKTAFNTSLNQVVAVEFDSFANEWDPNFPESDSPHIGIDINSIRSVATAPWPLDIQPQGSIGKAQISYQSSSKILSVSVDYPNSPVKLKPTVLSYPVNLGAVLSEWVLIGFSGATGDLVETHDILSWSFNSFL

SEQ ID NO: 166643 - protein, 515 aa, Glycine max
  Coding DNA Sequence Number=SeqID_74958
  Gene Ontology: Mol. function=glycine hydroxymethyltransferase activity; Cellular component=mitochondrion; Biological process=one -carbon compound metabolic process
  Homolog annotation: Hit_ID=P34899; Match level="QueryCoverage=100%, HitCoverage=100%, E-value=0.0, Identity=84%"; Hit description=Serine hydroxymethyltransferase, mitochondrial precursor
  Pfam annotation: Domain name=Aminotran_1_2; Domain location=73-434; Score=-89.1; E_value=0.0081; Accession=PF00155.12; Description =Aminotransferase class I and II
  Pfam annotation: Domain name=SHMT; Domain location=53-451; Score =966.1; E_value=1.4e-287; Accession=PF00464.10; Description=Serine hydroxymethyltransferase
  Pfam module annotation: Pfam domain module=Aminotran_1_2::SHMT; Domain location=73-434::53-451
MAMAMALGRLSSSFNKPLRPLFNAGSVYYKSSLPAEAAYDNEKSCDTELNAPLEVVDPEIADIIELEKARQWKGLELIPSENFTSVSVMQAIGSIITNTRNEGYPGARYYGGNEYIDMAETLCQKRALEAFRLDPAKWGVNVQPLSGSSANFQVYTALLKPHDRIMGLDLPHGGHLSHGYQTDTNKVSAVSLFFETMPYRLNENTGHIDYDQLESTAKLFRPKLIVAGATAYARLYDYARIRKVCDKQKAVLLADMAHISGLVAAGVIPSPFDYADVVTTTTHKSLRGPRGAMIFFRKGVKEINEKGEEVMYDYEDKINRAVFPGLQSGPHFHSITGLAVALKQATTPNYRAYQEQVLRNCSKFAQALSEKGYELVSGGTENHLLLVNLKSKGIDGSRVQKVLESVHIAANKNTVPGDVSAMVPGGIRMGTPALTSRGFAEEDFVMVAEFFDAAVNLAVKIKSETKGSKLKDFLATIQSSSYFQSEIAKLRHDVEEYAKQFPTIGFDKETMKYNK

SEQ ID NO: 166644 - protein, 106 aa, Glycine max
  Coding DNA Sequence Number=SeqID_74959
  Gene Ontology: Mol. function=identical protein binding; Cellular component=cytoskeleton
  Homolog annotation: Hit_ID=Q94JY4; Match level="QueryCoverage=50%, HitCoverage=63%, E-value=2e-16, Identity=79%"; Hit description =Protein BRICK 1
MEISIYTNPAILASTQVNWKKIKSAECRVHQHWIWKRVKEDMARAGGITNAVNVGIAVQADWENREFISHISLNVHRLFDFLVQFGTYTSPFLSAKRPITCRFIFP

SEQ ID NO: 166645 - protein, 109 aa, Glycine max
  Coding DNA Sequence Number=SeqID_74960
  Gene Ontology: Mol. function=catalytic activity; Biological process =metabolic process
  Homolog annotation: Hit_ID=A2Q5Z6; Match level="QueryCoverage=89%, HitCoverage=30%, E-value=5e-18, Identity=51%"; Hit description =Phosphoglycerate/bisphosphoglycerate mutase
MNAKRKEYMICVLSKRRILMRHEESLGNRNTTAYTTISDHNIQSTTQGMTQTLHVSEHLHYVIDNDRCSHDWRVQFYVFPYAYIRSTLCELRWCFLKKWIISVREESRI

SEQ ID NO: 166646 - protein, 60 aa, Glycine max
  Coding DNA Sequence Number=SeqID_74961
  Subcellular localization annotation: CTP_CleavageSite=48; ConfidenceScore=5.29e-01
MGGDGLGINMGNKSTASLHGIVQRLSHSHVMVTTDPCNSVRSRTVSISAFALTELHSWLL

SEQ ID NO: 166647 - protein, 815 aa, Glycine max
  Coding DNA Sequence Number=SeqID_74962
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9ZT82; Match level="QueryCoverage=99%, HitCoverage=46%, E-value=0.0, Identity=76%"; Hit description =Putative glucan synthase component
  Pfam annotation: Domain name=Glucan_synthase; Domain location=1-693; Score=948.1; E_value=3.6e-282; Accession=PF02364.6; Description=1,3 -beta-glucan synthase component
MRREGLAKDSDIWTDKLRDLRLWASYRGQTLSRTVRGMMYYYRALKMLTFLDSASEMDIREGARELVSMRHDDLESSNSKSPSSKSLSRASSSVSLLFKGHEYGTALMKFTYVIACQIYGTQKEKKDPHADEILYLMQNNEALRVAYVDEKTTGRDEKEYYSVLVKYDQQLQMEVEIYRVKLPGPLKLGEGKPENQNHAIIFTRGDAVQTIDMNQDNYFEEALKMRNLLEEYRSYYGIRKPTILGVREHIFTGSVSSLAWFMSAQETSFVTLGQRVLANPLKVRMHYGHPDVFDRFWFLTRGGISKASRVINISEDIFAGFNCTLRGGNVTHHEYIQVGKGRDVGLNQVSMFEAKVASGNGEQVLSRDVYRLGHRLDFFRMLSFFYTTVGFFFNTMVVVLTVYAFLWGRLYLALSGVEESMESNSNDNKALGTILNQQFIIQLGLFTALPMIVENSLEHGFLQAIWDFLTMQLQLSSVFYTFSMGTRSHFFGRTVLHGGAKYRATGRGFVVEHKRFAEIYRLFARSHFVKAIELGLILVIYASHSPVATDTFVYIALTITSWFLVASWIMAPFVFNPSGFDWLKTVYDFDDFMNWIWYSGSVFAKAEQSWERWWYEEQDHLKVTGLWGKLLEIILDLRFFFFQYGIVYQLGISDHNTSIAVYLLSWIYVFVVSGIYAVVVYARNKYAAKEHIYYRLVQFLVIILAILVIVGLLEFTKFKFMDIFTSLLAFIPTGWGLISIAQVFRPFLQSTIIWDGVVSVARIYDIMFGVIIMSPVALLSWLPGFQNMQTRILFNEAFSRGLRIFQIVTGKKSQS

SEQ ID NO: 166648 - protein, 277 aa, Glycine max
  Coding DNA Sequence Number=SeqID_74963
  Gene Ontology: Mol. function=catalytic activity; Cellular component =plasma membrane; Biological process=protein amino acid dephosphorylation
  Homolog annotation: Hit_ID=A9PCG7; Match level="QueryCoverage=85%, HitCoverage=84%, E-value=2e-91, Identity=70%"; Hit description =Putative uncharacterized protein
  Pfam annotation: Domain name=PP2C; Domain location=32-260; Score =152.8; E_value=9.1e-43; Accession=PF00481.12; Description=Protein phosphatase 2C
MTGKDILHIMKVKAGFAPPDTGKGKGKISKHITHGFHLMKGKSAHPMEDYLVSEFKQEKDRELGLFAIFDGHLGHDVASYLQNHLFQNILKEHDFWTETESAVKRAYLETDEKILEQALVLGRGGSTAVTAILIDGQKLIVANVGDSRAVICENGKARQLSVDHEPSKEKKWIERRGGFVSKIPGDVPRVDGQLAVARAFGDRSLKMHLSSEPDVLVEEVDPHTEFLILASDGIWKDFIGNHGYVKRRSSGIYSTNKGCSSCSKALDRRGSFQAKQG

SEQ ID NO: 166649 - protein, 491 aa, Glycine max
  Coding DNA Sequence Number=SeqID_74964
  Gene Ontology: Mol. function=DNA binding; Cellular component=nucleus; Biological process=regulation of transcription
  Homolog annotation: Hit_ID=A7PJ92; Match level="QueryCoverage=98%, HitCoverage=100%, E-value=1e-102, Identity=48%"; Hit description =Chromosome chr12 scaffold_18, whole genome shotgun sequence
  Pfam annotation: Domain name=Myb_DNA-binding; Domain location=209 -259; Score=35.9; E_value=1.4e-07; Accession=PF00249.22; Description =Myb-like DNA-binding domain
VLILGLMLAVSPLRSNIKDEKKQGEMEGNFSMATTTTDDVVFGDLSEGNLLESINFDELFVGIDIHGDVLPDLEMFGEFSVDVSTGEESSEMNSSAKSSKLENDQNVIATTSKKEEEEDKTSCNASGQDLGSNRGEEIVSERDESVVVNPAPKDGGKGRKSSSAQSKNNSSSNNNPQGKRKVKLASFSEASNGSCHETYESCATELTLKVDWTPELHRRFVQAVEQLGVDKAVPSRILEIMGIDCLTRHNIASHLQKYRSHRKHLLAREAEAASWSQRRQLCAGGGKREGSPWLAPTMGFPPMTPPMHHFRPLHVWGHPSMDQSFMHMWPKHLPNSPPLSWPPPAAPPQEPSFWHQLPYIYLMNTPLKQVPNALIPGTACFPQLLTPTVTTHYKPYYYFGTIGNANIMQRFGSPPVPGIPPHAMYKADHDIGLPGPLFDFYPSKECIDAAIGDVLSKPWLPLPIGLKAPALDSVMSELQRQGIPNIPPSSA

SEQ ID NO: 166650 - protein, 59 aa, Glycine max
  Coding DNA Sequence Number=SeqID_74965
MGWEGEGKGWKGDCGRRRGREGEGKERVLGVEWYFSLESGGKSLQGAMEKTKEVAKEEV

SEQ ID NO: 166651 - protein, 80 aa, Glycine max
  Coding DNA Sequence Number=SeqID_74966
MVSTLSGLRRKTLFEGFNPSIAVMTDIDTLQQLQNCIAEMERHHEEELRKLKANHNHLEAHGGLLVNIPSLTASWKLTYP

SEQ ID NO: 166652 - protein, 181 aa, Glycine max
  Coding DNA Sequence Number=SeqID_74967
MHGAIGDGAFDRDEPRGCVATVTGDSSDVATCNGALAMQGGVAGQTSASLRVCFLQVQLCSFAFCRMNSVITVLYFNGRIYEDNDGVIFEGSKKAIQIKRGISFNALKKKIGDKDVAGGSMFHSANSLTSCGNYLSNDETQPATNMSNLHIDEDDDDHDDDDYLVSNSYVEESVDEDDSVE

SEQ ID NO: 166653 - protein, 272 aa, Glycine max
  Coding DNA Sequence Number=SeqID_74968
  Gene Ontology: Mol. function=magnesium ion binding; Cellular component=membrane; Biological process=metabolic process
  Homolog annotation: Hit_ID=A7PXM5; Match level="QueryCoverage=83%, HitCoverage=71%, E-value=1e-32, Identity=34%"; Hit description =Chromosome chr12 scaffold_36, whole genome shotgun sequence
  Pfam annotation: Domain name=Terpene_synth_C; Domain location=57-233; Score=116.9; E_value=6.1e-32; Accession=PF03936.7; Description =Terpene synthase family, metal binding domain
MRKDSYAGKAKDVMELLEASHLNGPCLGASFPWESTIWFEVKWHIKQYKIEKYMDPILLELDTLNFNMIQAKLQMENLGIKEDLSLARNRLVESFLCAAGVAFEPNYTSGRKWLTKVIIFVLVIDDVYDIYASFEELKPFTMTFESDSTIHSYFVAKNQVTDMEDFLPTYEDLVYNVSLLIQLCNDLGTTVAERERGDTASSILCYMNEMNVSEEKARKKIQDMINKAWKKINGHCSTQVASMKPFLNQAINAARMAHTLYQNEDAWFWYPG

SEQ ID NO: 166654 - protein, 105 aa, Glycine max
  Coding DNA Sequence Number=SeqID_74969
MQHQQPHTKDGRCGDSTFQLSNSGLFYFISGNLNNCKNGQKLNIVLVMAVRQPIPKAAPPPASILPLQKIPATDLTSSAPTPTTDKSGSGRVGPMDEDLWFELMV

SEQ ID NO: 166655 - protein, 530 aa, Glycine max
  Coding DNA Sequence Number=SeqID_74970
  Gene Ontology: Mol. function=protein kinase activity; Cellular component=nucleus; Biological process=protein amino acid phosphorylation
  Homolog annotation: Hit_ID=A7PJ68; Match level="QueryCoverage=90%, HitCoverage=87%, E-value=1e-164, Identity=58%"; Hit description =Chromosome chr12 scaffold_18, whole genome shotgun sequence
  Pfam annotation: Domain name=Mad3_BUB1_I; Domain location=10-123; Score=63.2; E_value=8.8e-16; Accession=PF08311.3; Description =Mad3BUB1 homology region 1
  Pfam annotation: Domain name=Pkinase; Domain location=238-529; Score=- 46.7; E_value=8e-06; Accession=PF00069.16; Description=Protein kinase domain
  Pfam module annotation: Pfam domain module=Mad3_BUB1_I::Pkinase; Domain location=10-123::238-529
MLSYSPPRFRIAAVDAHHDPLLPFLRSIKKALEASDDSASSLSNLLKDCIRNFKNNDRYRNDVRFLKIWLLYMGVSDDFDSVFKEMLDSNVCTNNSSLYVWSASFFELKGRLHDALTIYQLGICRNTEPIEWLKKARTLFLSRISEIQNAASTQKVDDKESKNLEDNGINPWGTSTMDSLLKKIYPLIMKFDGYRSSTKPYTGKVALSTLKNSSRNKVLEIDNHVTEWFILELGGMKYHIKGCAGQGGFAQVYKANVDSDPDNVVALKIQKPAFPWEFYVYRLLDKRILDRERSSYGFAHRIHVYSDCSILICDYLANGTLQDVINSYVVIGKSMEEVLCIYYTIEMLHMVETLHGVGLIHGDFKPDNLLIRYARGDLTEDGFLSRSGPWCDQGLCLVDWGRGIDLHLFPDHTLFKGDCKTSGFRCIEMLEDKPWKFQASHLLNYTTNAMELIIYRLLSFRSLSPANSYWNIELWKTFFTKMLNQYPHDDDRSLLQDLKKSFQDYLSSNPQLIKKLKELLSKQRASLCSA

SEQ ID NO: 166656 - protein, 49 aa, Glycine max
  Coding DNA Sequence Number=SeqID_74971
MVSEFLVVEDDIIETENGNSSYNDNLSMDDRKRMVRKVVTVKVMEEGKE

SEQ ID NO: 166657 - protein, 230 aa, Glycine max
  Coding DNA Sequence Number=SeqID_74972
  Gene Ontology: Mol. function=electron carrier activity; Cellular component=anchored to membrane; Biological process=electron transport
  Homolog annotation: Hit_ID=Q682V1; Match level="QueryCoverage=45%, HitCoverage=28%, E-value=6e-31, Identity=59%"; Hit description =Predicted GPI-anchored protein
  Pfam annotation: Domain name=Cu_bind_like; Domain location=35-118; Score=112.5; E_value=1.3e-30; Accession=PF02298.8; Description =Plastocyanin-like domain
MAIFHRFLGLLILMAPMLLLHVVARQFDVGGKDGWVLKPTEDYDHWAQRNRFQVNDTLHFKYNKGIDSVVVVKKEDFDSCNINNPIQKMDGGDSTFQLSNSGLFYFISGNLNNCKNGQKLIVLVMAVRQPISKAAPPPASILPPQKIPATDLTSPAPTPTTDNSGSGRVGVSVSVGIVFMFIAFVGVLVCVLFAIESGSSSLHQKKKYQELWQSVATMPHSYVSICNTKE

SEQ ID NO: 166658 - protein, 57 aa, Glycine max
  Coding DNA Sequence Number=SeqID_74973
KEQNRLRPRSEVKTSQWQKSTKVLRDGGEWRVATNQSSPLPGAGPAENIAARQSSIL

SEQ ID NO: 166659 - protein, 85 aa, Glycine max
  Coding DNA Sequence Number=SeqID_74974
  Subcellular localization annotation: CTP_CleavageSite=35; ConfidenceScore=5.09e-01
MDMHIGGLISGQMTMMAQSNSSHLGFPALITALCRSRGVGSDALTSYENLRSVIDLAYIIRNYWNANDQTINFPEARKTKLRAAD

SEQ ID NO: 166660 - protein, 37 aa, Glycine max
  Coding DNA Sequence Number=SeqID_74975
  Gene Ontology: Cellular component=integral to membrane
  Homolog annotation: Hit_ID=Q2PMP0; Match level="QueryCoverage=91%, HitCoverage=1%, E-value=9e-12, Identity=100%"; Hit description =Putative membrane protein ycf1
NSIAEYPDQRNLESSISNQEKDIENDYVGSDSEKNSK

SEQ ID NO: 166661 - protein, 473 aa, Glycine max
  Coding DNA Sequence Number=SeqID_74976
HVVVGGDDGDIAAHHVFQRRLVIGLTGGEAVGQVAAGQLRAVDGLGTGRLDARQIGGAAGLGTVDDALRDTGQGWFVGAGEFAEQPKTGVVDVAQHDGAAGDADSQRGQLPAVQPELAGDRQHQADGGQTGDGGRALNHPHHGGERKGGHGDRQAGADHRVTQRRPYAGIHQDLFEHPAGAGHQQDDPGRLHRGGADGQRLFVAHAARLRQAVNHDQAGQQNGGERVADKLQPLLQLRAGGDQPRADGLHADQHQRAQHQRQAEAERRQIALGQRRLVLFRWHRPVDEAADKAAVQRAGDQHADHRRHQADGDHPAEVGLHLRSQQHRHRPRQQEGGGGGHAGEQRNGQLDDIAVGAARHGEHDADQQHHRHVEEQRQRADQAGDAERVVRLALSESFQQLRRNLIERADLMQDLAEHCPERHHDRQEAQRVAHAFLHGVGNMVQRHAGEDAGGDGHQHQRDEGVHARLHHQE

SEQ ID NO: 166662 - protein, 326 aa, Glycine max
  Coding DNA Sequence Number=SeqID_74977
MLVQHLVADAVGVFAHLRQGGVSQVAAHVLAGVRHVVAVIAVGGDIVQQRRQRAVAGAVGVHDLLRPAHIRRDVRINAQRIFTVFAAHGAAEFVAVELGDMPRQQRVLGLALVGLFGVARHIQAVRPGGAQHQIHPLQRHVRGGQRIAQPGQLQRFVFVHRQNRHVFLQEVAPPLRVVGNDVLGAQRQHHRHVVLFGVFDRLQGGGLHRLPFLAAHQIRAQHQRRRAGDHLFRNAFRAQLIHLARVDGEGALAAFANQRETAADGAVYALQIVEIGTAGGIAQVTVGVAADFHVAAHHAEQHRADRPPAPNSCAWVLPMVPPATDG

SEQ ID NO: 166663 - protein, 64 aa, Glycine max
  Coding DNA Sequence Number=SeqID_74978
MPLSMCRRLGELEIMSTRMTLQLADHFITRPYGVIEDVLVRDVCLQVKELDKKVLKERTKIDPG

SEQ ID NO: 166664 - protein, 86 aa, Glycine max
  Coding DNA Sequence Number=SeqID_74979
MAYTHIPDLHAILSNSARHQLDLAPYASEPYMLNGTRPGLLRDKHTLHSSRILGEMEVDEPWLGLWLPLNYQVVFVIGSAVGRLCG

SEQ ID NO: 166665 - protein, 177 aa, Glycine max
  Coding DNA Sequence Number=SeqID_74980
MSILALEKKTQREGKFPIQEREKTQKEKKIPKPRKGEDTKKKENPNERMGESKEKKEKFSIKDRKKKKYAERSLDQTISEQYRIVTNVSSKWSFRNEMLNIQNLIYGYEKISSAYSPSPIDTLFFIQKAYVALISWKFCLFTKACSHFGEENTETIFSLTIFKNYVGLSSSSQIEDT

SEQ ID NO: 166666 - protein, 103 aa, Glycine max
  Coding DNA Sequence Number=SeqID_74981
MELIENMAASDHAILRDRTHNATKRSLLELSSHDTLLAQNKLSTKQLESLMETLSKFPKHLQAAQPSHSTVMQIRISLRRFFRLPARRKLQSKSRARDEITPR

SEQ ID NO: 166667 - protein, 114 aa, Glycine max
  Coding DNA Sequence Number=SeqID_74982
MKAQVEKDEGPEAEALSRPLMLLKAQTNLKAQTYQGNPCGVYPDLSSFIGSGVYPDLSSFIGSGVYPDLSSLTGSGVYPDLFSFTGSGVYHDLSSFTGSGVIQTFVACIKRSAP

SEQ ID NO: 166668 - protein, 76 aa, Glycine max
  Coding DNA Sequence Number=SeqID_74983
MFLLRAVHVSSTFKFGAEFHDCLSADPQGNPPYSTFARSTMNKKKEEVEMRVVIAKRAGRTKSVSYLGFPLIFDER

SEQ ID NO: 166669 - protein, 156 aa, Glycine max
  Coding DNA Sequence Number=SeqID_74984
DQSRIEGMILKDELKACLRSKRNLSRQLSKTEGNMWAIIDEYKEKLNLAATHEQRLEDEYTKISAEREARERVINSLHRGAMVWMDRFAFTLNGSQELPRLLAKAKAMADVYSAPEEIHGLLNYCQHMIDLEVQEQMKANMLTLKDQMASMMEAML

SEQ ID NO: 166670 - protein, 44 aa, Glycine max
  Coding DNA Sequence Number=SeqID_74985
MKSKEYLLDVEAMSSKMNGNRMEKEEREETSLQGEDESRRSSPP

SEQ ID NO: 166671 - protein, 79 aa, Glycine max
  Coding DNA Sequence Number=SeqID_74986
  Pfam annotation: Domain name=Ins_element1; Domain location=4-72; Score=-14.2; E_value=0.0029; Accession=PF03811.4; Description =Insertion element protein
  Subcellular localization annotation: CTP_CleavageSite=33; ConfidenceScore=5.42e-01
VLPVASVSISCPSCSATDGVVRNGKKHRRTSALASVAAAQLLGRAIGAGLFAITPAGERGMCCKAIKLGNARVFPVTTL

SEQ ID NO: 166672 - protein, 45 aa, Glycine max
  Coding DNA Sequence Number=SeqID_74987
MVRGAMVFEVLVDLEDPTKRWMVVVVVVEWRIGSGREGDKGNSMK

SEQ ID NO: 166673 - protein, 85 aa, Glycine max
  Coding DNA Sequence Number=SeqID_74988
MPRAQNSRAHHSAYFGKRALEAARGAAFEEIPRENVLLLENLNDAELKLSLTRRIYGLSFGFKYAVTIMLFGLSLVQQEGSKEKA

SEQ ID NO: 166674 - protein, 241 aa, Glycine max
  Coding DNA Sequence Number=SeqID_74989
  Gene Ontology: Mol. function=electron carrier activity; Cellular component=mitochondrial matrix; Biological process=electron transport
  Homolog annotation: Hit_ID=Q0BWK1; Match level="QueryCoverage=55%, HitCoverage=43%, E-value=7e-49, Identity=75%"; Hit description =Electron transfer flavoprotein, alpha subunit
  Pfam annotation: Domain name=ETF_alpha; Domain location=21-107; Score= 180.8; E_value=3.5e-51; Accession=PF00766.10; Description=Electron transfer flavoprotein alpha subunit
  Pfam annotation: Domain name=FAD_binding_6; Domain location=126-211; Score=-5.1; E_value=0.0017; Accession=PF00970.15; Description =Oxidoreductase FAD-binding domain
  Pfam annotation: Domain name=TPP_enzyme_M; Domain location=9-139; Score=-33.0; E_value=0.089; Accession=PF00205.13; Description =Thiamine pyrophosphate enzyme, centra
  Pfam module annotation: Pfam domain module=ETF_alpha::FAD_binding _6::TPP_enzyme_M; Domain location=21-107::126-211::9-139
AAPAAPAGSRWVSEAFNKSERPPLAAAKVVVSGGRALGSSEAFAEVLAPLADKLHAAIGASRAAVDAGYAPNDLQVGQTGVVVAPELYIAVGISGAIQHAYGMKDSKVVVAINQDPEAQIFKIADYGLVADLFKTTRDPGLRFENGQFVMIGLEVDGLPLTRAYSIASPNYEEHLEFFSIKVPNGPLTSRLQHLKVGDPLLVSRKPTGTLITSDLKPGKNLYFFSTGTGLAPFMSLIQDIE

SEQ ID NO: 166675 - protein, 180 aa, Glycine max
  Coding DNA Sequence Number=SeqID_74990
  Gene Ontology: Mol. function=tetracycline:hydrogen antiporter activity; Cellular component=integral to membrane; Biological process=response to antibiotic
  Homolog annotation: Hit_ID=P03641; Match level="QueryCoverage=32%, HitCoverage=13%, E-value=4e-25, Identity=100%"; Hit description =Capsid protein
MSNIQTGAERMPHDLSHLGFLAGQIGRLITISTTPVIAGDSFEMDAVGALRLSPLRRGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 166676 - protein, 178 aa, Glycine max
  Coding DNA Sequence Number=SeqID_74991
MIDRGRLEVDDEGSEEQHICMQSVDERSFGRPKPLVVYFTKDAAPQMPRYPSVVKPVPFPYRNSHAVSWRYAPPNERKKEATDISSLSVKVTNIMWLSGVTRSGRVFAPSDLLTQPANVKGKTKIVEEQNDKTTLTPNEDIPVKGHPEKRYGCGKKEVSLEEAGKFLRIIQQSEFKVI

SEQ ID NO: 166677 - protein, 95 aa, Glycine max
  Coding DNA Sequence Number=SeqID_74992
  Homolog annotation: Hit_ID=Q54E42; Match level="QueryCoverage=97%, HitCoverage=3%, E-value=9e-28, Identity=64%"; Hit description =Poly(ADP-ribosyl)transferase
MREALEKMGAKKIPANNLPAREISTIFDWNQNSVNYEEDYVKYIESKKELMEANKKELKPVVDTLSRMESNSEVYVDQESGLIYDVLLTKVDAGY

SEQ ID NO: 166678 - protein, 222 aa, Glycine max
  Coding DNA Sequence Number=SeqID_74993
  Homolog annotation: Hit_ID=A5BSR3; Match level="QueryCoverage=78%, HitCoverage=52%, E-value=3e-08, Identity=26%"; Hit description =Putative uncharacterized protein
MTENPSLIEDPPSPIQRHVKWKMTHTNRYRKMTSEAARQIADKIDLLEEQVTHGEFVPQGRQDILNTAKGRPDHGGRVHAAGSGVTISQYYGRTSRASTTSSISFTKEQLAEIVVTIREQVRNDIEEENKRSLQAWKNELKDAIITDIFNTDKVSAPTNFDLNVLGARVSTKESNAEIAVNPSGEEHVGRVTPPMGLYVQSQDCTKLVALGKIHMDHLPYIA

SEQ ID NO: 166679 - protein, 104 aa, Glycine max
  Coding DNA Sequence Number=SeqID_74994
MYNRLAVGLVQQDLLLLEEKQGEWDTCFKVFSEVSLLVIDYKHLEIDYKIQNSNFKILFEKPICNLSLIYTLYFASPFVVEDEDGESGRSKEQSKGPRVRDQIK

SEQ ID NO: 166680 - protein, 41 aa, Glycine max
  Coding DNA Sequence Number=SeqID_74995
MDLKTGLQQPIALIDEAGCYFFPEIYVASDEEPYNLSKQFF

SEQ ID NO: 166681 - protein, 142 aa, Glycine max
  Coding DNA Sequence Number=SeqID_74996
  Gene Ontology: Mol. function=phosphotransferase activity, alcohol group as acceptor
  Homolog annotation: Hit_ID=A7QDY4; Match level="QueryCoverage=64%, HitCoverage=2%, E-value=5e-35, Identity=69%"; Hit description =Chromosome chr4 scaffold_83, whole genome shotgun sequence
MYSLDSHTAIDKGQYRSSKFSTFGISGKLIFHVVCIMFMWIELTLLTDIGSRACVSVDAVNMHVDFVREYNQDFECDLDPESTATFPSTLSQLTERLKHWKNVLQNNVEDSFPAVLKLEKESKKIAPDHTVKLDRVAADIPI

SEQ ID NO: 166682 - protein, 178 aa, Glycine max
  Coding DNA Sequence Number=SeqID_74997
  Homolog annotation: Hit_ID=B0LUR8; Match level="QueryCoverage=32%, HitCoverage=20%, E-value=3e-17, Identity=74%"; Hit description =Transcription factor
MTEENNTLRMMLQVLSSKYTKLETHLQEINKTQHKDMSSNEIGLVTVPPMFHTNNRARVDFTSWITTLTSSLEITLMETCSLNATQCCVIELGLSTLPISRPELGFEVETVAMGRFAAPDFDGHNMHELEVQGARARGLGFARFRVREVDGALGSGCVMFRESEDQRHNVRDVDRENA

SEQ ID NO: 166683 - protein, 157 aa, Glycine max
  Coding DNA Sequence Number=SeqID_74998
  Gene Ontology: Mol. function=structural constituent of cell wall
  Homolog annotation: Hit_ID=A7P1G8; Match level="QueryCoverage=79%, HitCoverage=44%, E-value=2e-32, Identity=46%"; Hit description =Chromosome chr19 scaffold_4, whole genome shotgun sequence
MEITKVSSILIVVLLFVSCISQANAYYYQQCSTKGTRCYEKYVRWPTECPSNESTDPKAKVSQIDCDKSICRAVCRKCSTSTKSNEHFTLVSDFAIQINARFIGYRPEGSGRDYTWIQALGILFNSKTLSLEAVKTPQWSENVDHLKFTYNDNPNGV

SEQ ID NO: 166684 - protein, 43 aa, Glycine max
  Coding DNA Sequence Number=SeqID_74999
MAEEKSGDPPQQKRSQRIEIKKEFNNFTQDFKWGVFFHLDDLL

SEQ ID NO: 166685 - protein, 166 aa, Glycine max
  Coding DNA Sequence Number=SeqID_75000
MDEGSQILFNYAIQNLCLSINLGVIREAHPQKCHTRTEEFLQESADENGVSVGDQAPENPMDFDDNVDPFGKMINDDQDGGVTLVWWKADDEVQREVLPGAKVLVTPASPPVGVAWYSVSKVEYRKWIGEGPCTQGELPAVYEFPQGRSTMVLTESRTGMSLSQVI

SEQ ID NO: 166686 - protein, 202 aa, Glycine max
  Coding DNA Sequence Number=SeqID_75001
MRTETQWLGKRPAKRSAFGARWPESEFKLIWAWRFTGGGSGRGGDDKRGGSGVGRIGSGASGGRHACEGGDNPRASPPEGGPEMKQAKRKGGNSSIILLASIVGHILKPSKSSTFHVEGGNGETILVWGIVGQRVGGDELVLELQWRPGRLVKRGEGVCPSSRSWDMEAMRAPNVRDAVSWFSRNQYLQQFNKEKEQQRGKE

SEQ ID NO: 166687 - protein, 77 aa, Glycine max
  Coding DNA Sequence Number=SeqID_75002
MAEEESGLPIGDPPQWERSQIIEIKKKLKNITKVVVLHCPCWWREDGVGTRPVRTKSGIQLSQVVMVAARVGEQDFD

SEQ ID NO: 166688 - protein, 323 aa, Glycine max
  Coding DNA Sequence Number=SeqID_75003
MQKRHVPSSLVTSNTDDENGLVLVGTHIDRQRVRKQVNMVIYGSCRRQSMWLLEEKRELREHLGHHRNVEVESVGLAAIKTAELVLSKGPQIGVVLALELNQAVLIKKLHGQSIIVGQHWTQGLKPLDTKYDIGTENWSLPTITRSGVDIVQQGKHKQVTTEGCTKLCVLPPSTRTVTRWLGKRPAKWPESEFKLIWAWYGSGLSGRSGVGITHAHGVRLAPLVSGASLVVVVVGEATTREVEVESSEEVVELVAAGMHARAAIARELLLLEAGGAGSLDQRERLVSLHLATNLLGQARDEVGQEKGWRQSDYPVGQVFELRQ

SEQ ID NO: 166689 - protein, 114 aa, Glycine max
  Coding DNA Sequence Number=SeqID_75004
MAGIAWHKELLNDQPLVFPLGILDYRRASTEDPWELCENYHLEDKVVLQGPRNDTSLQIEVLVPRKPAYCIPNTCPTPESSIHDPCMCFLDHKPSCLHDWSPLRCNHYFRTMHI

SEQ ID NO: 166690 - protein, 63 aa, Glycine max
  Coding DNA Sequence Number=SeqID_75005
MKGAQAYDAMMQRILFEPCGRRVRWRARDRVHPHMSLYGLCDPSASPSHKKSLAGNNSRVSLL

SEQ ID NO: 166691 - protein, 17 aa, Glycine max
  Coding DNA Sequence Number=SeqID_75006
MDWVFTDQALPNDLVKR

SEQ ID NO: 166692 - protein, 131 aa, Glycine max
  Coding DNA Sequence Number=SeqID_75007
MINNGQDGGVTLVWWKAEMKSNERSSQGRHAKVLVTLAWPPVGVSWYSVSKMEGELPVVDEVRQGRSTMVLIESRTEMRLSQASMVSEDDEAVNEKRTTPMPIPKASISTVNGTIKLGKARIGAKDRACLS

SEQ ID NO: 166693 - protein, 152 aa, Glycine max
  Coding DNA Sequence Number=SeqID_75008
  Subcellular localization annotation: CTP_CleavageSite=34; ConfidenceScore=5.06e-01
MASFSQMQSQFQSHMQSQGIALPLEPEVGPSGPRVSTKESCVDPSGNNPETGDSGKCTTPILVPIDEVTFVGQTLNTFLAWPTHLQAVVSPAKPPQWPDPKVDDPLYSITLTILELFLKPFQVNWDATVFGVFNLDFPLYIKHEDLSEIAHD

SEQ ID NO: 166694 - protein, 45 aa, Glycine max
  Coding DNA Sequence Number=SeqID_75009
MGSFSSSSLFLLFFFSSSHSKVWERCMASLRAASGLRRWVTPELD

SEQ ID NO: 166695 - protein, 135 aa, Glycine max
  Coding DNA Sequence Number=SeqID_75010
  Gene Ontology: Mol. function=DNA binding; Cellular component =cytoplasm; Biological process=regulation of transcription, DNA -dependent
  Homolog annotation: Hit_ID=A9P928; Match level="QueryCoverage=71%, HitCoverage=41%, E-value=4e-30, Identity=55%"; Hit description =Putative uncharacterized protein
MVNILSLVSAALVVPWANVANWKDSAMRKRNFHRDEFLHCTSCRKERRFRLKNRPDIKNYHEALNNKSWTCSLWPYQNITCDDDEERPSLRASRGCSRSSTCQGCSACYCEGRIKCRFEDCNCQECRDFMLYAEP

SEQ ID NO: 166696 - protein, 75 aa, Glycine max
  Coding DNA Sequence Number=SeqID_75011
MIGRDDEGDWKHGRKIPRKAQHRKFSGTRENFRVQRKMRREDPQLSERGIIFCDLSAILSLCWDDAGFGSILGDC

SEQ ID NO: 166697 - protein, 164 aa, Glycine max
  Coding DNA Sequence Number=SeqID_75012
FFRRPTLGDYFQEKVFLVANTEYKGPTFLGFIARSRICFLVDHWTQKVGITEHKGPTFLGDNGNLKRVAWGLDIGIGCGRTIQVEGTSTWVVVTENKGGYISSGSVQVEGFYKVDNKSQGPQAAWGLNVGTERLTDYDQHQPLAAKWKPLRGTSKAGRTREQLD

SEQ ID NO: 166698 - protein, 85 aa, Glycine max
  Coding DNA Sequence Number=SeqID_75013
  Homolog annotation: Hit_ID=Q69Q33; Match level="QueryCoverage=48%, HitCoverage=5%, E-value=3e-08, Identity=68%"; Hit description =Putative ATP-binding cassette transporter1
MGGEGEYGEPLGTTLEHNTLRRDLADVLINWGVNLDPLSKWSKGAGELFGAAIMSVQRAGTTTSLILMLFLLTSGYYIQGTPHPF

SEQ ID NO: 166699 - protein, 52 aa, Glycine max
  Coding DNA Sequence Number=SeqID_75014
MAQSCISRGCRQIAEPRKLMVLEHKEVEEPTSGTDCGDKIKIKKDGNNKVRY

SEQ ID NO: 166700 - protein, 165 aa, Glycine max
  Coding DNA Sequence Number=SeqID_75015
MEIKKCREEEDKHKSFILVRQQPMPTSSPKRPAVLEISFQPCKNLYKKRSTRDVPSLVLFEQPSGFTTTQVDVPSTCTTKDVPSNVLRQSSQAGEGRHKRIQAVSPLFFWKREKRDTKRIQAKQSLETRKLRKLLAKEEEKEVQEDVQRDSKVVKEYMKKLCKKL

SEQ ID NO: 166701 - protein, 56 aa, Glycine max
  Coding DNA Sequence Number=SeqID_75016
MTGMKRMREDGGIRGIGREEVIEDMENYNEEIKIKLVSMEFEGYASVWWNQVRSDV

SEQ ID NO: 166702 - protein, 88 aa, Glycine max
  Coding DNA Sequence Number=SeqID_75017
  Homolog annotation: Hit_ID=A7PD81; Match level="QueryCoverage=82%, HitCoverage=29%, E-value=2e-17, Identity=61%"; Hit description =Chromosome chr17 scaffold_12, whole genome shotgun sequence
MEEEKAVAYYDEKTRKGERATRFKQGLDFSSSTPNDNVPKHSSSFLSKFVKASSESKKQAQLQSIHDQLKEKPSFESRVSSRDRDSNR

SEQ ID NO: 166703 - protein, 105 aa, Glycine max
  Coding DNA Sequence Number=SeqID_75018
  Homolog annotation: Hit_ID=A7PD81; Match level="QueryCoverage=69%, HitCoverage=29%, E-value=6e-16, Identity=57%"; Hit description =Chromosome chr17 scaffold_12, whole genome shotgun sequence
MEEEKAAAYYDKVTRKGERAARFKQGLEFSSSAPNDDVAKPSSSFLSKFIKASSESKMEAQLQSIHDRLKEKPSFESRVSSRDRDSNRSRRRSRSREKRRKRSKS

SEQ ID NO: 166704 - protein, 348 aa, Glycine max
  Coding DNA Sequence Number=SeqID_75019
  Gene Ontology: Mol. function=DNA binding; Cellular component =cytoplasm; Biological process=regulation of transcription, DNA -dependent
  Homolog annotation: Hit_ID=A5AI33; Match level="QueryCoverage=17%, HitCoverage=26%, E-value=6e-11, Identity=50%"; Hit description =Putative uncharacterized protein
MTTGDPPQQKTRQGNEKKKEDENVTQGDSPQEERILRIEIEEELKNITEGPSKRRKQFRVGDDGKILFDEDELKIILDFKRGEDYIEVLCGATNKKYGDYVGRLKINNEGQYFITCECCPKCPLAGVAAHDVQRYVKESDRAAQCTRQDKMSNEELKLQDPRCRIQCPGHPARKYWSCCTMHNAGSTMSDTISLSADFQENDRSHPAQVVAAQIRTLLYKHEGCTSFVPSPGLKSYFCVELISIVQRAISEFQEAFKKHALREGSGRWKTNIWVHCEDEDKVPLWKTPLIKITCDDDEERLSLKASRGCSCSSTCQGCSTCYCEGCIKCRFEDCNCQECRDFMLYAKP

SEQ ID NO: 166705 - protein, 44 aa, Glycine max
  Coding DNA Sequence Number=SeqID_75020
MERTYNVNVTCTSNIKFMFAGMFMVSFIGQTENTGRRSSVIEMH

SEQ ID NO: 166706 - protein, 135 aa, Glycine max
  Coding DNA Sequence Number=SeqID_75021
  Gene Ontology: Mol. function=nucleic acid binding; Cellular component= nucleus; Biological process=mRNA processing
  Homolog annotation: Hit_ID=Q9FT01; Match level="QueryCoverage=49%, HitCoverage=17%, E-value=4e-27, Identity=91%"; Hit description =Putative splicing factor
MAIALSGQLLLGQPVMVKPSEAEKNLVQSNASGGAAGVTGSYGAVDRKLYVGNLHFNMTESQLREFFHAQPMPTTVPTAPHPPAVRPRVRARRGQTTDPHSIAERLHRERIAERIRALQELVPSVNKFDTYLWKL

SEQ ID NO: 166707 - protein, 152 aa, Glycine max
  Coding DNA Sequence Number=SeqID_75022
  Subcellular localization annotation: CTP_CleavageSite=74; ConfidenceScore=5.68e-01
ARELQGSSKVSAFPLQHQTKMLQNPPPPSSPNLSKPPPSRRRKRNSNPSTTGSRKSLLSSLGFRAGIGTAIEVEDEAGAEKNVGKEAKAVIDTGKHEDEIGVERDIRIVKEGDGNWELLSFGAANLGPKENWDIQLFSLIVICKFLHGVLGF

SEQ ID NO: 166708 - protein, 134 aa, Glycine max
  Coding DNA Sequence Number=SeqID_75023
MPQQHMPSLYDRTTKLEETLAKFMQVSMSNQKSTESAIKNLEVQLADELALEPVDDLVELEEIVEEAEGDEEGETPIRDYKEQHLARFLDIFKKLEITLPFGEALQQMPLYAKFLKDMLTKKTRYIHSDRIVVE

SEQ ID NO: 166709 - protein, 82 aa, Glycine max
  Coding DNA Sequence Number=SeqID_75024
MGSKIYPKVHENPKAFFINSSPILLEPLAHGSGYIYLGLTENKRGYISCGSVLVEGTSTRFKENKGGYIPCGSLLVKGFLQC

SEQ ID NO: 166710 - protein, 110 aa, Glycine max
  Coding DNA Sequence Number=SeqID_75025
MERSANCRVILVGIISSSPILRHIESDIKFMLAPKSIRALPTETAPIEQAMVAIFPRCHTLISSGDHQLLGCDPRLTTSRYLAPIVRQFVKFCDMPEVKRKHCSTIREVP

SEQ ID NO: 166711 - protein, 92 aa, Glycine max
  Coding DNA Sequence Number=SeqID_75026
MTVTRVRKECDELRDVNMTTAERQQQRAQALKGRKGQVKGGKEARQRVIESLPGEAVKWMDRFTLTLNGSQELPRLLARAQAMADVYSAPKE

SEQ ID NO: 166712 - protein, 46 aa, Glycine max
  Coding DNA Sequence Number=SeqID_75027
MAGILFLLKQQNSLAITSGINEALGLNLELGLGLNPEFGLDLKRAD

SEQ ID NO: 166713 - protein, 79 aa, Glycine max
  Coding DNA Sequence Number=SeqID_75028
  Subcellular localization annotation: CTP_CleavageSite=51; ConfidenceScore=5.04e-01
AGRGRDTTTAWGWLATGNKCTAATSRAPQLIHKKVRVLPTTHGRPIGDQVQSQSRTRLVAHDPRNLNKTSTSSEGRKIP

SEQ ID NO: 166714 - protein, 122 aa, Glycine max
  Coding DNA Sequence Number=SeqID_75029
  Gene Ontology: Mol. function=protein binding
  Homolog annotation: Hit_ID=Q86AI8; Match level="QueryCoverage=84%, HitCoverage=26%, E-value=2e-10, Identity=32%"; Hit description =Similar to Homo sapiens (Human). Mucin 2
MTGPFDESISCFLIRVDPWGYTPSPSEGCTPSHSEDYTSLPSEDYMSSPSEDFTSLPSEGYTPSPSERCTPSPSEDYTSSPTENYTSSPSEDYTSSPSEDYTSLPSEDFTSSPLEGYTPSPS

SEQ ID NO: 166715 - protein, 85 aa, Glycine max
  Coding DNA Sequence Number=SeqID_75030
MATVDITGSNNNDLNKPFRNSGGTSSSHLPTISSENLAQPEPDIEPRRGKKARIAKEYGPDYMTYTLEEDPSNLQEALSSLDADL

SEQ ID NO: 166716 - protein, 95 aa, Glycine max
  Coding DNA Sequence Number=SeqID_75031
TYQGNPCGVYPDLSSFTGSGVYPDLSSFTGSGVYPDLSSFTGSGIRHQPGNMTDRGLKKKLHKMMRIELFLTGIMQISFTDWIENSIADIRREEA

SEQ ID NO: 166717 - protein, 98 aa, Glycine max
  Coding DNA Sequence Number=SeqID_75032
MGDSDKCGLYVNDNPPQLITLGRVYEGSMTIHNVPLGNYQVKVGVEEVRDANVRLPVPTQKDKKGAKGSTKLVDMSDPNVDPLYLMTLTIPQLFLKPL

SEQ ID NO: 166718 - protein, 80 aa, Glycine max
  Coding DNA Sequence Number=SeqID_75033
MGVQIAPRPTWALRNIPPEGWLLLEEATPARLGELGGQPPSPYFAINRGRKCRKEGVQPPEALSLSFEFAWEKIVSVKEI

SEQ ID NO: 166719 - protein, 59 aa, Glycine max
  Coding DNA Sequence Number=SeqID_75034
MYDGIIKDFTFSNSVWTEEDYVNNYPESHLSDSISHLSDSIVEDTMESDEFAIIYLTHA

SEQ ID NO: 166720 - protein, 81 aa, Glycine max
  Coding DNA Sequence Number=SeqID_75035
MSPNRVVFGKACHLLVETAHLAYWAVKGCNMAFDEAVEIKKEFTSKVFKVNGHQLKLWSCQVEEFVANLSLVLPILCDDVP

SEQ ID NO: 166721 - protein, 100 aa, Glycine max
  Coding DNA Sequence Number=SeqID_75036
MEEENKDEMIIDENEERLKSNKSKKIKNAQPEINSLEDDYEAIDQLENEELIQEENEDDIVANSDNETSSKPFDANNNIDSSDDEGIESPLVESNHDDFF

SEQ ID NO: 166722 - protein, 79 aa, Glycine max
  Coding DNA Sequence Number=SeqID_75037
MAEAMDSPGYAVEELGVTRLSQEWQCGHLFCRKDITKWIQEGVRLPQIACTYEMYCLLRRRVEEDLPYLPPPNSEARDR

SEQ ID NO: 166723 - protein, 331 aa, Glycine max
  Coding DNA Sequence Number=SeqID_75038
  Gene Ontology: Mol. function=zinc ion binding; Cellular component =intracellular; Biological process=regulation of Rho protein signal transduction
  Homolog annotation: Hit_ID=A8N8V8; Match level="QueryCoverage=47%, HitCoverage=14%, E-value=3e-61, Identity=76%"; Hit description =Putative uncharacterized protein
  Subcellular localization annotation: CTP_CleavageSite=15; ConfidenceScore=5.03e-01
MQQSFPAPPQQRQPRQQGFQSESYNTRPPGPPEQQPLSPEPAPYSPSLRLVEDQDSPFNAITEDLRNRIIDWKGHPLSDLGPLQMYDLLSVRRDSLVREFYVYLFKEAIICVVEEKKRSLGRLLSNASGLTDSSSVTSASHSSKGVLRLKGRIYVRHIKNVTATSAAGEMSLTIDMEDELASFILIFKDRGSMESWRATIQGLVAMFQQQNPAWIQQQAEKEKREEGERRELEGGAGSMGMGMEEFGGAIPPGSNAKALRMLSGSTGTSVSTVDSLLNGSSRSTMSSSTSNASMGGNGNGNGGGDITGRIRRPACSINSPLSARDDELLPL

SEQ ID NO: 166724 - protein, 74 aa, Glycine max
  Coding DNA Sequence Number=SeqID_75039
MSQGGGFKWGQPNNRAGDVEGRTPRRTKTRQQRRVGLVRDGGHEANEEQARVCRLNCCRRSCRVAVAEVVLLFF

SEQ ID NO: 166725 - protein, 222 aa, Glycine max
  Coding DNA Sequence Number=SeqID_75040
  Gene Ontology: Mol. function=cystathionine beta-lyase activity; Cellular component=cytoplasm; Biological process=amino acid metabolic process
  Homolog annotation: Hit_ID=A8GJL6; Match level="QueryCoverage=42%, HitCoverage=23%, E-value=4e-36, Identity=81%"; Hit description =Cystathionine beta-lyase
  Subcellular localization annotation: CTP_CleavageSite=39; ConfidenceScore=5.10e-01
MFSAINRAATVGCGLRNRATGTAQLRDKSRRYGWVRHGCAMNRAATARLRDKSRRYGWVRFVELSSRHSCAINRAATVSGMEQQARLRDESRRYGLPHPASFRDCAGVTLIFGKRAQPRAAIRGKAVMATKKIDTRLVTAGRSKRYTQGSVNSVIQRASSLVFDSVADKQRATAGRASGELFYGRRGTLTHFSFQDAMTELEGGAGCVLYPCGAAAVANAIL

SEQ ID NO: 166726 - protein, 82 aa, Glycine max
  Coding DNA Sequence Number=SeqID_75041
MHDASFMEPHIPQVPKPPATTPTHARSYVDQSRHAVDACHAITERLERLLNLRIVTAGTETHEVMEECIRIARGVTKDDNVY

SEQ ID NO: 166727 - protein, 137 aa, Glycine max
  Coding DNA Sequence Number=SeqID_75042
SLIVVGLAKVFSNLLSVEAKLHDESRLIQRCFDDNKDDDKGDDKKLEDSRGKLKNTSRFKRKVEFKNQESRFKDQASKNQDQDSRLKIQESREDLTKISMKRCFQKLSSTWIFLKTCLPKSFYSLVIDYQIVVIDYQ

SEQ ID NO: 166728 - protein, 199 aa, Glycine max
  Coding DNA Sequence Number=SeqID_75043
  Homolog annotation: Hit_ID=Q2HW90; Match level="QueryCoverage=94%, HitCoverage=38%, E-value=6e-22, Identity=34%"; Hit description =Putative uncharacterized protein
MGPLQRQAFRKVYGKMLDLTAAEVFTEAVVSLAQYYNQPLRCFTFGDFQMVPTIEEFEEVLGCPLGGRKPYLFSGFLPSLSKIATVVGDSAKELDHLKQTRNGVVGLPHKYLEGKARDMASQEKWGPFADILALLIFGVVLFPNVDGLVDLAAIDAFLAYHHSKESPVVAILADLFDTFDRRYEKNSARIVCCLPALCV

SEQ ID NO: 166729 - protein, 253 aa, Glycine max
  Coding DNA Sequence Number=SeqID_75044
  Gene Ontology: Mol. function=transporter activity; Cellular component= integral to membrane; Biological process=transport
  Homolog annotation: Hit_ID=A4W9T9; Match level="QueryCoverage=100%, HitCoverage=65%, E-value=4e-96, Identity=73%"; Hit description=Major facilitator superfamily MFS_1 precursor
  Pfam annotation: Domain name=DUF81; Domain location=12-238; Score= -75.6; E_value=0.096; Accession=PF01925.10; Description=Domain of unknown function DUF81
MGLTIANIGGVPAATWLGEVIGWRMSFLATAGLGVVAMVALFFSLPKGSAGERPDVRRELSVLMRPQVLSALLTTVLGAGAMFTLYTYISPVLHDITHATPLFITAMLVLIGVGFSIGNYLGGKFADRSVSGTLKGFLTLLIVIMIAIPWLARNEFGAAVAMVVWGAATFAVVPPLQMRVMRVAHEAPGLSSSVNIGAFNLGNALGAAAGGAVISGGLGYSFVPVMGAIIAALGLLLVMMSGRKQPEAACAAE

SEQ ID NO: 166730 - protein, 81 aa, Glycine max
  Coding DNA Sequence Number=SeqID_75045
MTKLGLCLSSGPPPLDDKRVRITVRYLRVSSGPPPLDDTRVQNDQLGLEGQYDKDYGATDKSKALALTYPPMRNSDLRSSG

SEQ ID NO: 166731 - protein, 68 aa, Glycine max
  Coding DNA Sequence Number=SeqID_75046
MAYLLSIHIGLTDSQSISALQKGLPALYMMQSYPPRALDRRLQEDWAKDARESPRVLMSLRVDFRPMG

SEQ ID NO: 166732 - protein, 73 aa, Glycine max
  Coding DNA Sequence Number=SeqID_75047
MEMPHSQPVTSSLEQENLTLSPHQPHGKAKSGAALVVPSTQPLEVSHVLLQKRQIATGGHDGDDQCKQQHGRM

SEQ ID NO: 166733 - protein, 40 aa, Glycine max
  Coding DNA Sequence Number=SeqID_75048
MDLEIDVVNEVEGGDNLDRVWERWDGGRYAIKEGNGFKNF

SEQ ID NO: 166734 - protein, 226 aa, Glycine max
  Coding DNA Sequence Number=SeqID_75049
  Homolog annotation: Hit_ID=A2Q142; Match level="QueryCoverage=69%, HitCoverage=57%, E-value=3e-07, Identity=29%"; Hit description =Ovarian tumour, otubain
MCAPSEKVKTKGAQKKQITKQQRSMKHDPSYWEYVDALHFVQNSNFSVKRCASSSEQPKSKRKIPMLDQFHPCIHHFIENIVDVKVDGMGEDSWSLVRHHLLKELAQWSDEYIHLLGGIDIYEELKQSVLVDGLSMVTMDKWMNITDIVYVIASSEDRPRTLASDLACVLLPFIVFEESLEVKPSPFHSISVKECHKSSSVKSPCNAGYVLHSVQCPRQRLKNCKP

SEQ ID NO: 166735 - protein, 305 aa, Glycine max
  Coding DNA Sequence Number=SeqID_75050
MEEENERRLQIFKHELKEQIIHEMSRRGSPVLAPIQPDIQLLGARVSTKGSNAEVVVNPSPPDYVGPVKPTMGLYVHRQLCTELVALGKTYDGGSTIHGVAYADDVVKLTSSTPNKDNEPFEPVNDVPVEDPLRELIKSLVDIYEKPVEFVWDPAKFGIPNGVASLFVTCADVNKIISGVQCLNITILQLWTMGHCQLIVLCPAENHVVWFCSLRRKPDVHIKSAINTAFKTLNSTSEGKFDQTTPRWLEIKSHVQSGGYECGYYVMHWMWNIIGGEVKTDWMMWFGDGTTHDIEIITSLRKKWA

SEQ ID NO: 166736 - protein, 131 aa, Glycine max
  Coding DNA Sequence Number=SeqID_75051
MGSKIYPKVHENPKAFFINSSPILLEHLAHGSGNWSFPKEDCISFSVMVSNIGFQGCTLEGLFPPIFIIPTPYCSATPTLPRLLEGEFQNVWVWLDKGPDFAIAVSLSARQARSTGETSACSTEYGSMKYT

SEQ ID NO: 166737 - protein, 220 aa, Glycine max
  Coding DNA Sequence Number=SeqID_75052
MRSWVRGQWIPFDADAIGQLLGYPLVLEEGQECEYGQRRNRSDGFDEEAIAQLLCIPGQDFARTAAGRRVRIMRTNMTTLTQIWMTLLLSNILPSDHNSNLPLPKCMAPTRHPLDPDKSNRALGFPALITGLCQSFGVPVAPSKRQVQGDAPQAADAPPPHQAGPVGSFDTEQYLRHLVRQQAANHRAHVQPPDLSKSVVFNFYKISYPFVANCCYGLHV

SEQ ID NO: 166738 - protein, 213 aa, Glycine max
  Coding DNA Sequence Number=SeqID_75053
MAKRKRKGWWRFVSLTVVTHTIEREKQMLKGRIPRGFVWDRLLAAGRGSEESVWCLLTGRWEVAIGSGGGMVSAIGGGLAEEEDVLVILGSRGGMGGDFAKAKDGEGCLGTMVFNIQIMASSLEAMEVWAAAVEVWATASLAMVASRRSTQAAESSVSAIEDQQVRPNVRLLALVFEIKGISIKQRKQESEKERIVNIFLPVLFNTKGIIYSQ

SEQ ID NO: 166739 - protein, 353 aa, Glycine max
  Coding DNA Sequence Number=SeqID_75054
  Gene Ontology: Mol. function=hydrolase activity; Cellular component =nucleus; Biological process=mRNA modification
  Homolog annotation: Hit_ID=A7QLP0; Match level="QueryCoverage=89%, HitCoverage=68%, E-value=1e-101, Identity=36%"; Hit description =Chromosome chr13 scaffold_120, whole genome shotgun sequence
  Pfam annotation: Domain name=PPR; Domain location=185-219; Score =48.9; E_value=1.8e-11; Accession=PF01535.11; Description=PPR repeat
  Pfam annotation: Domain name=PPR; Domain location=256-290; Score =47.1; E_value=6.1e-11; Accession=PF01535.11; Description=PPR repeat
  Pfam annotation: Domain name=PPR; Domain location=69-103; Score=11.6; E_value=0.33; Accession=PF01535.11; Description=PPR repeat
  Pfam module annotation: Pfam domain module=PPR::PPR::PPR; Domain location=185-219::256-290::69-103
MVWCLLSTLLLLYFAAIKIQEANDSIDEEDPRPSSSNGATSLCGENLELKRGREIHGMVITNGFRSSLFAMTSVVNLYSKCRQIEDACKMFERIPQRDSVSWNTVVMQEAGQKSDSITLVSVLPAVADVKALRIGRSIHNYAFSVGFESMANVATAMLDMYFKCGSVRNARFMFKGMSSCSRNVVSWNTMINGYEQNGESEEAFATFLKMLDEGVEPTNVILNEGVMNSIISTYSKCMMVNIAASVFHNLKQETTVTWIAMILGYAHNGCVNEALNLFCEMQSHDIKPDSFTLVSVIIALADLSVTRQARWIHGLAIRTLMDKNVFVCAALIDTYAKCGAIQTARKLFGMMQE

SEQ ID NO: 166740 - protein, 106 aa, Glycine max
  Coding DNA Sequence Number=SeqID_75055
  Pfam annotation: Domain name=zf-GRF; Domain location=2-46; Score =17.7; E_value=0.00022; Accession=PF06839.3; Description=GRF zinc finger
MVKCKCEVSAIMFTSHSVNHPGRRFWRCPHWNESSSYRFFQWIDDTEADNNVSAKGSELVRYVQENEELKLKIASLMEEAKANAEEITVLWEKNCCTRGRMSCTLS

SEQ ID NO: 166741 - protein, 94 aa, Glycine max
  Coding DNA Sequence Number=SeqID_75056
MGYNSMRNKLIYFLLMQPTLLRASEAGLTGASSKEGKCAESPPRFICGKRQKNQRKPVMKNIPDSGVVFTFEEGRQKRGSCSHVPSIEEETGPT

SEQ ID NO: 166742 - protein, 165 aa, Glycine max
  Coding DNA Sequence Number=SeqID_75057
MKLCFYIRVLPDPWVTIAKLRLFHGLGQKTLTSPEMVQMTILVSVCQQAHLPLADERPLGHDSKMRLFRGVDRKTLTSLERVHMTTLVSACQSDLGSSNDKVFLRAIRLTGHDSKMCAQITIGCLCVPPDSQVTIAEGGVIDKNGVFAPTYPQFVMRNSDLRSSC

SEQ ID NO: 166743 - protein, 48 aa, Glycine max
  Coding DNA Sequence Number=SeqID_75058
MSRNFTDSIVMSVKPSKFLPETSWNFTDSTAMDVKNFEVVKRRSHADK

SEQ ID NO: 166744 - protein, 124 aa, Glycine max
  Coding DNA Sequence Number=SeqID_75059
GGKCPQNDEIVELDIRSGARVPDRCRSIPSAAKPNNDKGRTILVGRVVEESILRSHRASLATLTDYEQLSVGESLTLHHGEKSFCVDAPYELKEMEKRGHDKCYRCGWTFQEKEKESSKDALWV

SEQ ID NO: 166745 - protein, 38 aa, Glycine max
  Coding DNA Sequence Number=SeqID_75060
MMNIMVRTRGLGRALGHVTGRGVGRGDRDDFDYAPQHR

SEQ ID NO: 166746 - protein, 67 aa, Glycine max
  Coding DNA Sequence Number=SeqID_75061
MMPMMKLGCGAELWLCDLRVRRGEGEGALRWSATTNEVRRRWWLCHKRTDYLWIKLIHKSLIDQLDP

SEQ ID NO: 166747 - protein, 149 aa, Glycine max
  Coding DNA Sequence Number=SeqID_75062
  Homolog annotation: Hit_ID=Q6UUU1; Match level="QueryCoverage=57%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMAAFVSFHAWTLSSR

SEQ ID NO: 166748 - protein, 87 aa, Glycine max
  Coding DNA Sequence Number=SeqID_75063
  Homolog annotation: Hit_ID=Q7XGW8; Match level="QueryCoverage=68%, HitCoverage=4%, E-value=1e-07, Identity=40%"; Hit description =Retrotransposon protein, putative, Ty1-copia subclass
MAYQLATSRKITVIKMIWVPKGSSVYTNMQGPNKIWVSLRKKWYIDSGCSKHMTGDASNFTHISPKKSGHALSTACLALVNYVTKAI

SEQ ID NO: 166749 - protein, 157 aa, Glycine max
  Coding DNA Sequence Number=SeqID_75064
  Homolog annotation: Hit_ID=Q6UUU1; Match level="QueryCoverage=47%, HitCoverage=51%, E-value=3e-24, Identity=74%"; Hit description =Putative uncharacterized protein
IRARSDACARRPFAGPAVGGLGPPKARAVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGGGDFLEDARKILNREVRGRGKAVFP

SEQ ID NO: 166750 - protein, 381 aa, Glycine max
  Coding DNA Sequence Number=SeqID_75065
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=A8G992; Match level="QueryCoverage=100%, HitCoverage=79%, E-value=1e-165, Identity=79%"; Hit description =Phosphotransferase system EIIC
  Pfam annotation: Domain name=PTS_EIIB; Domain location=9-43; Score =70.3; E_value=6.5e-18; Accession=PF00367.11; Description =phosphotransferase system, EIIB
  Pfam annotation: Domain name=PTS_EIIC; Domain location=110-379; Score= 138.4; E_value=2e-38; Accession=PF02378.9; Description=Phosphotransfer ase system, EIIC
  Pfam module annotation: Pfam domain module=PTS_EIIB::PTS_EIIC; Domain location=9-43::110-379
MATNYADAARAIVASLGGLENIEAVTHCMTRLRFVVKDSARVDNATLKAIPGVMGVVHTDSQCQVIIGNNVNLAFQEVMKLGTPGNSGSAPVKRKITLRSIGAGILDALVGTMSPLIPAIIGGSMVKLLAMMLEMSGVLPKGSSTLIILNVIGDGAFFFLPVMVAASAALKFKTNMSLAIAIAGVLVHPNFIDLMAKAAQGQVVEFASVPVTAVKYTYTVIPALVMTWILSHIEYWVDRFTPAVTKNFLKPMLIVLIAAPIAIVFIGPLGIWIGSGISALVYTIHGYLGWLSVAIMGGLWPLLVMTGMHRVFTPTIIQTIAETGKEGMVMPSEIGANLSLGGSSLAVAFKTKNPELRQTAFAAAASAIVAGISEPALYGVA

SEQ ID NO: 166751 - protein, 217 aa, Glycine max
  Coding DNA Sequence Number=SeqID_75066
  Homolog annotation: Hit_ID=Q6UUU1; Match level="QueryCoverage=27%, HitCoverage=40%, E-value=2e-18, Identity=78%"; Hit description =Putative uncharacterized protein
  Subcellular localization annotation: CTP_CleavageSite=42; ConfidenceScore=5.08e-01
WNLYVPINVSFSPKVGPGLPAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 166752 - protein, 319 aa, Glycine max
  Coding DNA Sequence Number=SeqID_75067
MGEVEEVQEQMKANMEAIKEQMVTMMEAMMSMKKIMEANAIAVAATSAVAKVNPMPPSGLNQVNHPTSDMVDKDSGSTSSPHYMKIQNKHAFPSYGLPPNYTPPNVTYTPSEIVNNSTPILIESQQHQSDHARVSQTMGEMHEIPHHNLADFEPCLGYATEGQAVGGIPLQNNLEGPQFRPQPQPLYGKIVGYTPSSFADLVFAGERIKVGQERGKSDHLALMNAKTGANEEGENEGETHVATVVPTWKIPHQLNNNITQPISALLIPTTQSSIKAIPKSTTKLVYRTPNAQTPPLAKTKKEFCRKKHVGFTPNSGVIC

SEQ ID NO: 166753 - protein, 58 aa, Glycine max
  Coding DNA Sequence Number=SeqID_75068
MAYERGGDFLEDARKILNREAFPPGGSLVRSPVPAFGLPVSFRCMAALSHSTPDTQFR

SEQ ID NO: 166754 - protein, 62 aa, Glycine max
  Coding DNA Sequence Number=SeqID_75069
MTKSKGKDPLEGLGGPMTRARARKTKVALQQVLSILFEYKPKFQGQKSKVASAFWETKWWLT

SEQ ID NO: 166755 - protein, 32 aa, Glycine max
  Coding DNA Sequence Number=SeqID_75070
MHLGYTTTNRVESAHWSLKRLRQNSIGDICSV

SEQ ID NO: 166756 - protein, 51 aa, Glycine max
  Coding DNA Sequence Number=SeqID_75071
MAGHGRDQNRDVEPAEYRGLMAFRKNHPPKFSGDYDLEGARYLRLPPDFMG

SEQ ID NO: 166757 - protein, 101 aa, Glycine max
  Coding DNA Sequence Number=SeqID_75072
MSSIVYWDRARKTPSGPGEVQQGPGVSSSDYEPLDHTRKTPSGPGEVQQGLGRSSPLTRSLGPPLTGLSSRSTAPPDKHRARHHSSLGMAGSGQQTHRHHL

SEQ ID NO: 166758 - protein, 97 aa, Glycine max
  Coding DNA Sequence Number=SeqID_75073
  Homolog annotation: Hit_ID=UPI00006A2D9E; Match level="QueryCoverage =96%, HitCoverage=86%, E-value=2e-09, Identity=18%"; Hit description =UPI00006A2D9E related cluster
GLHALAFRGLHVLTFRGLHALAFRGLHTLTFRGLHVLTFRGLHVLTFRGLHVLVFRGLHALTFRGLHVLTFRGLHVLAFKGLHTLSFSGLDALTFKG

SEQ ID NO: 166759 - protein, 44 aa, Glycine max
  Coding DNA Sequence Number=SeqID_75074
MSHAVKDNRGKWALNYEGPFVVKRAFTGGALGFLVYYISLVTIF

SEQ ID NO: 166760 - protein, 132 aa, Glycine max
  Coding DNA Sequence Number=SeqID_75075
MECLEGVWETLEGNARCRFRGMIRLTATSLVHPGEPARTLQRTLEWILPTPTPYRLVEPVQVIEVSSSEEDPEEDPEVLPPEPTVDAIDFPEGDEDPLPDVDSPEDVMSASEANSTEESGPGGIVTSGDSSS

SEQ ID NO: 166761 - protein, 172 aa, Glycine max
  Coding DNA Sequence Number=SeqID_75076
  Pfam annotation: Domain name=G-patch; Domain location=1-42; Score =11.3; E_value=0.008; Accession=PF01585.14; Description=G-patch domain
MVARVMLGNGYEPRMGLGKNNGSRTSLISTRGNRGKFGLGYKPTQADIRKSVVGRKSGSQGSQLGRKVEGGPPCHISRSFISAGLGHEGQVVAICEDDSPSRSNDESLEGNNTWDPSIDFKQETDQTKGEEDEDVGLPPEVEKIVAHEDQEMGPHQEETTLVDLGHSSGERK

SEQ ID NO: 166762 - protein, 82 aa, Glycine max
  Coding DNA Sequence Number=SeqID_75077
MREINGDKQARGTNIGALGFKLEAEITSMEANRIRIRNNVCAYPLPVGWITLDTVFSDSAYGLAIGYGPRRLDFTTIPLFHC

SEQ ID NO: 166763 - protein, 215 aa, Glycine max
  Coding DNA Sequence Number=SeqID_75078
  Homolog annotation: Hit_ID=Q6WAY4; Match level="QueryCoverage=81%, HitCoverage=36%, E-value=2e-15, Identity=29%"; Hit description =Putative uncharacterized protein
MGSSQKPSLKKRFYQVKIKSLEVTSLRELGQLMGQLQWQAFRKAYGKIWDLARVEVSMEPIASLSQYYDQPLRCFTFEDFQLVPTVEEFEEILGCPLGGRKPYLFFGFYPSTTRVAKVVKISAQELDRVKQNRNGVVGVPRKFVLFPNMEGLVDLAVIDAFLAFHHGKESPVVAILAMYDTFDRGCPSIRYKVTARASKKERRIGTNSWLAWRGV

SEQ ID NO: 166764 - protein, 134 aa, Glycine max
  Coding DNA Sequence Number=SeqID_75079
MILGDTLRLFAPLCHPESSGPMIRGDTLWLFAPFCHPEAAGPMTSRDQVWSFCTLVSSRGGGPDDTRRYLRLSAPFCHPEAAGPMTSRDQIWSFCTLVSSRGGGPDDTRKYPSGYPYKHSFAICKTERLIACRG

SEQ ID NO: 166765 - protein, 52 aa, Glycine max
  Coding DNA Sequence Number=SeqID_75080
MSLPSVVHVSPLSSAKLLKKKEEVEMRVVITEEARQTKSVSYLCFPLISDER

SEQ ID NO: 166766 - protein, 300 aa, Glycine max
  Coding DNA Sequence Number=SeqID_75081
MKFGNQELPVLTNEFHYPGGEAVNDECNYLIDNIWNIPKNTNNNEQFVCSVKKGTICALYNFCITDNQGVSFLTKASPSRKGYTAFVLLSGPHKGVYTNFKDLCLAKEEIQNPIYKGFYSREEVEKVLELNTTYINKIKMSLEPENPTIVINTGQTKTSQKTYKDSVSPNIPGSINDLNLDNFKKIQTLLFKIHNNQTQIPGLYIGVHAYFNQKFVCINKTPYCQDKTNCHCKIKFLSRKARLDMDQFKSFGYEDLAISAKSLLDYGCLESILIPPSDRFEGFNSSINEAINLIQAEMMD

SEQ ID NO: 166767 - protein, 100 aa, Glycine max
  Coding DNA Sequence Number=SeqID_75082
  Gene Ontology: Cellular component=chloroplast
  Homolog annotation: Hit_ID=Q49KT9; Match level="QueryCoverage=33%, HitCoverage=29%, E-value=3e-11, Identity=93%"; Hit description =Putative uncharacterized protein ORF113
MGAGHARSRYLNRKEGDAEGRASDWSEVVTRALSHMDSLMCSSAPDPEMWIIQGTLAWRTSPLSLEHRFRFGLNGKNGAPNNVSSQTKNYEIAPFIPGVT

SEQ ID NO: 166768 - protein, 87 aa, Glycine max
  Coding DNA Sequence Number=SeqID_75083
MEISSFHQFPDKSLSEALNHFHGLLRKMPTNGYRGCHIYGEAYELGQCIPQEDSSMEVNYIGAQNHHRFQGYNQGRPPRFNQGRNFT

SEQ ID NO: 166769 - protein, 179 aa, Glycine max
  Coding DNA Sequence Number=SeqID_75084
MAPFTCACGKYNKEVVLSWYRLEVMINQGNESTKFLLWDRECSELIGQSADEVNKLKIEDGDVDLNASPQVLDKLLGYEFAFNIKVQPKFRNSAVLKCSADSSLINVVMDMLADAETSSKMNIPVSDSNHSAQHESQSLSVTADHDPLLGGSPCDDEAGTSQISPAQLSSKKLKKHGAI

SEQ ID NO: 166770 - protein, 263 aa, Glycine max
  Coding DNA Sequence Number=SeqID_75085
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=96%, E-value=7e-69, Identity=49%"; Hit description =Photosystem I P700 chlorophyll a apoprotein A2
  Pfam annotation: Domain name=PsaA_PsaB; Domain location=47-263; Score= -203.3; E_value=0.0021; Accession=PF00223.10; Description=Photosystem I psaApsaB protein
FLFNGRGYWQELIESIVWAHNKLKVAHATQPRALSIVQGRAVGVTHYLLGLAQDPTTRRIWFGIATAHDFESHDDITEERLYQNIFASHFGQLAIIFLWTSGNLFHVAWQGNFEAWVQDPLHVRPIAHAIWDPHFGQPAVEAFTRGGALGPVNIAYSGHLVHVAIPGSRGEYVRWNNLLSILPHPEGLGPFFTGTAILTLLGGFHPQTQSLWLTDIAHHHLAIAFLFLVAGHMYRTNFGIGHSIKDLLEAHTPPGGRLGRGHK

SEQ ID NO: 166771 - protein, 49 aa, Glycine max
  Coding DNA Sequence Number=SeqID_75086
MESSSVATYTTTEVRAKSQSASSHEENAWSRHQRLLKGNGVVLTPTYPQ

SEQ ID NO: 166772 - protein, 225 aa, Glycine max
  Coding DNA Sequence Number=SeqID_75087
MLIIIYPYKEKVNLAASYGQMLEDEHVKVSVLQIEREARERVIELLHREAMKWMNIFAHTLNESQELPRLLARAKAVADTHCHHKKVTIVTKKNECALRHHYQTRAKAKIMSEIEEVQEHMKADMEAIKDQMTTMISMRKMIEVNTELVATTSVATEVDLTHPSSVNQGGEVLGSTGDPHFVQVQSKHSFRPYGQPPNCAPPNVVHAPDENINHSALIPLESQQP

SEQ ID NO: 166773 - protein, 325 aa, Glycine max
  Coding DNA Sequence Number=SeqID_75088
  Homolog annotation: Hit_ID=Q6WAY6; Match level="QueryCoverage=72%, HitCoverage=42%, E-value=3e-07, Identity=23%"; Hit description =Putative uncharacterized protein
MGTRGCINYNPILAIRQLGYPMRGAPSKESITPFIARGFSDPNTRVLQGVRKAWDTVRRKDKELRGSSNGIIGGYHKGMRVRTQGLDWLPKLKAVRDEEAEALEESEEVQALKAELERARVVKEKFKSIAIKVQREYDELRDVNMATAKALERETKRARKEEHDRNKFQGALFDSNSELKLRRDERDQSQVKGMILKDELKDCLRSKRNLSQQLSETEGNMWAIIDEYKEKLNLAVTHEQRLEDEYAKQSAEREAMERVIDSLHRKAMMWMDRFIFTLNRSQELPRLLAKAKAMVDVYSAPKEIHGLLSYCQHMSNLIAHIIRSC

SEQ ID NO: 166774 - protein, 119 aa, Glycine max
  Coding DNA Sequence Number=SeqID_75089
  Homolog annotation: Hit_ID=Q2HW90; Match level="QueryCoverage=69%, HitCoverage=17%, E-value=5e-09, Identity=36%"; Hit description =Putative uncharacterized protein
MGSNQTPLLKKRFYQVKIKSLEVASLRELGQLMGQLQRQAFPKNYGKIWDLATVEVSVEAIASLTQYYDQPLRCFTFENFQLVPTVEEFEEILGCPLGEGEGSHIFSRVSIPPCPELPR

SEQ ID NO: 166775 - protein, 67 aa, Glycine max
  Coding DNA Sequence Number=SeqID_75090
MATPRVFLGRRTREPRVALLPKEDDHIKQGLTQDVPLRTAWLSNFYMHIYWGNPVLFGVWDGSCAPV

SEQ ID NO: 166776 - protein, 150 aa, Glycine max
  Coding DNA Sequence Number=SeqID_75091
MVLRQATQLVAITDGWWRWRRRLGVLGEGLGKKMEAKWLFYAIGRICGLQNSLKKSVARIGELIQLRLAWAKFCSPSKILLQQALLLRGLATSNHNSWQSPMVGGGGGGGWGCWVRVWGRRWKQNGFLMLLDEFVVYKTHSGKVLLAWAS

SEQ ID NO: 166777 - protein, 272 aa, Glycine max
  Coding DNA Sequence Number=SeqID_75092
  Homolog annotation: Hit_ID=Q2HTA0; Match level="QueryCoverage=50%, HitCoverage=21%, E-value=7e-14, Identity=36%"; Hit description=IMP dehydrogenase/GMP reductase, related
  Pfam annotation: Domain name=DUF1723; Domain location=161-210; Score =57.1; E_value=6.2e-14; Accession=PF08330.1; Description=Protein of unknown function (DUF1723)
MLKRGSFVSVRTTPPQTKLLPPSSVSVLYHVVVILSFHCCRSGHLHHRCVISIVEIMVRTKGLDQALDRIIGRAIGRKDNRDSNEALQRRRPIAFTRRQREVVPVAEDVHHVDDAADEEHPKLKLSSYGRKVQKFRRPAAKIEGLIVSTGLSPLIACSLDTGNRGLILTFAERWHKETSSFHLPVGEETITLDDVASLLHLPITGAFYSFETLHVEEVVLLLVELLEVSADEARVETVQCHGTYVQLSWLRDIYRSKCDVTHWTIAARAYLS

SEQ ID NO: 166778 - protein, 246 aa, Glycine max
  Coding DNA Sequence Number=SeqID_75093
RNPRAKRYFLHALSELLFVLSALTPDHWLDGPTKRVLSAKLLWRVLSFSNLAPTSHTSDITLDRAKLIYGLVMLGFPALIVALCKAQGVTSDSLTFESLSPVINLTYIKKNCWNLDDPSVTFRGTQKSKAKRSEAPSTSAPPTSALSTSAPPTSPLPPAPAALAPPILTEPTSGPAPDHVELVECGPLVAGHRSPGALACTGEDVAVPEPSPQPEPEPSAPVHDLPISHDLPFAPALDLNDAAQDD

SEQ ID NO: 166779 - protein, 212 aa, Glycine max
  Coding DNA Sequence Number=SeqID_75094
  Pfam annotation: Domain name=Transposase_23; Domain location=37-107; Score=-11.0; E_value=0.019; Accession=PF03017.5; Description =TNP1ENSPM transposase
MQSQGLTVSPEPEIGSLAASVSIKKGYVDPSWNNPNTGDSEKCRLYVEENPPRLVALGRLYEGSTTVHNVFLCHDQVKVGVEEVRDVDTPIPVPTEEVQLVGQTLNTFIAWLTHLVKLLSKQIFLKPLRVMWDATVFGVFNDNFPLYIKHQDLSKITHGGQCLSISIIQLWILHMTKTSMRAGNTDVYGFLEPQFIQRSGQSQFESESYIKN

SEQ ID NO: 166780 - protein, 148 aa, Glycine max
  Coding DNA Sequence Number=SeqID_75095
MHDATKEQARAKGQFGAVTACSGELKLNPAVVSSPRQVGFFTIKLFGGPGEPEASLGEPEASLGELGSRKTHEKTLLPPFFLDFQGVLRAFQLRNLQNESLKKKAKHNDDDDDDDDDDDLFPFHKVGLRKGFCLYKELPNNSLFKELG

SEQ ID NO: 166781 - protein, 49 aa, Glycine max
  Coding DNA Sequence Number=SeqID_75096
MHFQNRFPPFLGLFPFLDFFDLRKRANSRKRNPVCDKDELKQKEKEEER

SEQ ID NO: 166782 - protein, 331 aa, Glycine max
  Coding DNA Sequence Number=SeqID_75097
MASRKHKSIGARTNAQYDTRRFHSLDAWNRYINNVLGMSILPERKVEIYHIEFDDFKTKLERHNLHKRLTNLADGTIDVALVKEFYANLYNSEGPSPKQARVRGHLVKIDADSLNTYLETPVVLEEAETLPTYSRYYRLPIDHREIEVALYILGRGFILNGKGHPGRILGKDLTTLAQVWSVLSYSNLAPTSHTLNLTMDRARLIFGLVSHMDMNIDALISRQMTSIAQSNSCRLGFPALITALCRAQGVVSDSLTFECLSLAINLAYIRKNCWNIDDLTVAFQGTRRARPTNIPSSSTAPAHTPTSTFAAPSIPAHVDSQRFEAMLQSIH

SEQ ID NO: 166783 - protein, 177 aa, Glycine max
  Coding DNA Sequence Number=SeqID_75098
  Subcellular localization annotation: CTP_CleavageSite=81; ConfidenceScore=5.02e-01
GLVGACALSANLDRLARISEFRLSARLLAQQMDSSGALSGMTPRSANMHNSSFFQILPLAQRMEYYLGSLSDFCSSSYCTKLMKESPQWRVKPIAKCQARRKHYSSINGSLGAALLNLLRCNKEGSGHGYGIGADLWSGMRGVSSVNYLLMRKRLDLLCFLPYLDNGRTDARGSATD

SEQ ID NO: 166784 - protein, 652 aa, Glycine max
  Coding DNA Sequence Number=SeqID_75099
MASTNTLVTTSIPTMEITTIHTDNEPSIHEKNYDSHVTKALYKDNADKASDQKTIIYNLMCKKAKILANILNKSVLHKAGFKTTFSDLHKFILFHLMENLQFDLPHTVYSNILRSLKGLGGVYHVFNKIDEDSKHTLIVKGSVVAKQQKLCKTNLKAKKMTLEQSLKETPEVEMEAINKRKHKRLDKSIADEGLEEEELLAKEHRTKRRHKSVVFAPKCPPTVNLKVVALDAPTPKRAKKAQLVAEPRAKSQSSSSSDGESTNDTPIIPLHKSALTTLPHPPPSPLHLERFRRETPREPLTDEQRFSQDAIVHFPPPTWTRPVQSTIAKMPPNWLALGTWHSLTDIQLSDEDHSSLGKLHEKMYLDDQATTYPSSLHISRATDIMMVADRDLLESNSVDGFPKSFHLWAMMEVILLFHETLFKCYNLPRRITLMMLVSASQEMMIATPSSNVFFSFFPFHKGNLQLEAQQKMKVVFGSATVESVAKEAIEKEANAIVQAEAFAKVVDDSVVDDTNVINETSEASNATMANEVEPLIPNLASIKTLLEIRAKMVLMSLLYIPQVLAPLLSIMHNLLPSLNATIRQFSNLDVVLLQNIQQAQLSMLGAIAPPTPTPIPPFIPASLEPPPQPLAPIPPPPSSSPPPSQPRPPPTS

SEQ ID NO: 166785 - protein, 181 aa, Glycine max
  Coding DNA Sequence Number=SeqID_75100
  Homolog annotation: Hit_ID=A5BSC1; Match level="QueryCoverage=45%, HitCoverage=3%, E-value=2e-10, Identity=44%"; Hit description =Putative uncharacterized protein
MNPKDVGLLCPLINQEANPASCNKPKERWSLVFSVCNQEDLLLKTVTNSSSTDKSGNGYEGKVHVHDKDAIVCYFYGKTRQMTFKCKDRPKKESKYMPCYLDSGCSRHMTGKKSMFKCLTPYHGGTITFRGNKKGRTIGGGYGVSFNKDECVIQCEDGSPLFSAKRKGNLDGLVIVEDYSR

SEQ ID NO: 166786 - protein, 432 aa, Glycine max
  Coding DNA Sequence Number=SeqID_75101
  Gene Ontology: Mol. function=metal ion binding; Cellular component =nucleus; Biological process=positive regulation of transcription from RNA polymerase II promoter
  Homolog annotation: Hit_ID=A7QML6; Match level="QueryCoverage=86%, HitCoverage=30%, E-value=1e-137, Identity=63%"; Hit description =Chromosome chr19 scaffold_126, whole genome shotgun sequence
  Pfam annotation: Domain name=DUF1610; Domain location=104-127; Score =12.5; E_value=0.061; Accession=PF07754.2; Description=Domain of unknown function (DUF1610)
  Pfam annotation: Domain name=zf-LSD1; Domain location=104-128; Score =5.3; E_value=0.57; Accession=PF06943.3; Description=LSD1 zinc finger
  Pfam annotation: Domain name=zf-LSD1; Domain location=31-55; Score =8.7; E_value=0.17; Accession=PF06943.3; Description=LSD1 zinc finger
  Pfam module annotation: Pfam domain module=DUF1610::zf-LSD1::zf-LSD1; Domain location=104-127::104-128::31-55
  Subcellular localization annotation: CTP_CleavageSite=30; ConfidenceScore=5.62e-01
MTQPSPPPPLAPPPPSTPPPPQPAESVRVRCAGCRMILSVAPGLTEFACPTCRMPQMLPPELMPKAVAGNNAAAPLPPPPSAPASQLSQAPAHGIDPTKIQLPCASCKAILNVPHGLARFACPQCGVELAVDVSKVKHFFPVQEEVNEFVMIDVKTYNIKCDRDCGKAVSKDEREFQKGSRMCLMVDKVAVEVERDEDEGGMVGETFTDYRPPKISIGPPHPDPVVETSSLSAVQPPEPTYDPKIKDDLESSKALSCLQIETLVYACQRHLQHLSNGARAGFFIGDGAGVDLKFDARRDLDDVGATCIEVHALNKLPYSKLDSKSVGVREGVVFSTYNSLIASSEKGRSRLQQLVQWCGPGFDGLIIFDECHKAKNLVPESGSQPTRTGEAVVDIQPFTRLPQPMQSDEQVLVSVVLAARHAQLICSPLCLL

SEQ ID NO: 166787 - protein, 71 aa, Glycine max
  Coding DNA Sequence Number=SeqID_75102
MMKQILEAIQPSTTSSTNEPLEDQGHADDFTSLGYLHISCLFFLQDIDQFGFDRIGISNRSIISCKGLARN

SEQ ID NO: 166788 - protein, 186 aa, Glycine max
  Coding DNA Sequence Number=SeqID_75103
MAYHASSKANQNSMKNHEMHFGTSYSIENFQGGPELQPYYQNEAERGSNLDNLLMQFKETTKSTQRVLQSVEIQVGELAEEVTQFMSRREKYFVKVEAQEENPVKEHESREKDEEKDEEQAQQQWEKYSTRNPFAKRIFGHALSRESQALSAQPLHLRLIWSAKLAKAELSQFQFDLNSTKQRPDR

SEQ ID NO: 166789 - protein, 131 aa, Glycine max
  Coding DNA Sequence Number=SeqID_75104
MPGASEKVVDPTLSDEMDEDKLNRMEDEYRVPEYVSIDTMTKSLEKKKKVYNGFHLSMRGISEDMINVVVATCGDGGGTHLLLEVASPLSLPFSIPLPFIFQEAKESIDEEDPRPTSSNGACITNRSSDAM

SEQ ID NO: 166790 - protein, 136 aa, Glycine max
  Coding DNA Sequence Number=SeqID_75105
MAHLVRYRMHKTLRVNAPLPYPHLVTLILQHVNVPVANEHFVKVKHSFAIGATGIAYRKDIDGQWVRKQDINAPDKCTPSPPPRDPSSTLLTDVLNELRDLRSFVGERFDSMDSRITRLEDDMGFIRRCFDPPTDS

SEQ ID NO: 166791 - protein, 135 aa, Glycine max
  Coding DNA Sequence Number=SeqID_75106
  Subcellular localization annotation: CTP_CleavageSite=73; ConfidenceScore=5.44e-01
MQQGQPYIPIVGFPDPNYGLKAVNQNKLPSPIMSSPSAPLCVAQRPLSFTFIGPNTVFYIPNRRCSSLCAGPTASNGGSWWPPLVVGGGGVVSRVISLSELISLSGNPLLALSLTFCIERNSSRVGICIERNISR

SEQ ID NO: 166792 - protein, 142 aa, Glycine max
  Coding DNA Sequence Number=SeqID_75107
  Subcellular localization annotation: CTP_CleavageSite=37; ConfidenceScore=5.01e-01
MWAGRLIRTSTSSMTPSGIATLRLARWMTTLVKHGICKSEISNGTRDNKSARIFALLWLGGWWNGNNNFAPYKCRNISAQLHLLISLQLPLMSAQILQELCIFWNLFDGIQERNIDFHPPESLKKIRIKFHFLCRNGSRRKR

SEQ ID NO: 166793 - protein, 308 aa, Glycine max
  Coding DNA Sequence Number=SeqID_75108
  Pfam annotation: Domain name=Transposase_23; Domain location=48-109; Score=-4.9; E_value=0.004; Accession=PF03017.5; Description =TNP1ENSPM transposase
MGLALRGSRNSSCLAPENQEQLTQKIRDQLKMSITQKPLEAEVGHSVASVSTKESCVDPSGVYEGSMTIRNVPLGNDQVKVYVEEVQDADARVPVPTQEVQLVGQTLNTFLAWPTYLVKIFSKQGVEGLVKPIDMLDLGIDPLYLMILTILQFLLKPLQVSWDATMVGVYNDNFLLYIKHEDLSEIVHNGQCLNISVIQLLIFTYWQIVIILPKDNVVIWFCSLHNRPDIYLKGIIVEAKLHGESKNNSRVQYKNQEEFKTQEESLESRIKIQGSRSQESRSRFKTQDSRIKRRLNQDKYEKFFSKIE

SEQ ID NO: 166794 - protein, 102 aa, Glycine max
  Coding DNA Sequence Number=SeqID_75109
MAHQLKVSAKATLEKLPWHLIIVSGEEDILVSYPSSTPYVEAAEESLEMAFEALEVTSNSYVDSPPVQPRSSRAALIVARVVLGHRYKPGMGLGWNDDGVAS

SEQ ID NO: 166795 - protein, 130 aa, Glycine max
  Coding DNA Sequence Number=SeqID_75110
WEDLWGPGVERNEDKGYVGVRELSEGGQLGMVGLCVICGCGELTRTIARPPPMVPGDMSRGSGDLGDVRRAPGSQPIKEQRPQSKGACVVAGQLRILCDIWDMASGNRLPREVEMAFGNRLPRGVIDYQA

SEQ ID NO: 166796 - protein, 208 aa, Glycine max
  Coding DNA Sequence Number=SeqID_75111
MAAGFAALITALCKAKGVTSDLLSFESLSPTINLAYVKNNCWNLDDPTVTFWGPRKAKGKRSEAPPSSALPTFAPSTSTATPFAVASSLPALASAPVSSGPSTFSSETLFAILQSLHKGQIIIMQSSSQKQPVLSMEEFLSQVAWPGVRPSPLGGGEASAAQEPVPEEDEPIPPEPFFYETDPASAQEEVASPKPVPQSSPALVLDDP

SEQ ID NO: 166797 - protein, 37 aa, Glycine max
  Coding DNA Sequence Number=SeqID_75112
GKGSALAFTTAKGPSLSRSAKSIGAGAATIASAGAAV

SEQ ID NO: 166798 - protein, 171 aa, Glycine max
  Coding DNA Sequence Number=SeqID_75113
  Homolog annotation: Hit_ID=A5ATN9; Match level="QueryCoverage=66%, HitCoverage=42%, E-value=5e-13, Identity=34%"; Hit description =Putative uncharacterized protein
MAPSDKNQSVYATVCAETNRQEAMLDSESTMGTTFAVKKYSKKGIRKCTHCYGDNHVLETCFKLHGYPDWHPKGKTTPNTKVDATSKSHISTAAGFVTKSSISNSALNLSVVTRGSEWITYSSATDHMTCDTHKFTSFSHNCSKNFIINANRVSSPIEGVDHPFQGEDGQW

SEQ ID NO: 166799 - protein, 288 aa, Glycine max
  Coding DNA Sequence Number=SeqID_75114
HKLLAEKTRKKLEEAAQSGIVDGVIDPPSPVRRHDSFEEQASQGSFVPQGHQDVLTTAIGCPEHPRCVRAAGVSVTIKKYFGSAPRTSRNSSSLPPAELQQLTQQIRDQLEESITEKVTRQLMASFSKMQSQFRSQMQSQGLMPPLEPLVGPSGPRVSTKESYVDPSGNNPETGDSDKCGLYIEAQVGVEEVKDPDVPVPVPTDETVVSLEKPPQNPDPEVDNLLYLMTLTIPELFLRPYQVTWDVPVFRVFNPNFPLYIKHEDLFEIVHGGQWLSISVLHYGFCKSF

SEQ ID NO: 166800 - protein, 51 aa, Glycine max
  Coding DNA Sequence Number=SeqID_75115
MERRPPRTRRWPICLTSWEGVELHDWEIPRFMVNAVKFSRVPKMDSDECTN

SEQ ID NO: 166801 - protein, 38 aa, Glycine max
  Coding DNA Sequence Number=SeqID_75116
MEEKKKKEEKNEAEALPNCHRNRLLHRSSFGVLRSPFS

SEQ ID NO: 166802 - protein, 55 aa, Glycine max
  Coding DNA Sequence Number=SeqID_75117
  Gene Ontology: Mol. function=aminoacyl-tRNA ligase activity; Cellular component=mitochondrion; Biological process=embryonic development ending in seed dormancy
  Homolog annotation: Hit_ID=O23247; Match level="QueryCoverage=100%, HitCoverage=8%, E-value=2e-13, Identity=61%"; Hit description =Arginyl-tRNA synthetase
MGLFAKVKGKQTRFKGPQAVGQVIRNNLPQSKMIESCSVVGPGCVNIVLSKKWIA

SEQ ID NO: 166803 - protein, 150 aa, Glycine max
  Coding DNA Sequence Number=SeqID_75118
  Subcellular localization annotation: CTP_CleavageSite=42; ConfidenceScore=5.15e-01
TASQVAGGDTLWLSAPFVNQGKRVFTLVLRRHSSPMTHEILLCWAGTTKFDSMWKRRGPAGWDIGRPNDGPLFVGMRLLLDHLKMFNIHRCGIRKVPRCFEKKPVKNTKLRVYLAKWGSNWVASSSTLLKNGSQGFRGFRNASVKFPKTL

SEQ ID NO: 166804 - protein, 136 aa, Glycine max
  Coding DNA Sequence Number=SeqID_75119
MGAKHLTRTKEWSHVIEQRSPDEIRLVLFECVLHGCCGSLGGLMGTRVERNEDMGYVGVRELSWRWATGDGGFMRALWMWKTCCAPSPDRHLVPHVMEWYLEICRGGKETLGTSGGVLLPKTKLDQSRPNPGIVGQ

SEQ ID NO: 166805 - protein, 115 aa, Glycine max
  Coding DNA Sequence Number=SeqID_75120
METLQKVRKAWEVVQKKDKELRGSNSGPIGGYRRWLKAHVQGLDWFPSLRTTKREEVEAPEENEELPPRPWNKRPRGLVGKSTAGTSSEGLYGAATASLSSGERKETNHEYMAWS

SEQ ID NO: 166806 - protein, 203 aa, Glycine max
  Coding DNA Sequence Number=SeqID_75121
MLVQAGPYVPPPMQQQQQQQKQQATEAPSQPSLEELVRQMTIQNIQFQQETRASIQSRTNQMGQMATQLNKAQSQNSDKLPSQTVQNPKNVSVITLRSGKQIEVPPPVAAPAPEPVKLHSTPEKEDEIVAQKRKLPDHERANKNFHAGGPSSSSSDLQQPPIPLPFPLRAIPNKKMEEVDKEILETFRKVEVNIPLLYASNKF

SEQ ID NO: 166807 - protein, 68 aa, Glycine max
  Coding DNA Sequence Number=SeqID_75122
  Subcellular localization annotation: CTP_CleavageSite=54; ConfidenceScore=5.34e-01
MILHEIRRPNSLKTVPSGVANCRKLPFGGRATRGLTSASSMGGKCAESLPTFIRGKRRKNQKKVVYEL

SEQ ID NO: 166808 - protein, 38 aa, Glycine max
  Coding DNA Sequence Number=SeqID_75123
MGTTTGEELATQLAQASKVVSSRSNRLLEEEFGRPKWA

SEQ ID NO: 166809 - protein, 93 aa, Glycine max
  Coding DNA Sequence Number=SeqID_75124
MARSVPATCLYSRDLYERELTRLLVIIPKVVIFLLMVSRVLSGVANCRNLPFGGRATHDLRVRVPRKEYARSRHQRLFEENVRKTGKDVIYEL

SEQ ID NO: 166810 - protein, 179 aa, Glycine max
  Coding DNA Sequence Number=SeqID_75125
  Homolog annotation: Hit_ID=Q2HW90; Match level="QueryCoverage=98%, HitCoverage=35%, E-value=1e-18, Identity=34%"; Hit description =Putative uncharacterized protein
MIEVSVEAIASLTQYYDQSLRCFTFGDFQLAPTIEEFEGILGCPLGGRKSCLFARFYPSRARIEKVVKILEQELDQVKQNRNGVVGIPRKRLEEKAKALANQGEWTSFIDILALLVFGTILFPNVDGPVDLAAINAFLAYHHSKESPVIAILADAYDTFDLRCEKSSARILCCTPALYV

SEQ ID NO: 166811 - protein, 97 aa, Glycine max
  Coding DNA Sequence Number=SeqID_75126
MSYRVSEKSRRTPRRRPVNVSLFCENAPIIWDQHRLQGTFKPSVFTPKAYTPKSPSGPLPPDSGPTQKKYADLIFELYKTHDSSIVLKIIFSHRASK

SEQ ID NO: 166812 - protein, 164 aa, Glycine max
  Coding DNA Sequence Number=SeqID_75127
  Gene Ontology: Mol. function=transcription factor activity; Cellular component=nucleus; Biological process=regulation of transcription, DNA-dependent
  Homolog annotation: Hit_ID=A7NX82; Match level="QueryCoverage=63%, HitCoverage=85%, E-value=9e-16, Identity=44%"; Hit description =Chromosome chr5 scaffold_2, whole genome shotgun sequence
  Pfam annotation: Domain name=AP2; Domain location=10-62; Score=72.0; E_value=1.9e-18; Accession=PF00847.11; Description=AP2 domain
MEKEKGEEEVKYRGVRRRPWGKFGAEIRDPTKPTGRQWLGTFDTAEEAARAYDRAAIGLRGALAILNFPDEYYSHLPFVLSNSSTKGNESSFDTEVIELEYLDDKHGCEAMHVLILHGIVELHYVEWAMETTLNLFFHNVVQAWENNSKSALSYFMISSWSVKA

SEQ ID NO: 166813 - protein, 133 aa, Glycine max
  Coding DNA Sequence Number=SeqID_75128
MLFSVAGRGRGRGWGEYRNLIPVPVPDFWSSGKIRIRTHTLSTRVLPVKVGTDSGGYLRNTDNGNDKDDEGSRMVVTPLAVIVTIVMVAITMTVGWNSSCSNDNGGDDNNNGGGGCNKGEVRWWWWWWYDDGS

SEQ ID NO: 166814 - protein, 402 aa, Glycine max
  Coding DNA Sequence Number=SeqID_75129
  Gene Ontology: Mol. function=phosphoinositide phospholipase C activity; Biological process=intracellular signaling cascade
  Homolog annotation: Hit_ID=Q2HTA0; Match level="QueryCoverage=87%, HitCoverage=61%, E-value=8e-37, Identity=28%"; Hit description=IMP dehydrogenase/GMP reductase, related
  Pfam annotation: Domain name=DUF1723; Domain location=151-200; Score =63.8; E_value=6e-16; Accession=PF08330.1; Description=Protein of unknown function (DUF1723)
MARTRGLGRATGRVIGRDRQDDHDDVPERRRPTASARRQQVYQMIQDVPDMTEDVPDMAAEAPEMTADVQGHDGAEGSHADGFPGGPRDPLVLTSFSNHVAHAVWSGQERPDLKLVSHGKKVTLIGRSVPEIEGLVGATGLSSLIDCSVVTGDPGLISAFVERWHSETSTFHLPVGELTITLDDVSSLLHLPITGALHSFHALSTEEAIFLLIELLEVSAEEARAETTLTCGAYAQLRWVRDIYEMRYAFRDLGQSGGYAWGVAALVHMYDQLDEASRTTTRQIAGAGSMSTFLAHMKEIIGAPYRARCDALTVTNVSWLPYSEHRGVRAFELISSFQGQLRWGPMVVTARPERVIRQFGYIQSIPPPPVSARLSHDDINDRWMHFAEHVLPVGELCLVSGQ

SEQ ID NO: 166815 - protein, 121 aa, Glycine max
  Coding DNA Sequence Number=SeqID_75130
MTIWRCMGNRQSNWRVPQHRSRLRLCRDGKRMQLKGNRHSYGRVSLNWSCQWYWRVRHKGGANNIGDLVCLYTSLFLQTQCSGGTYEEERNVVEELMKKKKAMQGTQLWSHGASSFIRPKF

SEQ ID NO: 166816 - protein, 80 aa, Glycine max
  Coding DNA Sequence Number=SeqID_75131
MHAPRKPPVELASLLFAKKSPVVIAISPCIGNRQSNWQVPTDTKNEGTLSKSGNRKEEKEGILKQAQPNSDAKRATNCRR

SEQ ID NO: 166817 - protein, 89 aa, Glycine max
  Coding DNA Sequence Number=SeqID_75132
MENEGGTKCGFVSGFALGPFVEFQLGPLYFHEQVCCTTRYVDRVSCSKFPMQLAHCCYLVHYQAKGGDGGVVGDVAGEYKEEVEKIGDS

SEQ ID NO: 166818 - protein, 244 aa, Glycine max
  Coding DNA Sequence Number=SeqID_75133
  Pfam annotation: Domain name=VQ; Domain location=82-112; Score=34.7; E_value=3.4e-07; Accession=PF05678.5; Description=VQ motif
MAAITDQWMQFYQQPLMDSHGHDHHALAPISTELGFSDATVTTTTSSPTPTMPSSESNSILSQLSPKGNVSKPIRRRSRASKKTPTTLLNANTTNFRALVQQFTGCHSTTMPTLGVQKGPITLNFQQGNSSGQKVHHNTSSRVVLPFSGRSHNNSNSNNNQVHQVPSPFPNGQKQEDEEQRQLPQQSGYSFDYVKNSGFLPSSGNSIRPTTTSMDHVSDGCIFLVMITKLLYIPATIFILSVFN

SEQ ID NO: 166819 - protein, 385 aa, Glycine max
  Coding DNA Sequence Number=SeqID_75134
  Gene Ontology: Cellular component=chloroplast envelope
  Homolog annotation: Hit_ID=A7NVZ6; Match level="QueryCoverage=97%, HitCoverage=76%, E-value=1e-117, Identity=60%"; Hit description =Chromosome chr5 scaffold_2, whole genome shotgun sequence
MVADIQSSKEKPKELSSWLKTFGRHLQDKSLYALGISSEFQLGMDDTLLFGLDAYEDTEKPRGKAVFHHKNFMAVVLDEELPVKWAILLLYHDLTVEAVYPGLFVDTTGNYWDLPFSMAVDLASVTTSDSSTAYHLCARYTSGSPKQFENVQNQNDRVPPPTLLPGLAFKSAFSYRKKVDIWRSEAKKLKLVQPYDIFLSNPHVSASGIIGAAATTAFGDNSARAQVEDGSPGFFLQASGIKSSFLADIFASVSFTAQHGNFQRLFLDLTRFQARLDFPSGFKFLSAATGLTQDLLNSQKPSMDAVQAIIPNATLSLQQQIVGPVSFRVDSGITVDLKNPDWPIHALEPVFALEYALQVLGSAKAVAWYCPKRQEFMAELRFFET

SEQ ID NO: 166820 - protein, 104 aa, Glycine max
  Coding DNA Sequence Number=SeqID_75135
  Gene Ontology: Cellular component=membrane
  Homolog annotation: Hit_ID=A7QKA3; Match level="QueryCoverage=42%, HitCoverage=14%, E-value=2e-12, Identity=75%"; Hit description =Chromosome chr2 scaffold_112, whole genome shotgun sequence
MLERESAGYNILLTGESLSIPIARANADADADVVTTTAQDHYLPVSFNQAISATMPFFTAIFAFLITCKKETGVVFGIVVTGNSEAEKTSPPLSLARWRRRRPW

SEQ ID NO: 166821 - protein, 72 aa, Glycine max
  Coding DNA Sequence Number=SeqID_75136
MEFEAMARQKVTERLGESAIGEDSFIRNECVPNCELEGREFESKRRKGIGAIGVRDFSFSLACLDSKERSLF

SEQ ID NO: 166822 - protein, 95 aa, Glycine max
  Coding DNA Sequence Number=SeqID_75137
MGLPEEPSFYTEHLLRQRPSSPTTTISCPLRLVPFEAAADKAMGCKFFFFLRFSGVYVGLVDEADLRAVSERLSGTACCHPSSVVCHPVPHYQFR

SEQ ID NO: 166823 - protein, 38 aa, Glycine max
  Coding DNA Sequence Number=SeqID_75138
MGSTNGKVKSNDSTGDVLGNKQNSAHKNGSKKSQQDRY

SEQ ID NO: 166824 - protein, 91 aa, Glycine max
  Coding DNA Sequence Number=SeqID_75139
MDSMNSMMEKLFKQVQLLGAKSNLEEEEEEVGSKAGSDKILDSAQIPFPTFDGMNYHEWRAKAEQFFELENTPQAQRRKLLLLSMEGKAFV

SEQ ID NO: 166825 - protein, 162 aa, Glycine max
  Coding DNA Sequence Number=SeqID_75140
MAPTRHPLDPDKSNRALGFPALITGLCQSFGVPVAPSKVIRWPITRAFVEKYCTQRQAQGDVPQAADAPPPHQAGPAGSFDTEQYLRHLMSLSLQSQGFTSFPCPTPDQVRAEVAWPGDWPEARAVEAPAETPAEAPDEADEAREDEEMADLLDFLGGSGAT

SEQ ID NO: 166826 - protein, 183 aa, Glycine max
  Coding DNA Sequence Number=SeqID_75141
  Subcellular localization annotation: CTP_CleavageSite=41; ConfidenceScore=5.35e-01
MWISPCGSVSWDRTHKTPSGPGGAQQGPGVSSSGYKSLSVLQGARPSQQGIAPARHPVDPEKSNRFLGFPALITGLCQFYGVPVTPNKVIRPPINQAFIKKYRVPQAGAGRDTPAARGWPAVGNRRTAATSRIPQLIYKGWSFAYDLWPTSRQPSPKPKVSKSTRSVTNKSSRVQLQTLKKRY

SEQ ID NO: 166827 - protein, 312 aa, Glycine max
  Coding DNA Sequence Number=SeqID_75142
  Homolog annotation: Hit_ID=UPI00016621D1; Match level="QueryCoverage =80%, HitCoverage=42%, E-value=4e-09, Identity=26%"; Hit description =UPI00016621D1 related cluster
GLHVLAIRGLHVLAIRGLNALTFRGLHVLAIRGLQSTPLEDYMSSPLEDYTGLHVLTFRGIHVLTFRGLHVLAFRGLYDLPNRGQHALTFRGLHALTFRGLHALTFRGLHVLPIRGLHGLTLRGLHVLTIRGLHVLAFRGLHILAFRGLHVLAIRGLNAFTFRGLHGYTPSPSEDYTSSPSQGNTSSPSEDFTSSPIGLYDLAIRGQDVLTFTRLDAFTFRGLHAFTFTGLHVLPIRGLHALTLRGLHVLAIRGLHVLAFGGLHVLAIGGLHVHTFRGFDVLTFSGLHVHAFKGLYDLAIRGQQALTFRGLH

SEQ ID NO: 166828 - protein, 69 aa, Glycine max
  Coding DNA Sequence Number=SeqID_75143
DCHHQKGGDCGSNVFQDYFDDAKESRVKQIPKIQESSFKNQDSRFKIQESSFKNQDSRTVKIKIQDSKF

SEQ ID NO: 166829 - protein, 134 aa, Glycine max
  Coding DNA Sequence Number=SeqID_75144
MASRKRKAPASASQAHYDRSRFTSQEAWDCYSDIVIGKKILPERNVMIYHTEFDEFKTKLERRNWHKELTNFLDGSNDVALVKEFYANLYDLEDKSPKQIDSRCFDDNKDDDKNPMRMISRLSQEQFKNQESST

SEQ ID NO: 166830 - protein, 93 aa, Glycine max
  Coding DNA Sequence Number=SeqID_75145
MAEDQPRRVTLEDYSSSAMPQFFTSIVRPEVQAHNITYPHSMIQLIQDKTRVHTCQLTLKFAIKSSLQVGGCSICGGAHESRCCIPLDDTAQE

SEQ ID NO: 166831 - protein, 34 aa, Glycine max
  Coding DNA Sequence Number=SeqID_75146
MKKLIMERMENKVKWWLDRNIEMTITQATGLQMR

SEQ ID NO: 166832 - protein, 35 aa, Glycine max
  Coding DNA Sequence Number=SeqID_75147
MMQRSKTHIAETHSCALRANVTFEFKTLVLSLAPR

SEQ ID NO: 166833 - protein, 117 aa, Glycine max
  Coding DNA Sequence Number=SeqID_75148
MGYPSHVVLGGGRAMVQNNSPHPQITYKPTILCCPPPTELTYSHVALILVPLNAGSPSILPSFHNIQNPCALPFPQPAIHKHFSALMQNSAAHFHSKILHKVQISKTTLAFIQFCPN

SEQ ID NO: 166834 - protein, 95 aa, Glycine max
  Coding DNA Sequence Number=SeqID_75149
MAEPSKKHKGSSSRSQWHSEVQDTPIPSSISSSSWFSSEEQRIWYTNLFSSHSIIDPKFIDMDFFSDESFKCIEAFQNSNLIPCMSLKLPVYSEL

SEQ ID NO: 166835 - protein, 66 aa, Glycine max
  Coding DNA Sequence Number=SeqID_75150
MWDVAWKGLSKTYMDEMTLRKLSAKRSRRDATAEGTSVTPEFDSHCFRSAEHQQRFEAIKGWSFVP

SEQ ID NO: 166836 - protein, 198 aa, Glycine max
  Coding DNA Sequence Number=SeqID_75151
MAGRRVQIMRTSMTPLTQTWMTLLLSNILPSNHNSDLPLPKCQLVYAILTQVSVHVAQLISDAIYQFVGITPPRHPVDPEKSNRALGFPALITGLCQFYGVPVTPTKLIRPPINRAFIEKYCMPSQAEQQGQAQQQQEEHVTDRQTANHRGLVQLNESFYRYTLHQQSQDPSPFPWPTPEQIRATIAWLGDRPSIQIG

SEQ ID NO: 166837 - protein, 169 aa, Glycine max
  Coding DNA Sequence Number=SeqID_75152
EVFVSLNCELSVVVCYNGVWEVIPADEVFDCSWGLWQWSQYVRTPHGEGPSGAQTLEIVRRSMWHICKLLALFASLGKVEGVCPECWPVVVGSHHFGGKGASSSVETANPFMKLSYDILAIKDDVVTGLLFEASGFVLRFLVDSLEVSGLLGASQLGEQVCYGIAFLGD

SEQ ID NO: 166838 - protein, 128 aa, Glycine max
  Coding DNA Sequence Number=SeqID_75153
MVAGNTTIEKPREDWSEEERRLVQYNLKAKNMITSTLGMDEYFRVSNCKSEKDMWDTLQKKKGIALKASSSIQEESDKEDLIDLNEDDDLSLFLKRFNKFLKIRGNQRIPNFKPKRRTEDSSSTPKCF

SEQ ID NO: 166839 - protein, 75 aa, Glycine max
  Coding DNA Sequence Number=SeqID_75154
  Gene Ontology: Mol. function=aspartic-type endopeptidase activity; Biological process=proteolysis
  Homolog annotation: Hit_ID=A5AZ88; Match level="QueryCoverage=80%, HitCoverage=5%, E-value=1e-09, Identity=51%"; Hit description =Putative uncharacterized protein
MEEAEKEILETFSKVESTDVVIHLANRSVAYPVGFIEDVLVRVGELIFPVDFYILNMEEEFSQGSVPIILGRPPS

SEQ ID NO: 166840 - protein, 86 aa, Glycine max
  Coding DNA Sequence Number=SeqID_75155
MLKSDSNGPQRSRTPTTVTNPSDDDGVEETTVTGLHVVVKRVGQVRHPSGLTLCYNGELEWETNSSFGRIHGTGTVLSDQIPKNLS

SEQ ID NO: 166841 - protein, 260 aa, Glycine max
  Coding DNA Sequence Number=SeqID_75156
  Gene Ontology: Mol. function=ATPase activity, coupled to transmembrane movement of substances; Cellular component=integral to membrane; Biological process=transport
  Homolog annotation: Hit_ID=A2U111; Match level="QueryCoverage=80%, HitCoverage=33%, E-value=2e-37, Identity=38%"; Hit description=ABC transporter, ATP-binding protein, MsbA family protein
MTKATHYHNESDDVSVVDFNNLTQIINNLGKTFEKLGPKNFTPKYNDKIASLGTILPVLGMLFGTIKPQKYESAPVYSGDVIDFFSYIKDYSNYYVQSLVTEYGSLKVLAWLCVVTAFMFLLRNAFRYFGSFLLINYRVGVTKDLRGAMYRKILSLPVSFFTESRKGDLMSRMSNDVGEVEGNILGSLIDLINAPFMLISTLITLFFLSPEMTLFSLLILPVMGTMIALIGKSLKKDSHEAQHELGNIFSIVDETLKSSK

SEQ ID NO: 166842 - protein, 100 aa, Glycine max
  Coding DNA Sequence Number=SeqID_75157
MVTAKCVMDMGKGNLEMSVEDQKATFNLFEANEHPEPPPSLPPAAGDDTRGILAQVAWPRVQLPSFRGGDTFGVANDDVADVEADDDYVVDISDATELGI

SEQ ID NO: 166843 - protein, 249 aa, Glycine max
  Coding DNA Sequence Number=SeqID_75158
  Subcellular localization annotation: CTP_CleavageSite=33; ConfidenceScore=5.44e-01
MNVGALISGQITSMAQSNSSRLGFPTLITTLCRSRGVASDSLVFERLSPVINLAYIRKNCWNPDDLTVTIKGARRARARLAEAPSTSATPPPARTLAAPSTPSSTDSQHLEAMLRSIHQGHIVLLQSLQLVAPPDSIPSIEQFNEWVPQPREDESSETSTLKPLIRRKRVVETQEATTTSKKSLETTSEPLEPMLETTSIQQAVDPSTPEDQTTPVLSPNTSPLATPVLHLTDEEDVQTQDTQDRSQDF

SEQ ID NO: 166844 - protein, 92 aa, Glycine max
  Coding DNA Sequence Number=SeqID_75159
MYNSIITYIGLHCSAHWQMVIILPKENVVIWFCSLHTRPDNYLKGIINSALKDLTILHKVNPRLVLGGLLLNVIDKKEAPSVGITSCTGCQL

SEQ ID NO: 166845 - protein, 570 aa, Glycine max
  Coding DNA Sequence Number=SeqID_75160
  Gene Ontology: Mol. function=catalytic activity; Cellular component =cAMP-dependent protein kinase complex; Biological process=intein -mediated protein splicing
  Homolog annotation: Hit_ID=A7MQ22; Match level="QueryCoverage=36%, HitCoverage=79%, E-value=2e-98, Identity=80%"; Hit description =Putative uncharacterized protein
  Pfam annotation: Domain name=PP2C; Domain location=45-298; Score= -44.4; E_value=0.0024; Accession=PF00481.12; Description=Protein phosphatase 2C
  Pfam annotation: Domain name=SpoIIE; Domain location=93-298; Score= -36.9; E_value=0.1; Accession=PF07228.3; Description=Stage II sporulation protein E (SpoIIE)
  Pfam module annotation: Pfam domain module=PP2C::SpoIIE; Domain location=45-298::93-298
MIAGIRAIIASMLQSFNPDQLEEEARQAGSLSRLGLPGSRKAALWEHFVERYGETAGEIEDDFHTLFGEAFLHAYDLEGDRASNQDQTGEVIGERSACFVVCDGVAGFPGGDVAARIARSSLMEAFDGNAHLDAQSIRNYVNHANHAIRQQQKASSEHSRMGTTLVSLFVDRDYELAYWAHAGDSRLYLFRRGYLYHVTTDHSLVQQMKDAGHQTEGINSNLLYFALGMGDEQRDASYSDVVEIEDGDAFLLCTDGFWHGVTLEQMQQSLHMVNTPEEWLTLMQQIIRNFSRLTVSRITSARWPSGLAHRRTPPYCTRCPKRRSFSLFEIENANMKHGLLGLAALLLSTHAFAENYRIVQSPAQKLDVWIDDVKDNQLASWCKRNVDLRIVTHGAKNVAALEDFLPRVAGLMASQCKALQQLNWTLNDDDGNPIASGSAAKAQQWQTVVTPPPAPVQQPETAAVAPAAPVLNSPQADTTPWLQFSLLDGCHFRTWWQHPAQTSALFVPSKQGLSCGQDGWLSGRSSLTQMGNGAAKSVVVTFLQGFPIAGLNNKQQSAELSITTVNSERM

SEQ ID NO: 166846 - protein, 252 aa, Glycine max
  Coding DNA Sequence Number=SeqID_75161
VGGDSAHFPPLEDAPVSLTSPSRRRVGCDTPVPIPTNEVSLVGQAIHTFLAWPTHLPVLSPAKPPQKLDPEVNDPLYLMTLTILELFLRPYQVTWDATVLGVFNPDFPLYIKHEDLSEIALGGQCLSISVHLTETSMRAGNSDINGFLEPQSIQRCGQSQFETGSQTTTFKGIINSALKGLDDALQSKSKASARWIVVKCNRQKGSTECGYYVMHWMSTIILGSFKNNWEATVRAREIKGAANPVGTILSPS

SEQ ID NO: 166847 - protein, 51 aa, Glycine max
  Coding DNA Sequence Number=SeqID_75162
MSKGVRKESEGGACHSARPGELGCFLQKAPPSRELPGRPKWAWLLFAPPGY

SEQ ID NO: 166848 - protein, 88 aa, Glycine max
  Coding DNA Sequence Number=SeqID_75163
  Subcellular localization annotation: CTP_CleavageSite=25; ConfidenceScore=5.04e-01
MTGVMVLNRGQQPKLGPHQSHFFAVARNVKVFWLTATATAILNHDRSLWGFGNSDVLKKASLWWRDLAKLESIGVVPTNLERDEQGLE

SEQ ID NO: 166849 - protein, 70 aa, Glycine max
  Coding DNA Sequence Number=SeqID_75164
MDSSDALNGMTLRSAQMHSSSFFQILPCAQPWSVALNGWLAKPEDWLSERMKINTSQTYLINLKLRGNDY

SEQ ID NO: 166850 - protein, 125 aa, Glycine max
  Coding DNA Sequence Number=SeqID_75165
  Homolog annotation: Hit_ID=A5ARS1; Match level="QueryCoverage=41%, HitCoverage=15%, E-value=3e-08, Identity=57%"; Hit description =Putative uncharacterized protein
  Pfam annotation: Domain name=RVT_2; Domain location=1-117; Score= -180.8; E_value=0.009; Accession=PF07727.5; Description=Reverse transcriptase (RNA-dependent DNA pol
  Subcellular localization annotation: CTP_CleavageSite=24; ConfidenceScore=5.30e-01
MDHFKVQRLKRTTFQVLIPSLNVNTTPESGIFFMTSFLRFFRRFPQINVGGDSAHFTPLGDAPVSLASLTRKRFFLELEIIQKDNRIFIHQEKYTKDLLKRFRIDEAKPMATHMHPSTVIDKDEK

SEQ ID NO: 166851 - protein, 153 aa, Glycine max
  Coding DNA Sequence Number=SeqID_75166
MVGYPFTWSSSKGIVNGVEERLDRAMEDVEEMVKGSWNNSSKVDFSADEREVVVRRFLDDYVATSGKYINLQKSEVTISRNVDQGAKKAIFNFIKDKHKGHLVIRTPPINDLENLKVRVLMYKEALCWNYTLHEQILKVEDVKAIRSRRSHDH

SEQ ID NO: 166852 - protein, 391 aa, Glycine max
  Coding DNA Sequence Number=SeqID_75167
  Homolog annotation: Hit_ID=A5BDZ8; Match level="QueryCoverage=28%, HitCoverage=7%, E-value=4e-07, Identity=30%"; Hit description =Putative uncharacterized protein
MAPLVSTAPQSWMILTSYYGGNRQIVKLEIKIQHTPIGNNKIRFFYHSILPHEHLDGILKGLPKEYGPVIESMFEPLSIGEVEALLLVHEARMKKFQKRFADSPSVNVAQVYNSSSNLTIHPRIISVHKIDPIILEIVVTSIVAVATFMEAMILTTAVATVEEAMALAVLEVVVEAAEAAVIMQIFSAKFASNWVTQQQCHFCNDSNFQPNASLMQMEPVFQSNSSNTFGSEQNQGTNTHKDSQPSAMLVDSENQDPNSTTWIPDSGASFHVTGESQNIQQLGPFEGPDQIYIDNGQGLSIKSSGYTKEPMKSYFKVHWVLMASTYFHILHSDSTSATCLLSSSSPKNENCIFKDFVCIERGIREYYAIPCLPNGPAPFIFIHDIASHHKG

SEQ ID NO: 166853 - protein, 125 aa, Glycine max
  Coding DNA Sequence Number=SeqID_75168
TIVSTATPLGLEVIPQVKVFLDEGLVCIVRHQIPKIGGMMNVLSGANLFCKITHAPNIFMIHVHREFLGVPMEPKRIKGRSPEFQEYLSMSPRELDIRLQEDWTKDSGEVPRVLMSLRVDFEPMG

SEQ ID NO: 166854 - protein, 143 aa, Glycine max
  Coding DNA Sequence Number=SeqID_75169
  Homolog annotation: Hit_ID=A5AV98; Match level="QueryCoverage=97%, HitCoverage=19%, E-value=1e-24, Identity=41%"; Hit description =Putative uncharacterized protein
MTVADNIKITLPKTDNTKMFMGLVGEHSQTTDKSLAGTLMSTRTIMKFDGSHTTHELVIEMANFILNSLSSEYDPFQMSYNTMKDKWHTHELHNMLVQEETRLKNQGSHSVYYVSHQGNQGAGRKKHDKGLGPLKINDDPVQI

SEQ ID NO: 166855 - protein, 51 aa, Glycine max
  Coding DNA Sequence Number=SeqID_75170
MATPMSTACYLDKDETDQSIDVKQYQESYPNQINIKMQYLGSDPRSSPGEQ

SEQ ID NO: 166856 - protein, 84 aa, Glycine max
  Coding DNA Sequence Number=SeqID_75171
  Homolog annotation: Hit_ID=A6FJQ2; Match level="QueryCoverage=45%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPASNGGSWWQPVVMGGGEEGVRVWVVVWRGEE

SEQ ID NO: 166857 - protein, 39 aa, Glycine max
  Coding DNA Sequence Number=SeqID_75172
MVIRSQFFIRMNPPFSRSSLQCIGGLSGQMIRSSKREGN

SEQ ID NO: 166858 - protein, 101 aa, Glycine max
  Coding DNA Sequence Number=SeqID_75173
  Homolog annotation: Hit_ID=A5C8K0; Match level="QueryCoverage=87%, HitCoverage=4%, E-value=2e-12, Identity=38%"; Hit description =Putative uncharacterized protein
TCKWLLQDSGTLKRVSWGLDIGTRAIDLNVWDAIEVGPYIPTMVAGNTTIEKPREDWSEEERRLVQYNLKAKNIITSALGMDDYFRVSNCKSAKDMWDTLQ

SEQ ID NO: 166859 - protein, 169 aa, Glycine max
  Coding DNA Sequence Number=SeqID_75174
MLSSMSLNILSMILFHLYLTVTSSKSDFLPTAHIPLVLPSHNELTHSSQHAKTNFTSVSADPSRSLNTEFPNSQNVTSLLLFQMLNQILLLMNTLTQFLTNKNPSALSGTSSSQSHTVSSPYNPVLPSQNVHPVQTRSKSGIHQSRLHPSLFLAHCEPKTVEEALADPQ

SEQ ID NO: 166860 - protein, 84 aa, Glycine max
  Coding DNA Sequence Number=SeqID_75175
  Subcellular localization annotation: CTP_CleavageSite=48; ConfidenceScore=5.48e-01
MTKNGGKSSRNHPRKRLGRVTEAPRLGFSSWKQFFSVILRKRGRSLPPSSPKRARLLPPEGTAFWWNFLEGPSGPSCYLQPLVY

SEQ ID NO: 166861 - protein, 124 aa, Glycine max
  Coding DNA Sequence Number=SeqID_75176
MTGPLDESISCFLIRVDPCVLVPITYRRLHVLAIKGLHVLAIKGLYALTFKGLHVLTFRGLHVVATYPLAGGRRVTRGCVFQERKMRGVATNVYSMKMSEKPERCGLRTLSERFGSCIYARGRY

SEQ ID NO: 166862 - protein, 94 aa, Glycine max
  Coding DNA Sequence Number=SeqID_75177
MHQGQSSEPVHLGHKRGQDLKDKQRSDLDRPATGKFVSDVTGKKGYHALTKGLGSSSSMDSFASWKMNDSEMEKEEKEETPLQGEDESRKSSPP

SEQ ID NO: 166863 - protein, 32 aa, Glycine max
  Coding DNA Sequence Number=SeqID_75178
MDSSWLMSISPSSTCDMTVLVINGDSGCDGRD

SEQ ID NO: 166864 - protein, 283 aa, Glycine max
  Coding DNA Sequence Number=SeqID_75179
  Homolog annotation: Hit_ID=A7UQU7; Match level="QueryCoverage=49%, HitCoverage=24%, E-value=7e-20, Identity=39%"; Hit description=IMP dehydrogenase/GMP reductase, putative
  Pfam annotation: Domain name=DUF1723; Domain location=136-185; Score =50.0; E_value=8.4e-12; Accession=PF08330.1; Description=Protein of unknown function (DUF1723)
MARSLGRGDGDDSDVPTDSPANSPTILEAEAAVAGDKPMVDADAQDIGPETNTQNIGAQDAANEPEGFPGGPRNPSVLTEYADHVAASVWSGQERPELKLSSHGRKVHNLGRPIPAIEDMVAGTGLSPLIACSIDTGDRGLISSFFERWHRETSSFHLPVGEVSITLDDVVSLLHLPIVGAFHDFQPLRTDEAVLLLVELLMVSTEVAMAEIGQCGGPYSLRDLTLAGRYAWGAAGRIHMYDQLNDASLSTTRQLSSYITLLQCWIYEHFPSVAECNADPDYD

SEQ ID NO: 166865 - protein, 106 aa, Glycine max
  Coding DNA Sequence Number=SeqID_75180
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=100%, HitCoverage=14%, E-value=4e-19, Identity=47%"; Hit description =Lipoxygenase
  Subcellular localization annotation: CTP_CleavageSite=54; ConfidenceScore=5.01e-01
MALAKELMGFSSFDSASYKVFLHNKHGTFWFNTILLPSDNTRVVRLRKGAKFPMAAISEDLIKTTLTVHAEKPDFKETILKHLDAINDRIGTRNIVLELMSTEIDP

SEQ ID NO: 166866 - protein, 523 aa, Glycine max
  Coding DNA Sequence Number=SeqID_75181
  Gene Ontology: Mol. function=N-acetyltransferase activity; Cellular component=membrane; Biological process=cell redox homeostasis
  Homolog annotation: Hit_ID=Q3SHE8; Match level="QueryCoverage=54%, HitCoverage=91%, E-value=1e-56, Identity=44%"; Hit description =Integral membrane protein, DUF6 precursor
  Pfam annotation: Domain name=DUF6; Domain location=219-347; Score =54.9; E_value=2.7e-13; Accession=PF00892.11; Description=Integral membrane protein DUF6
  Pfam annotation: Domain name=DUF6; Domain location=372-499; Score =70.9; E_value=4.3e-18; Accession=PF00892.11; Description=Integral membrane protein DUF6
  Pfam annotation: Domain name=TPT; Domain location=363-497; Score= -23.8; E_value=0.014; Accession=PF03151.7; Description=Triose -phosphate Transporter family
  Pfam annotation: Domain name=UAA; Domain location=219-505; Score= -173.0; E_value=0.095; Accession=PF08449.2; Description=UAA transporter family
  Pfam module annotation: Pfam domain module=DUF6::DUF6::TPT::UAA; Domain location=219-347::372-499::363-497::219-505
MGAPGIPSAGMVTMVMVLQSVGLPAEAIAILLPIDRLLDTVRTTVNVEDIPVLCALVNAAYRGETSRAGWTTEADLLTGVRTSERTIQALMAREDACILIGEEAGGVMAASICLERHPAQEDTVQFGMIAVSPLLQNRGYGKTMIRAAEKLAMSQWADRGDAAFPTPARYVATAAIQSIYCCDDEPKGIVAGRHIVPRAPMKESTHPYYGAMLVLLSSIAFSSKAIMVKLAYVYHIDAATLIALRMAFAIPFFAGLGWWAMRQGMPASMTGKDWMTLVLLAVLGGYGSMWLNFEGLRYVSAGLERVILFLYPTLVVAMSAIFLKHQITRREWFAMVTSYAGVVMVVWHDVELAGLASTETLYGAWLVLLSAVVYAAYLLVSGQLIPKLGASRFTALTMSLAAFASACHFGASESLSGVMGLPHGVYALAFLMALIATVLPSVLMNMGIHQLGSRKASLISAIGPVSTIVLAYLFLGESLSWIQAIGTALVLAGVMVRRDEHLQSNILNIFKDFDVTAFKFYTD

SEQ ID NO: 166867 - protein, 368 aa, Glycine max
  Coding DNA Sequence Number=SeqID_75182
  Gene Ontology: Mol. function=protein kinase activity; Cellular component=intracellular; Biological process=protein amino acid phosphorylation
  Homolog annotation: Hit_ID=A8GG75; Match level="QueryCoverage=66%, HitCoverage=51%, E-value=1e-115, Identity=83%"; Hit description =Serine/threonine protein kinase
  Pfam annotation: Domain name=Pkinase; Domain location=134-368; Score=- 33.6; E_value=1.3e-06; Accession=PF00069.16; Description=Protein kinase domain
  Pfam annotation: Domain name=Pkinase_Tyr; Domain location=134-368; Score=-126.8; E_value=0.00012; Accession=PF07714.8; Description =Protein tyrosine kinase
  Pfam module annotation: Pfam domain module=Pkinase::Pkinase_Tyr; Domain location=134-368::134-368
MTLLSDGKTRSQTVTFLQGYPIADLTLTRTPLEVVAVNKQRMIVTRPDASDSWLVLPFDAQQHVWRFSGTLLIKMDKNTGTDSEAVKSRVDSLRGIWSPQFMPQQKDVFRELTMSANENHTPNALPAGYRFNEFEIKEVIGGGGFGIVYRAWDHQLERTIAIKEYMPVSLAVRGADLALELRGERFQKLFNAGRNSFIQEARLLARFNHPGLLHVLRFWEENGTAYMGTLYYSGMTLKEWQLTSPDSIDEAWIRRLLPPLFGAINTIHTAGYLHRDLSLDNIQIQENQLPVLLDFGSARKEIGNLSDETEIMLKPGFAPIEQYSEEGEVEQGPWTDIYALGAVLHTLITGHAPPVSVVRCIEDNYQPL

SEQ ID NO: 166868 - protein, 104 aa, Glycine max
  Coding DNA Sequence Number=SeqID_75183
MEVNTATIVAASIATEVDPTHPSSLNQSKHPLPPYDLPSNYTPPNVAHTLDENVDNSAPIPIERQQPQSDHAYVFQPMGETHEAPRDHNLADFKPHHGYAAEDQ

SEQ ID NO: 166869 - protein, 101 aa, Glycine max
  Coding DNA Sequence Number=SeqID_75184
MTSSKCRGSSSTPICLSYIRYKLSVPTIACLIALLLYYSGTSFAPHPGKLKALLTYLMTFFFSVSTHPVTDESVVGISVNAAREFAAFVPTFSPRKNQGVK

SEQ ID NO: 166870 - protein, 360 aa, Glycine max
  Coding DNA Sequence Number=SeqID_75185
  Gene Ontology: Mol. function=transcription factor activity; Cellular component=membrane; Biological process=regulation of transcription, DNA-dependent
  Homolog annotation: Hit_ID=A8GF46; Match level="QueryCoverage=78%, HitCoverage=94%, E-value=1e-117, Identity=76%"; Hit description =Transcriptional regulator, LysR family
  Pfam annotation: Domain name=HTH_1; Domain location=75-121; Score =43.6; E_value=6.9e-10; Accession=PF00126.18; Description=Bacterial regulatory helix-turn-helix protein, lysR family
  Pfam annotation: Domain name=LysR_substrate; Domain location=145-356; Score=87.0; E_value=6.1e-23; Accession=PF03466.11; Description=LysR substrate binding domain
  Pfam module annotation: Pfam domain module=HTH_1::LysR_substrate; Domain location=75-121::145-356
PLAGRQRAEPVAQPAKKRSAQAEGAVRNQYRTAGSADWQRADRRRDPHQRQWPGGENPAAGGAAGGAAGRRNGNVHFGRAAEASFVSQPTLSMRLKNLEKELGVSLINRGNHFGGFTAEGERVLAWAREIVSVYQGLKLEVESLKHGLHGTLRLGVVPQCSISVSEMLKAVSARYPHLDYRLAVLSADQLLEALTAHTVDIGIGFFELSTLKELHFQSQPLVETGVELVFHPQHFPKLVGDTPLPLEAVAALPLCLAEPTRYFRRYLDQHFRDAGLTLHTRLETASIFQLLEGIFVGLGCGLFPRGQLQSPLMPALQRRPVAIGAMPRHAAVVVDMAERATPLAQKFFDAASEWLRRQNE

SEQ ID NO: 166871 - protein, 123 aa, Glycine max
  Coding DNA Sequence Number=SeqID_75186
MNEKVKVCLWMNALLEPKLLNPRKTMIYWQPNLITSLETISRIFSIGFNDEICSISGSSCAQLTIWAQRASITKRSFNATEESGRASISRSRPKCEIRLLSTMVVFSQAQCMTSTKLKSTNSR

SEQ ID NO: 166872 - protein, 155 aa, Glycine max
  Coding DNA Sequence Number=SeqID_75187
MVRTRGLGRALGQVTSRGVGRGDRDDSDDARQRRWPTASARRQRVVVTADHIDESVIPAPDVQDDTMEAPAAVEDIPADAGAEAAEDQPQGFPGGPSDPSVLTAYAAHVACSVWTGEERPELKLSSHGRKVHSLGRHRRSGTFVRVCGAMAPGDV

SEQ ID NO: 166873 - protein, 406 aa, Glycine max
  Coding DNA Sequence Number=SeqID_75188
  Gene Ontology: Mol. function=hydroxyacylglutathione hydrolase activity; Biological process=electron transport
  Homolog annotation: Hit_ID=A6TD76; Match level="QueryCoverage=99%, HitCoverage=86%, E-value=3e-99, Identity=50%"; Hit description =Putative oxidoreductase
MQLNGEEQGAFDRWYRQQPECSLDSAAHCADGAVYPQRALFGRYLAQQFVAAAEAHPHVTLRHVQARALAWEGQQLLLSNGETLTGDILALAISHPPPSLPRMLQPFADHPALIANPWQPGVLDSVEPDASVAIVGTGLSMADVVASLATRQHQGPLLAFSRRGQLSRANLSGEWPEWTLATQPQPSARRWLRHIRDEVARAAAQQLPWQRVLDEVRVQGQAIWQSLPLHEQQRFARHLRSWWDVHRYRIAPQVAAVIARRQQQGSLQVLAARLVAIHAHPQQLEITLRQRDGTRQNHVLDKLIVTTGPGHEALTTSQPLLQSLSEQGLIRADALGFGIDVDDRSRTLNRHGQPNARLFVVGPAARARFGELMGLPQVADHAAAVADEILKVLPVAHAERCPPSAS

SEQ ID NO: 166874 - protein, 66 aa, Glycine max
  Coding DNA Sequence Number=SeqID_75189
MNLIKPFILLCFLYGVILIAAVVAGEPWKDEEKGTNGIHEEFSGCDEVQGIRKYFLFSSHVSFYNK

SEQ ID NO: 166875 - protein, 426 aa, Glycine max
  Coding DNA Sequence Number=SeqID_75190
  Homolog annotation: Hit_ID=Q6WAY6; Match level="QueryCoverage=81%, HitCoverage=61%, E-value=2e-26, Identity=27%"; Hit description =Putative uncharacterized protein
IFSQLLIFGGVLFPNVDGLVDLAAIDAFLAYHNHKENPVVAMLADLYDTFDRRCEKSSTRIVCCTPALYVWLVSHLFRQEVRHACPLESHRSCTEKGGANWDQLLSSKEGASVNWFPRWKEGRNGVLISCGGFPNVHLMGTRGCISYNPVLPIRQLGYPMRGAPLEEELAPVISRGFDKTNMETLQKVHKAWEVVQKKDKELRGKEDKEVQTLRAELEQAQTIKERFKSASLKIRKENAELRDINVATTKALEQETKRARKEEHGRNKFRGALWGSNSELKLRREERDQSRVDSLILKDELKACSSSKRSLSQRLCETETNMLAIITKYQEELNLAMAHEHRVADEYAQVYVEKEARGRVIDSLHQEATMWMDRFSLTLNGSQELPRLLAKAKAMEDTYSAPEEIHGLLGYCQHMIDLMSHTIRNR

SEQ ID NO: 166876 - protein, 60 aa, Glycine max
  Coding DNA Sequence Number=SeqID_75191
MWTITAFEEVTKTHGLRKTPPFDFRHITEFSRIASRDFTYCAPKGAKNLEAANQRLYIIK

SEQ ID NO: 166877 - protein, 71 aa, Glycine max
  Coding DNA Sequence Number=SeqID_75192
MDSFSSWKMNGSEMEKEERKETPLQGEVSLEEAHHHRRPWIRAWRKKETNEGRGREEHGIWCSKRALKSEV

SEQ ID NO: 166878 - protein, 325 aa, Glycine max
  Coding DNA Sequence Number=SeqID_75193
  Subcellular localization annotation: CTP_CleavageSite=12; ConfidenceScore=5.58e-01
MSPASPSRQRVSCDIAASTSTIPPLLSSPPLPTPLLSPPHPATTSTTIIPSQLLSPTTTLLPPPSPPLAQPPPPLSSPPLLLSMLLPLFHPTKLIPTTIIPPLLPSLSRFHHHLHLRRHHYSTLTTVVAVGKKISSGARRPIKGACKYPYDGEWQIQGITPNVALLGSIQKKESNDGFREVPILSIENWDENFKELKCRVKDSSTTESGAICMQRTSRIGDGNLSTDYDKHNLCNHETCTTSSSRGGHCPSTSKEALWLKDDSMVADKLCEIGKVMSYPNFVWRPSIVGMRPLFDHFEVHGTHRWAIREVPWHVGSQKKALLHNP

SEQ ID NO: 166879 - protein, 57 aa, Glycine max
  Coding DNA Sequence Number=SeqID_75194
ENDRSHPAQVAAAQIRTLLYKHEGCTGLITNHLDVTLTSSVGPECVELISIVQRAIS

SEQ ID NO: 166880 - protein, 134 aa, Glycine max
  Coding DNA Sequence Number=SeqID_75195
LERIDGDPVLRETRIWATWEYAELSWRWATGDGGFMRALWMWKNLLCTIARPPPSTTCDGVKLPAFIVDHRVVPGDMSRGSGDLGDVRRAPGSQQIKGKQDHKARRLVGAKMVSGNRLPGDVIDYQALKTRSGS

SEQ ID NO: 166881 - protein, 32 aa, Glycine max
  Coding DNA Sequence Number=SeqID_75196
DDARLTGASSIGGKCAESPPTFIRGKRWRNQK

SEQ ID NO: 166882 - protein, 60 aa, Glycine max
  Coding DNA Sequence Number=SeqID_75197
MENFPVINLENINGEERKTDAILPRKGPITRTMSKRLQEDWARAAEEGPRVLMNLRGSIL

SEQ ID NO: 166883 - protein, 291 aa, Glycine max
  Coding DNA Sequence Number=SeqID_75198
  Gene Ontology: Mol. function=motor activity; Cellular component=cell projection
  Homolog annotation: Hit_ID=UPI00016621D1; Match level="QueryCoverage =91%, HitCoverage=41%, E-value=5e-14, Identity=30%"; Hit description =UPI00016621D1 related cluster
MTGPLDESISCFLIRLDPWVLVPITFRGLYVLAFRGLHVLTFRGPHALAFRGLHVLTFRGLHVLAFKWSCTFTFRGLHVLASRGIHVLAFRGVHALAFRGLHALAFRGLHVLAFKGSCTFAFSGLHVLASRGLHVLAFRGLHVLAFRGPHALAFRGLHVLTSKGLHVLAIKGSCTFTFVGLHALTFRGLHILAFRGLHVLAIRGLHVPTFRGLQAFAFKGLHVSLFKGLHALALRGRHALTFRGLHVLAIIGLHSFAFKRRHVLNFRGLHALAFRGLRVLTFSGLHIHTLR

SEQ ID NO: 166884 - protein, 98 aa, Glycine max
  Coding DNA Sequence Number=SeqID_75199
MEEVSLYQLYERVRIIYVGRLNLRPCNTGHKSPLYKQNVNLEQLLQNTSAPFSFLTHKNPNRATRGGALESTRDATIANREHLSDYLEVRDELLTLGD

SEQ ID NO: 166885 - protein, 353 aa, Glycine max
  Coding DNA Sequence Number=SeqID_75200
  Gene Ontology: Mol. function=metal ion binding
  Homolog annotation: Hit_ID=A7PUM6; Match level="QueryCoverage=98%, HitCoverage=83%, E-value=1e-32, Identity=30%"; Hit description =Chromosome chr7 scaffold_31, whole genome shotgun sequence
MNRPDPCLQDLRDKIFPLEEQNASVKLNINRKKNSPSLLKNNTKIDKAASKPDKAEDEKRGEVEALEEVSSYTIGSARRAKAAARLKFTRSAPPPSCQLDKVGGEEKKDGGLPPGETSNGSLKIKIPNSSKANSSQQPETNKRDNSELRNEMADMFEPLNSLVEPGSKKPRKKSTMQENTVTPIVRSHDNAADQNESTPSNSDSVQHQRPLRTQEKTFRISEDLNFPAQPEIGSNIKSNKEFGPIWFCLVAAEEKKASARLPQLSSSYLRVKDGSVTVSYIKKYLVKKLGLGSEAEVEITLQGRALLSSLQLRNLVDMWLQTVPKNGIQASVGSSAKDFIMVLSYGRKACDTS

SEQ ID NO: 166886 - protein, 170 aa, Glycine max
  Coding DNA Sequence Number=SeqID_75201
  Homolog annotation: Hit_ID=A5BM65; Match level="QueryCoverage=97%, HitCoverage=98%, E-value=6e-16, Identity=31%"; Hit description =Putative uncharacterized protein
MARLRLGKKFDPAKKTWKRISNKVQSKVHKLYIPKAIEATFKRLITILHTLPYLIPSRDRRSLSSKKNISSVRIDNLFCHEPSCSCSCSSSVMNVHAHAHQEERSRGKEVMIDNGIMDTIEDAWKALVAKTNEMQVDQKAEEFISKFREEMRLQKERSLQEFMEMLARGC

SEQ ID NO: 166887 - protein, 270 aa, Glycine max
  Coding DNA Sequence Number=SeqID_75202
  Pfam annotation: Domain name=zf-C2H2; Domain location=32-54; Score =17.5; E_value=0.051; Accession=PF00096.17; Description=Zinc finger, C2H2 type
  Subcellular localization annotation: CTP_CleavageSite=43; ConfidenceScore=5.41e-01
MPMNMNNIFNNSNQPSFFNSGQDPHQNNQNGFRCRLCNHVFPSYQALKAHFESHFTLENPAIRNLFSSSHANSQREMIPNPLQPNFPRPMVMQETRNFVNRNFQAPPQQPMVMPQYRANLFPCAIQHNVAASQPLQGPPEPQATQFVNNNVEMAQLLAPPAIHQMEMERCPSLHKSHPIALKFDASSTKIQPNCRTSSQDPDLEAFRYFDFSFCCILRSRSLVVIVVPSEKNETPSSHGGTRWSQRRWGKKEEDESMEGYRCTVRRLRME

SEQ ID NO: 166888 - protein, 299 aa, Glycine max
  Coding DNA Sequence Number=SeqID_75203
  Gene Ontology: Mol. function=lipid binding; Cellular component =cytoplasm; Biological process=endocytosis
  Homolog annotation: Hit_ID=A5AGS1; Match level="QueryCoverage=84%, HitCoverage=87%, E-value=1e-55, Identity=46%"; Hit description =Putative uncharacterized protein
  Pfam annotation: Domain name=ENTH; Domain location=31-155; Score =142.9; E_value=9e-40; Accession=PF01417.11; Description=ENTH domain
MGSLFLGQIKKQTSTFLQEKFKSARMTFTDVTEAEMLAEEATNKDDCSPDAKTMTRIAEASFDIDEYWRIVDVLHRRLYNIDWDQWRQSYKALVLLEFLLTHGPREFAPEFQCDAEVIEELGIFTHIDEKGFNWGSRMLKLSEQILKLLQDEEALIEARLKALKITNEIQGFGSSFNSPTSSSSSSSSPWSLSSEASQGSSSFYSFSTTSTPAYTFDSNDQLNKHHSPTSIANDGEENNILIDSDEDEDMEKPKGLLSEICSKIIGGSPIKGDNRENIEFRCLSDVGSKGENVMAGGKS

SEQ ID NO: 166889 - protein, 68 aa, Glycine max
  Coding DNA Sequence Number=SeqID_75204
MTLGAEFNVESLTCRDWNTSSKVSQKECVRFSFTGARKKRTTYISMKFSRFKKLGLGFDMLMKDRDTG

SEQ ID NO: 166890 - protein, 49 aa, Glycine max
  Coding DNA Sequence Number=SeqID_75205
MQENSRLCGGSGGARKDEMKQGSARMGLDGDQKDKHKKSVSLLRRFMIK

SEQ ID NO: 166891 - protein, 85 aa, Glycine max
  Coding DNA Sequence Number=SeqID_75206
MAKATAMVARGKGRDGANNNYMETPLGVAKEEEWYIVIVKKYTTAICILAYGSSADNVDEYVQIGDQITKTPNDYYKWEWHANFQ

SEQ ID NO: 166892 - protein, 245 aa, Glycine max
  Coding DNA Sequence Number=SeqID_75207
  Gene Ontology: Mol. function=metal ion transmembrane transporter activity; Cellular component=membrane; Biological process=metal ion transport
  Homolog annotation: Hit_ID=A7NX02; Match level="QueryCoverage=63%, HitCoverage=31%, E-value=4e-50, Identity=68%"; Hit description =Chromosome chr5 scaffold_2, whole genome shotgun sequence
  Pfam annotation: Domain name=CorA; Domain location=1-214; Score= -27.8; E_value=7.2e-05; Accession=PF01544.9; Description=CorA-like Mg2+ transporter protein
VRDELEQLLDDDDDMADLYLSRKAGSASPVSGSGAANWFAASPTIGSKISRASLATVRLEENDVEELEMLLEAYFSEIDHTLNKLTTLREYIDDTEDYINIQLDNHRNQLIQVPFHVSAPGMLHVIYRYSIMFFFFHKFAKWSSTLVQLELFLSSGTVCLSFYSLVAAIFGMNIPYTWNDNHGYMFKWVVICLRSIFCGDVSHYYSLCSQEGMVQHHVELLDMLHVELLDLPFPHSYSVLWIQSL

SEQ ID NO: 166893 - protein, 266 aa, Glycine max
  Coding DNA Sequence Number=SeqID_75208
MNGKFEYASNAGPNSNRRAPVVGTQKKEGDTHVVTTAPTWMKTPQNAKISYQHNHPNFSIRAGSSLPNQVEGPATIEKAPAQHAAPATPRPANNTTPGMSYDNPRRPPRDQFSPIPMAYSELWPSLLENHLLVAIPGKVFQSPYPKWYNSMPRAHTIVEPPDTTLILAYHSKEGPNVKTNPIASHGGASVNAIEKDRPSGSKRLEDVATSRRFIYQSLQAACMVSRGGDKSDECLFHLRELHDMETFPTVEELLQRLMVWGQLEVS

SEQ ID NO: 166894 - protein, 241 aa, Glycine max
  Coding DNA Sequence Number=SeqID_75209
  Homolog annotation: Hit_ID=Q2HTA0; Match level="QueryCoverage=45%, HitCoverage=16%, E-value=6e-14, Identity=43%"; Hit description=IMP dehydrogenase/GMP reductase, related
  Pfam annotation: Domain name=DUF1723; Domain location=122-171; Score =61.4; E_value=3e-15; Accession=PF08330.1; Description=Protein of unknown function (DUF1723)
MVRTRGRPRALGSGTSRGMGRDEHDVDVPRRRRPTASARRQRVQVDVAEEVPQVTEDIPDVTEDVPHVEEDILTADVDATDVAADGAEGSPAEHGEGIPAPEIEGLVAGIGLSPLIRCSVVTDDPGLISAFMERWHRQTSTFHLPVGELTITLDDVACLLHLPIIGALLRFEPLGMDEAVLLLTKLLEVSGNEARAETVCAHGAYVRLSWLHECNPCSCGASGGFLRPGLVWGLCLGSCRA

SEQ ID NO: 166895 - protein, 84 aa, Glycine max
  Coding DNA Sequence Number=SeqID_75210
MVHLPRKENAWSRHQHLFEENIGKNKMEKVKGLRILKMRVRELFMHEEGEKRQGVEPLNDLLILKGEKRQGIGPLNGLLIFFTK

SEQ ID NO: 166896 - protein, 165 aa, Glycine max
  Coding DNA Sequence Number=SeqID_75211
GLLSFNSDYMVWYRRKTKMFVDPNNANTTTLGEVVETLQYMVSPQGRNTWTIDDFVPYVEKLAIISEDVETRGIGRRREPVEAEEYFQQMMERGHGMYYTPATFSQYLSQMYQYPFEGHHTDTSASEHLYGGVAETQPHFSWPTMTPSQPHFSWPNIFLTLKIYS

SEQ ID NO: 166897 - protein, 174 aa, Glycine max
  Coding DNA Sequence Number=SeqID_75212
  Homolog annotation: Hit_ID=UPI00006A2D9E; Match level="QueryCoverage =94%, HitCoverage=83%, E-value=6e-09, Identity=15%"; Hit description =UPI00006A2D9E related cluster
MTKDNDWYLKTLHWAIRGTVRLHVLTAKGLHTLIFRGLYVLPLRGLHALAFVGLHALTFRGLHVLTVGGLHALAFRGLHVLAIRGLHVLAFVGLHSLTYKGLHALATLRLHALAFRGLHILAFRGLRVLAIRGLQALAFRGLHVLAIRGLHVLTFRGLHVLAFEGYMPSLQRTA

SEQ ID NO: 166898 - protein, 369 aa, Glycine max
  Coding DNA Sequence Number=SeqID_75213
  Gene Ontology: Mol. function=DNA-directed RNA polymerase activity; Cellular component=alpha DNA polymerase:primase complex; Biological process=DNA replication, synthesis of RNA primer
  Homolog annotation: Hit_ID=A4CPM9; Match level="QueryCoverage=97%, HitCoverage=54%, E-value=1e-115, Identity=57%"; Hit description =Putative DNA primase
  Pfam annotation: Domain name=Toprim; Domain location=263-343; Score =63.7; E_value=6.2e-16; Accession=PF01751.13; Description=Toprim domain
  Pfam annotation: Domain name=Toprim_N; Domain location=125-256; Score= 178.0; E_value=2.4e-50; Accession=PF08275.2; Description=DNA primase catalytic core, N-termina
  Pfam annotation: Domain name=zf-CHC2; Domain location=2-99; Score =152.6; E_value=1.1e-42; Accession=PF01807.11; Description=CHC2 zinc finger
  Pfam module annotation: Pfam domain module=Toprim::Toprim_N::zf-CHC2; Domain location=263-343::125-256::2-99
MISKQTIDKIFSTIRVEEIVGEYVQLKRAGSNYKGLSPFHEEKSPSFVVSPSKQIWKDFSTGKGGTAISFLMEIENFTYPEALRHAAKKYGIEIEEDQREFSEEAKNAQSERDLLYKIHEVANDYFQNFLWEAEEGKSIGLAYFRERELKDDIIKKFQLGYSPEKKNAFTAYALEKGYSKEILEKSGLSIFPENAPNGIDRFRERVIFPIHSFSGRVLGFGARILKNNVKTAKYLNSPETEIYHKSNVLYGLNQSKQAISRKNVCLLVEGYMDVISLHLSGIENVVASSGTSLTTEQIKLIKRLTENVTILFDGDNAGIKASFRSIDMLLTEGMISEFFYFLKEMTRIPLPEHPQDYVEIHRQMRRWIL

SEQ ID NO: 166899 - protein, 76 aa, Glycine max
  Coding DNA Sequence Number=SeqID_75214
MESGDMRGYRMVTRTFRQPRANEPVDAQRLTLSSAPFAIQGQRVRWQVEIPYGHPHFSSTEANEFDGISTMLVVRF

SEQ ID NO: 166900 - protein, 23 aa, Glycine max
  Coding DNA Sequence Number=SeqID_75215
MSKSVKISAVLHCSSVFNRRYRA

SEQ ID NO: 166901 - protein, 133 aa, Glycine max
  Coding DNA Sequence Number=SeqID_75216
MEFADHLLPAGQPCLVPGQVSADYIEWFFRISHPFMTPTQAADQQRDAPAADPEDYIQPPSPQVPVAFDPPPYVDDYEGYEAIAQRLERVLNLRIVTVGTELYDIMQDCLTIARGGPSADGTVGARQRRRTDH

SEQ ID NO: 166902 - protein, 136 aa, Glycine max
  Coding DNA Sequence Number=SeqID_75217
  Homolog annotation: Hit_ID=A7PPI3; Match level="QueryCoverage=50%, HitCoverage=14%, E-value=6e-16, Identity=60%"; Hit description =Chromosome chr8 scaffold_23, whole genome shotgun sequence
MPLRGRIASDSLEDKDMVISRICKRLELWKEVESNTIDMMIENDFSREDSEWKTNIEHIRNMAGELELVIFGFLVEKFSEELKKVIAKIATTRSRTVATLMLTKVDTAGWLKRTKQEKGEHPSALCNQGRVYSRLI

SEQ ID NO: 166903 - protein, 378 aa, Glycine max
  Coding DNA Sequence Number=SeqID_75218
  Gene Ontology: Mol. function=two-component sensor activity; Cellular component=membrane; Biological process=two-component signal transduction system (phosphorelay)
  Homolog annotation: Hit_ID=A4G8F7; Match level="QueryCoverage=65%, HitCoverage=35%, E-value=3e-52, Identity=45%"; Hit description =Putative uncharacterized protein
  Pfam annotation: Domain name=GGDEF; Domain location=298-378; Score= -12.6; E_value=4.6e-06; Accession=PF00990.12; Description=GGDEF domain
  Pfam annotation: Domain name=PAS; Domain location=174-288; Score =48.6; E_value=2.2e-11; Accession=PF00989.15; Description=PAS domain
  Pfam annotation: Domain name=PAS; Domain location=8-120; Score=46.8; E_value=7.8e-11; Accession=PF00989.15; Description=PAS domain
  Pfam annotation: Domain name=PAS_3; Domain location=196-291; Score =2.0; E_value=0.064; Accession=PF08447.2; Description=PAS fold
  Pfam annotation: Domain name=PAS_3; Domain location=30-123; Score =58.7; E_value=1.9e-14; Accession=PF08447.2; Description=PAS fold
  Pfam annotation: Domain name=PAS_4; Domain location=14-125; Score =13.9; E_value=0.0089; Accession=PF08448.1; Description=PAS fold
  Pfam annotation: Domain name=PAS_4; Domain location=180-293; Score =17.8; E_value=0.0037; Accession=PF08448.1; Description=PAS fold
  Pfam module annotation: Pfam domain module=GGDEF::PAS::PAS::PAS _3::PAS_3::PAS_4::PAS_4; Domain location=298-378::174-288::8-120::196- 291::30-123::14-125::180-293
MSIDISESKFKNLFESAAIGIAMVKPNGGWSEVNDELCRILGYSRSELLSLTFQEVTYPEDLDKDLNLLDQLVSEKIERYQLEKRYIKKSGEIVWAELTVTKHLTSNGEIDYFISIIKDIQSAKETEAALTALRKTLEEKVNLRTEELKQANMSLLNSYQEKVASEQQLKDVELELRTILDNANDAYVCITADGDVKAWNKQAELTFGWSEDEVIGRKLDKLIIPPELQDAHLKGLKRFAEHKQSDMMGKRIELEALRKDGLLIPVELQINVLEIKGQTLFTSFLRDITDRKQLENLLKNEARNDPLTGLPNRRKLEEVLPIAIHRAGANRANLSLLFVDLDGFKSINDNHGHNVGDMLLREVANRIDKCTRQSDTVV

SEQ ID NO: 166904 - protein, 88 aa, Glycine max
  Coding DNA Sequence Number=SeqID_75219
MSVEEFLAHVAWPGVQSSPSGGGEAPATQEPVPAEDELVPLEPLIFETDPVSAQEEVASPAPVPVSPAPITDDYQPSAPALEQKQPIS

SEQ ID NO: 166905 - protein, 150 aa, Glycine max
  Coding DNA Sequence Number=SeqID_75220
MATIMKAMMSVKKIMEANVVAIAATSAVAKVNPMLPSGLKQINHPISNMHAFPSYGLPPNYTPPNVAYTLNENLNNSTPIPIESQQPQSDHAHASRPMEETHEIPHHDLADFEPWLGYATERQAVGGIPFENTLESPQYHPQLHLLHSTA

SEQ ID NO: 166906 - protein, 49 aa, Glycine max
  Coding DNA Sequence Number=SeqID_75221
MPMLNQFHPCIHDSIVNIIDVKADGNCGYHAIAALLGMGEDSWLPWTSG

SEQ ID NO: 166907 - protein, 76 aa, Glycine max
  Coding DNA Sequence Number=SeqID_75222
MAAEWRRKRERRRHFKEKMSLEETHHHRRPWIRAWRKKEMNEGRGREEHGILCSKKALKSEPTNPRSSPRFSTKYA

SEQ ID NO: 166908 - protein, 68 aa, Glycine max
  Coding DNA Sequence Number=SeqID_75223
MANKVSELNVEGPEETGAEARAGKDEATANGVAVEVEGAKVGRAEDGGASDLLPLALRGPQKVTVGSS

SEQ ID NO: 166909 - protein, 281 aa, Glycine max
  Coding DNA Sequence Number=SeqID_75224
  Homolog annotation: Hit_ID=Q6WAY4; Match level="QueryCoverage=76%, HitCoverage=36%, E-value=5e-24, Identity=33%"; Hit description =Putative uncharacterized protein
MVEFSVEAIASLTQYYDQPLRCFTFRDFQLVPIVEEFEEILGCPLEGRKPYLFSGFYPSMAKVAKVVKISVQELDRVKQNRNGVVEIPRKHLEEKAKALADQGEWVPFIDTFTLLIFGVVLFPNMEGLVDLAVIDAFLAYHHNKESPTITILADLYDTFDRRCKKSGARIVCCMPALYVWLVSHLFRQESRPTCPLQGHHLCTEKGKENWEQLLASLLGYPMRGAPSVGSITPFIARGFSDTNARVLQGVRKAWNAVQRKDKELRGSSNGVIGGYHKWLRV

SEQ ID NO: 166910 - protein, 82 aa, Glycine max
  Coding DNA Sequence Number=SeqID_75225
MLLRNVIHICVRVVMLVRMIHTRLFVAAWVKSCPGMHSSCVIASLSGFIFIVGTLQYKGVAQELIPRPYWLLNRECKSRLSI

SEQ ID NO: 166911 - protein, 130 aa, Glycine max
  Coding DNA Sequence Number=SeqID_75226
  Homolog annotation: Hit_ID=Q6WAY4; Match level="QueryCoverage=93%, HitCoverage=22%, E-value=2e-10, Identity=30%"; Hit description =Putative uncharacterized protein
MVEVSTEAIASLAQYYDQLLRCFSFGDFQLSPMVEEFEEILGCPLGGRKPYLFLGFYPSLAKISKIVQISAQELDRQKQVENGVVGIPRKCLEAKARILVGKGEWALFIDILALLIFGGVLFPNVDGLVT

SEQ ID NO: 166912 - protein, 51 aa, Glycine max
  Coding DNA Sequence Number=SeqID_75227
MKAFLGKYLQGTTTKGHQSKVTVVRNSGTRDAELRWCDNLGFVCQLYDKMQ

SEQ ID NO: 166913 - protein, 538 aa, Glycine max
  Coding DNA Sequence Number=SeqID_75228
  Gene Ontology: Mol. function=N-acetyltransferase activity; Biological process=metabolic process
  Homolog annotation: Hit_ID=A7NYD4; Match level="QueryCoverage=77%, HitCoverage=71%, E-value=8e-62, Identity=49%"; Hit description =Chromosome chr6 scaffold_3, whole genome shotgun sequence
  Pfam annotation: Domain name=Agenet; Domain location=23-103; Score =31.4; E_value=3.2e-06; Accession=PF05641.3; Description=Agenet domain
MEIVHNNYSPRNRKRKRGFSRKLGVNEKVEVRSVDLGFLGSWHPATVIQCEKLKRHVRYNNVLDDGGVNYLEEAVSVLEALDGDKECYSYSRGSIRPMPPLVEFERGDLKFGLCVDVNYEKAWWEGVIFDDHSDGMEKRSVFFPDLGDEMQVGIHQLRITQDWHEVTEEWEQRGNWVFLDLVEEQKRKSFVAVSAKQIWYDVRIKNGFEKIQEWTCNMKYLWRNLVMEVINDYLSLTINEVISVLNLQLFPPTISSSLVEDEVEDVPMFCPEAVEQSDMKHLNVSGMNEENVDQVWSRDLVYRSAGNRKRKRLENSKANIQKVSASSSLTNHKPLNVLSYLIDNSIILPRCKVYYKVKGRHRKVCTLADGKITRDGIKCNCCMGIYSFVGFENHASGNSTCRPSASIFLEDGRSLLDCLIKMMHDHKTMETSGKSFSDMSWFGGRLTIFLLNHAILSAILTSLMVTGFVHHVVVGFVAKGKLTEMMRLNNYFLAFSANINIMLGAWKMELQIYQQDILEIGSVEKTVKRRLGECKQKG

SEQ ID NO: 166914 - protein, 336 aa, Glycine max
  Coding DNA Sequence Number=SeqID_75229
  Gene Ontology: Mol. function=hydrolase activity; Cellular component =nucleus; Biological process=mRNA processing
  Homolog annotation: Hit_ID=Q9LKF9; Match level="QueryCoverage=99%, HitCoverage=40%, E-value=5e-63, Identity=64%"; Hit description =Cleavage and polyadenylation specificity factor subunit 2
  Pfam annotation: Domain name=RMMBL; Domain location=71-109; Score =8.1; E_value=0.072; Accession=PF07521.3; Description=RNA -metabolising metallo-beta-lactamase
TGPRGGGYRDIFVDGFVPPSTSVAPIFPCYENTSEWDDFGEGGSDIKGKLDEGAASLILDTKPSKVVSDERTVQVRCSLVYMNSEGRSDGRSIKNILSHVAPLKLGSYLRQFHGLRLSSFETSVKNNKIGVYFQRSPDSNPHSEIVSEPSLDPLMDHPPYLSTEGQPLSYELAFGVELGSNSHSKMPEVLVHGSAEATEHLKQHCLKHVCPHVYAPQIEETIDVTSDLCAYKVQLSEKLMSNVLFKKLGDYEIAWVDAVVGKTENDPLSLLPVSGAAPPHKSVLVGDLKLADIKQFLSSMGVQGGGSGAQQIVIEGPLCEDYYKIRDYLYSQFYLL

SEQ ID NO: 166915 - protein, 51 aa, Glycine max
  Coding DNA Sequence Number=SeqID_75230
MKAYLDKYLQGTTTKGHQSKVTVVRNSGTRDAELRWCDNLGFVCLLYDKMR

SEQ ID NO: 166916 - protein, 141 aa, Glycine max
  Coding DNA Sequence Number=SeqID_75231
STLEDPQQQALRDQHKDAQTKVEYVKKLYDQVKVQIAKNESYGKQAHKKRKEVVLEPGDDLGHLRTNVFQEGGNDENHVKCLCLWAFILLHLGLHPSPLGPSSFSTRGLCPSPLRPSSFFTWAFSLYLASFMILINLLGFD

SEQ ID NO: 166917 - protein, 153 aa, Glycine max
  Coding DNA Sequence Number=SeqID_75232
  Pfam annotation: Domain name=DUF1723; Domain location=22-72; Score =15.8; E_value=0.007; Accession=PF08330.1; Description=Protein of unknown function (DUF1723)
MAHRGLGRTLDRAIGKFIGRREEHPELKLSFHGRKMTKKTNSFHLPVGEVTITLDDMASLLHLPIVVAFHSFKQLYVDVVVDMLVELLESGTYAWGAVALVHIYDNLNEASKSMTRQLEEYITLLQCWIYEYFLSVGSALAAEDYDESRPCAR

SEQ ID NO: 166918 - protein, 107 aa, Glycine max
  Coding DNA Sequence Number=SeqID_75233
  Gene Ontology: Mol. function=aspartic-type endopeptidase activity; Biological process=DNA integration
  Homolog annotation: Hit_ID=A5BJT3; Match level="QueryCoverage=99%, HitCoverage=11%, E-value=7e-11, Identity=36%"; Hit description =Putative uncharacterized protein
  Pfam annotation: Domain name=RVT_2; Domain location=1-85; Score= -175.8; E_value=0.004; Accession=PF07727.5; Description=Reverse transcriptase (RNA-dependent DNA pol
MEHMDVKTTFLHDDLEEQTYMEQSDRFIKGGLGRLVFSKEKLKSLLSKEFDMKDLGPSKKILEIEIFSGIGNPNDYGSHNKLSVDQCLKTDAELKYMSKVPHANAVG

SEQ ID NO: 166919 - protein, 52 aa, Glycine max
  Coding DNA Sequence Number=SeqID_75234
MPPKLTAKETFDIRNLQAKDPLSSSYLFEPVTKSKLALIPIVVRLRGLNTGK

SEQ ID NO: 166920 - protein, 18 aa, Glycine max
  Coding DNA Sequence Number=SeqID_75235
MGVMFNCDEPNRPVMILR

SEQ ID NO: 166921 - protein, 388 aa, Glycine max
  Coding DNA Sequence Number=SeqID_75236
  Gene Ontology: Biological process=intracellular signaling cascade
  Homolog annotation: Hit_ID=A7NYD3; Match level="QueryCoverage=94%, HitCoverage=92%, E-value=1e-162, Identity=68%"; Hit description =Chromosome chr6 scaffold_3, whole genome shotgun sequence
  Pfam annotation: Domain name=DUF231; Domain location=214-386; Score =276.7; E_value=4.7e-80; Accession=PF03005.6; Description=Arabidopsis proteins of unknown function
MALLHSLFALLFLLLSLQLHTVSCALLLSLRHHHNTLHQQRPMIHANQTNCALFVGTWVQDDSYPIYQSSNCPIIDPQFNCKMFGRPDSDYLRYRWRPLNCDLPRFNGVEFLLQMKGKTVMFVGDSLGRNQWQSLICMIYAAVPQTQTQLVRGEPLSTFRFLDYGVTISFYRAPYLVEIDVVQGKRILRLEEVDGNGDVWRSVDVLSFNTGHWWDHQGSLQGWDYMELGGKYYQDMDRLAALERGMKTWANWVDSNVDRSRTKVFFLGISPSHTNPNEWNSGVTAGLTTKNCYGETTPITSTGTAYPGVYPEQMRVVDMVIRGMSNPAYLLDITMLSAFRKDAHPSIYSGDLNPQQRANPTYSADCSHWCLPGLPDTWNELFYTTLFY

SEQ ID NO: 166922 - protein, 150 aa, Glycine max
  Coding DNA Sequence Number=SeqID_75237
MTNLERSQFLDYTFLDFQGAIMCQKLLTNNNPSPNPVLLTESQAKCDVSSGSCCANLSESSPVCELYQVEEIDLGGMMNHQMEYTCAGKNNQVIGAIDLVTIVEQPSPGDQQCQNGTTSLECSIDNNGLYKCVYTRRKVRKSCEGFSMPS

SEQ ID NO: 166923 - protein, 106 aa, Glycine max
  Coding DNA Sequence Number=SeqID_75238
  Homolog annotation: Hit_ID=A7QU44; Match level="QueryCoverage=61%, HitCoverage=7%, E-value=3e-16, Identity=61%"; Hit description =Chromosome chr2 scaffold_176, whole genome shotgun sequence
  Pfam annotation: Domain name=PB1; Domain location=19-86; Score=4.0; E_ value=0.094; Accession=PF00564.15; Description=PB1 domain
MDNLNNTLTPFVVRKEVRSMTIKATYKEDIIRFKVSMDCGIVELKEEIAKRLKLKVGTFDIKYMDRASYGSVDPYSYKAHGSVDPYELIRGIIQINFIWIRGLRIS

SEQ ID NO: 166924 - protein, 40 aa, Glycine max
  Coding DNA Sequence Number=SeqID_75239
MGGSDINGKLDEGAASLILDTKPSKVVSDERTKLIRGTKS

SEQ ID NO: 166925 - protein, 350 aa, Glycine max
  Coding DNA Sequence Number=SeqID_75240
  Gene Ontology: Mol. function=N-acetyltransferase activity; Biological process=metabolic process
  Homolog annotation: Hit_ID=A7NYD4; Match level="QueryCoverage=100%, HitCoverage=62%, E-value=5e-40, Identity=47%"; Hit description =Chromosome chr6 scaffold_3, whole genome shotgun sequence
MSPLVEFERGDRKFGLCVDVDYEKAWWEGVIFDDHCDGMEKRSVFFPDLGDEMQVGIHRLRITKDWHEVTGEWEQQGNLVFLDLVEERKRKSFVAVSAKQIWYDVRIKNGIEKIREWTCNMKYLWRNLVMEVINDYLSLTVNEVILVLNLPWSLLNEAPEPESVEAMASVDLSVTFPDKEIVVQKEPVPPVKEVLPKLQKEIGPGGAFWSEENRENRSSTHLRKFQNPDIFPPTISSSLVEDEVEDVPKFCPEAVEQYYRSGDLVCRSAGNRKRKSLGNSKANIPKCQSNGLAPRVKGRHRKVCTFADGKITRDGIKCNCCMGIYSFVGLENHASGSSTCRPSAGIFLED

SEQ ID NO: 166926 - protein, 193 aa, Glycine max
  Coding DNA Sequence Number=SeqID_75241
MPLGGRIASTRGVTSDSRSLESLSPTMNLAYIKKNYWNLDDPIVTFRGPRKPRGKRSEAPPTSAAPDASAPPSSTLPNPTTAAPSSSTPTIPASIPAQFPVQLPASSTPTSDFVFTLEMLHSMMQSLHRGGGGTSAAQEPEQAIEEPVLAEDEFTPLEPSSVVADTSMAHEEDVPAAPVLDLNEDQAQDEQDV

SEQ ID NO: 166927 - protein, 101 aa, Glycine max
  Coding DNA Sequence Number=SeqID_75242
MTGPLNESISCFLIRVHPWVLVPSPSEGYTPSPSEDYTSLPLEGCTPSSSENYTPSPSEDYTPSPSEECTSSPLEDDMSSPSEGYTPSPSEDYTSSPLEDY

SEQ ID NO: 166928 - protein, 148 aa, Glycine max
  Coding DNA Sequence Number=SeqID_75243
MASRKRARTDNIPSSSIPAPQSTSIEPNNRPIVPLEYFLEKVALPKAQLPFVRTNEATPSKPTPGQVEPIPAKPRTPVVNPPLSPELEVVPPSPPLIIIYDASSNEAVAPLDSPAKEASDPPASPVGGIADLSDSSSGEVVALTDSLV

SEQ ID NO: 166929 - protein, 117 aa, Glycine max
  Coding DNA Sequence Number=SeqID_75244
  Subcellular localization annotation: CTP_CleavageSite=40; ConfidenceScore=5.70e-01
MKKIKPRRFRNASKTFSWVISRRFSAVLHRSSVFNRLSSLAMDVWGANTFPFSSNKCWWRLHAYSFLGRRTRRRVGCDTNEDPYAHSAAFIEICNTVKIVGVPDEAIRLSLFSFSLA

SEQ ID NO: 166930 - protein, 164 aa, Glycine max
  Coding DNA Sequence Number=SeqID_75245
  Homolog annotation: Hit_ID=A2Q1D6; Match level="QueryCoverage=43%, HitCoverage=11%, E-value=6e-07, Identity=44%"; Hit description =Ovarian tumour, otubain, related
MDYPTLGKICYNMDEQGDAPMQHNNKQNSLGDLRSVWDAMNNMMMLQHTQIKASFKTSIHFVGHVYKKTLFKRLRRMVSRRLQFFDQGLCEAEVSIDDEIETIRQRFKDVDVGGKVTLKSKLREIAYPEENSMFPPSSKVNTKGAPKKGLKRSERFTKRDPSYW

SEQ ID NO: 166931 - protein, 150 aa, Glycine max
  Coding DNA Sequence Number=SeqID_75246
MYMVNNIFTLSRYKENMVQPKPSAGIKGKPHQHALTFMPSCKNTIEAFHRALGGRTFGYQQQGNGGNVACPIISEHNLGLRPSPTTPQFKETKHKLAPNCLTALVCALYGSAFAYSNPLRVDLGTTNCGRVTVYLDLSLSLDLARYLTIA

SEQ ID NO: 166932 - protein, 186 aa, Glycine max
  Coding DNA Sequence Number=SeqID_75247
MGEVEEVQEQMKTDMEAMKEQMATMMEAMMSIKGIMEVNAVAIATTNTVVEVDLTPPYGLNQINHPTSDMHAFPPYGLPPNYTPPNVAYTPNENVNNSTPILMESQKPQSDHAHVSRPIGETHEMPYHNLADFEPCLGYATEGQAVGDIPLQNTLEGPQYHPRPHPLHSTVGKNPHAMAEMGKLII

SEQ ID NO: 166933 - protein, 73 aa, Glycine max
  Coding DNA Sequence Number=SeqID_75248
  Homolog annotation: Hit_ID=Q9SVA6; Match level="QueryCoverage=45%, HitCoverage=8%, E-value=8e-07, Identity=78%"; Hit description=GTP -binding-like protein
MSWQEELERNQKASGSKSDGCARQVASYEFTTLTCIPGVITYRGAKIQFCTSALASIRGPGTMYLAYYVSLYL

SEQ ID NO: 166934 - protein, 132 aa, Glycine max
  Coding DNA Sequence Number=SeqID_75249
  Gene Ontology: Mol. function=protein dimerization activity; Cellular component=nucleus; Biological process=regulation of transcription, DNA-dependent
  Homolog annotation: Hit_ID=Q9M3F0; Match level="QueryCoverage=68%, HitCoverage=14%, E-value=1e-09, Identity=35%"; Hit description =Putative uncharacterized protein F18N11.30
  Pfam annotation: Domain name=zf-BED; Domain location=81-126; Score =53.1; E_value=9.8e-13; Accession=PF02892.6; Description=BED zinc finger
  Pfam annotation: Domain name=zf-C2HC_plant; Domain location=82-131; Score=3.3; E_value=0.017; Accession=PF07567.3; Description=Protein of unknown function, DUF1544
  Pfam module annotation: Pfam domain module=zf-BED::zf-C2HC_plant; Domain location=81-126::82-131
  Subcellular localization annotation: CTP_CleavageSite=68; ConfidenceScore=5.13e-01
MANEGTSQPQCPLISQGSTHHPTLNGQESSHQPTPNGQESSHQPTPNESANPSIVAPTPTTTDTMEVDSAATQNRPKRRRSEVWDHFEKIIVDGKVKARCNYCKKDLGGSSNDGTSHLKGHLLICPHQEDFG

SEQ ID NO: 166935 - protein, 105 aa, Glycine max
  Coding DNA Sequence Number=SeqID_75250
MTDIVCTKDDVNLRVSTGLLAAIDKGVTEIVCAEDDVNLRVSTNLLAAIDKGVSMTEIVCAEDDVNLRVSTGLLVAIDKGVSMTEIVCAEDDVNLRVSTELVGCD

SEQ ID NO: 166936 - protein, 47 aa, Glycine max
  Coding DNA Sequence Number=SeqID_75251
MAIEGFTIKRGVKESALSATPPRSARVDRALSAHVAGLARTSVGSWA

SEQ ID NO: 166937 - protein, 66 aa, Glycine max
  Coding DNA Sequence Number=SeqID_75252
  Gene Ontology: Biological process=transposition, DNA-mediated
  Homolog annotation: Hit_ID=Q1J7G7; Match level="QueryCoverage=45%, HitCoverage=42%, E-value=2e-10, Identity=100%"; Hit description =Transposase
LPGINRDTRIYLFLRSDLPSQWLLFLSAVPPVQLLTGWCVTAKAPPDISAGKCSGHAARNHHTRRA

SEQ ID NO: 166938 - protein, 107 aa, Glycine max
  Coding DNA Sequence Number=SeqID_75253
  Subcellular localization annotation: CTP_CleavageSite=77; ConfidenceScore=5.57e-01
MHTQSFTIPQFPKIGLTHKNSPQWSRQLSQPTLLRASEARLTGAFSKGGKCAESPPTFICGKCQKNRRKTVMKNIPSSGVVFTFEEGRQKWGSCSYIPSIEEEIRPT

SEQ ID NO: 166939 - protein, 69 aa, Glycine max
  Coding DNA Sequence Number=SeqID_75254
  Subcellular localization annotation: CTP_CleavageSite=35; ConfidenceScore=5.00e-01
MSPQPLEPHNHSRTHLKLFGQLPLQAWILAGGFVRACALSATLNCLACISEFRLSAFFSCSADGLKRCA

SEQ ID NO: 166940 - protein, 193 aa, Glycine max
  Coding DNA Sequence Number=SeqID_75255
MYRVGGIIHNVAYADDVVRVCVETIYDGDASVPFPTAEIQYVRDTSSTFIAWPKHLVKPIADDSNHNVHLPLRRLGEAEVAAEADPLGELMKTLFCVYKNPVEVSWEATQFGLPNVGAKFFITHADLAEIISGDKCLNISILQLWTIFVVEAKLISHCMVCSSLNLYTMLRTDVNNANNTFNHGSRNHKGSCT

SEQ ID NO: 166941 - protein, 175 aa, Glycine max
  Coding DNA Sequence Number=SeqID_75256
MASNSQQFSARNDAIVIRGVHEVVTNSSSSVETKKLEDLCPSMQQSKAIEQPEAYPANIYNRPPQPQQQNQPQQNNYDLSSNRLPSQSVQNPKNVSAIALRLGKQCQGPQSVASPSSANEPAQLHSTPEKDDDKNLKSKLPNNYCAEAAYPSSIPSKSNFQQKNGRGKEGDLGNI

SEQ ID NO: 166942 - protein, 41 aa, Glycine max
  Coding DNA Sequence Number=SeqID_75257
MAAIEMAPKKLSAKRSRRDVAAEGTSAAPEFDSHCFGSAVH

SEQ ID NO: 166943 - protein, 137 aa, Glycine max
  Coding DNA Sequence Number=SeqID_75258
  Homolog annotation: Hit_ID=Q6WAY4; Match level="QueryCoverage=72%, HitCoverage=18%, E-value=1e-10, Identity=35%"; Hit description =Putative uncharacterized protein
MVEVSTEAIASLAQYYDQPLRCFTFGDFQLSPMVEEFEEILGCPLGERRPYLFSGFYPSLVRISKIVQISAQELDHRKQVENGVVGIPRKYLEAKARNLAGKGEWAPFIDILAMRSPLSECGWVGGPSSDQRFSRLS

SEQ ID NO: 166944 - protein, 267 aa, Glycine max
  Coding DNA Sequence Number=SeqID_75259
  Gene Ontology: Mol. function=serine-type peptidase activity; Biological process=metabolic process
  Homolog annotation: Hit_ID=A0K360; Match level="QueryCoverage=37%, HitCoverage=70%, E-value=6e-47, Identity=89%"; Hit description =Transcriptional regulator, HxlR family
  Pfam annotation: Domain name=Abhydrolase_3; Domain location=159-267; Score=-85.9; E_value=0.042; Accession=PF07859.4; Description =alphabeta hydrolase fold
  Pfam annotation: Domain name=DUF24; Domain location=31-106; Score =49.0; E_value=1.6e-11; Accession=PF01638.8; Description =Transcriptional regulator
  Pfam module annotation: Pfam domain module=Abhydrolase_3::DUF24; Domain location=159-267::31-106
MDRDEILQYSQAVCQGLKDDDDGLRREVLAHAGSRWSLGIVNTLGVYGRLRHAEIGRRMHGVTQRMLTHTLRQLERDGLVIRHDFSEIPPRVEYELSDTDYHDLAGYVHGAKIIHFALTRAPIDNINDVVYETVKKTRSVRQLHMSFLVPRTKILKPAIIYFPGGGFMTAEHNKFMEMRMALAEAGFVVAAAEYRTIPDTFPAPMIDAKAAVRYLRQHAHDYGIDPSRIGVFGDSAGGWLAQMLGTTNGDKSFDHGDFLSQSADVQA

SEQ ID NO: 166945 - protein, 96 aa, Glycine max
  Coding DNA Sequence Number=SeqID_75260
MGLNQTPSFKKRFYHVKTKSLKVASLQELGQQMDQVQRQAFRKTYGKIWDLAMIEVSVEAITSITHYYDQPLRCFTFGDFQLVPIVEEFEGILDAH

SEQ ID NO: 166946 - protein, 196 aa, Glycine max
  Coding DNA Sequence Number=SeqID_75261
MAEEAKGKGFSTLGLVDLAVIDAFLGYHHSKESPVVAILVDLYDTFDQRCKKRGARIVCCMPALYVWLVSHLFLQESRPTCPLQGHRLCTEKGKAKWEQHLASVTTWLPHERSAIGGKHHAFHHTGFQGPQHEGASRSPQGIGCGAKEGKELRGSSNGIIGGYHKWLRVRTQGLDWLPKLRAVRKEEAEALEESEE

SEQ ID NO: 166947 - protein, 139 aa, Glycine max
  Coding DNA Sequence Number=SeqID_75262
  Gene Ontology: Mol. function=transferase activity, transferring glycosyl groups; Biological process=metabolic process
  Homolog annotation: Hit_ID=Q20CE9; Match level="QueryCoverage=46%, HitCoverage=37%, E-value=5e-14, Identity=55%"; Hit description =Fgenesh protein 16
MPFLAALKPIIGAEAIELALAIWFNERIKGRRVVHGDWVQQLLILSHPYVGCFVTQCGSGSLTKAMRAFAKHDTQWLRERKNPKEDELSGSLSALLQVIKRTASAHPLSERSTLSQNPLMRAKRFRFALSAQARTNPPI

SEQ ID NO: 166948 - protein, 331 aa, Glycine max
  Coding DNA Sequence Number=SeqID_75263
MRLIDDGSFKQTPLVDESVLSEWSMQIPPKMKREVRRRWMQLCPRLLLHPQHPPPSLVAPKVISSMAYVSRRAAPKKQQSLSIVDHLRELSETNDDKDGLVFRKHKAAPPSDKATTPQVKKQVDAAIAHDSQLAKVPPVREQTSTVQQFERNLRMTREIVICPLSMYKDPKVAPSFVALDQSTGIEVLPPPTLKCLHPKICMPTSPTALHKSVYKISSGACREVNIQLFTLVSQFVPLVYGHQAIPLTKDNIFNVGMILMRHGLTDQWASYPPGIHIRPTTTIKFMPDRVAPRLPPLDLWKNKGKVPPHTKPMPYLGPKDNISLRPIPYGA

SEQ ID NO: 166949 - protein, 118 aa, Glycine max
  Coding DNA Sequence Number=SeqID_75264
MSLENKTGDSTVLKIGNSAKVVIKQDMKGRRHKYGFNNNKREKVEKKRVVDDETGDKHQLDERGTSNNLKVVYSGTKEFKIASNKRDLFLGFSEHQERLRKKLALEEGRIFAANEQLS

SEQ ID NO: 166950 - protein, 107 aa, Glycine max
  Coding DNA Sequence Number=SeqID_75265
TTWLPHERSAIGGKHHAFHHTGFQGPQHEGASRSPQGIGCGAKEGKELRGSSNGIIGGYHKWLRVRTQGLDWLPKLRAVRKEEAEALEESEEVQALKAELEQARAVK

SEQ ID NO: 166951 - protein, 17 aa, Glycine max
  Coding DNA Sequence Number=SeqID_75266
MPLSLSEYTREPAQRII

SEQ ID NO: 166952 - protein, 100 aa, Glycine max
  Coding DNA Sequence Number=SeqID_75267
  Subcellular localization annotation: CTP_CleavageSite=62; ConfidenceScore=5.67e-01
MGGLSNTQMTTNGGRVVLLCQKRLKSLSTKRSSHAKRNLWAQLASTAKCSYNALSVMRESRRAQESRSRAKHNIISLSEMFVSCQAQHTTGTKPKSIYSR

SEQ ID NO: 166953 - protein, 98 aa, Glycine max
  Coding DNA Sequence Number=SeqID_75268
MAWLMATVMQLVFLQLGKGCGLGKRNWLEKGDTKEFRRLVLCSFGKGRRETQKEFWRLFLGEFFLANGEENEKMNSTSFQGLKNQKTSESFWYKEEEE

SEQ ID NO: 166954 - protein, 356 aa, Glycine max
  Coding DNA Sequence Number=SeqID_75269
  Gene Ontology: Mol. function=hydrolase activity, acting on acid anhydrides, in phosphorus-containing anhydrides; Cellular component =anaphase-promoting complex; Biological process=regulation of mitotic metaphase/anaphase transition
  Homolog annotation: Hit_ID=A7Q2K9; Match level="QueryCoverage=37%, HitCoverage=12%, E-value=8e-43, Identity=70%"; Hit description =Chromosome chr1 scaffold_46, whole genome shotgun sequence
  Pfam annotation: Domain name=DEAD; Domain location=93-243; Score= -6.0; E_value=0.00012; Accession=PF00270.20; Description=DEADDEAH box helicase
MMNCSPTSTFRAFSDAEEDEEDNEEDQDQDQDNVSADEYDDVLGEASDEADVFARHDGFNWQRVDKLCNEVREFGADLIDVDELTSVYDFRNNMFQQQAILAFLRGFSMVVSASTSSGKTLIAEAAAVATVTRGRRIFYTTSFKALSNQKFGEFRETFGDSNVGLLTGDSAVNKDAQDFSGGGGGSARHRGESGIKEKDEKTSLNYFCFLLKRLEISQPALSKTLLHSRFSFSSHLKSARNRSVDTHIAPHSFRYYQKPLARTHRTSYRRKVEENPTLLLELCGSKKPYTALGIVEGAQSSKLSTLPVNKLDESYTPSKVSIRDDDGFHNLKEIKTVELVKATGWVYLSLSGADPR

SEQ ID NO: 166955 - protein, 45 aa, Glycine max
  Coding DNA Sequence Number=SeqID_75270
MTQDLARKVKRSKTWICAWKSSAPMSMPRRQHCLSKTLTANRNHP

SEQ ID NO: 166956 - protein, 171 aa, Glycine max
  Coding DNA Sequence Number=SeqID_75271
MAAQLIHDRVEMECLEGAWETLEGNARCRFRGTIRFTATSLVHPDKPAHTLQRIVEWILPTPTPYRLVEPVQVIEVTSSEEDREEDSKELPPEPAVDALDFLEGDEDPFPEVDSPEGVMSVSKADSTEDSGPGEMAISGGSSSYGYGSLVNCPSEHQFNDCLKKFEIACSS

SEQ ID NO: 166957 - protein, 96 aa, Glycine max
  Coding DNA Sequence Number=SeqID_75272
MATKGWSFVGASMVEEEEENGNSLAFLCACRGQFSKVGNIYIKTLRIKPRVRFKVSLPLKKELMQSSLGKDQSPEPLARGSKRIGLELLKKSLGFL

SEQ ID NO: 166958 - protein, 71 aa, Glycine max
  Coding DNA Sequence Number=SeqID_75273
MTLPDIITTTQSSIRDDGVTSIITALWYHCPVYQFNGHVEYKTIQIIDEEGVWCMFNTFANMESDASSIGA

SEQ ID NO: 166959 - protein, 74 aa, Glycine max
  Coding DNA Sequence Number=SeqID_75274
MTNFARCFQIIIVTKTHFWWFFLWDCHSKSFSSGDIPSHLNKEEKTETPSFLSKNTTLEKILLIRDRACDLLDR

SEQ ID NO: 166960 - protein, 100 aa, Glycine max
  Coding DNA Sequence Number=SeqID_75275
  Gene Ontology: Mol. function=aspartic-type endopeptidase activity; Biological process=DNA integration
  Homolog annotation: Hit_ID=Q6L3N8; Match level="QueryCoverage=98%, HitCoverage=9%, E-value=1e-11, Identity=32%"; Hit description =Putative gag-pol polyprotein, identical
MASSNGNFPASMPILIGKNYDDWSAQMKVIFRFQDVTKVVQEGVQEPEKNPTDAQSVDTVKKAWDILEKSYAGDSKLKKVKLQTLRRQYELLLMSDLKSI

SEQ ID NO: 166961 - protein, 207 aa, Glycine max
  Coding DNA Sequence Number=SeqID_75276
MERSMINATNGGALGDMTPAKARNLIEKMISNSQQFSARNDAIVIRGVHEVATNSSSSVETKKLEGKLDALVNLVAQLALNQKSIPVVRVCGLCSSLDHHTHLCPFMQQSGAIEQPEAYAANIYNRPPQPQQQNQPQQNNYDLSSNRYNPEWRNHRNLRWSSPQQQQQPAPSFQNVAGRSRPYVPPPMKQQQMQQQPQPRPLQQQQP

SEQ ID NO: 166962 - protein, 101 aa, Glycine max
  Coding DNA Sequence Number=SeqID_75277
  Homolog annotation: Hit_ID=A7QNX2; Match level="QueryCoverage=66%, HitCoverage=10%, E-value=5e-10, Identity=54%"; Hit description =Chromosome chr1 scaffold_135, whole genome shotgun sequence
MVCEGSVPCLGLSYMVVRDLDCVKESSNLSNGVKYGHSTVYDSSQYDKEITLFRRMADDTFVDSDFDMLSKEYSLSRDTSMTSRGFQQELIGNSYSGKFES

SEQ ID NO: 166963 - protein, 309 aa, Glycine max
  Coding DNA Sequence Number=SeqID_75278
  Homolog annotation: Hit_ID=A7P523; Match level="QueryCoverage=81%, HitCoverage=60%, E-value=5e-85, Identity=59%"; Hit description =Chromosome chr4 scaffold_6, whole genome shotgun sequence
MQLEKAFRYLTYIILPSFFMELAHKIIFFSAVKISAPHISPGLTCELQKLRFEGVHKLFEGCGSEAGVIFKEHVRIRRQLWVTSHRYRFFIIGCVVTITVSQLGALLLVLASKSDKTFFNSGDLVICSAVQLSGFFLCILGAARITHRAQGIVAIATRWHMLVTTASAESEHCEAQVSEGLASDDDSDSDDSSNIHVSVIPPQLSSFQTRQTLVTYLQHNHGGITVYGYSLDRGLLHTLFAFEFSLVLWILSKNKRGYISCGSVQVEGTSTWFFKEIKGGYIPYGSLACKGFYKVERNLKNCRLLGNWM

SEQ ID NO: 166964 - protein, 377 aa, Glycine max
  Coding DNA Sequence Number=SeqID_75279
  Gene Ontology: Mol. function=isocitrate lyase activity; Cellular component=cytoplasm; Biological process=carboxylic acid metabolic process
  Homolog annotation: Hit_ID=P0A9G7; Match level="QueryCoverage=98%, HitCoverage=87%, E-value=0.0, Identity=90%"; Hit description =Isocitrate lyase
  Pfam annotation: Domain name=ICL; Domain location=12-377; Score =670.1; E_value=1.7e-198; Accession=PF00463.12; Description =Isocitrate lyase family
MEHLHMKTRTQQIEELKKEWTQPRWEGIRRPYSAEEVVKLRGSVNPECTLAQNGAAKMWKLLHGGSKKGYINSLGALTGGQALQQAKAGIEAIFISPAGSMYPDQSLYPANSVPSVVDRINNTFRRADQIQWAAGIEPNDPRFIDYFLPIVADAEAGFGGVLNAFELMKSMIEAGAAAVHFEDQLASVKKCGHMGGKVLVPTQEAIQKLVAARLAADVLGVPTLVIARTDADAADLITSDCDPYDSEFITGERTSEGFYRTHAGIEQAISRGLAYAPYADLVWCETSTPDLALAKRFADAIHAKYPGKLLAYNCSPSFNWQKNLDDKTIASFQQQLSDMGYKYQFITLAGIHSMWFNMFDLAHAYAQGEGMKHYVEK

SEQ ID NO: 166965 - protein, 191 aa, Glycine max
  Coding DNA Sequence Number=SeqID_75280
  Gene Ontology: Mol. function=chloramphenicol O-acetyltransferase activity; Biological process=response to antibiotic
  Homolog annotation: Hit_ID=P62577; Match level="QueryCoverage=100%, HitCoverage=100%, E-value=6e-98, Identity=81%"; Hit description =Chloramphenicol acetyltransferase
  Pfam annotation: Domain name=CAT; Domain location=6-181; Score=339.3; E_value=6.7e-99; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDVNTRRFRQFLHIYSQDVACYGENLAYFPKEFIENMFFVSPNPWVSFTSLDLNVANMDNFFAPVFSMGKYYPQGDKVQMPLAIQVHHAVCVGFHVGRMLNELQQFCDEWQGGA

SEQ ID NO: 166966 - protein, 413 aa, Glycine max
  Coding DNA Sequence Number=SeqID_75281
  Homolog annotation: Hit_ID=Q6WAY6; Match level="QueryCoverage=87%, HitCoverage=66%, E-value=1e-15, Identity=24%"; Hit description =Putative uncharacterized protein
MGQLQRQAFRKAYAVEVLHLWGLPAITNGIRPPKASRKWGGRNTEKIFGVLFPNVDGLVDLAAIDVFLAYHNHKESPVVAMLADLYDTFDRRCEESNARIVAVLQLSMWGWFHTLFSKKVGPSIRYKEGRIRILSSCEGCPNVPLMGTRGCINYNPVLTIRQLGYPMRGAPLDESITPFIARGFSDHNARDRELRGSSNGIIGGYHKWLGVRTQGLDWLPNLKTVRDDEVKASEESDEVQALKAELERARVVEEKFKSIAIKGSNSKLKLRRVKGIITGQRHDLKDELKACVRSKRNLSQQLSETEGNMWAIIDDCKEKLNLAATHEQRLEDEYAKISAEREARERVIDSLHQEATMRMDRFALTLNRSQELPRLLAKAKAMADTYSAPEEIHGLLSYCQHMIDLMDHMIRNR

SEQ ID NO: 166967 - protein, 72 aa, Glycine max
  Coding DNA Sequence Number=SeqID_75282
  Subcellular localization annotation: CTP_CleavageSite=22; ConfidenceScore=5.06e-01
MIFTLLFSKNATQTLKPHFSPPKTTGGCHKPPLLVVGPPHQEEHFNRSGILRILLEDSMEKIPQSSISKFSE

SEQ ID NO: 166968 - protein, 223 aa, Glycine max
  Coding DNA Sequence Number=SeqID_75283
  Homolog annotation: Hit_ID=Q6WAY6; Match level="QueryCoverage=58%, HitCoverage=20%, E-value=6e-15, Identity=40%"; Hit description =Putative uncharacterized protein
MSPLFEQNCNCGQGFSKRFGPHKTDSERHSGPTTEVPRRQGEGYGQSRRLGPVYGYLAAIDAFLAYHHSKESPVVAVLADLFDTFDRRCEKSSARIICCLPALCVWLVSHLFQQDTRHPCPLLSHRSCTEKRRMDWDQLLAGIGGRTISWFPRWKEGKEGVLFSCGRYPNIPLVGTRGCINYNPALAIRQLGYPMRGAPTEEACLFPCEGSRRTKFQDYTKNP

SEQ ID NO: 166969 - protein, 51 aa, Glycine max
  Coding DNA Sequence Number=SeqID_75284
  Homolog annotation: Hit_ID=A7QMV8; Match level="QueryCoverage=100%, HitCoverage=4%, E-value=2e-10, Identity=70%"; Hit description =Chromosome chr14 scaffold_128, whole genome shotgun sequence
VPNTIQTQFVVNAVEADKHPVVLLSSSIIKFAEQCLSPEMRASVFSPRLME

SEQ ID NO: 166970 - protein, 22 aa, Glycine max
  Coding DNA Sequence Number=SeqID_75285
MEEKLACGASMEAGSLSFNGIL

SEQ ID NO: 166971 - protein, 85 aa, Glycine max
  Coding DNA Sequence Number=SeqID_75286
AANHRGKVQIHECLHQLSLSQQSQGFAPFACPTPDQFRAEVVWPGDWPEAQAGEAPTEAPSDAEEARMDEEMTDLLDFLGGSGGT

SEQ ID NO: 166972 - protein, 127 aa, Glycine max
  Coding DNA Sequence Number=SeqID_75287
  Homolog annotation: Hit_ID=Q5QJQ3; Match level="QueryCoverage=59%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDLEELVLKSCAVKAN

SEQ ID NO: 166973 - protein, 130 aa, Glycine max
  Coding DNA Sequence Number=SeqID_75288
MMRIMKLAKYRLKAQVEKNEGPSGEGQSPRVEKDEGPSNPCGVYLDLSSFTGSGVYPDLSSFTGSGVYPDLSSFTGSGVIQISVACNPCGVYPDLSSFTGSGVYHDLSSFTGSGVIQTFVACIKQSAPTQ

SEQ ID NO: 166974 - protein, 84 aa, Glycine max
  Coding DNA Sequence Number=SeqID_75289
MGGGGCMTARLGELLTSSRSNMLAQKKNHQKSKGGVYLVKKRDANSNKAHLGLPEYSSRRRLLLEEATWLAWASWVASSSPIFL

SEQ ID NO: 166975 - protein, 130 aa, Glycine max
  Coding DNA Sequence Number=SeqID_75290
MHENEWHGACLLFAPIWEPIGHYLGVSNNYSPTIHNSHGCFLEFNKSTPKVHHSTIPKIGLTHKEKSPAESPTVATCPSRATEGEAHGCAFPKEERCAKSPPTFICGKRRKKPKETGQNDNSKFGSCIYA

SEQ ID NO: 166976 - protein, 81 aa, Glycine max
  Coding DNA Sequence Number=SeqID_75291
MHVHRCCPVSQRTGEELVDTIPSPRPKVSKGLGVGTSRYWARDRQVVVLRLAQDVKELLLRGCLVPFKFLLVSYSPMFLKP

SEQ ID NO: 166977 - protein, 177 aa, Glycine max
  Coding DNA Sequence Number=SeqID_75292
MAELSQLQLSLNWAMPEPSAKRGIWHQGKGRANLKLSMIPGDSNQWKPGTDIQITFWTGGSFRKGMLRFIILKSGSIDVAVVKEFYANLYSPEDQSPKQVRVRGHLIRIDADNLNSFLETPEVLEEGETLPTYSRFSRMMIDPQEFAAHLYIPGRGFVLNEEHHPWKLLRKDLTTLA

SEQ ID NO: 166978 - protein, 99 aa, Glycine max
  Coding DNA Sequence Number=SeqID_75293
MDINPGLTAVFWDARGSHSVGVRSPLQFHQKLKLVVEGHLVICIGGGRRLALPIRYGNDGGPGDVGVWLRARNGFWHEQRWQNQPGKHQRKSREVWVRL

SEQ ID NO: 166979 - protein, 103 aa, Glycine max
  Coding DNA Sequence Number=SeqID_75294
  Subcellular localization annotation: CTP_CleavageSite=39; ConfidenceScore=5.81e-01
MGSPPASTPPHPHPPPPPPPPPSPSDASASPSAVKQTRKASRLRSLSTRPPGVERPVVHVDPATGKADGPHKKKLRTYLGIVARDKVDITYENWTEVPTAQKD

SEQ ID NO: 166980 - protein, 78 aa, Glycine max
  Coding DNA Sequence Number=SeqID_75295
MSPMELSTVATYPSARGRREAHGCVFQGRKTCKVATNIYLRKTLEKPKVGLRILRIKGSGVVYAPGSGAFAPTYPQLR

SEQ ID NO: 166981 - protein, 66 aa, Glycine max
  Coding DNA Sequence Number=SeqID_75296
MDKVDIFVPHPLTNASLLIQLSPECGSVCSSDLCSRVWTSKTVQLEITRLARWWGCRKTTSKAQNR

SEQ ID NO: 166982 - protein, 289 aa, Glycine max
  Coding DNA Sequence Number=SeqID_75297
  Homolog annotation: Hit_ID=Q6WAY6; Match level="QueryCoverage=77%, HitCoverage=41%, E-value=3e-27, Identity=34%"; Hit description =Putative uncharacterized protein
LSPMVEEFEEILGCPLGGRKPYLFSGFYPSLARISKIVQISAQELDHRKQVENGVVGIPRKYLEAKARILAGKGEWAPFIDILALLIIGGVLFPNVDGLVDLAAIDAFLAYHNHKESPVVAMLADLYDTFDRRCEKSNTRIVFYTPALYKGGADWDQLLANQEGASINWFPRWKEGRVGVLISCGRFPNVPLMGTRGCINYNPVLAIRQLGYPMRGAPLEEELAPDKELRGSNNGPIGGYRRWLKAHVQGLDWLPSLRTAKREQVEAPEEDEEVQALRTKLEQAKTVKE

SEQ ID NO: 166983 - protein, 118 aa, Glycine max
  Coding DNA Sequence Number=SeqID_75298
MVEARQKEGKRRRWLPPSSPKRAGLLPPEGTAWLLFNVAELYGLCNNASFRLRECCETFTDCLTMGVKYLEAVKRRLHATKQWSPDEIRRRNFEESQELARDPAITVRRHVSPLRGKG

SEQ ID NO: 166984 - protein, 174 aa, Glycine max
  Coding DNA Sequence Number=SeqID_75299
ASTFNFERPDILQDSIRHPSKKLLSFEFAQRFNIQFRASRYITGLNNRHPRKNLLRCLNWLRGSTFNFERLVNILRDSIRHPSKKLLSFELAQRLKHSISRVSIYYGTQSDIRVKSYCRLNWLRASTFNFERLDILRDSIRHPSKKLLPFELAQRFNIQFRASRYITGLNQTSE

SEQ ID NO: 166985 - protein, 85 aa, Glycine max
  Coding DNA Sequence Number=SeqID_75300
  Gene Ontology: Mol. function=endonuclease activity
  Homolog annotation: Hit_ID=Q9AY32; Match level="QueryCoverage=74%, HitCoverage=95%, E-value=7e-27, Identity=96%"; Hit description=RRNA intron-encoded homing endonuclease
MSNRDSRGHSDFIVRERKLGARRRSDTVLVSTINDADQGSADVAFRTPLAPYEKSKSLGSGGSMVARLKLKGIDGRAPPGVEPAA

SEQ ID NO: 166986 - protein, 197 aa, Glycine max
  Coding DNA Sequence Number=SeqID_75301
  Gene Ontology: Mol. function=unspecific monooxygenase activity
  Homolog annotation: Hit_ID=Q9AVH2; Match level="QueryCoverage=36%, HitCoverage=25%, E-value=8e-36, Identity=95%"; Hit description =Putative senescence-associated protein
AKTNLSHDGLNPAHVPYWWVNNPTLGEFCFTMIGRADIEGSKSNVAMNAWLPQASYPCGNFSDTSSFKFRRTKGSIGHAFTMCRPSQTPHLTMSSARIDRPKPTLAPTYPTPLKSFHKVGLESSSTGSSFPADSAKPVPLAVVSLDSRIPLVRTSSELTVRRPGKEAPKARSQSVPRPARDDPFSPGSSSSSPPTAN

SEQ ID NO: 166987 - protein, 293 aa, Glycine max
  Coding DNA Sequence Number=SeqID_75302
  Gene Ontology: Mol. function=protein methyltransferase activity; Cellular component=cytoplasm; Biological process=protein amino acid methylation
  Homolog annotation: Hit_ID=A7ZSF3; Match level="QueryCoverage=39%, HitCoverage=39%, E-value=1e-57, Identity=87%"; Hit description =Ribosomal protein L11 methyltransferase
  Pfam annotation: Domain name=PrmA; Domain location=1-179; Score=3.7; E_value=1.9e-11; Accession=PF06325.4; Description=Ribosomal protein L11 methyltransferase (PrmA)
MDVGAVSVTFQDTHDNPVYEPLPGETRLWGDTDVIGLFDAETAMDDVVAELSQHPLLGSGFRHKIEQIEDKDWEREWMDNFHPMRFGERLWICPSWRDVPDPDAVNVMLDPGLAFGQNGDRFRLWLRHSGHRRAETRCSPGRSALISIRRRSRPAAITRSATAWPAACRCICRTSSRKTCRRMWWSPISSPVRCVNWRRCLACCRKLAAILVCPACWPARRKACVKPMRSVLRLTPWRKKRSGAASLACAANRRMGQRLLARFPPPETCLKSPPAPFSCRFFTLKSVDCCTRR

SEQ ID NO: 166988 - protein, 255 aa, Glycine max
  Coding DNA Sequence Number=SeqID_75303
  Homolog annotation: Hit_ID=UPI00016621D1; Match level="QueryCoverage =65%, HitCoverage=46%, E-value=5e-19, Identity=37%"; Hit description =UPI00016621D1 related cluster
  Subcellular localization annotation: CTP_CleavageSite=51; ConfidenceScore=5.52e-01
MPTCPRIQSTTRPPLQWSTRSHLPRTTHPRLQRTTRAHHQGTTHPRLQRARCPHLQRSTRPHLKRATRPHLQRTTRPLLQRANVLAFRGLHVLTFSGLHVLAFRKLHGITFRGGLHTLAFRGVHAHAFRGLHVLTFRALHVLTFRGQHALTLKGLHALAFRALHTLTFIGLLVPAFEGLHVLTFRGLHVLTFRRLHVLAFTGVDALTFRVLHVLAFQGLHALAFVGLHALPFRGQDALTFRGITVLTFRGQHAFT

SEQ ID NO: 166989 - protein, 259 aa, Glycine max
  Coding DNA Sequence Number=SeqID_75304
  Gene Ontology: Mol. function=oxidoreductase activity, acting on NADH or NADPH; Cellular component=mitochondrial respiratory chain; Biological process=electron transport
  Homolog annotation: Hit_ID=A7P914; Match level="QueryCoverage=92%, HitCoverage=91%, E-value=2e-88, Identity=69%"; Hit description =Chromosome chr3 scaffold_8, whole genome shotgun sequence
  Pfam annotation: Domain name=Fer4; Domain location=192-215; Score =38.5; E_value=2.4e-08; Accession=PF00037.18; Description=4Fe-4S binding domain
MAAILARKSLLALRARQLAVSGQGLHSSQYYGLRLSAHSFSTKREDEEREQLAKDISKDWSSVFERSINTLFLTEMVRGLMLTLKYFFETKVTINYPFEKGPLSPRFRGEHALRRYPTGEERCIACKLCEALCLDVTKCNMSLVNAETNVQLFLYSNNTTQSVRLRPLICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 166990 - protein, 659 aa, Glycine max
  Coding DNA Sequence Number=SeqID_75305
  Gene Ontology: Mol. function=nucleic acid binding; Cellular component= nucleus; Biological process=mRNA processing
  Homolog annotation: Hit_ID=A2Q200; Match level="QueryCoverage=80%, HitCoverage=98%, E-value=0.0, Identity=69%"; Hit description=PSP, proline-rich
  Pfam annotation: Domain name=DUF382; Domain location=225-365; Score =288.4; E_value=1.4e-83; Accession=PF04037.4; Description=Domain of unknown function (DUF382)
  Pfam annotation: Domain name=PSP; Domain location=373-420; Score =96.2; E_value=1.1e-25; Accession=PF04046.7; Description=PSP
  Pfam module annotation: Pfam domain module=DUF382::PSP; Domain location=225-365::373-420
  Subcellular localization annotation: CTP_CleavageSite=51; ConfidenceScore=5.34e-01
MAAETIPYQNGVVASSNDSTATGKKSRENDRRRRRRKQKKNNKASEAPVPNSSEESDDAKENNDSKQIHRKLILNVSSNNIDVKLGFSYLNRARCVSGPLVESERISRALLGERELEGKDWRMICVFGLLVEQIEIEYVPEKAELVEGMDEEFRKIFEKFTFTDATALEDTDKKDGSEENAATNKKANSDSEEEENDNEQKEKGISNKKKKLQRRMKIAELKQICLRPDVVEVWDATASDPKLLVFLKSYRNTVPVPRHWSCMRDVVIGGAAEAITNPGLGKRGIEKPPFQLPDFIAATGIEKIRQAYIEKEDSKKLKQKQRERMQPKMGKMDIDYQVLHDAFFKYQTKPKLTSLGDLYHEGKEFEVKLREMKPGMLSHELKEALGMPEGSPPPWLINMQRYGPPPSYPHLKIPGLNAPIPPGASFGYHPGGWGKPPVDEYGRPLYGDVFGVQQQDQPNYEEEPVDKTKHWGDLEEEEEEEEEEEEEEEEEEMEEEELEAGIQSVDSLSSTPTGVETPDVIDLRKQQRKEPERPLYQVLEEKEEKIAPGTLLGTTHTYVVGTGTQDKSGAKRVDLLRGQKTDKVDVTLQPEELEAMENVLPANGFLPLLDEYRYEEAREEEKLRSQREDFSDMVAENEKKRKRKMQEKEGKSKKRDFKF

SEQ ID NO: 166991 - protein, 169 aa, Glycine max
  Coding DNA Sequence Number=SeqID_75306
  Gene Ontology: Mol. function=transmembrane receptor activity; Cellular component=intrinsic to membrane; Biological process=innate immune response
  Homolog annotation: Hit_ID=A2Q4P3; Match level="QueryCoverage=94%, HitCoverage=92%, E-value=6e-72, Identity=81%"; Hit description=TIR
  Pfam annotation: Domain name=TIR; Domain location=19-158; Score=33.1; E_value=4.2e-08; Accession=PF01582.11; Description=TIR domain
MQRLPAKMIAKIARPACDVFINHRGIDTKRNVSGLLYDNLTRMGVRSFLDSMNMKPGDRLFDHIDRAILGCKVGVAVFSPRYCDSYFCLHELALLMESNKRVVPIFYDVKPSQLVVKDNGTRSPKELQRFSLALEEAKNTVGLTFDSLNGDWSEWLRNASDAVIMNLRE

SEQ ID NO: 166992 - protein, 841 aa, Glycine max
  Coding DNA Sequence Number=SeqID_75307
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=A7R403; Match level="QueryCoverage=97%, HitCoverage=46%, E-value=0.0, Identity=62%"; Hit description =Chromosome undetermined scaffold_596, whole genome shotgun sequence
MNLRQRPVAARGGATNLPRPPPLNSVFNIIPVHDLFTDHPSLRYPEVRAAAAALRTVGDLPKHQFMRWEPEMDLLDWLRLLFGFQLDNARNQREHLVLHLANSQMRLEPPPVIVDALDAGVLRRFRRKLLHNYSAWCSFLGLKSNVLLSRRRDPTDLRRELLYVSLYLLVWGEAGNLRFTPECLCYIYHFMAKELNHVIDEHGDPDTGRPYMPTVSGELGFLKSVIMPIYNTIKVEVDSSRNGKAPHSAWRNYDDINEYFWSRRCLKRLGWPLNFECNFFGTTPKEKRVGKTGFVEQRSFWNVYKSFDRLWVMLILFFQAAIIVAWEGTTYPWEALEKRDVQVKMLTVFITWSALRFLQSVLDAGTQYSLVTRETRWLGVRMALKSMAAIMWTVLFSVFYGMIWIEKGSRPIWSDAANQRIYTFLKVVLFFLIPELLALVLFVVPWLRNVIEESDWKIVYLLTWWFHTRIFVGRGVRQALIDNVKYTVFWVAVLASKFSFSYLFQIEPLVAPTKALLNLKNIRYKWHEYGIQFSLPFMARQLFNLMPEEKLLSQQATLLKKLRDAIHRLKLRYGLGQPFNKIESSQVDATRFALIWNEIMITFREEDIISDRELELLKLPPNCWNIRVIRWPCSLLCNELLLAVSQAKELENESDWSLWLKICKNEYRRCAVIEAYDSVKYLFPKVLKAEKEEYSIMTNIFGVIDSYIQTGKLTEAYKMSRLPQIHGKVSEFVQLLIQPERDMNKAVNLLQALYELFVREFPKVKRTIIQLREEGLARRSSTADEGLIFENAVKFPDAGDAVFTEQLRRLHTILTSRDSMHNVPLISRHDDELLSLPILCL

SEQ ID NO: 166993 - protein, 292 aa, Glycine max
  Coding DNA Sequence Number=SeqID_75308
  Gene Ontology: Mol. function=binding; Cellular component=nucleus; Biological process=activation of protein kinase C
  Homolog annotation: Hit_ID=Q2HUG1; Match level="QueryCoverage=88%, HitCoverage=88%, E-value=1e-114, Identity=52%"; Hit description =Tetratricopeptide-like helical
  Pfam annotation: Domain name=PPR; Domain location=114-148; Score =11.1; E_value=0.37; Accession=PF01535.11; Description=PPR repeat
  Pfam annotation: Domain name=PPR; Domain location=150-184; Score =21.8; E_value=0.0026; Accession=PF01535.11; Description=PPR repeat
  Pfam annotation: Domain name=PPR; Domain location=215-249; Score=1.7; E_value=4.9; Accession=PF01535.11; Description=PPR repeat
  Pfam annotation: Domain name=PPR; Domain location=79-113; Score=30.5; E_value=6.1e-06; Accession=PF01535.11; Description=PPR repeat
  Pfam module annotation: Pfam domain module=PPR::PPR::PPR::PPR; Domain location=114-148::150-184::215-249::79-113
MVLSEEAEPNEATIVTVLSACASIGTLSLGQWVHSYIDSRHDLVVDENIGNALLNMYVKCGDMQMGFRVFDMIVHKDVISWGTFICGLAMNGYERNTLELFSRMLVEGVEPDNVTFIGVLSACSHAGLLNEGVMFFKAMRDFYGIVPQMRHYGCMVDMYGRAGLFEEAEALLRRMPVEAEGPIWGALLQACKIHRNEKMSEWIRGHLKGKSVGVGTLALLSNMYASSERWDDAKKVRKSMRGTGLKKVAGCSWVELEMSNNRLGSNFSLYYKNQVAKWVICPVLMQVAVIAG

SEQ ID NO: 166994 - protein, 250 aa, Glycine max
  Coding DNA Sequence Number=SeqID_75309
  Gene Ontology: Mol. function=metal ion binding
  Homolog annotation: Hit_ID=A2Q4Q8; Match level="QueryCoverage=88%, HitCoverage=87%, E-value=1e-106, Identity=81%"; Hit description=Zinc finger, RING-type
  Pfam annotation: Domain name=zf-C3HC4; Domain location=154-191; Score= 20.2; E_value=0.00046; Accession=PF00097.16; Description=Zinc finger, C3HC4 type (RING finger)
MVSFGRLPFLPLMLTFWLIFTASYCKWMCRASDFPREYDGTCLQMRMSYSPAAHLFLFFVQWTDCNLAGALGLLRILIYKVYVDGTTTMSTLERKASIREFYAIIYPSLVQLQESVADTEDKKQKAVCMERYRKRDDEEHRQPSDIDIEREEECGICMEMNSKIVLPDCNHVMCLTCYHEWRTRSQSCPFCRNSLKRVNSGDLWVFTDNRDVVDMATATRENLRRLFMYIDKLPLVIPDFLFDTYDSHLR

SEQ ID NO: 166995 - protein, 979 aa, Glycine max
  Coding DNA Sequence Number=SeqID_75310
  Homolog annotation: Hit_ID=A7QYN8; Match level="QueryCoverage=97%, HitCoverage=76%, E-value=0.0, Identity=72%"; Hit description =Chromosome undetermined scaffold_252, whole genome shotgun sequence
MGSVQLHWSQWPPQNATPPKWFCTSKGPLGCGPSGIMAGDAIITDSGAMHVAGVPIVNPSTIVVWEVMPGPGNGFQVIPRTSTNNGVPPPLSSPNWTGFAPLAAYLFSWQDHLLSEEKQGKNQTNQNLGDSIPLNCSPVSNFSAYVSPETAAQTAATTTWGSGVTAVAFDPTCGGSVIAVVIAEGQYMSPYDPDEGPSITGWRVQLWESSLQHVVLHPIFGNPTSSMGGQPPMQTVWQTKVDLSIPPTNDFKNHQAPAVGMNTDIQKVSEFGFDKSKRVNFDPFDLPSDVRALARIVYSPHGGEIAIAFLRGGVHIFSGPNFAPVDNYQISVGSAIAAPAFSSTSCCSASVWHDPSKDQTILKIIRVLPPAIPTSQVKTNSSNWERAIAERFWWSLLVGVNWWDAVGCTQSAAEDGIVSLNSVIAVLDADFHSLPSAQHRQQYCPVYFSELSPLAFVVIFFISLDRIKCRLLEGANAQEVRAMVLDMQARLLLDMLGKGIESALINPSALVPDPWQVSSETLTSIDPEAVAVEPALVPCVQAYVDSVLDLASHFITRLRRYASFCRTLASHAVTAGTGNNRNVVASPAQCSATPATSQGGQNGTTSSSGSTQMQAWVQGAIAKISSTTDGVSNPVPNPPISGPSSFMPISINTGTFPGTPAVRLIGDSQQPRYAGGVQRTADTNLQKPQPNASVPGKVEEIAKPVSTVVRPDDGQAGRVSQLVPASKGGEEPSPGRSRIGTGNAGLGYTYEEVKVLFLVLMDLCRRTAGLQHPLPVSQVGSNNIQVRLHYIDGNYTVLPEVVEAALGPHMQNMPRPRGADAAGLLLRELELHPPAEEWHRRNMFGGPWSDPDDLDSANDAPKLISLNPLDSSSLENCDVYYGANGLWPRKRRMSERDAAFGLNTSVGLGAYLGIMGSRRDVVTALWKTGLEGIWYKLPPIFPVKMTGRFGGSAAGLMDVQCVVEHGFELYSWLQYKIVI

SEQ ID NO: 166996 - protein, 168 aa, Glycine max
  Coding DNA Sequence Number=SeqID_75311
MSPSPLGSHNHSQTHLKLLERLLLRTRVSADLHTATLSELFETLTFLSLELPKHAKASSPGQTLGENNTFANLPSLPVSQPTLLRASEARLTGASSKGGKCADSSPTFICGKHRKNRRKMVMKNILDSGVVFTFEEGINTSHVDISGALAPTYPPSKRKSDLRSSFLR

SEQ ID NO: 166997 - protein, 273 aa, Glycine max
  Coding DNA Sequence Number=SeqID_75312
  Gene Ontology: Cellular component=mitochondrion
  Homolog annotation: Hit_ID=A5AFX7; Match level="QueryCoverage=32%, HitCoverage=50%, E-value=2e-12, Identity=44%"; Hit description =Putative uncharacterized protein
  Subcellular localization annotation: CTP_CleavageSite=50; ConfidenceScore=5.10e-01
SVGGATYSWIPMISFLAPYGPTPGARRCRGTPRALAAIHNRDDDVSTRISTARAWATIAIRVGQCPESIGGPALTSFSSFPRGTCSLSVSRQYLALDGIYRPIGAAFPNNPTRRQRLVGTWARSATEDASPDYNSDAEATDFHGGLFRFARVTKGILVSFFPPLIDMLKLSGTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPDGR

SEQ ID NO: 166998 - protein, 43 aa, Glycine max
  Coding DNA Sequence Number=SeqID_75313
MNGSGMEKEEREETPLQGEDESREAHHHRTWIRALVLEEEGDE

SEQ ID NO: 166999 - protein, 171 aa, Glycine max
  Coding DNA Sequence Number=SeqID_75314
TDGVVRNGKSTAGHQRLASVAVHAARRVPFAIQAAQLLGRAIGAGLFAITPAGERGMCCKAIKLGGVVLAEVLLADSRFTRPDMGFHPTKLNFVPSDADEAPLDVSICLHAFGIVGCGSFSGVKSANVRVLTIGSCVAYLPNGIRVASQTHSIQASLLGTLEDFKVPHVNH

SEQ ID NO: 167000 - protein, 108 aa, Glycine max
  Coding DNA Sequence Number=SeqID_75315
  Subcellular localization annotation: CTP_CleavageSite=49; ConfidenceScore=5.51e-01
MTNPPGSPPPPSPPPPADPFTVKRTRKATRLRSLATRPLGAERLVVHVDPATGKADGLQKKKLRTYLGIVTRDKVDMTYETWKELPAAQKDLIWKDIQAELKSLKLRM

SEQ ID NO: 167001 - protein, 186 aa, Glycine max
  Coding DNA Sequence Number=SeqID_75316
NVKLFYAEFDEFRREVERRIWHKELTNFSEGSIEVSIVKEFYANLHDPKDKSPKQVRVRGHLIKFNADALNTFLKTPVVIEEGESLPAYFRFANPRPFPQELATRLCLPGRGFELNADDLPLKILRKNLTTLAQNWSVLSFSNLAPTSHTSDITLDRAKLIYEFIMKMDMNLGSLIFVATYPSAGG

SEQ ID NO: 167002 - protein, 277 aa, Glycine max
  Coding DNA Sequence Number=SeqID_75317
  Gene Ontology: Mol. function=protein binding; Cellular component=cell projection
  Homolog annotation: Hit_ID=UPI00006A2D9E; Match level="QueryCoverage =74%, HitCoverage=85%, E-value=7e-12, Identity=16%"; Hit description =UPI00006A2D9E related cluster
MPLPSEDYMSSPSEGCRPSPSKGDMPSPLKDFTSLPLEGYMPSPLEDYMSSPSESYKPSPSVDYMPSPSEDNTPSPSEDYTSSPLEGFTPSPLEGYTSSPSEGYTPSPSEDYTGLHALAFKGLHVLSFRGLHALAFRGLHVLDFRGLHALAFRGLHVHTFRGLHGLAFRGLRVLPFRGLHALAFVGLHAFTFRRLQALAVRGLHVLAFRGLHALAFRGLHVLTFKGLHVLAFRGLHVLPFIGLHSFAFVSLLKHVHILVKEHRDYFSLTHHKSKNYV

SEQ ID NO: 167003 - protein, 203 aa, Glycine max
  Coding DNA Sequence Number=SeqID_75318
  Subcellular localization annotation: CTP_CleavageSite=38; ConfidenceScore=5.74e-01
MAESSKKRKGSSASASASRAHRSGATSASTTPIPPSLSSSTLFSSEEQQKRYSNIFSSRSIIDPKFIDMEFFSAETFDCIQAFQNLGLIPFMSLQLPVYPELVKAFYCNLEIQDNTLISEVSGIKMVIDQSLFHDLTQLSSDGVPFEEPPLIAISSGPLSSVESASDADMTSSGESTSGSGPHHPLESQEHPQQAQSSSRDPP

SEQ ID NO: 167004 - protein, 187 aa, Glycine max [sequence omitted]

SEQ ID NO: 167005 - protein, 102 aa, Glycine max
  Coding DNA Sequence Number=SeqID_75320
  Homolog annotation: Hit_ID=O52175; Match level="QueryCoverage=28%, HitCoverage=33%, E-value=2e-07, Identity=93%"; Hit description =Salmonella berta plasmid pBERT, complete plasmid sequence
GKPVVPAALMNRPTRGERRFAYWALAECILAYYVGTDEGVSEVLHVAGEKRLHRAAAKPFFHRLRPPDSITKSDAQISGGETRQDYKDTRRFPLGGSLGRSL

SEQ ID NO: 167006 - protein, 64 aa, Glycine max
  Coding DNA Sequence Number=SeqID_75321
MAESPQEQVQMVEVAVGSELEWSPPLLPLAVEAPPPPEEEGWSPGQATSVSNSSMLIMEGKPKP

SEQ ID NO: 167007 - protein, 69 aa, Glycine max
  Coding DNA Sequence Number=SeqID_75322
MPKGPYHLLNCSHGGTAPPNAQARRDDFSGSRVRKCIHIMHRISISSWHHNGHIVPAFVTYHIHALHFA

SEQ ID NO: 167008 - protein, 319 aa, Glycine max
  Coding DNA Sequence Number=SeqID_75323
  Gene Ontology: Mol. function=deoxyribose-phosphate aldolase activity; Cellular component=cytoplasm; Biological process=deoxyribonucleotide catabolic process
  Homolog annotation: Hit_ID=A8G9H6; Match level="QueryCoverage=81%, HitCoverage=100%, E-value=1e-118, Identity=85%"; Hit description =Deoxyribose-phosphate aldolase
  Pfam annotation: Domain name=DeoC; Domain location=70-306; Score =266.0; E_value=7.8e-77; Accession=PF01791.10; Description =Deoxyribose-phosphate aldolase
MNANRLRHSCSNSYYWPAARRVAMCGEKDLSCRRGNAVPQRYLHGTKSARQHPGTQLESFMTELTAAAQRALNLMDLTTLNDDDTDEKVIALCRQANSPAGHTAAICIYPRFIPVARKALREQGTPDIRIATVTNFPHGNDDIDIALAETRAAIAYGADEVDVVFPYRALIAGNEQVGFELVKQCKQACQAANVLLKVIIETGELKQADLIRKASEIAIKAGADFIKTSTGKVPVNATLESAELMMSVIRDMGVAKTVGFKPAGGVRTAEDALHYLQLADRILGEGWADARHFRFGASSLLASLLAALGHQTQTAGGGY

SEQ ID NO: 167009 - protein, 143 aa, Glycine max
  Coding DNA Sequence Number=SeqID_75324
  Homolog annotation: Hit_ID=Q6UUU1; Match level="QueryCoverage=62%, HitCoverage=79%, E-value=1e-22, Identity=54%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPPGGSLVRSPVPAFRFTGVIPAVMA

SEQ ID NO: 167010 - protein, 245 aa, Glycine max
  Coding DNA Sequence Number=SeqID_75325
  Gene Ontology: Mol. function=chitin binding; Cellular component =extracellular region; Biological process=chitin metabolic process
  Homolog annotation: Hit_ID=UPI00006A17C9; Match level="QueryCoverage =92%, HitCoverage=100%, E-value=2e-24, Identity=29%"; Hit description= UPI00006A17C9 related cluster
  Subcellular localization annotation: CTP_CleavageSite=12; ConfidenceScore=5.22e-01
MLVRMIKTRLFAAARVKSCPGMHSSCVIASLSGCARTVGRPPKSGGGSGAVWIWSPLKVRTHSPLKARTCSPLKFRTCRLLKVRVCSPLKVRACSPLMFRTCRPLKARACNPLKVRTCNPLKGRTCSPLKVRACSPSKARTCNPLKGRTYSPLKVRACSTLKVKACSPLKFRTCHPLKARACSPLKVRTCSPLKMRMCSPLKARACSPLKVRTCSPLKARTCSPLMARACSPLRVRVLVPKGPPF

SEQ ID NO: 167011 - protein, 131 aa, Glycine max
  Coding DNA Sequence Number=SeqID_75326
MQLPQEPLNKKPRGLARKSMARKNFVELCGAATRLCETETIMLAIVSKYQEELNLATAHEHKVADEYAQVYAEKEARGRVIDSLHQEATMGMDRFSLTLNGSQELPRLLAKAKAMADTYSAPEEIHGLLGY

SEQ ID NO: 167012 - protein, 208 aa, Glycine max
  Coding DNA Sequence Number=SeqID_75327
  Homolog annotation: Hit_ID=Q53L74; Match level="QueryCoverage=75%, HitCoverage=13%, E-value=1e-07, Identity=26%"; Hit description =Retrotransposon protein, putative, Ty3-gypsy sub-class
MARTGDNGGVYHQLDESQRLFLDAWTIQMQRLLNRNKEEPYRRIVKSSSFTLKPLSPREACDDQIRMREKREQEKENSEAPQRNMKKKSDTPEEKSDTQKRESDNSNQCLFQGDSHGLPPSRSIEHQVDLLLEASLPNKPTYNSKPQETQHKDAQSKLRQMFSKKEGMMRIMKQAKYSLKAQVEKDEGPSGEGQSPRVEKDEGPSGEG

SEQ ID NO: 167013 - protein, 86 aa, Glycine max
  Coding DNA Sequence Number=SeqID_75328
MSRNFTDCLTMGVKFLEAVKQRLHAIKQWSPDEIRAINSWGSGLDGGGCMNENQFMGLRIRFDGGGCTNSTRQSIREAPDLMVEDA

SEQ ID NO: 167014 - protein, 170 aa, Glycine max
  Coding DNA Sequence Number=SeqID_75329
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
  Subcellular localization annotation: CTP_CleavageSite=33; ConfidenceScore=5.26e-01
MKHFTDTPHQCQHSKPVYTPLAPNTQTASPRALADSLMQLARQVSRLESGHPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 167015 - protein, 49 aa, Glycine max
  Coding DNA Sequence Number=SeqID_75330
MGAKYLEVVKRGSHPNNGWSPNKIRAPTKHKDLSSCKPHPHRTTPLLEE

SEQ ID NO: 167016 - protein, 96 aa, Glycine max
  Coding DNA Sequence Number=SeqID_75331
  Subcellular localization annotation: CTP_CleavageSite=55; ConfidenceScore=5.37e-01
MGGTKRLLVTIPKVVISLLMVSRASQRPSMTTDSPPLLMFPWTQWSCQLSQPTLRREGDAGLAGASSKKGKCAEFVGPCGLNNLKRDRLRMQKKQQ

SEQ ID NO: 167017 - protein, 123 aa, Glycine max
  Coding DNA Sequence Number=SeqID_75332
MEREIITMIVDILPVFYYEKMVGYMPSSFADLVFTGERIEVGLWRGKFDYAASTSTNNWRFGASGAKKKEGDAHAVTSAPTWPKNQQTPHNTYQYAPHQPSFSANVGNPPKSAPIQQKSPAQP

SEQ ID NO: 167018 - protein, 145 aa, Glycine max
  Coding DNA Sequence Number=SeqID_75333
  Gene Ontology: Mol. function=transcription factor activity; Cellular component=intracellular; Biological process=regulation of transcription, DNA-dependent
  Homolog annotation: Hit_ID=Q2NT07; Match level="QueryCoverage=98%, HitCoverage=99%, E-value=5e-60, Identity=80%"; Hit description =Transcriptional regulator slyA
  Pfam annotation: Domain name=MarR; Domain location=29-99; Score=82.1; E_value=1.8e-21; Accession=PF01047.13; Description=MarR family
MDTPLGTDLSRLVRIWRALIDQRLKPLELTQTHWVTLHNIHQLPPEQSQIQLAKAIGIEQPSLVRTLDQLEEKGLITRATCANDRRAKRIKLTRQAEPIIEQVENVIDATRDDILSGISLEEINQMVTLIARLEKNILELQNREK

SEQ ID NO: 167019 - protein, 182 aa, Glycine max
  Coding DNA Sequence Number=SeqID_75334
MPRAAPCSARRGNAGRPSHRKPEPRPAAEALYDYLRAAIAPRLESLGCAAGASTLKVAQLDAALGNAARDVGRRAHVQVETHDRANHGGTAPWPTAEGDRCTDPHSHGGRARTVTGSPRSAPCRARRARSAARPLLPSTLGDLAADGRHLPRAVRTRRSAARLGHFDKVPQGDAVHVRASLG

SEQ ID NO: 167020 - protein, 432 aa, Glycine max
  Coding DNA Sequence Number=SeqID_75335
  Gene Ontology: Mol. function=fructuronate reductase activity; Cellular component=cytoplasm; Biological process=metabolic process
  Homolog annotation: Hit_ID=P39160; Match level="QueryCoverage=98%, HitCoverage=87%, E-value=1e-163, Identity=65%"; Hit description=D -mannonate oxidoreductase
  Pfam annotation: Domain name=Mannitol_dh; Domain location=1-128; Score=132.3; E_value=1.4e-36; Accession=PF01232.14; Description =Mannitol dehydrogenase
  Pfam annotation: Domain name=Mannitol_dh_C; Domain location=156-404; Score=358.6; E_value=1e-104; Accession=PF08125.4; Description =Mannitol dehydrogenase C-terminal domai
  Pfam module annotation: Pfam domain module=Mannitol_dh::Mannitol_dh _C; Domain location=1-128::156-404
MSASGRQLVEQLRAQNLLYSVTEQGATRHDVKIIGSVHSALHPALDGCDGILNALARAETAIVSLTVTEKGYCTHGATGELDSTHPLIVHDLAHPRQPKSAIGFIVEALRLRREAGLAPFTVLSCDNLRDNGHVARVAVIGLAQRQDAALAAWIDQQVTFPCTMVDRIVPAVTEETQREITGLLGIADPCGVACEPFRQWVIEDNFVAGRPDWQRVGAQFVPDVAPYELMKLRLLNGTHSFLAYLGYLGGCETIAETMQLPAYRQAALSLMLTEQRATLTMPAGSDLNAYAHQLLERFSNPSLRHRTAQIASDGSQKLPQRMLDSLRYHLHHGSDCRHLLLGIAGWMRYILGEDEKGERYPVADPLVAKFERINQQFPSGPARVQALLGINEIFADDLPANPAFVAALQHTYDRLCQQGARAAVASLNPEAK

SEQ ID NO: 167021 - protein, 45 aa, Glycine max
  Coding DNA Sequence Number=SeqID_75336
SWFVEVVLAARIWFVELVVIARAVWGADFAICSGCSLVLARCHFE

SEQ ID NO: 167022 - protein, 66 aa, Glycine max
  Coding DNA Sequence Number=SeqID_75337
MEKPDKKTFKDKKGKKEYITWEDNDMDSSSVSENEIVNLSLMAKDYESEEEMHSMIFIKNVSNLPN

SEQ ID NO: 167023 - protein, 118 aa, Glycine max
  Coding DNA Sequence Number=SeqID_75338
MVSGAIICLILSKNWEVKGQILRVIRKDIGRLVKIGASYPIPSKEKKSKSDKREIVLVFPKSSIKARLGVVTHDGDMFKLTAKSYSYWKPMMEDHLRWKDLHELITHDNKSEGKKDNE

SEQ ID NO: 167024 - protein, 318 aa, Glycine max
  Coding DNA Sequence Number=SeqID_75339
  Gene Ontology: Mol. function=unfolded protein binding; Cellular component=cytoplasm; Biological process=cellular protein metabolic process
  Homolog annotation: Hit_ID=A7PD22; Match level="QueryCoverage=94%, HitCoverage=69%, E-value=1e-104, Identity=56%"; Hit description =Chromosome chr17 scaffold_12, whole genome shotgun sequence
  Pfam annotation: Domain name=Cpn60_TCP1; Domain location=1-290; Score= -109.5; E_value=2.1e-10; Accession=PF00118.15; Description=TCP-1cpn60 chaperonin family
GINFVAIDLNKPLPEQGQFGDLIADLAIEATTTVGVEIDQGPRWAAGVFESSQGSHDKKKDVVSPGKMSKRLLTHASFFLILPLSTKRILKFKLDLVILDKGLTDLATHYLSKHGVSAMRRLRKSDNNRIAKACGAVIVNRPDELQESDVGTGAGLFEVNKIGDEYFAYIVDCKEPKACTVLLRGASKDLFNEVERNPQDAMSVARNIIKNPKLVPGGGATELTVSAGLKQKISSIEGIEKCPYEAAAVAFEAIPRTLAQNCGVNVIRTMTGTKCSCMLLRIDDIVSGMKKKQAPGAPPSKPKVETEADANSEQILVD

SEQ ID NO: 167025 - protein, 145 aa, Glycine max
  Coding DNA Sequence Number=SeqID_75340
  Subcellular localization annotation: CTP_CleavageSite=47; ConfidenceScore=5.14e-01
MATPPRSPPQSDGQSEATSKRSRTTTQLRTLTLRTMDQPRPIVYRVVAREKDPIIHNNWKDVPETLKEIVWNDILAKFDIPEAAKVKTKVMSTVATRWQQFKSTLTSKFVFALNTHMKAIPRIGSEGFMCEANFNVDSVKDPHEL

SEQ ID NO: 167026 - protein, 249 aa, Glycine max
  Coding DNA Sequence Number=SeqID_75341
  Gene Ontology: Mol. function=kinase activity; Cellular component =Golgi apparatus
  Homolog annotation: Hit_ID=A9PF07; Match level="QueryCoverage=81%, HitCoverage=34%, E-value=1e-80, Identity=67%"; Hit description =Putative uncharacterized protein
  Pfam annotation: Domain name=DUF248; Domain location=81-249; Score= -247.6; E_value=7.9e-11; Accession=PF03141.7; Description=Putative methyltransferase
MNNQDGKPVTQPDKSRIVPMAIIFVVLCGSSFHMGIIFCSEKDKFLSIYSEKSIESHKESSIIPLQIKYISYPKCSIDFQDYTPCTDPRRWKKYISYRHTLLERHCPPKLERKDCLVPPPDGYKLPIRWPKSRDECCFSNVPNEWINKQKSNQHWLKKEGEKFIFPGGGTMFPNGVAKYVDLMQDLIPEMKDGTIRTAIYTRCGGWMQRNKVTIEASIILVFGKTNTSPKSLKCTTNLSLANKPATIIS

SEQ ID NO: 167027 - protein, 243 aa, Glycine max
  Coding DNA Sequence Number=SeqID_75342
MASRKRRAMPTPGEASGWDSSRFTSKIAWHRYRDNIQLQNILPERNVELALGMFDEFLQELQRVRGQVVRFDAETINDFLNTPGPTHIRLGEEDGPGPGKPHFPTDQPDRPVQHFQARISSVDHDVVSPSSMHQRPRVSIRGSSSSPSPFSAFFPGIASSTCIHLSTPGLAWLDAEIHSYGTTTHYGEHAQAVPAPADGSTAHHSRGLSSAAATEDPAVDEDLIADLAGADWGPWADLGGGNT

SEQ ID NO: 167028 - protein, 33 aa, Glycine max
  Coding DNA Sequence Number=SeqID_75343
MKHGASSTRAHHHNESGLGGIDGEVTLVPLATA

SEQ ID NO: 167029 - protein, 151 aa, Glycine max
  Coding DNA Sequence Number=SeqID_75344
  Homolog annotation: Hit_ID=A2Q246; Match level="QueryCoverage=69%, HitCoverage=42%, E-value=1e-47, Identity=90%"; Hit description=CENP -B protein
MDIDNLMNYPGENEACLEVHSLEDIVGTIIENNVEDDGEDDTVSLEPVTRKEALMALNTLHNFMIQYKNTTPEPLDAIRKVRDELQIDLNFKGKQTTIESYFNKVAYGHDNTNWRRMETMIEANAANHNASLQITTSKGGVMWLDQVYAHR

SEQ ID NO: 167030 - protein, 437 aa, Glycine max
  Coding DNA Sequence Number=SeqID_75345
  Gene Ontology: Mol. function=protein binding; Biological process =protein metabolic process
  Homolog annotation: Hit_ID=A5C486; Match level="QueryCoverage=81%, HitCoverage=40%, E-value=6e-81, Identity=47%"; Hit description =Putative uncharacterized protein
MREAGFSSTLVKTRVEQAVSMEACSQKASSDRSHAKENITKPHHVVLGGSNNVSPSSGPFGQVAAGSFTKPNLDHVNNNDVTSVLSELVRRKNTVIVGEGVANAEGVAREVMERFEVGNVPEDLRYVQFMSLPLMCFKNISKEEVEQKLMEIRNLVKSYVGRGVVLYLGDLKWLFEFWANFCEQKRNYYCSIEQMVMELKKLVCGSGESSRLWLMGIATFKAYMKCKMCHPSLEAIWELHPFTIPVGSLSLSLNFHGDFQAQEKSKVFFKDVAFEDRTGVRNHLTCCRDFLINFEKEAQSITNCISNKVCIASSLPMWLQNCKEERSDIMEDQENSRLEYLCKKWNSLCNSIHRRHPSIMEFCYRPPRDCALGSDIKINMVTSKKSCPKLARICISGRHFIEEKNSTTRGVIKNPPNNAQSMKQGFPNLENSRLQHP

SEQ ID NO: 167031 - protein, 60 aa, Glycine max
  Coding DNA Sequence Number=SeqID_75346
MEEKVKLKINGGNKPWKKKLHHQESVLDKKLREEASMEKENEREKKWRRNEGNIGREVEL

SEQ ID NO: 167032 - protein, 82 aa, Glycine max
  Coding DNA Sequence Number=SeqID_75347
AEFDIPEASDMRTKKEILQTVGERWRQFKSDLTSNWALAVDKGNVDDTVCIKYDNSKENWTQFCQSRRDPSWVDVRKKTQTI

SEQ ID NO: 167033 - protein, 293 aa, Glycine max
  Coding DNA Sequence Number=SeqID_75348
  Gene Ontology: Mol. function=polyphosphoinositide phosphatase activity; Cellular component=membrane of vacuole with cell cycle -correlated morphology; Biological process=cellular morphogenesis during conjugation with cellular fusion
  Homolog annotation: Hit_ID=A7QMQ1; Match level="QueryCoverage=83%, HitCoverage=31%, E-value=1e-96, Identity=65%"; Hit description =Chromosome undetermined scaffold_127, whole genome shotgun sequence
MRARASSGDLVRIGNSNEMLNSVSGVLRTNCIDCLDRTNVAQYAYGLQALGRQLHAMGLTDVPKVDPDSSIAVALLDMYQSMGDALAQQYGGSDAHNTVFPERQGKWKATTQSREFLKSIKRYYSNAYTDGYFQPHEGKPALWELDSDYYIHESGIGDDLIPEKCSEPNISPSGRGGMVFMPIPACRDDFSRIKPGGVSGNSGVAPDAAEIQLKSPNWLFGQRKYEEGSSAAKVASRESDVEGSQANGFCDLNWLSSGNDMNEEDVFQRSPLTHLYVYLGHCDLLALDRAEIC

SEQ ID NO: 167034 - protein, 245 aa, Glycine max
  Coding DNA Sequence Number=SeqID_75349
  Gene Ontology: Mol. function=mannosyl-oligosaccharide 1,2-alpha -mannosidase activity; Cellular component=membrane
  Homolog annotation: Hit_ID=A7QMQ1; Match level="QueryCoverage=27%, HitCoverage=7%, E-value=4e-24, Identity=85%"; Hit description =Chromosome undetermined scaffold_127, whole genome shotgun sequence
  Pfam annotation: Domain name=Syja_N; Domain location=8-242; Score= -112.1; E_value=0.00011; Accession=PF02383.9; Description=SacI homology domain
MMYERVVVVMLLSLLHFASGAELVKELHSALTTGFHNDVVCLWKKSLVAIWVLLWWRWEHYHWDINTTIALVEMETEDINEGGERKDFGFECVEGSQELDEGLCSSQNYTLPFSDVLRWESFSVQVDVSDIPRLKEVLSAFPESEYLKRGVNDRGRVGNDVETEQIVLDEESGSCKGKMSSVVQIRGSIALFWSQEASTFSPKPDIICVASEALDLTGFYYSGKTNIIKRANKSNRTSTGRYVHH

SEQ ID NO: 167035 - protein, 225 aa, Glycine max
  Coding DNA Sequence Number=SeqID_75350
  Subcellular localization annotation: CTP_CleavageSite=40; ConfidenceScore=5.18e-01
SVMQALPSHVMQTSFHHRAVCDKVDKKGLGFRSSRLVSTSYMMKVDWLFPQREMIYGNFQENLGLNIGDGAKVEFWNDRWVPGVPPLNSSKGDDQLSCIGSEDDAEVLRGYVFCFGRSWCLISKAIWYMLLPQTMHSEFLVQDSNLWMLSNLKNEESVQPTGMVSQIWREADHPPNGHFKLNCDGSVNSSMKNVAVGGVFCDSNGQVIFAYAADMGFCSIVSTKL

SEQ ID NO: 167036 - protein, 67 aa, Glycine max
  Coding DNA Sequence Number=SeqID_75351
MEQVSKWNLLQELGFPHALLDAIQDKEQLDDRTKALLEEKTCSLMMEEWKKMLNNQNFLRHDSQVPF

SEQ ID NO: 167037 - protein, 219 aa, Glycine max
  Coding DNA Sequence Number=SeqID_75352
QRETAAVAENVPHVDNTTEELFQHAEETVDDAEGFPAEHRDTLVLTAYADHVAIIIWNGERLDRLTTANVCWMPYGDHRAVQEVVQQFGYVQTIPPHCACPRLFFEDIDDRLMHFSNYLAPPGDPPRHPPIMQDGTYVEPEMPKILVAPTSVEEALAQGPSNVEQPRHAADACQTIVERLERLLNLRIVTEGTKAHDVMQGCIRIARSVTMDGNVYVRS

SEQ ID NO: 167038 - protein, 90 aa, Glycine max
  Coding DNA Sequence Number=SeqID_75353
MSMLDQFHPCTYDFIENIVDVKLDGNCGYHAIATLLELAKWSNAYINLLGGIDRFEELKRLLLVDGLSMVTMDKWMNITDMGYVIASRYF

SEQ ID NO: 167039 - protein, 168 aa, Glycine max
  Coding DNA Sequence Number=SeqID_75354
MLQWRKEFGANTIMQGNGQKSSLETFQLFSSLVSAFGIFDDVAQQVPHIPPPPCVEVLASEVPSYIKHNVDSVNLDGVTLLKIKLHSELAQPKVGSFHGLPGIFALLKAEVHFFAGDWSGIDKLLPHVSTDAKKIKRQFTQSTDSKISMILSRRWWNSTISVYGREGW

SEQ ID NO: 167040 - protein, 205 aa, Glycine max
  Coding DNA Sequence Number=SeqID_75355
  Homolog annotation: Hit_ID=UPI00001628AD; Match level="QueryCoverage =27%, HitCoverage=5%, E-value=9e-08, Identity=46%"; Hit description =PHD finger transcription factor, putative
MIGDALRKLSGKLLITRDWHEVTEDWQQLANWVFLDLVEELKRKLFVAVSAKQIWYDKSGNGAGMESIKVMASVDLSLTLPDKKIVVQKEPVPPGKKISPELQEEICPYGTCKVVSVELCPDVVVREYLLAPKQANRALWMEELQKHLVCLGWKIEWSNKNNVKRYGYDVPDKKGRKLYLSLIEVCRVMEKDLNMNVNVLLAAPK

SEQ ID NO: 167041 - protein, 138 aa, Glycine max
  Coding DNA Sequence Number=SeqID_75356
  Pfam annotation: Domain name=Retrotrans_gag; Domain location=58-133; Score=13.9; E_value=0.0024; Accession=PF03732.8; Description =Retrotransposon gag protein
MGEGCCKQPYPCICKEAVSGFEPMTNKSPMHKFKRASAKRNTHGLSARKTLEEDELYSLFSFSLAGEAKRWLHSFKGNSLKIWEEVVEKFLKKYFPESKTAKEKAVVPSMVRLMKQANVFPLKKTLKKFIIWEINSDK

SEQ ID NO: 167042 - protein, 101 aa, Glycine max
  Coding DNA Sequence Number=SeqID_75357
MEIVDNNYSQDLKKNEGFQERLVRSMDLGFLGSWHPEPVIQSEKLKWHVVSVSEAFHGDNECYCYSHGSIRPLPPLVEFEICVDVNYNNISNQGFLSDFFI

SEQ ID NO: 167043 - protein, 130 aa, Glycine max
  Coding DNA Sequence Number=SeqID_75358
  Subcellular localization annotation: CTP_CleavageSite=71; ConfidenceScore=5.30e-01
MDTPKCLSPREKMSGVATNVYLRENVRKTKKRFGNFENKGSRVVYSSGSCSSPRRAGFFTMKLFGGPAQASQMLAWASWGPEKSRKRPFCPLLWYPFVFLIKRLSDSWLHAATGVKHCNSTSKNQKIYER

SEQ ID NO: 167044 - protein, 93 aa, Glycine max
  Coding DNA Sequence Number=SeqID_75359
MPRPLHPIVVVYHTSLIHPPLPPHSPHGGGPGFGMVVVVPEQQNEHQRLRLWGLQEMRGVLKVREAEGSSIAGNRSNTDACTYALNTLNKTEC

SEQ ID NO: 167045 - protein, 72 aa, Glycine max
  Coding DNA Sequence Number=SeqID_75360
  Homolog annotation: Hit_ID=Q2HW89; Match level="QueryCoverage=100%, HitCoverage=10%, E-value=2e-16, Identity=47%"; Hit description =Integrase, catalytic region; Ribonuclease H
MEVVLLNEVEIPTLRILAESGLEEAKWAQARYDQLNLIEGDLVLMKVSQVQKDHRGKWVPNYEGPFVVKKAF

SEQ ID NO: 167046 - protein, 543 aa, Glycine max
  Coding DNA Sequence Number=SeqID_75361
MEDWGNFLHRILEEDSKDSTPIKMFLLVWWFGEKQRRLMAAIGGRGWQRRRTILFPNVDGLVDLATIDAFLAYHHSKENHVITVLEDAYDTFDLRKICLSVITCVLKRLKQIGKNSWQAARLPYERCTVRGNPRAFHRELRGSSNGIIGNYHKWLKSRMQGMTWLPKLKSISGKEVEILEENEEVGSSNELKLRRAERGESRMESMALEENMLIIIDQYKEKVNLATSHEQMLEDEQAKVSALQIEREARERVIELLHGENMKWMSRFALTLNESQELPRLLARAKAVADTYSAPDEVHGIDEGRHGGHERPNDHHDGGHDEHEEMMEVNAAAVATTSVATEVDPTPPLGVNQEAQVAPISRRSRASIISRCMACLPTMHHPMLYMCPRRTSTTLPLYPLRANNLNLGMHMALNPWGRPMKHPETTIWPNLSLTSDVAEPQSFGGMPQPNTLGDLQLRPIEGGGDYPFAYMAELCLVPDVIIPPKFKVPDFDKYKRTTYPKNHLKMYCQKMGAKYQYNFDMALDRMQLQNMWKREHESFKEYA

SEQ ID NO: 167047 - protein, 77 aa, Glycine max
  Coding DNA Sequence Number=SeqID_75362
  Subcellular localization annotation: CTP_CleavageSite=21; ConfidenceScore=5.35e-01
MASPPASPPPPAPSDTSASPSAVKRTRKASRGRHLRDLEGGPYCSEGLDLGGYSEFEIPEASDSRTKRKLLQTVGER

SEQ ID NO: 167048 - protein, 117 aa, Glycine max
  Coding DNA Sequence Number=SeqID_75363
  Homolog annotation: Hit_ID=A9PCD9; Match level="QueryCoverage=52%, HitCoverage=18%, E-value=3e-22, Identity=75%"; Hit description =Putative uncharacterized protein
MEERLCAYSRVVAHFPTAVKEVNDKFKWRNGWFCSLSEKATAQGKPDPCPLHSQWLKELRIVWSLNSSGQEVNIYKGQALRPLLSPISFTTLPFGCSYYYCYYLDDGYIDFSLSLSN

SEQ ID NO: 167049 - protein, 200 aa, Glycine max
  Coding DNA Sequence Number=SeqID_75364
MWDNVGVEGAIFGKFQAGGEREERFQEGGQREEGGQGGGFELWNQQQLIGQGPPPQPQPLFHQDLYSALGVGPSKTISDDQSWSRSRTAGTKPRKIALICGAGRAARAATSIAKPTSRALGSPLHAATNDYNNSSLCNKPSNHLLLEERVEVGAGEASVAVGVSVLPEPAALGLLQSPQFHRCFCSFFEVEGLCVWIRRP

SEQ ID NO: 167050 - protein, 287 aa, Glycine max
  Coding DNA Sequence Number=SeqID_75365
  Gene Ontology: Mol. function=ubiquitin thiolesterase activity; Cellular component=nucleus; Biological process=ubiquitin-dependent protein catabolic process
  Homolog annotation: Hit_ID=A7Q028; Match level="QueryCoverage=43%, HitCoverage=11%, E-value=1e-55, Identity=83%"; Hit description =Chromosome chr8 scaffold_41, whole genome shotgun sequence
MEEYVLNLKEIGKLGCMPSRAVDRIFQYLKTSLGKGLLFKSEGTLPLKVYVDANYAGSVVDKDPTLNTEWLLNLVVAEFRAMTHGMRERLWIKIILDNLEVLEEEKNLGPHDRLIHVYHFLKDTTQNQQQVQNFGHPFLLVIHEGETLTEVKLRIQKKLQVPDEEFSKWKFAFLSFGRPEYLQDSDIVSARFQRRDIYGAWEQYLGLEHTDNASKRSNAANQVRCGGRRRQTRYAEGGGYVADMDDDEWMYEIMFEQTDMDYENEEACGANEPHVDCSDAFNTSQMN

SEQ ID NO: 167051 - protein, 84 aa, Glycine max
  Coding DNA Sequence Number=SeqID_75366
  Homolog annotation: Hit_ID=A5BK17; Match level="QueryCoverage=64%, HitCoverage=3%, E-value=1e-07, Identity=51%"; Hit description =Putative uncharacterized protein
MAQAHSISTPMVTNCKLSKHGADLFHDPTLYRSVVGVLQYATLIRPEISYVVNKTFHIRNNCLSWLKLDILVVQEAESHGKVEH

SEQ ID NO: 167052 - protein, 247 aa, Glycine max
  Coding DNA Sequence Number=SeqID_75367
  Gene Ontology: Mol. function=ubiquitin thiolesterase activity; Cellular component=nucleus; Biological process=ubiquitin-dependent protein catabolic process
  Homolog annotation: Hit_ID=A2ZKM0; Match level="QueryCoverage=55%, HitCoverage=13%, E-value=3e-59, Identity=79%"; Hit description =Putative uncharacterized protein
MGCLPGSKGTRPKAQTVVTRTNSIQYKIEKVVRFRTLEKPKEDEFSLELTKLDTYDNVVEEVAQHIGLSDPSKIRLTSHNCYSQQPKPQSIKYRGMEHLSDMLIHSNQTSDILYYEVLDIPLPELQCLKTLKIAFHHDTNDEVVIHTIRLPRHSTVSDVINDLKSKWFVVNSIVPPQFHTEDDRIMDRVNPEYEAWEVQDQMLLVWLQSTLSKSVLSRMLGTNHSYQVWEKIHEHFSLHTKSRARQL

SEQ ID NO: 167053 - protein, 89 aa, Glycine max
  Coding DNA Sequence Number=SeqID_75368
MASCGEAKEFIDEDPRPTSSNGAYINWDISADISLKYMGADMVLLHGLSDKGAKQMMEEEKEGGATPFHSLEKWNPKLRIGYILTWVYC

SEQ ID NO: 167054 - protein, 147 aa, Glycine max
  Coding DNA Sequence Number=SeqID_75369
MVGVPEKERTGPAEAISTQEHKILRVNGDISKVDTFRVSKPKTEGWNGLKTRRRDDWRWSGRIPAPGRRRVAATRQAYFITFKQHMYIHQKGERQLDKTRHTAVFYNKISRKTKKAKTENLSRDTHNYNNSYELTCDFDNHIAIKIT

SEQ ID NO: 167055 - protein, 112 aa, Glycine max
  Coding DNA Sequence Number=SeqID_75370
  Homolog annotation: Hit_ID=A5BCI9; Match level="QueryCoverage=45%, HitCoverage=14%, E-value=8e-07, Identity=49%"; Hit description =Putative uncharacterized protein
MVLVNDPLVAPVSFSLDLTIVTSLNLGLMSVFFLGIPHLIRLIPILCRPDQSLEFIYQLNPTLLLAHNEPKSVKQALADSKRFNAMKQEHEALMNNKTWDLVSLPPNRKAVG

SEQ ID NO: 167056 - protein, 48 aa, Glycine max
  Coding DNA Sequence Number=SeqID_75371
MTLMTPPPMDQQQQQQEHDEMLVPRSDLPEGPQPMEGPQIVGLVPGTN

SEQ ID NO: 167057 - protein, 32 aa, Glycine max
  Coding DNA Sequence Number=SeqID_75372
MVQLGAGRSGNMAFLDTTTSWFFKANSWQSLK

SEQ ID NO: 167058 - protein, 271 aa, Glycine max
  Coding DNA Sequence Number=SeqID_75373
  Subcellular localization annotation: CTP_CleavageSite=34; ConfidenceScore=5.70e-01
RKGSSSTTTAAGHRRQGTFGNPPTPIPPSLSSPRSSTLFSSDNQRQRYYSQFCNRVILNPKYLDLEFFDGETFDCYQSLFFSLTKLPSQGVPFDDTLVDDWKFDYSSHDARRMIDWAHLVRYWMHKALRANAPLPYPYLVTLFLHRFNVPLDDEPFVKVKRSFSIGASAVTSFGYRKNVDGQWVHKHDLPQPIPDERTPSPPPQRGDSTSLLSEVLIELYGFRAFVGERFNTMDTRLDVMDTRFDGMDTRITRLKDDMSFIRRYFDPSTDS

SEQ ID NO: 167059 - protein, 184 aa, Glycine max
  Coding DNA Sequence Number=SeqID_75374
MVRTRGLGCVLGHITDRGVGRGDRDDSDDAPQRPQPTASARRQRVAITAEHDEPVVPVTEAVGASVEPVVYADEPMARGDVHDTGADTPADTGTQAVEDEAEGFLGGPSDPSVLTEYADHVAGSVWTGEERPELKLSSHRRKVHSLGRPIPAIKGLVVGTGLSLLIACSIDTGDRGLLSSFVER

SEQ ID NO: 167060 - protein, 43 aa, Glycine max
  Coding DNA Sequence Number=SeqID_75375
MEKKMKNKELKSMAVEWKRKKDGWRRYFKEKMSQEQAHHHRKP

SEQ ID NO: 167061 - protein, 111 aa, Glycine max
  Coding DNA Sequence Number=SeqID_75376
MTPGQASNPLPDGHAPQPQVIPQVPETDIPHVPEPGAPSTSARPTVDEPRHAVEVCYGIAERLERHLSLGVVTPGSSTHEVIEECLKMARSVTQDQLVYVRSRRRRCMDQT

SEQ ID NO: 167062 - protein, 44 aa, Glycine max
  Coding DNA Sequence Number=SeqID_75377
  Subcellular localization annotation: CTP_CleavageSite=50; ConfidenceScore=5.01e-01
MTKEVIHGHNSVAHQLHFSFSSSSSTFFSGFQATGEPRPSELLA

SEQ ID NO: 167063 - protein, 100 aa, Glycine max
  Coding DNA Sequence Number=SeqID_75378
MVDKDTLDYSGWRGSKNLRELASGDHPTFDALIWHRELTSLTLLLLTGSETMLFELGVGSCCISLFVCLWRFEEQSTHPYNQQFSSIDDVENVGAPTSLT

SEQ ID NO: 167064 - protein, 411 aa, Glycine max
  Coding DNA Sequence Number=SeqID_75379
  Gene Ontology: Mol. function=sucrose-phosphatase activity; Cellular component=cytoplasm; Biological process=metabolic process
  Homolog annotation: Hit_ID=A5BUI1; Match level="QueryCoverage=85%, HitCoverage=83%, E-value=1e-136, Identity=66%"; Hit description =Putative uncharacterized protein
  Pfam annotation: Domain name=S6PP; Domain location=57-297; Score =457.1; E_value=2.4e-134; Accession=PF05116.4; Description=Sucrose-6F- phosphate phosphohydrolase
  Pfam annotation: Domain name=S6PP_C; Domain location=298-408; Score =151.8; E_value=1.9e-42; Accession=PF08472.1; Description=Sucrose-6 -phosphate phosphohydrolase
  Pfam module annotation: Pfam domain module=S6PP::S6PP_C; Domain location=57-297::298-408
MLMCFLCFELFKAEFRTGYVPDSRTTKLRTLKPELHYVEPKLVENLQVPTREDSYQVDHDDPENLALLRFNALWEAYYRHNSLLVFSTGRSPTIYGELRKQKPLLTPDITIMSVGTEITYGESMVPDDGWKQYLDHKWNRDIVMEETAKFPELTLQSETEQRPHKVSFYLEKGKAPNVTQTLSKRLENRGLDVKIIYSNGIALDVLPQAAGKGQALAFLLEKLKADEQGPINTLVCGDSGNDAELFTVPEVNGVLVSNAQEELLQWYAENARGNPRIIHATERCAAAIVQAIGNFSLGPNVSPRDIGDLMSNRKVHSPSHEVVMFYIFYERWRRGEVENPEQYIQKLKSVFHSTGNFVHPSGIDQPMHQTIDTLAKAFGDKTGKDFRVWVDCISLAEVCVVSLPLSSTLLK

SEQ ID NO: 167065 - protein, 100 aa, Glycine max
  Coding DNA Sequence Number=SeqID_75380
  Subcellular localization annotation: CTP_CleavageSite=19; ConfidenceScore=5.02e-01
MAKHKSKSRSKNPQISLVRVSIRSRRWHCQSSFVGSGIGHNLVDVVVVVVECDGRQIVELDFHGGSVHKVASIISEMPDLECGDATLFGTLHNGEESGGF

SEQ ID NO: 167066 - protein, 87 aa, Glycine max
  Coding DNA Sequence Number=SeqID_75381
MTVASKIDNTDSSKLTRNEEDDSEEGIPLSPWSIDPSCSSLLLRVALFLLQAASISKFSGAKSSVGVLPRIQEASYYRAVNQDKGLN

SEQ ID NO: 167067 - protein, 112 aa, Glycine max
  Coding DNA Sequence Number=SeqID_75382
  Subcellular localization annotation: CTP_CleavageSite=39; ConfidenceScore=5.21e-01
MHPPPKEFGVMLHDCLVWTLKCNPSFSSFFGDPRMSLPSVVHVSSIFESGAPRMSLPSAVRQFYILHFYSAPHECHCLALFMRPPPSSLEPRECHQLALFANSQFSTFFGAP

SEQ ID NO: 167068 - protein, 479 aa, Glycine max
  Coding DNA Sequence Number=SeqID_75383
  Gene Ontology: Mol. function=metal ion binding; Cellular component =nucleus; Biological process=embryonic development ending in seed dormancy
  Homolog annotation: Hit_ID=A7NUQ6; Match level="QueryCoverage=51%, HitCoverage=99%, E-value=2e-55, Identity=48%"; Hit description =Chromosome chr18 scaffold_1, whole genome shotgun sequence
  Pfam annotation: Domain name=ZF-HD_dimer; Domain location=57-116; Score=102.2; E_value=1.6e-27; Accession=PF04770.3; Description=ZF-HD protein dimerisation region
MEFKQHEETDLRMLAATTSYNDFGIPPSSQGEEEPVAAAIPVVIPMTPTPPTLAQKNDNEKYHECLKNHTIKTGVHTLDGCIKFLPLGEEGTLDALKCLVCNCHRNFHRKETPNDTYLVPYHRHSPLPLAAYYGEQVGYPHVQGQQCTTLALPSRSRGSGGAQSSREDMEAVSDPTSGATPHGGSSKKRFRTRFTQEQKGKMLAFAEKLGWRILKHDESVVQEFCAQTSIQPRVLKVWVHNNKHTLNKKNIGIGSTIHNVTYADDVVRVSVDKVFDGDAQVSFPTSKIQYVRQAHDIFLAWPANLGKCVSHEDSRLTPSKVFEPIERLNNVATDDPLRQLIRTLYDIYEKPIELLWDGTKFGIPNVDASFFLTYSYVNEIISGDKCLNIAILQLWMMFMDEWSSSLGHGSVYGFLEPQSIHNAKERHAECQQYIETWTHVQSGGYECGYYVMHWMWNIWFGDGCSNPASAPDRASSIKW

SEQ ID NO: 167069 - protein, 78 aa, Glycine max
  Coding DNA Sequence Number=SeqID_75384
MEIVNDFFLFDKISMGSINSSTSITQQQVAEIIGTLEEEWRNELEEENKMESRENEIGVEGGHQNGVIPKGIAVLSPN

SEQ ID NO: 167070 - protein, 110 aa, Glycine max
  Coding DNA Sequence Number=SeqID_75385
MDEDEWMYEIMSERADMDYENAESCGANEPHVDCSDAFKTSQCREDVLQWARSVAFENGFVAVILRSDTNTGVASISVGKKNLSEETLGLGNVGVPSSFVASQWLEEKLD

SEQ ID NO: 167071 - protein, 73 aa, Glycine max
  Coding DNA Sequence Number=SeqID_75386
MAEPSKKRKGSSSRSQRHSEPQDTLILSFISSSLLFSSEEQRTRYINLFSSRSIIDPKFIDMDFFYDESFECI

SEQ ID NO: 167072 - protein, 64 aa, Glycine max
  Coding DNA Sequence Number=SeqID_75387
  Subcellular localization annotation: CTP_CleavageSite=35; ConfidenceScore=5.18e-01
MSRRHVLSASSARSASHLSPSRLSASLALSESSITCAKRENGAKCDVELPCYGRLNPQLGILAE

SEQ ID NO: 167073 - protein, 112 aa, Glycine max
  Coding DNA Sequence Number=SeqID_75388
MQQGHEYIPIVRFLDPNYGSAESNDGSWWPPMVMGGGEEGVRVWISLSKLVSLSGSPLFTLSATIHAKHNSLCTNSRSGRQFSLSAIPSWVGIALSALILAQRNSLSGWNYT

SEQ ID NO: 167074 - protein, 451 aa, Glycine max
  Coding DNA Sequence Number=SeqID_75389
MSHDYHAPNGLLDEVVGDFSSDEDEILADNNNINDNDDNDIQFLFQPKSTENIYLPYPNSADVGDNQVADNPEYRHYLDQQQQSDSHDVELYVGVRRIHKSYVVQLKGANGNLERKNILAMVEENEQLIIPTFITFVRQEFGYTITYRKAWLAKQWALEHAYGNWEESYNILHKYLQTIPALDESNQPIPNKSSFATTESYKKTTHTVLHGWIKYQGSNGPWQWMRENDGDTTTNLAESLNSTDAMIASEQVYTLIAAKFITKEETKSNTDYVQQFGRQRFQFQVEEIVNMRERGVKWGNSLSDWIKEHVIVGNLKGYTCHVHMSLLHLETESWLRENLSSNLVVDNSHWIVASVKAMIIDIQISSNNILALHPGEHLGLTNEDSLDICNANDAFSLYCDGAIFKSVSAAAYQRGYGGGVVGSVPRSWNGSEAWDPKSGGEIGLSVSCNPY

SEQ ID NO: 167075 - protein, 86 aa, Glycine max
  Coding DNA Sequence Number=SeqID_75390
MKRNLELQERQQWWRRKERKSNVEEEKGAAGIFWRKREKKFQDVIGTGADVGAGVVARAEVEFGVEVSRTQRSENLEQLLGRCIRQ

SEQ ID NO: 167076 - protein, 142 aa, Glycine max
  Coding DNA Sequence Number=SeqID_75391
MSLFRDTTVPPPTPSGTSAQSTNVIVPMLQCLHHCLCLVMQSIHDLAQHWLILRMKDFMAQVDWPRVQPSPVGGGEAPTAQEPQPEPEPTPEDTPEETPEVTPTATPLEATKERDGAADTDYATDMAATQGTWDDPTPAQEN

SEQ ID NO: 167077 - protein, 107 aa, Glycine max
  Coding DNA Sequence Number=SeqID_75392
MGGSEKEKGSAPEALLSLSNLLGKIVSVKKMLSSLGTDVWGANTFPVRKYNSRTFQLKVRRSRLFRFFRRFPQINVGGDSARIPFVEHASRESRVALPPKGRLRQQC

SEQ ID NO: 167078 - protein, 184 aa, Glycine max
  Coding DNA Sequence Number=SeqID_75393
  Pfam annotation: Domain name=Transposase_23; Domain location=45-115; Score=-16.2; E_value=0.071; Accession=PF03017.5; Description =TNP1ENSPM transposase
MQSKFQSQMQSQGLALPPEPEVGPSTARVSTKESCVDPSGNNPDTGDTNKCRLYTEEIPPRLVALGRVYEGSTTVHNIPLLHVQVKVGVEEVRDVDAPIPIPTKEVKLVGQTPNTFLAWPTHLVKRLSEQGAEGPAKPADRPNHEVMWDATVFGVFNEHFPLYIKREGLSEIAHGGQCLSISVI

SEQ ID NO: 167079 - protein, 150 aa, Glycine max
  Coding DNA Sequence Number=SeqID_75394
MTPLMKKIEGLQAPHGATSKPTTFSTQITCYKCDPFFAIAQAEKTFLPHLLLLTLPLKGCLVRVIAGLCHCRKRNDTVMETSAWVASHSSYVLVDSVGIEKVVSTIVLDALNFCFWPGPCDISVNLKNYYSLHGGASSACGPNGLGLAKY

SEQ ID NO: 167080 - protein, 53 aa, Glycine max
  Coding DNA Sequence Number=SeqID_75395
MVGENVNHEDFDDIKKNLLEKEGDVNHASFDGVEKKSHVCHHQKGGECECMYT

SEQ ID NO: 167081 - protein, 117 aa, Glycine max
  Coding DNA Sequence Number=SeqID_75396
MFLMHLFPLYSTTSGGRIVVPPANRKSEANPLKQKIEKAEVGQRFQEVSVLANVFPTYRNPSLVLITIARGERERRENERSGGQEGASFVINCVKLVEDKKGKKKKVFSGEGPSGED

SEQ ID NO: 167082 - protein, 66 aa, Glycine max
  Coding DNA Sequence Number=SeqID_75397
MGCISNQNSHQESASVGHRLVDHLPGAVVGVGVPTGPDATEVGTEGLLTEKCISPLLVDIAPPSGG

SEQ ID NO: 167083 - protein, 127 aa, Glycine max
  Coding DNA Sequence Number=SeqID_75398
MRFFHGDFPPWRCSGRQRRRGEGRHHPLGNKPWKKELHHQECALDKKLEDDALMEEKKERREEHEIEGIKEGEKWTFEVCLIRLSFIKVTTSVTNASIYRLGSFLGKLSCENFLEKLVLSYTHPSNN

SEQ ID NO: 167084 - protein, 72 aa, Glycine max
  Coding DNA Sequence Number=SeqID_75399
MACPSNRLLHYGRKNINNLIQFDPKPPIFSPTQGPTHIYLSYQMLPTQSGYEQTNPKKRVIVTPSTLTIITN

SEQ ID NO: 167085 - protein, 95 aa, Glycine max
  Coding DNA Sequence Number=SeqID_75400
MDKCQRRYPQTRSPQCGCSHGSAGDFDTRRKKKNDRVQAQGERRRTIGFKRGFYKTDVNNGILTSVLEKPMLTKSTYLQKCHRAFVNIGFSYNRC

SEQ ID NO: 167086 - protein, 193 aa, Glycine max
  Coding DNA Sequence Number=SeqID_75401
MKKGAEKEREKEDEGFYFCSKPDCVKFFCSKSDCVKFCSSNHWDKNEMPLWTTTHSGHNGGATVSRCVAGTEKTFDVILTRSGSLDTGNKDLDDTTSGLHPSPLGPSSFSTRGLCPSPLGPLACIWPVSGFSSTLLTLAVARELEDKDLEALYELKGPMTRSRAKFLQEEMIKRIKDELLIKGKEGENHKGLN

SEQ ID NO: 167087 - protein, 55 aa, Glycine max
  Coding DNA Sequence Number=SeqID_75402
MASNRSSSWARGEGEGSRKRCRCWFWALMLCADVGLGFDRKVCLVGTGLEYNDKM

SEQ ID NO: 167088 - protein, 184 aa, Glycine max
  Coding DNA Sequence Number=SeqID_75403
  Homolog annotation: Hit_ID=Q2HW90; Match level="QueryCoverage=77%, HitCoverage=35%, E-value=2e-14, Identity=31%"; Hit description =Putative uncharacterized protein
MIEVFVEAIASLAQYYDQSLRCFPFGDFQLVPTVEEFEGILGCPLGGRKPYLFSGKHLEEKAKALADQGEWTSFIDVLALLVFGIVLFPNVDGLVDLAAIDAFLAYHHNKESPVVAVLADAYDTFDPRCEKSSHCMCVEKGKANWEFLTGFLNIPLMGTSEGNAKMLQRVRKAWNAVQRKDKEL

SEQ ID NO: 167089 - protein, 86 aa, Glycine max
  Coding DNA Sequence Number=SeqID_75404
MGSSLAMGCSSRFDVSVCGSCEGGVKGDEGWFCWSKEYKCQRGLVLRLLDEDTRLLRSMLLYGNCNCCGGGNCSCGHEGCGDDGCD

SEQ ID NO: 167090 - protein, 199 aa, Glycine max
  Coding DNA Sequence Number=SeqID_75405
  Homolog annotation: Hit_ID=A5AG06; Match level="QueryCoverage=92%, HitCoverage=38%, E-value=3e-12, Identity=30%"; Hit description =Putative uncharacterized protein
MEWMKDVASYLNCSLLSVPFTYLGIHIGANPKESDPEEGGTQAGETRMMFPVGRRYEHTKIAWEKGGLGIRDLTKFNQALLGKWKWNLFHHHGELWARVLESKYGGWRNLDEYRRVLVPWLGFGKKGEGRLLDGIPIMFTWNMGVVPAVEEIQHLNINEQQQDGWVWLSESTEVYTVSSAYQLLDRESRDENIDGVFQD

SEQ ID NO: 167091 - protein, 504 aa, Glycine max
  Coding DNA Sequence Number=SeqID_75406
  Homolog annotation: Hit_ID=A5BRP8; Match level="QueryCoverage=27%, HitCoverage=10%, E-value=1e-52, Identity=67%"; Hit description =Putative uncharacterized protein
  Pfam annotation: Domain name=tRNA_anti; Domain location=156-239; Score=17.5; E_value=0.022; Accession=PF01336.16; Description=OB-fold nucleic acid binding domain
TVTDLAFFAEDVHLLASVGTDDRVYLWEISEGPDDEDKLQITTNIVIALQIVREEKVEHPQICWHCHKQEILIVGMGKHVLRIDTPKVGNGEAFVVDDPLRCPVDKLIDGVKLVGTHNGEVTDLSMCQWMTNQFVSTSQDDTENLISKLHPRKGTWKIAVRITDIWDVKKHNGRQAINMVLMDQTGAKIGATLWQEFFLEFQPKLHLGCFYLIQNIKVVDNQSEYKEDYALQLDDAIEKNHFVGEPLVLMLTLAKIKDAKDKYPLSVQNIKNGSKLYVNADIAKIKKFRNAYDKCKQKTTDEGSGSQSQYTNNSQRMLQDKFLHNAQMVSLGDISKLREDGYCLTVAMVDEVMIDTPWSYDSCPYCTTTFDPLKIRAACRSCQNQVSHTVPRYKLVVKMDHNGEKANFHFWDASCIKMFGKTTDECRQEWIAVGDEIKVFPECVNDLVGKTLAVRFKFHVHMCQSSVLDVSQEEHHIHTLTSTLGLQDEASIGKSPAACAETSL

SEQ ID NO: 167092 - protein, 77 aa, Glycine max
  Coding DNA Sequence Number=SeqID_75407
MKRKKKAGEGHFCHFTLRAGCPSKNAGCTKCLAPIIRQFVKFRDMLKKKRKIDAQSVRFRDTPEIKWKHRCTISEVS

SEQ ID NO: 167093 - protein, 80 aa, Glycine max
  Coding DNA Sequence Number=SeqID_75408
MDSVEAKLHGESKMMTKVMTKSSKINQRKTQENPRSIKNNSRVQDKNQEEFKTQEESLETRIKIQGSRSRFKNEEKTQSR

SEQ ID NO: 167094 - protein, 110 aa, Glycine max
  Coding DNA Sequence Number=SeqID_75409
MTPLMKKIQGLQALHGATSYPHLEILIMIVEGLHNSKKHMPLHAKPSSKLSIYSRRNWGKKEGGRYPCQHFGARIGQAPADLSWYASVCATSSELFSSRWELLQFSTRAA

SEQ ID NO: 167095 - protein, 70 aa, Glycine max
  Coding DNA Sequence Number=SeqID_75410
MVPACHRARHLWMTKGAEDDVSLYMLSCFESYREQKVYKDNRLDNLATYAFRMKNNVSTGEGEYADEIFS

SEQ ID NO: 167096 - protein, 141 aa, Glycine max
  Coding DNA Sequence Number=SeqID_75411
MVLTNMDGEELPFPMNSDVVCSSWFPPRILVCCKKKVQVSLPGRAPLHLQIKNEGGGVFLHPKLSPPPPLQKHQAHGNYEDSSPQASIVEFLLPFSRFVSLPTRVVRDGLRPMLHFGVMGHATLPPFSCYSCQNMRPPSAR

SEQ ID NO: 167097 - protein, 670 aa, Glycine max
  Coding DNA Sequence Number=SeqID_75412
  Gene Ontology: Mol. function=iron ion binding; Cellular component =integral to membrane; Biological process=iron ion transport
  Homolog annotation: Hit_ID=A7QJ68; Match level="QueryCoverage=95%, HitCoverage=96%, E-value=0.0, Identity=68%"; Hit description =Chromosome chr2 scaffold_105, whole genome shotgun sequence
  Pfam annotation: Domain name=OPT; Domain location=43-655; Score =512.7; E_value=4.3e-151; Accession=PF03169.6; Description=OPT oligopeptide transporter protein
MMSSPANLNTGGEEKKLEIEKVVESQVEVADTESKRIQPWKEQITVRGLVVSTVLGIIYSIIAMKLNLSAGIVPNFNVSAALLAFLFVRSWNKVLHKAGFISKPFTRQENTIIQTCVVSCYSIAVHGGFASYLLGLNRKTYELSGVGTEGNNPNTVRDPGFAWMTTFLFVVCFVGLFILIPLRKIMIVDLKLTFPSGLATAVLINGFHTQGDKMAKKQVGGFLKYFSISFMWGFFKWFFSGTQDCGFAQFPTFGLQAWKQTFYFDFNMTYVGAGMICPHLVNLSLLLGAILSFGVIWPLIDRRKGDWFPTNLDESNMKALYGYKVFLTVALILGDGLYNFVKILVSSILSVHEKIKNRKNASSADQQRDNAEELKQKEVFLRDNISMWIGTGGYIVLSVISIIVIPLMFPQLKWFYVVVAYILAPSLAFCNAYGTGLTDMNMAYNYGKVALFVVAAMSGRDNGVVAGLVGCGLVKSVVSVACTLMHDFKTAYYTCTSPKAMFICQLIGTALGCVIAPLSFFLFYKAFDVGNPHGEFKAPYALIYRNMAVLGVEGFSALPQHCLQLCYGFFAFAVVVNMVRDLSPNVFGKWMPLPMVMAIPFLVGAYFAIDMCLGSLVVYVWHKLNTKKAEAMIPATASGLICGEGLWALPASILALAKVNPPICMNFLAS

SEQ ID NO: 167098 - protein, 316 aa, Glycine max
  Coding DNA Sequence Number=SeqID_75413
  Homolog annotation: Hit_ID=Q6WAY3; Match level="QueryCoverage=33%, HitCoverage=4%, E-value=5e-07, Identity=35%"; Hit description =Gag/pol polyprotein
MGSNQAHLSKKRFYQVKIKSLEVSSLQGGNGWTSPNVKLSLVLTVEEFEEILGCPLGRRKPYLFSGFYPSMARIAKVVKISAQELDRVKQNRNGIVGIPRKLLEEKAKALSDQVAIDAFLAYRHSKESSVASILADVYDTDEKLLMHFFQDSLAGAAVIWDLAAQVAPPMLEKEMITMIVGMLPVFYYEKLVGYMPFSFADLVFAGERIEVGLKRGKFNYVSPASTSNIRFRASGAKKKEGDAHVVTSAPAWLKEEKVEAAGVSLSEEYALSDATSSPSESFVSSCAQCAQLAKPNFTNSRLASLQNLKRQGAFKH

SEQ ID NO: 167099 - protein, 90 aa, Glycine max
  Coding DNA Sequence Number=SeqID_75414
MTKGNPGDLQPFYHDIDRTFHRLVRHSVHPDHSVHFEHFEHSEYFVASDSEYSDFDHSAVNFHIENMAQPPPRERTLREMAAPDFTYESL

SEQ ID NO: 167100 - protein, 22 aa, Glycine max
  Coding DNA Sequence Number=SeqID_75415
MGSNPETVSLHMQGYSLFAYAR

SEQ ID NO: 167101 - protein, 158 aa, Glycine max
  Coding DNA Sequence Number=SeqID_75416
  Gene Ontology: Mol. function=aminobutyraldehyde dehydrogenase activity; Cellular component=mitochondrion; Biological process =metabolic process
  Homolog annotation: Hit_ID=Q8VWZ1; Match level="QueryCoverage=48%, HitCoverage=15%, E-value=1e-21, Identity=67%"; Hit description =Aminoaldehyde dehydrogenase
MGAKYLEVVKRGSHPNNGWSPDEIRVEEDTKVVIFNSKKITEKKDELGKLEVIDYGEPLDEASADLDDVIGSFNYYVELAVGLDAKKNSSVSLPMETSKSHVHKEPIGVVALITPCFCADLSGKKMAKEDNFIRWTSPILDIISVYQANIMDYLFTCS

SEQ ID NO: 167102 - protein, 251 aa, Glycine max
  Coding DNA Sequence Number=SeqID_75417
MTNQQSGLCTAREHCLALAIAIALALLGADEVDLGVGLEDGGESSVDGWDGWVWKGWVLGFLAEVRGLGSEDEGHIHLLTYHDLVDAEAVSITDIVSGSYSRHDYVEKHNVDHPTHVGYLLLVFAHGQTIQSTSRCSNNGGRRDYHLSPSNSSLDVGCILPSISLEESIRAIMSGVELFQKISPAHLAKQSLYIKSFLLQVLEVYPLPRDKSILRESLCCIINIVDGWDASGLILPRGAIVHREFKEKESF

SEQ ID NO: 167103 - protein, 200 aa, Glycine max
  Coding DNA Sequence Number=SeqID_75418
  Homolog annotation: Hit_ID=A4PP05; Match level="QueryCoverage=86%, HitCoverage=48%, E-value=2e-13, Identity=32%"; Hit description=IMP dehydrogenase/GMP reductase, putative
MALMFDYRGCATCIRRRSKHSGSYAWGAAALVHMYDNLNDTSKSTVRQLAGYITLLQCWIYEHFPSVGFSIPTEDYDERRLRACQWTSSKALTVSTYRRCLDRLTPDVIGPIDGHSRPERIVQQFGYIQAIPSHHAASSFSIEEIDDRWMQFSEYIAPIGQLCAVLNHCLTDYMDWLCMISHPFMSLAQPGDPPRVLPIQ

SEQ ID NO: 167104 - protein, 101 aa, Glycine max
  Coding DNA Sequence Number=SeqID_75419
MAIKKTKGTTAEEDESTTTTTTDHHENRNKNHCRRKEEQQPLTPEKRRRRSTGEKRKKKQFQKCRVPQATTIPESINSEPNLPSSKSHLCILIQIALTLDF

SEQ ID NO: 167105 - protein, 120 aa, Glycine max
  Coding DNA Sequence Number=SeqID_75420
MEEEVDPSIKREKHKENGVTNVGCEDDFLDSPITKFYQEGSPSSLDMELRQKGCTEPVKLIKVIWSPPLSLLPPKPLNLNLHARIVGRSQLSYKGCSCLPTIRHNFRKFKCVIPVFRFQP

SEQ ID NO: 167106 - protein, 63 aa, Glycine max
  Coding DNA Sequence Number=SeqID_75421
MVSSCWLGRVRSSLHHPMTSYPHIFIPIPNQALDRRLQEDWARDAREGPRVLMSLRVDFRPMG

SEQ ID NO: 167107 - protein, 123 aa, Glycine max
  Coding DNA Sequence Number=SeqID_75422
MVLMLQSLYHLCLVMQSIHNLAQHRPIISMEDFMAQVAWPGVQPSTLGEGEASTSQELQPEAKAQSEVTLEATLGTSPVTTPLVEVFEEDDGATNTYYAAYLAVMQSTWDPWPATAQETSQPA

SEQ ID NO: 167108 - protein, 202 aa, Glycine max
  Coding DNA Sequence Number=SeqID_75423
  Homolog annotation: Hit_ID=A5BSR3; Match level="QueryCoverage=40%, HitCoverage=25%, E-value=1e-11, Identity=46%"; Hit description =Putative uncharacterized protein
MHFKSNLKRKWALAVDQDGVDDIVCEKYGISKEKWAQFCQTRRDPSWEDVRKKAQAIQKQNIAPHILSRGGYEYLEQKLLVEKTKKKLEVAAQSGSVDGIIDPPSPVRRHMKWKMVRTKKTGEMMTEAAKEIAEKIDSFEEQASQGSFVPHGRQDVLTATIGHLEHPGRVRAAGAGVTIKQYFGSAPRMSRNSSSLPLEELQ

SEQ ID NO: 167109 - protein, 128 aa, Glycine max
  Coding DNA Sequence Number=SeqID_75424
MKVLSRSSQQVGYVVHGREQEDELQNDLWREERENSKGFNFTNLLEVQGLSTLVQMKGTFYPELVKVFYTCAKAVMEVAGIDMCGVRKLEESADGYNKMTTYRDFTKASNEITERHLKKLGMTYVDHE

SEQ ID NO: 167110 - protein, 114 aa, Glycine max
  Coding DNA Sequence Number=SeqID_75425
MVVGRGLKPLKRVSRLRLDRVLTMVEKEKPQGMFYNNPMVSAKCTYQNPELSHVRVDVAKESMSEYEKSEREPGTYRVEELRALVYRGCYGDVTTLADNYRLVHNSQWITMAYR

SEQ ID NO: 167111 - protein, 76 aa, Glycine max
  Coding DNA Sequence Number=SeqID_75426
MEAEWRRKRERRCHFKEKMSLEEVHHHRRPWIRAWRKKEMNEGRGREEHEILCSKRAMKSEPTNPRSIPWFSTKCA

SEQ ID NO: 167112 - protein, 242 aa, Glycine max
  Coding DNA Sequence Number=SeqID_75427
MLAIINKYQEELNLATTHEHKVADEYARVYAKKEARGRVIDSLHQEATMKDAITKRAPRHPYRIRSKSRMMGDLEEVQEKMKADMSALKEQMASMMDAMQGMKQLMESNAATVAAVSSAIEADPTFPTATHHPILNMVGQERSTPGHISNPHPRYNRGAYPYDLPPNYTPPVIRDDAGHVPPLILEGEPPRHPDEVHEDHGEHAQGDVDSYSPFPAEGPASNALPQPNITGEPQNHPTQPMF

SEQ ID NO: 167113 - protein, 237 aa, Glycine max
  Coding DNA Sequence Number=SeqID_75428
  Homolog annotation: Hit_ID=UPI0000E478F5; Match level="QueryCoverage =80%, HitCoverage=7%, E-value=5e-09, Identity=27%"; Hit description =PREDICTED: similar to plus agglutinin
  Subcellular localization annotation: CTP_CleavageSite=46; ConfidenceScore=5.20e-01
MRHIQVLTKAKTDVFLVAAPQAHQTQHPPLVNLTSPNAHKTQGMPLVSLVSSKACQPKGPPLVSLASPKACKIQGPPLVSFTSPKARKTKGLPLASLFSPKARQTQDPPLLKALIIQGLPLVSLVSPKACKTQGLPLVSLISLKACKTQGSSNPRSTIGESCFYKGSQTQGPPLVSLVSPKAHKTQGSPLVSLISPKAHQTQGPPLVSLDTGSKVHGVHPKVCPWYKNPRFSLGTKT

SEQ ID NO: 167114 - protein, 117 aa, Glycine max
  Coding DNA Sequence Number=SeqID_75429
MEEGLSTNKPPLFRGIKHVTSKEEQTQSPHTCFQTILNELRSLGKTCDNYDDIDKIIRTLSKKWRPQDEGLERKKSLTFNSQKNKKASSSREQVLRSSSKALKVDDSSDDELEEGCK

SEQ ID NO: 167115 - protein, 242 aa, Glycine max
  Coding DNA Sequence Number=SeqID_75430
MGYVGVRELSWRWATGDGGFMRALWMVKLPAFIVDHRVVPGDMSRGSGDLGDVRRAPGSQQIKGTKTTKQGGLWLENEVRKLRKPLVIDYQGRNEALIVMAAQLIRDRVEMECLEGAWETLEGNTSCRFRGTIRLTATSLVHPDEPARTLQRTVEWILPTPTPYRLVEPVQVIEVTSSEEDPEEDLEELPPEPAVDALDFLEGDEDPLLEVDSPEEVMSASEADSTEDSGPREMAVSGGSSS

SEQ ID NO: 167116 - protein, 196 aa, Glycine max
  Coding DNA Sequence Number=SeqID_75431
MWYGTLIINFVKPHGAMVLDDLATKMTWIVNGSRIKHYLGAETRSFRPRRLAWANISGKNNLRNSPNLAKDWPRPINEIYLNSLGLVKSCLVWIQLAEQLPKNDHKVILEFYANAWPTKEGVLDQHSKVWGQWIPYPMMLEEGQQCKYTSRRERAIGFDQEAIGHLLCFRGCDFVLRMMQKRLWIMRTHMTIITQI

SEQ ID NO: 167117 - protein, 99 aa, Glycine max
  Coding DNA Sequence Number=SeqID_75432
  Subcellular localization annotation: CTP_CleavageSite=41; ConfidenceScore=5.09e-01
MDKATPSIPRPAPTIEHIKQDNSGKVEITFNRRNSFSSRIEASRFEYESARRSFSVRTCSIPVGLTRYESHNQFPTMTRWIALRNLVLEDVRTQCSDRM

SEQ ID NO: 167118 - protein, 45 aa, Glycine max
  Coding DNA Sequence Number=SeqID_75433
MEAADLSIRVRGQLVVGLRAGVQVNVVGMQELPLVQARCRKNSPV

SEQ ID NO: 167119 - protein, 82 aa, Glycine max
  Coding DNA Sequence Number=SeqID_75434
MEKDTKVVIFIYKSFDFYLKQVMTKSSKVHDNKDDDFKNQESRFKVQASKNQDQDSRFKIKESRRDLIKISMKKFFQKLSST

SEQ ID NO: 167120 - protein, 97 aa, Glycine max
  Coding DNA Sequence Number=SeqID_75435
MAILYSITEIIPTLEITTINIDNEPSIHVEHFFDIQELEKVGLKLNKTLLFYGARHFFNEPQIIYPELIRTFWRNVEFVNKKEDSIQSSGNQGSIVK

SEQ ID NO: 167121 - protein, 200 aa, Glycine max
  Coding DNA Sequence Number=SeqID_75436
GTSFVVQVEGTSTWVVVTENKRGYISCRSVQVEGTSTWLFKENKGGYILCGSLLVKDFTRLKRNLKDHRTLGDWMQTLQARSSCTASKEGAFKQGLASSIKQDFATVSERSFSFIVELPNSMFTFIHQVQPIIEKVNSDDEEPVVAAKDLAMEFYDGPPPSLEYKFSKTPMDSSSDDESRDDFFHKIENEEEAAKQKREK

SEQ ID NO: 167122 - protein, 92 aa, Glycine max
  Coding DNA Sequence Number=SeqID_75437
  Gene Ontology: Mol. function=ATPase activity; Cellular component =chromosome; Biological process=chromosome organization and biogenesis
  Homolog annotation: Hit_ID=A7Q542; Match level="QueryCoverage=79%, HitCoverage=9%, E-value=3e-27, Identity=61%"; Hit description =Chromosome undetermined scaffold_51, whole genome shotgun sequence
MAKLEPPEGCSFLDGLEVHVAFGSVDAALDLSHTQNIGRMTKAHFPHSEFIVVSLKEGMFNNTNVLFRTKFVDVFASSICYKSYTYVHLQGK

SEQ ID NO: 167123 - protein, 280 aa, Glycine max
  Coding DNA Sequence Number=SeqID_75438
MGDVEEVQEQMKADMVALKDQVAFMMEAMLSMKRLIESNMATATAASATAEADPTHPSATNQAHQPASDMMGQGREVLGSTGGPHMGYNRNAYPYSLPPNYTSPTMHKNIDHAILVTLEGQQPQPMVEGEMIIMIVDTLSVFYYENLVGYMPSSFVDLVFVAPAWSKPQQTPHDTYQYAQHHPSFSARARNPSNSAPAQQRTVVQPQRAPAHSLDPTQPHPTDGSNPSLSANPGRNPLVKKLPEFAPIPMSYGDLLPSLIANQMAVVTLERIYQSPFPQW

SEQ ID NO: 167124 - protein, 197 aa, Glycine max
  Coding DNA Sequence Number=SeqID_75439
  Homolog annotation: Hit_ID=Q9LHC7; Match level="QueryCoverage=36%, HitCoverage=9%, E-value=6e-07, Identity=35%"; Hit description =Retroelement pol polyprotein-like
MGGEGCNTARPGYDTYQQGPKHYNSIVIPPFNNKLWKLKPALLSLIGSHPFIGMDHQDSYTHLSTFLELCSTMGAFGKNAKVVYLKAFPFSLAGGRKHHCKVLSSIQIHQDPLLLFPKDLMNLSVKHGRDSSLCCRVGDTMMSKSPEEAIVIIESLQPMIIRVAMIGLRFKEKANFLNNFNKVDHKKHTKLIKFKKF

SEQ ID NO: 167125 - protein, 107 aa, Glycine max
  Coding DNA Sequence Number=SeqID_75440
MTRRLLAGSLAFESRILHYLIVRILLPRSSNLAQRSFLIGAAVIASFGYRKEHDGSWVKKGAQPIDEEGHLPVGEDSTLLQKILDRFDGLQTFVGERFDALELQVDM

SEQ ID NO: 167126 - protein, 113 aa, Glycine max
  Coding DNA Sequence Number=SeqID_75441
MNFKDEKCDILEFLPRIFSKIPLHFNPKLQGKAIFGVLEPPSTSWGFKFQISVLGTSSKILKAIQWLMNQNEENVTGAWVDGGPSAERNEDKGYVGVRELNLKVGNWGWCAYA

SEQ ID NO: 167127 - protein, 96 aa, Glycine max
  Coding DNA Sequence Number=SeqID_75442
MRARARVMSEVEEVQEQMKVDIEAMKDQMAAMMEAILSMKKIMEVNVAAVVATNVVAEVDPTPPSGLNQINHPTSDMVGPRGKELGSTNDPHFVRV

SEQ ID NO: 167128 - protein, 73 aa, Glycine max
  Coding DNA Sequence Number=SeqID_75443
  Subcellular localization annotation: CTP_CleavageSite=56; ConfidenceScore=5.34e-01
MSPPPLGPHNHSQTHLKLLGRLPLQARFSAGLHTTKSLKLSGTWTFLSLELSRHAKASRKGQNSFPKSDFRLE

SEQ ID NO: 167129 - protein, 51 aa, Glycine max
  Coding DNA Sequence Number=SeqID_75444
MHSCFLLHLHASSATNSNPNELAKRAYRAKQVHLLRMNTHPLAEIPVAKRG

SEQ ID NO: 167130 - protein, 81 aa, Glycine max
  Coding DNA Sequence Number=SeqID_75445
MQNLQHIGTALHLPIITPKDFLQRVAWPGDWPEAEPTIIVATAETAKAEPTAATTTEMDHIPANTVEPKLNEDYIVDVSGD

SEQ ID NO: 167131 - protein, 68 aa, Glycine max
  Coding DNA Sequence Number=SeqID_75446
TYQGNPCGVYPDLSSFTGSGVYPDLSSFTGSGVYPDLSSFTGSGVIQKLYSLYQAIRPVRFTSNPTQN

SEQ ID NO: 167132 - protein, 222 aa, Glycine max
  Coding DNA Sequence Number=SeqID_75447
MGPKKLPAKRARKNTAGKGSIGAPQAEVDFDRHRDEEFAEFQKEIAWRHWAPLVSPMANGFPLTEMPSARGYRPVGVRAEAGLCPDCSGETGVTPLRHPVDPEKSNRALGFPALITGLNQFYGVQAGTGPGTTVATRGIAAGSCRRITTTFTATAISRVHLCSHVEDPNPYVWPTPEQFGATMAWPGDMPDFQTEAGPTRTSRDGDGAQEDDDMVDVMDFFL

SEQ ID NO: 167133 - protein, 170 aa, Glycine max
  Coding DNA Sequence Number=SeqID_75448
  Gene Ontology: Mol. function=aspartic-type endopeptidase activity; Cellular component=chromatin; Biological process=chromatin assembly or disassembly
MKKEKVGPKQEDTWKMRKERDNTRLKELSVSISKLLEMLEADRKEKKAGFKTLEATMDSLLKPNNNSGANMHMNVAGNNFIGGSPSTPPFQTNHQLHYYVVYLRPSYLRRNTYPSTSQFKIPTKTVTKPAEMQIRREKGLCYTCDEKFTSSHKCPNRQYLLLQMDEDEKC

SEQ ID NO: 167134 - protein, 22 aa, Glycine max
  Coding DNA Sequence Number=SeqID_75449
MDYNNEASNGIKFRMLGYFTIG

SEQ ID NO: 167135 - protein, 175 aa, Glycine max
  Coding DNA Sequence Number=SeqID_75450
  Gene Ontology: Mol. function=magnesium chelatase activity; Biological process=chlorophyll biosynthetic process
  Homolog annotation: Hit_ID=O65808; Match level="QueryCoverage=87%, HitCoverage=11%, E-value=1e-65, Identity=84%"; Hit description =Magnesium chelatase subunit
MKCAAIGNGLFTQTTPEVHRIVPENDHNLPIVKIVYEDLQAQYQSSLTAAVIAFNSKRKHASYVVLGYLVEELRDMVMYKTFCKDLEDANIFIGSLIFVEELALKIKAAMEKERERLDAVLVFPSMDEVMRLNKLGSFSMSQLRQSNNPFFHLIIHFYVKQQYSMWSFISSLYAH

SEQ ID NO: 167136 - protein, 53 aa, Glycine max
  Coding DNA Sequence Number=SeqID_75451
MASGQEYKRWKMSVNVLRDNCESLIQDFFKIKPCLTMKGFNSFKAHVIDYQYM

SEQ ID NO: 167137 - protein, 75 aa, Glycine max
  Coding DNA Sequence Number=SeqID_75452
MSQNFTNFLTDGCQGFAPFACPTLEQFGAEVAWPRDWLEAQVGEEPAESPGETEEARMDEDITDLLGFLGGSGAT

SEQ ID NO: 167138 - protein, 72 aa, Glycine max
  Coding DNA Sequence Number=SeqID_75453
MAGHILMLGVTTCPSRAIEARLTGALSKGGKMRGVATNVYLWKTSGKPKETGRQKRGFCSYVPSIEEEIRPT

SEQ ID NO: 167139 - protein, 74 aa, Glycine max
  Coding DNA Sequence Number=SeqID_75454
MWDFTLHLYSNNFHGYPTTFTLEEIKKRKDVQDRIKNISRFKKKVDFKNQDSRIKFPRIKIKIQDSRFKNQEKT

SEQ ID NO: 167140 - protein, 64 aa, Glycine max
  Coding DNA Sequence Number=SeqID_75455
MGDIDYRRKREGSDEMRKGNGGEGEKRAREHQRGKKRATFLVASLNIAVNGTVKWRERNLKIKT

SEQ ID NO: 167141 - protein, 472 aa, Glycine max
  Coding DNA Sequence Number=SeqID_75456
  Homolog annotation: Hit_ID=Q2HVW0; Match level="QueryCoverage=24%, HitCoverage=84%, E-value=5e-07, Identity=31%"; Hit description =Putative uncharacterized protein
  Pfam annotation: Domain name=RRM_1; Domain location=22-92; Score =36.2; E_value=1.2e-07; Accession=PF00076.13; Description=RNA recognition motif. (a.k.a. RRM, RB
MLENQQSQLPTCKLEGENRYHLYFTRFPDDTTEKELWTQFKKWGDVREIFISEQRNKGGRRYGFVRFKGVSDERRLERQLDNIIVGGLKLYVNITKYGRGKARHEQAIVKPKRQVEGENEGMTVAQQMAPHNMVPTMSYAEAVATRIENTGQRRNTTISLARYGGSHSSVQLKILAGEKKWYTDAWVGRLKKQEIFERVDDEIPWILGSNVVPKYLGDYMVLLLRLLDIKAEEMSNEENNHGSSLFYSLEKWNPAMKPGNRLVWIQCWGIPIVAWDIGHICKIVAAMGDLVEVDDDVEELRRLDRARVLIRTPWRPTIQHSIDVHIDGEIHTVHIVEENSSAEGKCTHQCRSTPGSSEEIVSDDSDTGTPLLRLINFSPRTIASEPNNGIIINENLSLPSGYRDNVDPMGKDRGNLAHCPIHVTCEAEIEMGKEAELESRPLSETSACSGEKETYNVQTKAKHGDKGKKAMR

SEQ ID NO: 167142 - protein, 328 aa, Glycine max
  Coding DNA Sequence Number=SeqID_75457
  Gene Ontology: Mol. function=binding
  Homolog annotation: Hit_ID=Q3EC58; Match level="QueryCoverage=45%, HitCoverage=25%, E-value=2e-21, Identity=65%"; Hit description =Uncharacterized protein At2g06210.2
MDLIQEILLDMRQIKELLLEFKKGKTPSDGGEYSINNDKKPEGENSDNNGLEFEKEDKQPMQTVLSLQLGVWVTKSQQEYDSAKALEGSSNERIGTHCGEQLGVKDKDLKTIDVEVVKEIRVEEAVNLQQKMQEQEGFSQLSSKNLNLGLIAPTPAPNPPDASSHMTLNGLSSAELHLLNERNPKLDATHLEKAKELYTRVLIQHCSNLYVTNGNEVVLVENDHFDVQRRSLHRFKKLPVVVFMSRCLMFDAGVAMQKFSASTLKKAKRTADEVRATVAELQNVVRVFSELFAASNLHTHVFDEKKIDTHVGYSNHLLSATKVHLETA

SEQ ID NO: 167143 - protein, 446 aa, Glycine max
  Coding DNA Sequence Number=SeqID_75458
  Gene Ontology: Mol. function=mismatched DNA binding; Cellular component=intracellular; Biological process=mismatch repair
  Homolog annotation: Hit_ID=Q1XBQ8; Match level="QueryCoverage=95%, HitCoverage=37%, E-value=0.0, Identity=84%"; Hit description=DNA mismatch repair protein
  Pfam annotation: Domain name=GIY-YIG; Domain location=360-433; Score =34.3; E_value=4.5e-07; Accession=PF01541.15; Description=GIY-YIG catalytic domain
  Pfam annotation: Domain name=MutS_V; Domain location=28-266; Score =53.0; E_value=9.2e-19; Accession=PF00488.12; Description=MutS domain V
  Pfam module annotation: Pfam domain module=GIY-YIG::MutS_V; Domain location=360-433::28-266
MVLCKLTNITIKSLTYTFVNNEGRRRRWVFPTLVESHGFEDVKSLNKIHGMKIVGLLPYWLHVAEGVVRNDVDMQSLFLLTGPNGGGKSSLLRSICAAALLGICGLMVPAESAHIPYFDSIMLHMNSYDSPADKKSSFQVEMSELRSIIGGTTKKSLVLIDEICRGTETAKGTCIAGSIIETLDRIGCLGIVSTHLHGIFTLPLNINNTVHKAMGTTSIDGQTIPTWKLTDGVCRESLAFETARREGVPELIIRRAEYIYQSVYAKEKELLSAEKSSNEKKYSTYINVSNLNGTHLPSKRFLSGANQTEVLREEVESAVTVICQDHIMEQKSKNIALELTGIKCLQIRTREQPPPSVVGSSSVYVMFRPDKKLYVGETDDLEGRVRAHRLKEGMHDASFLYFLVPGKSLACQLESLLINQLSSRGFQLTNTADGKHRNFGTSNLYA

SEQ ID NO: 167144 - protein, 68 aa, Glycine max
  Coding DNA Sequence Number=SeqID_75459
MDLECKNPLKLSYTEEGRPVRVTLFYENTPIIWDQHRLKGALKPGVFIPKAYTPKSPPGPLPPDSGPT

SEQ ID NO: 167145 - protein, 101 aa, Glycine max
  Coding DNA Sequence Number=SeqID_75460
MSASMHQSDFAPYVSRSYNGQWNASELPHDKHMSYSSCILEEMEIEESLLGLWLPLHYRADMRGWCLVLDVQQVDFVADLGVAFVDDWAFLVGSVGSNGKD

SEQ ID NO: 167146 - protein, 207 aa, Glycine max
  Coding DNA Sequence Number=SeqID_75461
  Gene Ontology: Mol. function=nucleic acid binding; Cellular component= nucleus; Biological process=DNA replication
  Homolog annotation: Hit_ID=A7QQ41; Match level="QueryCoverage=56%, HitCoverage=15%, E-value=3e-42, Identity=67%"; Hit description =Chromosome chr2 scaffold_140, whole genome shotgun sequence
  Pfam annotation: Domain name=Rep_fac-A_C; Domain location=96-202; Score=-17.9; E_value=1.4e-05; Accession=PF08646.1; Description =Replication factor-A C terminal domain
MWSSIMLKFGQLASMLWLISSTMLLKLVRTIATSQLYVEADFPEVCTLKRLFENEGKSVPTLSISREMSNLGKTDVRKTISQIKDEKLGTLEKPDWISVFVAVSHIKVDNFCYLGCPLKIRDRQCNKKVTNNADGTWHCERCKVYKGTMTNNLNVAIKHIINDDGNVDTFVRQITSLSHGRHPNISSCKQSQFTWCQLKVELNKEYT

SEQ ID NO: 167147 - protein, 856 aa, Glycine max
  Coding DNA Sequence Number=SeqID_75462
  Gene Ontology: Mol. function=protein binding; Biological process =protein metabolic process
  Homolog annotation: Hit_ID=A5C486; Match level="QueryCoverage=100%, HitCoverage=99%, E-value=0.0, Identity=50%"; Hit description =Putative uncharacterized protein
  Pfam annotation: Domain name=AAA_2; Domain location=659-844; Score= -51.2; E_value=0.089; Accession=PF07724.5; Description=ATPase family associated with various c
  Pfam annotation: Domain name=Clp_N; Domain location=113-170; Score =2.3; E_value=0.6; Accession=PF02861.11; Description=Clp amino terminal domain
  Pfam annotation: Domain name=Clp_N; Domain location=24-79; Score =14.7; E_value=0.027; Accession=PF02861.11; Description=Clp amino terminal domain
  Pfam module annotation: Pfam domain module=AAA_2::Clp_N::Clp_N; Domain location=659-844::113-170::24-79
MRAGVCSIQLQALTPEAATLVKQAVTLATRRGHAQVTPLHIATVMLATSTGLLRKVFLQCHSHPLQYKALELCFNVSLNRLPAPTPSPLLSPPYSTTPSLSNALVAAFKRAQAHQRRGSIENQQQPILALKIEMEQLIVSILDDPSISRVMREAGFSSALVKTRVEQAVSMEVCSQHQASKENTTTKLQVLGGSSSMSPSRSFGQFGASFKSIDHVGDHVDDVTSVLSELVSKRRNTVIVGESLASAEGVARGVMERLETGSVQGELRFVQFVSLPLVSFRNISKEEVERKLVELRNLVKSHVGRGLILYLGDLKWLFEFWSSYCEQRTNYYCSVEHMVMELKKLISGNRENSRLWLMGIATFRTYIKGKACHPSLETIWDLHPFTVPVGSLSLALNFDSDFHVQERSKVTFKDESFEERAKVRKYLTCCRDCSLNFEKEAKSIASSFTISKRDCTTSLPTWLKNCKAERSRMMEDQENAKLWDICKKWNSFCSSAHGFPSNLEKPFLFISSSPSSPTSVSSHERKPSLNLSHLNWPVISERKEVPKECELYTETTVRNDSYEGNLIMFMPERNHPKPDLLSNPNSSPNSASSSEAVEGLDSTQMFKDHNDENLKILCDALEKKAPQQKKTVKEIASTVLLCRSGMRKVGNHLVKRDDRQETWFFFLGVDSQAKEMVSKELAKVIFGSYSNFVSIGLSCFSLTHEESKNKRARDEFGGSYLQRFGEALNENPHRVFFMEDLEQVDHFSKKGVKQGIESGAITLPGGESVPLKDAIVIFSSECFSSVLSRACSPARTTSPFSDEDMKENINNSEEKISCLSLDLNMAIEVDVQKNVHLDGETDEILELVDKKINFKI

SEQ ID NO: 167148 - protein, 141 aa, Glycine max
  Coding DNA Sequence Number=SeqID_75463
  Gene Ontology: Mol. function=RNA-directed DNA polymerase activity; Cellular component=exocyst; Biological process=lateral root morphogenesis
  Homolog annotation: Hit_ID=A7QHV3; Match level="QueryCoverage=55%, HitCoverage=12%, E-value=6e-31, Identity=82%"; Hit description =Chromosome undetermined scaffold_100, whole genome shotgun sequence
  Subcellular localization annotation: CTP_CleavageSite=39; ConfidenceScore=5.24e-01
MSPHPPLILQSLSIQGLISSSGGGGGSTASGDAGSSGASRAIVKDRFKTFNTMFEELHQKQSQWTVPDTELRESLILAVAEVLLPAYRSFVKRFGPLVENVKSTQRYVKYTAEDLERILGIGAPSNMVRSKVIKFKVKERG

SEQ ID NO: 167149 - protein, 228 aa, Glycine max
  Coding DNA Sequence Number=SeqID_75464
  Gene Ontology: Mol. function=aspartic-type endopeptidase activity; Cellular component=small subunit processome; Biological process=DNA integration
  Homolog annotation: Hit_ID=A5AR01; Match level="QueryCoverage=69%, HitCoverage=13%, E-value=3e-34, Identity=46%"; Hit description =Putative uncharacterized protein
MASDSQKTDGPAFSISGTPTITSEKLNGKNYLAWSASIELWFLDQGYHEHLEQSSEKISEDKREQWKKFDYQLCALLWQSVEPTILTNFRAFKTCYSFWKKTQSVFANDIQQLYDAAQKLTTLKQTDHDMVVYALKAQSVVEELKLSLEADKLEDIKTELDNLYMVLEEIQLIVLKLLPGYLIEGDEVVVETEEDELEEEVAFNVLTVREWVTHKTLVILFTDSPENR

SEQ ID NO: 167150 - protein, 497 aa, Glycine max
  Coding DNA Sequence Number=SeqID_75465
MHVNTPKFERAQVRKTLSAAKRRECVEQIVMETNSGRQQGAGMKQGSYAEVVMRNVPRPHQRRTSATDDHNTHRSRSSVYLDISLTGQKWLNEAWVGRLKNPALFDRVKDDLLWDIGTNISPKYIGDDMVLLLGLTNDKAKRMIDVESEGGDSLFYSLEKWNLRMRTGTPKTGQGPSPNQNTVDADRRTHCRRTHPREEIYSEDSDAGTPRSVTNLRMEKEHEVQSMTASGVTIAATMEKEHEVQFMAVPRATIAATMEKEHEVQFKAVPGATIAALIFSQTSPSEVTSSGTSHLSVATPTAIAGAGNTTFGTVTHDHHCAMANEGEAQKKVNMRPADSTTKLPEIGSYDVDKSFMPLGRQILNNPQSRPNSACREYVRKRWCTKQDDPSCLACPLPHTATELITPPQQQQPRINDNQTKKQEQATKCLENKTAQAVAVEADLVNNQTQEAEVLWKMAQELGVTSGPIQKSFVEKIMEMEERDNKEAERLGNRSVTP

SEQ ID NO: 167151 - protein, 144 aa, Glycine max
  Coding DNA Sequence Number=SeqID_75466
  Gene Ontology: Mol. function=RNA-directed DNA polymerase activity; Cellular component=exocyst; Biological process=lateral root morphogenesis
  Homolog annotation: Hit_ID=A7QHV3; Match level="QueryCoverage=84%, HitCoverage=18%, E-value=4e-53, Identity=84%"; Hit description =Chromosome undetermined scaffold_100, whole genome shotgun sequence
MEPAIDTRSKVLEESLQKLGVEKLSKDDVQKLQWEVLEAKIGNWIHFMRIAVKLLFAAERKVCDQIFEGFDSLGDQCFAEVTTNSIFMLLSFGEAIAKSKRSPEKLFVLLDMYEILQEIHSELYKIQTPRQQQTLVLNFMLQGK

SEQ ID NO: 167152 - protein, 203 aa, Glycine max
  Coding DNA Sequence Number=SeqID_75467
  Gene Ontology: Mol. function=RNA-directed DNA polymerase activity; Cellular component=exocyst; Biological process=lateral root morphogenesis
  Homolog annotation: Hit_ID=A7QHV3; Match level="QueryCoverage=76%, HitCoverage=23%, E-value=3e-54, Identity=68%"; Hit description =Chromosome undetermined scaffold_100, whole genome shotgun sequence
MGMAVASDDLLSKKAAAMRASLERSQAITDDVVSILGSFDHRLSALEAAMRPTQIRTHSIRKAHENIDRTLKSAEAILAHFDQYYQAEAKIVKGPHEDVKNYLEAIDQLRRNIRFFGNKKGFKNDDDVVIRANNLISEAISKLEDEFKRLLSSYSRYSVCVVDRQGSTTFTISGDVFFSLRLAVADLSRIYCVVFLFHRGGAC

SEQ ID NO: 167153 - protein, 80 aa, Glycine max
  Coding DNA Sequence Number=SeqID_75468
MPIWLEIAPCNGEDEVVVAGVDGGVPEDDHRRNLDFSYGKHQEIQPLGSRNPLKKLKEETKTINGKEEKIEEEKDRERED

SEQ ID NO: 167154 - protein, 147 aa, Glycine max
  Coding DNA Sequence Number=SeqID_75469
MAEGGDGGGKYHQLDGSRHLLLDAMTTQMQHLLNCNNEELYRLIEGLEHQMNPNAGRPYGGNRRANDGPNRMDGHNKIEGVKLNVPLFKGISNPDAYLDWEMKIQHRDDERRETGDRYMTEMRRVMRKRYVPTSYNRTMRQKLQRLS

SEQ ID NO: 167155 - protein, 118 aa, Glycine max
  Coding DNA Sequence Number=SeqID_75470
MTRGNPGDLQPFDPEIVRTFHRLVRHSVHPDHSVLFEHCEHFEYSVAGDFEYSDFEHSTTNFHTENMAQPPPRERTLREMAAPDFTYESLCIQYPDEGVPYVLKIGLIHLLPKFHALA

SEQ ID NO: 167156 - protein, 71 aa, Glycine max
  Coding DNA Sequence Number=SeqID_75471
MRTLNGDFPPWRCSGRQRRRGMRRRHPLGNKPWKKELHHKDEPWIRSLERMLQWRKRKRERKRERGGGAQN

SEQ ID NO: 167157 - protein, 130 aa, Glycine max
  Coding DNA Sequence Number=SeqID_75472
  Gene Ontology: Mol. function=nucleic acid binding
  Homolog annotation: Hit_ID=A7QX73; Match level="QueryCoverage=86%, HitCoverage=26%, E-value=3e-13, Identity=37%"; Hit description =Chromosome chr6 scaffold_214, whole genome shotgun sequence
MLVATPRIFPPLESAPVSLAFARPQKGTEWFTTYRSNNFGSAYLSDDKACVIVGLRQKQIATNDGGVITLCDAQEIPKLRKNLISSWYFVGQWFLIEIRILLESMCVLTVMIAQKTIGNIYRLLGRIVVG

SEQ ID NO: 167158 - protein, 223 aa, Glycine max
  Coding DNA Sequence Number=SeqID_75473
  Gene Ontology: Mol. function=ribonuclease H activity; Biological process=regulation of epidermal cell division
  Homolog annotation: Hit_ID=A9PJC0; Match level="QueryCoverage=97%, HitCoverage=94%, E-value=1e-71, Identity=59%"; Hit description =Putative uncharacterized protein
  Pfam annotation: Domain name=GRAM; Domain location=100-179; Score =29.5; E_value=1.2e-05; Accession=PF02893.11; Description=GRAM domain
  Subcellular localization annotation: CTP_CleavageSite=41; ConfidenceScore=5.12e-01
MASFLQELLIGFPFTSAAYVGEKSKRYLPDPATQYNTSTTSSEQGRVNSVLTGMNRLGRKTNNLATGLKEHVKLGPKITDTVKGKLSLGARILQVGGVEKVFMQLFSVKDGGEKLLKACQCYISTTSGPLAGLLFISTDKVAFCSDRSIKAYSSKGHLIRIHYKVVIPLEKIRSINQSQHVKKPSQKYIEIVTVDNFDFWFMGFLNYQKAFKYLKQAISQAQA

SEQ ID NO: 167159 - protein, 203 aa, Glycine max
  Coding DNA Sequence Number=SeqID_75474
MRGQDIYCSQEETTSSPSSSGSEDEVRGEESSEEVYPHEEGDLLVVIRLLGGDIKRTLLLKQSFYLLLSRETSLSTAIPIELEVIPQVKELLDEGLVCIIRHRIPMISGMMNVLSGATLFCKITHASNIFIIHIHRDSLGSDQGIPAHPKRIKVISEWPTPPSVDGRSSEFQEPFDLRLDPFQGGGNDAILHPKALDKKIPEY

SEQ ID NO: 167160 - protein, 143 aa, Glycine max
  Coding DNA Sequence Number=SeqID_75475
MASRKRKAPASASQARYDRSRFTSQEAWDCYSDIVIGRKILPERNVMIYHTKFDEFKAKLERRNWQKELTNFMDGSIDVAIVKEFYANFYDPEDNSPKQERVRGHLIKFDADALNTFLKTPMVIDEVEELPSYSKFCRLRPDP

SEQ ID NO: 167161 - protein, 64 aa, Glycine max
  Coding DNA Sequence Number=SeqID_75476
MVAWNEEGVFAQAKGHDLKFKVATLYAEGGFAGILLPHQNLMIALPQVNSVVGLVGRLFGHGIK

SEQ ID NO: 167162 - protein, 48 aa, Glycine max
  Coding DNA Sequence Number=SeqID_75477
MLSLCIFHFEASTIHHPKLAKRAYYAKRVHLLRMNTHPLAEPPMAKRG

SEQ ID NO: 167163 - protein, 120 aa, Glycine max
  Coding DNA Sequence Number=SeqID_75478
  Subcellular localization annotation: CTP_CleavageSite=45; ConfidenceScore=5.54e-01
MSCTGSQSAPRHLSKSATSVHLLSEKGALSQKSLMCAKRSIHALSARARTRSLSLSKIIGRPVRVTVFCENAPTIWDQHRLKGALKPGDPKAYTLKSPLGPLPPDSGPTPKIILAHRHCS

SEQ ID NO: 167164 - protein, 120 aa, Glycine max
  Coding DNA Sequence Number=SeqID_75479
MRSAKKADCFLFTPSPIYSKIGEELATQLAQASKVASSKSNRLLEEETGRPKMPSIPERPIKGCTSSSNNPRTKLGYDTFERMKPPFSLSKQREREQAQSNCVLRQTSQSNSVANFNISC

SEQ ID NO: 167165 - protein, 127 aa, Glycine max
  Coding DNA Sequence Number=SeqID_75480
MASYGSINVAIVKEFYANLYDTEDKSPKQIWVRGHLIKFDVDALNTFLKTPMIIEEGENLPAYSKSSRLRMMGELLQAQENKVDSPLEIMDQLALVQPMQLCSIGTKVCTSDPMVADGGARVDDEGM

SEQ ID NO: 167166 - protein, 70 aa, Glycine max
  Coding DNA Sequence Number=SeqID_75481
MYMFEAFRIGMKIREISTSRGVNISVRMMVVHMMEKYYHRKLKLNLVKGLRVILMAIVDITNQQDLVYLN

SEQ ID NO: 167167 - protein, 250 aa, Glycine max
  Coding DNA Sequence Number=SeqID_75482
MTSRKRKSICTRPTSQYDTRRFSSLDAWTRYADNVMGRNILPERKVELYHTELDDFKAELERRNFHKRLINLANGSIDLALVKELYANLYSYEDRPPKQFRVRDYLVKINADSLNIFLETPVGQPGKILRKDLTTLAQVWSVLSYSNLAPTSHTSDLTLNRARLIFGLVSHLDMNIGALISNQMTSIAQTNCWNPEDLIVSIRGARRARAWPAELPSISAAPTPASTSAVIPAQTNSQCFEAMLQSIHPG

SEQ ID NO: 167168 - protein, 476 aa, Glycine max
  Coding DNA Sequence Number=SeqID_75483
  Pfam annotation: Domain name=Transposase_23; Domain location=224-294; Score=4.5; E_value=0.00038; Accession=PF03017.5; Description =TNP1ENSPM transposase
MGTAADNDGVDDTVCEKYDISNEKWAQFCQTHRDPSWEDVQKKAQVIQKQNIAPHVLSHGGYEYLEQKLMAEKTKKKLEEASQSGSTEGVINPPSPIRRHVKWKMARTKKTGQMTSEAAKEIAEKIDSFEEQASQGLFVPYGRQDVLTVRAAGASVTIKQYFWIGSTNLPQFLLHPSQRTRAVDSTNQGPGGGIDHRKSDSTADGILQPDAGSCGDPSPTDPETGDSDKCGLYIEENSSHLVALGRVYEGSTSVHNIPLLHGQVKVGVEEVKDAEAPIPVPTDEVILVGQALNTFLDWPTHLVKPLSEQVMWDATVFGVFNQDFPLYIKHEDLSEIAHSAGNSDVYGFLEPQSIQRSGQSQFESESYIKSWMQSSKRDVYLGAYLNGGHRKMVFILPKENLVVWFCSLHNRSDNYLKGIINSALKGLDDTPQSKSKAGARWIVVKYFNDVKPLEAKRLKVLRIQWAQFYLKVTNQS

SEQ ID NO: 167169 - protein, 51 aa, Glycine max
  Coding DNA Sequence Number=SeqID_75484
MGPKSTLRLMRILGPSLASLAQSAWSLLSNALAGMQLDTSGKFDDVDRGRT

SEQ ID NO: 167170 - protein, 545 aa, Glycine max
  Coding DNA Sequence Number=SeqID_75485
  Homolog annotation: Hit_ID=Q6WAY6; Match level="QueryCoverage=51%, HitCoverage=51%, E-value=3e-33, Identity=32%"; Hit description =Putative uncharacterized protein
MGTDQTGKRFYQVKIKGLDITSIKELGRLMGPLQMQAFRKAYRKILDLTIAEISTEAITSLTQYYNQPLRCFTFGDFQLVPTVEEFEEILGCPLGGRKPYLFSGFLPSLSKIAIVVRDLARGLDRVKQTRNGIVGLPQKYLEGKARDMENQEEWVPFMDVLALLIFGVFLFPNVDGLVDLAAIDAFLAYHHSKESPVVCSDHLLFTRSLCMVGFTLIPTRHKASMSAPKPSLVCRKKKRGRIVNWFPRWKEGKEGVLFSCGGYPNIPLIGMRGCINYNPTLAIRQLGYPMRGAPTEESLSPFLVRDFGAQNFKIINEENFEAPEEDEEVRALKTELGKARLAKEKFKLVATDVRKECAGLREENAATAKALEQETKRARKEEHGRDKFRGALWGNNSELKLRREERDRSRAHSMVLKEKLGVCSRSKRNLSQRLCETETNMLAIITKYREELSLATAHEHRVVDKYAQVYAEKEARGRVIDSLHQEATMWIGRFALTLNGSQELPRLLAKAKAMADTYSAPEEIHGLLDYCQHMIDLMAHIIRNR

SEQ ID NO: 167171 - protein, 173 aa, Glycine max
  Coding DNA Sequence Number=SeqID_75486
MEEKRKKRQQEAMNMEDSTMIIDPPSLIAKHVKTHYKNRRHMAALFYMVVTTYSILPLGDQSIQVNTKGSNAKSVANPSGEDLVANVMSTMGLYVQGDHCAHLVALGKIYEEGSIIHNVPYADDLVRVSLEKVYDKDSQVPFSTSEIQYVRQTFDTFITWLTHLVKPVSHEDA

SEQ ID NO: 167172 - protein, 87 aa, Glycine max
  Coding DNA Sequence Number=SeqID_75487
MVKEECKEVSVSSKRTLVSTIIPLELEVIPQVNELLDEGLVHKSLNSCVLLVPKDRCDQRFPTEPERIKIIPKWPHSTKYKGNLGLS

SEQ ID NO: 167173 - protein, 181 aa, Glycine max
  Coding DNA Sequence Number=SeqID_75488
MAILGECCALCPNSGKLSAWGGKLKTSPWLGELPWPSQQIMLIYTMMSMDIPKGQDDDAQGIDMIYKIQVILPASLKEGSNVKVWLGEGIGDFSMASTYRMLTTSSLPIDDGDWSRIWKLMCKDFVAFNKSKNVPLTCNKVLTQGLKIAKDRGFTHIVLQSDSQYAISAIKGDKFGVAERG

SEQ ID NO: 167174 - protein, 111 aa, Glycine max
  Coding DNA Sequence Number=SeqID_75489
MSVVIILNMPRRMLEQIRITKNRFPNSIPLLEKACWESIGLGDFQGPISWSYSGRQRRRGERRRHPLGNKPWKEKLHHQESALDKKLREEGSMEEENERERERERESGMEN

SEQ ID NO: 167175 - protein, 67 aa, Glycine max
  Coding DNA Sequence Number=SeqID_75490
MLLQGEDESRTSSASFEDMDKSLKVEEDERREREREDMKFMPQMRCPKIKGLKNSTLLGYPPYTMEP

SEQ ID NO: 167176 - protein, 53 aa, Glycine max
  Coding DNA Sequence Number=SeqID_75491
MMAHHLTSKQTHGFQALERGEGIETSIPRSTCDEYFSLQERYFVNPNGKYVWQ

SEQ ID NO: 167177 - protein, 135 aa, Glycine max
  Coding DNA Sequence Number=SeqID_75492
  Subcellular localization annotation: CTP_CleavageSite=74; ConfidenceScore=5.02e-01
MKNVEERSKPSRNSSQKRYGNVSEASRLGFSSRKQLFQANSKEREVPKGLNPFSLHFSPIYRKLGEKLATQLAQASRVASSRSNNLLEESSGGPKWAWVYLRGHSDVQVRGAKTPWPATEYGGLTSSSSTNALKL

SEQ ID NO: 167178 - protein, 75 aa, Glycine max
  Coding DNA Sequence Number=SeqID_75493
ANEPIDAQRLTSSSAPFVIQGWRVRWQAEITYGHPRLSSIEGNEFDGIRMMLVGRSSAMAKGSVVVGPTLSFSRH

SEQ ID NO: 167179 - protein, 63 aa, Glycine max
  Coding DNA Sequence Number=SeqID_75494
MCLLGKERQGWTSSPWVKVYGELGFWLKACRTAGHDICQGVGLASGLGIKEMSHIISMIHMQQ

SEQ ID NO: 167180 - protein, 81 aa, Glycine max
  Coding DNA Sequence Number=SeqID_75495
GQDRLRQRSEVLRDGRKERLGSRPIGRQTLPSPGRTESAAAKQPRVVRDGLRSMLHSGVMGHATLPPFSCYSCQNVRPPSA

SEQ ID NO: 167181 - protein, 91 aa, Glycine max
  Coding DNA Sequence Number=SeqID_75496
MEACLWGFYGGWIFELQWGPLMVIFHHGDAAEDKGKELGDDASMEEKKERSGEHEIEGIKEGEKWNFEVCLIRLSFIKVAASVTHASIYRL

SEQ ID NO: 167182 - protein, 122 aa, Glycine max
  Coding DNA Sequence Number=SeqID_75497
  Subcellular localization annotation: CTP_CleavageSite=41; ConfidenceScore=5.54e-01
MVEPSKKRKGSSSTATAAAHRRHGPSGAPTTPIPPSLSSPRSSTLFSSDDQRLRQGAPFEGTIVDDWKFDYSSHDARRMVCNDQAEMTGRLLVGSLTFDNRIMHYIIVRIFASSVFKFSTSL

SEQ ID NO: 167183 - protein, 158 aa, Glycine max
  Coding DNA Sequence Number=SeqID_75498
AQETTLVSACYQAFRLTDSKKVYTDNHSGISARQRDSKVSMTDLVSAEDDAFRLTDSKKVYTDNHSGISARQRDSKVSMTDLVSAEDDAFRLTDSKKVYTDNHSGISARQRDSKVSMTDLVSAEDDQKRIYTDNHSGISARQRDSKVSMTDLVSAEDD

SEQ ID NO: 167184 - protein, 173 aa, Glycine max
  Coding DNA Sequence Number=SeqID_75499
KKNESYISKPQKEEVVLEPGDDLGHLRANVFQEGGNDENPETDQIQAKGPRGEGRRAQVEKDKAPEWRRMKTYQGNPCGVYPDLSSFTKSSIYPDLSTFTESGVYPDLSSFIGSDIIQISVACMKRSAPSQVHINFQFVHILHCKDQFHTIKLDAKEVVNDKSFYYKPYQHLT

SEQ ID NO: 167185 - protein, 56 aa, Glycine max
  Coding DNA Sequence Number=SeqID_75500
MTTVSSTDSSPEPPRFMGSTRSYKFVAAFHNDRVLPPSAMPYLDTSIQYMIVVTKN

SEQ ID NO: 167186 - protein, 86 aa, Glycine max
  Coding DNA Sequence Number=SeqID_75501
GCEKIPRSMISSGIDESEELLVLCSSSTKSLFSFWELRFLVRWEEENTISESNSDAILPPRALDRRLQEDWARDARESPRVLMSLR

SEQ ID NO: 167187 - protein, 74 aa, Glycine max
  Coding DNA Sequence Number=SeqID_75502
VLEATIKATTEKKMELERLITRLSESGIDDEEAAEEEEEAAEEDKEAAEDEEEAAKEEEDAADTESDEDSEATP

SEQ ID NO: 167188 - protein, 106 aa, Glycine max
  Coding DNA Sequence Number=SeqID_75503
MTSKELNEEPYEVKISCTATHETKDFLSKEIRFGTTICPRISNPSRKRGGTDTQFQVSKQNSILDIIDTYRILWKAVFDESRMYGLEGDLSYLSRSTLQYGAKKPK

SEQ ID NO: 167189 - protein, 309 aa, Glycine max
  Coding DNA Sequence Number=SeqID_75504
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPRASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARANWSSTAVAAALELVDPPGCRNSITPDTVDRVLIRGFPVTAATVSYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 167190 - protein, 151 aa, Glycine max
  Coding DNA Sequence Number=SeqID_75505
MTHYSVPGASVSPGGGPTLRIQSEEELGLVHDHPNTDLDDIATQQHPPQRSQFQPPPPKCQLVYAILTQFYAVPVTSTKLIWPPLNKAFIEKYCMPRQAQQQGQAQQQQASADAPPPPLGVQTGAEPAGTTGDGDGAQDDDDMADVMDFIL

SEQ ID NO: 167191 - protein, 89 aa, Glycine max
  Coding DNA Sequence Number=SeqID_75506
MESYEGPSPKQARVKGHLVKIDADSLNTFLETPMVWAEGETLPTYSRYCRLPTDYREIEAALCIPGRGFILNTEGHPRRILGKDLTTLA

SEQ ID NO: 167192 - protein, 99 aa, Glycine max
  Coding DNA Sequence Number=SeqID_75507
MAPVEMRLQQGRATWQVATVTADKGLHIAGPIGASRGATSGGDLGEREAPVMLAFSASVGFKRRWLKGRLQFTVACKICVLKVKKKVVAVEREVAGGCC

SEQ ID NO: 167193 - protein, 76 aa, Glycine max
  Coding DNA Sequence Number=SeqID_75508
MHLGDQGSLLYNKEKNNMKDCKNTSGEDVSFTSRISQSLPNSSQALKLAPASSSGLCRSSHNKISQNSLELRPFSM

SEQ ID NO: 167194 - protein, 100 aa, Glycine max
  Coding DNA Sequence Number=SeqID_75509
DADEAPLDVSICLHAFGIVGCGSFSGVKSCEREDPFHPGLFVGDAGGFQSPTREPPSAGNARGRCLVINGCYLVDPASSHMLVSKIKIKLIDAVDLEGGP

SEQ ID NO: 167195 - protein, 98 aa, Glycine max
  Coding DNA Sequence Number=SeqID_75510
MSTRKDQRSRFKKEASPDDADRTFPIRHHPNIIQGLNRKYNSRHRSIGCIFDRCCRKNLQCTSARFYRSSSTEVVVRPTPACFHLLGKENVSPPRKKT

SEQ ID NO: 167196 - protein, 65 aa, Glycine max
  Coding DNA Sequence Number=SeqID_75511
MPMLYPFSEVNFKIIEQKKELTAEPYESGNSQSTVLRKRNLTHLFRPEGEQAIRQGDSEVAESLV

SEQ ID NO: 167197 - protein, 333 aa, Glycine max
  Coding DNA Sequence Number=SeqID_75512
  Homolog annotation: Hit_ID=Q64EX4; Match level="QueryCoverage=86%, HitCoverage=78%, E-value=3e-58, Identity=39%"; Hit description=MtN19- like protein
  Pfam annotation: Domain name=SURNod19; Domain location=29-331; Score =126.5; E_value=7.8e-35; Accession=PF07712.3; Description=Stress up -regulated Nod 19
MVNMEFISNAMILSFSILLLLPSTSYSLYQKPENHIKTAIFVTGSFEMGPGSIATKTFENIKFPKGHVGIKSFDAKLVDQEGNSIPSYETYLHHWFAIKYHQNITMSPNPKLRRPEDAFFQRNEGTCNGGILPHYWGFGVESRGTTSKIPDPFAIEQGNPTKLKMDMRRNGCSTSWSLIHVVHKIRKPALNDNLQCKQIEGFQGSRRMVSLRYKISWVDWNIYQIPVKVYILDSTDKVRSNGSKILHDCLAEYTIPAGGGGDSPHVQKANIPMENGGYLIYGTAHMHSGWKDFMYINTKIWNGKEAGNEKGYLIGMSVVIHNRVQSRFMMVKF

SEQ ID NO: 167198 - protein, 76 aa, Glycine max
  Coding DNA Sequence Number=SeqID_75513
MDDRWMQFGDYIAPVSLFIRGVWVVKTLASQRSLSRKLHKEASRESFSRKLPEVILVHRTNVHDLTVAICDMSFGM

SEQ ID NO: 167199 - protein, 73 aa, Glycine max
  Coding DNA Sequence Number=SeqID_75514
FFGVLVTPSKVIRPRINQAFIKKYCTCRQAKGETPQQPGDGQQQATNAPPPPPEPLSSSTKGLEYCLRNMADQ

SEQ ID NO: 167200 - protein, 59 aa, Glycine max
  Coding DNA Sequence Number=SeqID_75515
MASRKLSAKRSRKDAAAEGTSAAPEFDSHRFRSAEHQQHFEAIKGWSFHRERRVQLRDD

SEQ ID NO: 167201 - protein, 50 aa, Glycine max
  Coding DNA Sequence Number=SeqID_75516
QFRAEVSWPGDWPEAQVGEAPAEGPGGAEEARMDEEMTDLLGFLEGSGAT

SEQ ID NO: 167202 - protein, 125 aa, Glycine max
  Coding DNA Sequence Number=SeqID_75517
EDVGHLFFNCNLTKGLWWESMRWIRVIGPLPSHPKCHFTQFCEGFGNPVYQDIRGGWWSALTSSIWHHRNNLIFQGRPFDPYKVMDHAIYLVWSWFKAKDKDFNISLNHWSSNISNSFGYSARLS

SEQ ID NO: 167203 - protein, 197 aa, Glycine max
  Coding DNA Sequence Number=SeqID_75518
NLAGVWSYLNWEIDPPSYFPATSVESPDHHGAWFQAGAIVKEHFGHDVIHAFDKYMQSPIMSSSLNGNLLLSEGKVVIGGDIVDNPLEAFYGDVLGHLGLLLDYLEFTLLDYTEELVGLLQGYLLSAEAFPFFNEPPYWNILIWGGVCFVGLFRDHLCFSFGIRGSYRVGGLLLPLARLLRSVPPRDRLAVFIGEKD

SEQ ID NO: 167204 - protein, 498 aa, Glycine max
  Coding DNA Sequence Number=SeqID_75519
  Homolog annotation: Hit_ID=A5ATC7; Match level="QueryCoverage=82%, HitCoverage=92%, E-value=1e-164, Identity=69%"; Hit description =Putative uncharacterized protein
MARKTLAWSLLLGMACSIVIGSYEESFPTRTFSSNNYHEAIQRLQSFKASLTRHDSIASASSSLSTFSSPSSAPSPSLSLQGVNNPRVYRVTSYGADPTGNSDSTEALLAAIEDAAKGPSEGYLMEGIRDLGGAQINLEGGNYLISRSLKLPVAGVGNLMIHGGTIRASDNFPEDGYIIDLSPSSNGRNSLPSYNFEFITLKELLLDSNFRGGGISVINSLRTNIDNCYITHFTTNGILVQSGHETYIRNSFLGQHITAGGDKNERNFSGTGITLQGNDNAVTDVVIFSAAIGIMVTGQANAFSGVHCYNKATGFGGTGIYLKLPGLTQTRIVNSYMDYTSIVAEDPVQLHISSSFFLGDANIVLKSKNGIVNGVDIVDNMFSGSNQGVEIVQLDQSNSPFQQIDQVIVDRNIARGMKLKATVAKMSMQGNGTSWSVDFNNVLLFPNLIKNVQYSLSSSGSTFPNHALRNVSENRVVIETNEAVAANVFVTVDQSALS

SEQ ID NO: 167205 - protein, 422 aa, Glycine max
  Coding DNA Sequence Number=SeqID_75520
  Gene Ontology: Mol. function=hydrolase activity, acting on carbon -nitrogen (but not peptide) bonds, in linear amidines; Cellular component=chloroplast; Biological process=metabolic process
  Homolog annotation: Hit_ID=A9GYV1; Match level="QueryCoverage=95%, HitCoverage=84%, E-value=0.0, Identity=97%"; Hit description =Allantoate amidohydrolase
  Pfam annotation: Domain name=Peptidase_M20; Domain location=84-422; Score=19.0; E_value=0.0001; Accession=PF01546.19; Description =Peptidase family M20M25M40
DLEKRDDLFPQILRDEAVARLYELGKVSDASGYLERTFLSPASMRAINLIRKWMEDAGLRTWVDQMGNVHGRVDGANANAEALLIGSHMDTVVDAGMFDGSLGIVSAISALKAMHVNGKLQKLKRPVEVIAFSDEEGVRFQTTFLGSGAIAGILPGTTLEISDKREVMIKDFLKENSIDITEESLLKLKYDPKSVWGYVEVHIEQGPVLEQVGFPLGVVKGIAGQTRLKVTVRGSQGHAGTVPMSMRQDPMAAAAEQIVVLESLCKHPEEYLSYDGHCSDSTVKSLSTSLVCTVGEISTWPSASNVTYTVDIRAIDDLGREAVIYDLSKQIYQICDKRSVSCIIEHKHDAGAVICDSDLSSQLKSAAYSALKKMEGDIQDEVPTLMSGAGHDAMAISHLTKNLTMNEDLNRWECCLCVVAEE

SEQ ID NO: 167206 - protein, 338 aa, Glycine max
  Coding DNA Sequence Number=SeqID_75521
  Gene Ontology: Mol. function=pyridoxal phosphate binding; Cellular component=mitochondrial inner membrane; Biological process=electron transport
  Homolog annotation: Hit_ID=A9PHV7; Match level="QueryCoverage=94%, HitCoverage=89%, E-value=1e-111, Identity=62%"; Hit description =Putative uncharacterized protein
  Pfam annotation: Domain name=MOSC; Domain location=181-326; Score =70.3; E_value=6.3e-18; Accession=PF03473.8; Description=MOSC domain
  Pfam annotation: Domain name=MOSC_N; Domain location=12-141; Score =226.1; E_value=8e-65; Accession=PF03476.7; Description=MOSC N -terminal beta barrel domain
  Pfam module annotation: Pfam domain module=MOSC::MOSC_N; Domain location=181-326::12-141
  Subcellular localization annotation: CTP_CleavageSite=27; ConfidenceScore=5.53e-01
MADGSSTPATPSAKVSAIFIYPIKSCRAISVSRAPLTPTGFRWDRQWMVVNSQGRMYTQRVEPRLALVEVELPSEAFLENWEPTQDSYMVVNAPGMQPLKICLSQQGKEVANAVSVWEWTGSALDEGAEASQWFSDYLGKPCQLVRFNSESSLTEQNLTTEFVVPNSHESYTSEVRPVDPDYVKGQHQTTFTDGYPFLLASQESLDELNEHLKEPVSINRFRPNILVEGCEPYSEDLWTDIKISKFLFSGVKLCYRCKIPTINQETAIAAPEPNETLMKTRSGELIRPNDKNKKRIYFGQNMTWNWMGFSAEGSGKIIKVGDSVYVLQKVSSTAEAAA

SEQ ID NO: 167207 - protein, 39 aa, Glycine max
  Coding DNA Sequence Number=SeqID_75522
MEEDEERVSEKAGFARIEREHRPFDRAIALVLIWWWSSL

SEQ ID NO: 167208 - protein, 68 aa, Glycine max
  Coding DNA Sequence Number=SeqID_75523
MGHAAKPPLPMASLVSVKDSPLPVAIWCMPSPARAGMAVQKEADAQGAGQIVTPIGGLPCTGIVSMAG

SEQ ID NO: 167209 - protein, 149 aa, Glycine max
  Coding DNA Sequence Number=SeqID_75524
INWAHLVRYRMHKALRANAPLPYPQLVTLFLRHFQIPLDDEPFVQVKRSFAIGPGAVTSFGYRKDRNGQWLKKDALPPQDERTPSPPPQRDDSSAFMTEVLSELRGLRTYVGERFDSLDGHFEGTDTRITQLEEGVTYLRRCFNLPPPS

SEQ ID NO: 167210 - protein, 94 aa, Glycine max
  Coding DNA Sequence Number=SeqID_75525
MSLSGSVYFVKMASRKRKSIGARPTAQYDTRRFHPLDAWNRYTNNILGKSILPERKVEIYHTKFDDFKAELEGRNLHKCLTNLADGIIDVALVK

SEQ ID NO: 167211 - protein, 121 aa, Glycine max
  Coding DNA Sequence Number=SeqID_75526
  Subcellular localization annotation: CTP_CleavageSite=72; ConfidenceScore=5.43e-01
MSASWFAWLFEALKLSLRACSRVILSRPSRIVPTPLPFTLDTPSTKRIHQSRVVCRFRRILPKNSVMNCVFMGSHGAELTTSSITERYKSKGALGLDRLKDGSVVMVFLKARKACSQVSFH

SEQ ID NO: 167212 - protein, 156 aa, Glycine max
  Coding DNA Sequence Number=SeqID_75527
  Gene Ontology: Mol. function=4 iron, 4 sulfur cluster binding; Cellular component=integral to membrane; Biological process =tricarboxylic acid cycle
  Homolog annotation: Hit_ID=A6BY88; Match level="QueryCoverage=50%, HitCoverage=9%, E-value=6e-35, Identity=93%"; Hit description =Aconitate hydratase 2
REQALLEPFWLLFGRKAQSNLLNNARMLLFCKRINNQPKSCYAGRRRTGHLTLLFDSINRCTGKLYNESEENVVLEEYRKHVAERAAQGIVPKPLDASQMAALVELLKNPPAGEEEFLTDLLVNRVPPGVDEAAYVKAGFLAAIAKGEAHSPSGHS

SEQ ID NO: 167213 - protein, 82 aa, Glycine max
  Coding DNA Sequence Number=SeqID_75528
MERNGMRTFFTMMNAVVRARVRVFIGSGREEGVRFGLVSLYCALLCPIQLRTVTYIKNMYLICFHFFTSSKKHKTETAMRTG

SEQ ID NO: 167214 - protein, 56 aa, Glycine max
  Coding DNA Sequence Number=SeqID_75529
MDENWVPAVAPIYQSVKYRAEFRGEVTETLQYMVSPQGRNTWTVDDLVPYVEKLAI

SEQ ID NO: 167215 - protein, 150 aa, Glycine max
  Coding DNA Sequence Number=SeqID_75530
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=2e-11, Identity=31%"; Hit description= UPI00006A17C9 related cluster
  Subcellular localization annotation: CTP_CleavageSite=66; ConfidenceScore=5.30e-01
MLVRMIHTRLFAAARVKSCPSMHSSCVIASLSGCACTVGRPPILGGQRTLNSLKVWMWSTLKMRTRSPLKVRACSPLRVRTCSPLRVRTCSPLKVRTCSPLKARTCSPLEVRACSPLMVRTCSPLKARTCSPLKVRVCSPLLARTCSPLK

SEQ ID NO: 167216 - protein, 116 aa, Glycine max
  Coding DNA Sequence Number=SeqID_75531
  Subcellular localization annotation: CTP_CleavageSite=38; ConfidenceScore=5.10e-01
MPISPCGSISWSVLSRHRDRARKTPSGPGEVQQGLGVSSSDYEPLSSSPLLTELSSRSTAPPGRHRARHHSSLGMAGSGQQMHRRHLPKPFSSSTKAGALPRTRGRPAGDQVQSQR

SEQ ID NO: 167217 - protein, 257 aa, Glycine max
  Coding DNA Sequence Number=SeqID_75532
  Gene Ontology: Mol. function=signal transducer activity; Cellular component=membrane; Biological process=signal transduction
  Homolog annotation: Hit_ID=A4SJX7; Match level="QueryCoverage=94%, HitCoverage=75%, E-value=6e-43, Identity=39%"; Hit description=GGDEF domain protein
  Pfam annotation: Domain name=GGDEF; Domain location=153-257; Score =61.5; E_value=2.8e-15; Accession=PF00990.12; Description=GGDEF domain
MPTRMPIFDSFDTISQKISNFNEQLLSGILDTLPLQIAVIDESSSIVYVNQAWRSFGLLYGLDIETDWFGISYLDICRANEDTNQPLLLDGIAHVLNGSQNHFTTDYLCHTPTQQPTWLTLHLQPMQTALADGKLFLLSLTNITHHKQTEDRISALTLTDPLTGLANRRRLEQFMHDEWSRAIRHQSSLSVMMVDADHFKQLNDSMGHAAGDDCLRQLANILRKYSNRPGDLAARYGGEEFVLVLGQTTQQEAAKIC

SEQ ID NO: 167218 - protein, 79 aa, Glycine max
  Coding DNA Sequence Number=SeqID_75533
MTKKKMITMIVDTLTVFYYEKMVGYTLSSFFDMVFTGKRIEVGLKRGKFDHPTLMNGKPRANREDENEEGTHAVAAIPT

SEQ ID NO: 167219 - protein, 79 aa, Glycine max
  Coding DNA Sequence Number=SeqID_75534
MGTNQNGKRFYQVKVKGLDVTSLKELGRLMGPLQRQAFRKVYRKILDLTATEVFTEVVVSLAQYYDQPLRCFMFGDFQM

SEQ ID NO: 167220 - protein, 162 aa, Glycine max
  Coding DNA Sequence Number=SeqID_75535
KNCWNPEDLTVSIRGARRARARPTELPSTCAAPTPASTSAVVAPPGSIPSVEQFREMDESSEATIPKPFVIGEEAGETQVRQVVTATPKRSLEATSEPPALVVDLPSPQRIVNPSTPILEIPEDPTTPVLAMDTSPPATPVLHLTNEEDVPTQDTQDQSQEL

SEQ ID NO: 167221 - protein, 174 aa, Glycine max
  Coding DNA Sequence Number=SeqID_75536
  Homolog annotation: Hit_ID=Q6WAY4; Match level="QueryCoverage=47%, HitCoverage=15%, E-value=4e-09, Identity=37%"; Hit description =Putative uncharacterized protein
MGTNQTRKRFYQVKIKGLDITNIKELGQLMGPLQVQVFCNAYGKILDLTIAEISTEVVVSLTQYYDQPLRCFTFGDFQLVPTVEEFEEILGCPLGGRKSYLFSGVSSLLEQDCSCGQGFGDRIGSCKANSKRRSGPTTKVLRRQGKGYGESSGVGPIYGHISIANLWGCPLSKH

SEQ ID NO: 167222 - protein, 344 aa, Glycine max
  Coding DNA Sequence Number=SeqID_75537
  Gene Ontology: Cellular component=membrane
  Homolog annotation: Hit_ID=A8GAL2; Match level="QueryCoverage=67%, HitCoverage=55%, E-value=1e-118, Identity=90%"; Hit description=MscS Mechanosensitive ion channel
  Pfam annotation: Domain name=MS_channel; Domain location=97-325; Score=79.0; E_value=1.5e-20; Accession=PF00924.9; Description =Mechanosensitive ion channel
NALAGTVWFGIRRSDVAVDGIGVDCPDLGRDPPGAAPGGAGRPSAPWPAIAARLATGHHPIQTVPARGAAAARGDHQHPGDAVAAERQPDPGGDRHSRTGVDPRLHPAVADPILGLVAGIQLSANDMLKIGDWLEMPKYGADGAVTDIGLTTVKVRNWDNTVTTIPTYALISDSFKNWRSMSESGGRRIKRSLNIDTGSVHFLSEEEQRRLQRNPLLHSYLNDKTQELSRHNQEIAIDLASPLNGRRLTNLGTLRAYLEAYLRAHPRIHQNMTLMVRQLAPTPEGLPLEIYAFTNTTVWAEYESIQADIFDHILAVIDEFGLRVHQTPTGNDLRGMLLQNANAS

SEQ ID NO: 167223 - protein, 92 aa, Glycine max
  Coding DNA Sequence Number=SeqID_75538
DKESADDTVLEKYDISKEKWAQFCLSCRDLSWEDVRKKAQAIPKQNTTPHLLSRGSYEYLENKLMEGKRNKKVEETAQSRSTNTVIGIPSPI

SEQ ID NO: 167224 - protein, 207 aa, Glycine max
  Coding DNA Sequence Number=SeqID_75539
  Homolog annotation: Hit_ID=P15305; Match level="QueryCoverage=56%, HitCoverage=22%, E-value=8e-07, Identity=26%"; Hit description =Dynein heavy chain
MSSPSKDYTSSPSEGYMPSPSEDYISSPSEGCTPSPSEDYTGQQILSLKGLHVLAFRWLHVLDFRGLHVLAFRELHVLAFRGLHALAFRGLHVLAFRGLHICAFGGLKVSMHVAQLISDAIHYFQGLCPHDTQWTRRIPTGPWGPSKVIRPPTNRAFIKKYYALRQAQGKTPQQPVDGRQRATDAPPPPPKPLSSSTKARALPTTRG

SEQ ID NO: 167225 - protein, 128 aa, Glycine max
  Coding DNA Sequence Number=SeqID_75540
  Subcellular localization annotation: CTP_CleavageSite=54; ConfidenceScore=5.13e-01
GGQNGHLVTSSDTWFAQASLWLAWATRKLRVELALGKSTNVPSLGGTTLVQLAPTMEVQSLIDAGWLTFQEDNPNVRTNPLASHGGPAVNAVEEYKPRGPKWMEDVLTSKRFILEAMCDAGIICLDGH

SEQ ID NO: 167226 - protein, 197 aa, Glycine max
  Coding DNA Sequence Number=SeqID_75541
  Gene Ontology: Mol. function=transferase activity, transferring phosphorus-containing groups; Cellular component=integral to membrane; Biological process=two-component signal transduction system (phosphorelay)
  Homolog annotation: Hit_ID=P14376; Match level="QueryCoverage=96%, HitCoverage=20%, E-value=1e-89, Identity=84%"; Hit description =Sensor kinase protein rcsC
  Pfam annotation: Domain name=RcsC; Domain location=3-48; Score=4.6; E_ value=8.8e-05; Accession=PF09456.1; Description=RcsC Alpha-Beta-Loop (ABL)
  Pfam annotation: Domain name=Response_reg; Domain location=74-186; Score=139.9; E_value=7.2e-39; Accession=PF00072.15; Description =Response regulator receiver domain
  Pfam module annotation: Pfam domain module=RcsC::Response_reg; Domain location=3-48::74-186
MPEQPWQERGSVLFCRRHIGIPVERAPGEWVHSVATPHELLSLLARIYKVELEERDGAGGLPSPESLASVNDDMMILVVDDHPINRRLLADQLGSLGYQCKTANDGVDALNVLSKNHIDIVLSDVNMPNMDGYRLTQRIRQLGLTLPVVGVTANALAEEKQRCLESGMDSCLSKPVTLDVLKQTLSIYADRVRKTRI

SEQ ID NO: 167227 - protein, 92 aa, Glycine max
  Coding DNA Sequence Number=SeqID_75542
MSGFTRDSPQISASPHQLDLAPYASGPYNAQWNAPTLLHDKHTLRSSRILGEIRRLMNLGWGMAFVDNWAVGNEKVGYWLSNDIVGLVGNLA

SEQ ID NO: 167228 - protein, 109 aa, Glycine max
  Coding DNA Sequence Number=SeqID_75543
MSSTICWDRAHKTPSGPGEVQQGPGVSSSGYGPLSVLPGARPPQQGIVPARHPVDPEKSTRVLGFPALIMSLCQFYEVPISPTRSSGTLLTELSSRSTVPPRQAQGETP

SEQ ID NO: 167229 - protein, 176 aa, Glycine max
  Coding DNA Sequence Number=SeqID_75544
MKREKHASYSSHNSCKSLSEELCDYYEGRHRSHLRPLSHRREKERKPQEANIKLSYFHGKDNVEDNLDWEIRVEQQLKKKSTSKSYGSHSYPKKEQGQGILGALASIATPLGLEFIPQVKKLLDEGLVRKSLNPCALLVPKIGIITHQVPKIGGMMNVLSGATLFCKITRTPNIFM

SEQ ID NO: 167230 - protein, 65 aa, Glycine max
  Coding DNA Sequence Number=SeqID_75545
MMDAPDSTLRCNVGTVLSLSGPLEGASNSPSLIGDQPGSPKVFPTKVGKRFLPRQLHVASSRSFI

SEQ ID NO: 167231 - protein, 87 aa, Glycine max
  Coding DNA Sequence Number=SeqID_75546
MASSTSFQQESSQITIMKQKTNKTTHHISQNPIPTHTLHDPENALLSRFGAEMMAKGWSFVGVSMENGGERKSNVRKRERELLKMWG

SEQ ID NO: 167232 - protein, 91 aa, Glycine max
  Coding DNA Sequence Number=SeqID_75547
MTTSGHHEQPLITTEPPLGEEHFNQIGILKIHLKDSVENKLSILSFIASLRLVLFEDLGSVNLIHELYMYVCAELTIMNIPGGANIVVKEL

SEQ ID NO: 167233 - protein, 43 aa, Glycine max
  Coding DNA Sequence Number=SeqID_75548
MSKRLQEDWARAAEEGRRVLMNLRGSIMKVGYPRNIGFLALAF

SEQ ID NO: 167234 - protein, 66 aa, Glycine max
  Coding DNA Sequence Number=SeqID_75549
MARIVFASCPYFTNLHGRELKGLLVIIPKVVISLLMVSRGIIPFEEHIAAVGTTNNNTFIKEKNSR

SEQ ID NO: 167235 - protein, 181 aa, Glycine max
  Coding DNA Sequence Number=SeqID_75550
  Homolog annotation: Hit_ID=A7P093; Match level="QueryCoverage=55%, HitCoverage=24%, E-value=1e-40, Identity=77%"; Hit description =Chromosome chr6 scaffold_3, whole genome shotgun sequence
MSFKATNDTWDVLYEVAGQVVRLKMKDLVFLKFDFQNSGVLGGFPPPVAAKNAFFPNQGVSQAKEEDVLRASSVKRYGRKKHRTIPKPRSIEPDLINQSGHQHAIAYVEGDKYYGAKTIISLWEPKIQQPNEFNLSQLWILGGSFDQDLNSIVAGRQAADVGLGYFPNTPLSRPALIGLGA

SEQ ID NO: 167236 - protein, 79 aa, Glycine max
  Coding DNA Sequence Number=SeqID_75551
MSPYHAHATAPHGDQPESQGSSKPSDMPPSTSIFPHEKLQMHCIPLVENIIFLENTSMHRDKHTFPSLGCLAPIMVSKV

SEQ ID NO: 167237 - protein, 208 aa, Glycine max
  Coding DNA Sequence Number=SeqID_75552
GLLTLSIWSFVVVATYHSAGGRREGSRVRLPWEANARSRHQRLFEENVGKIGKGVSLAPTYSSIAMRKSDLRSSSRTKHWRETLRCWTINDLFVFERRETLRHWTINDLLGWPTKAGLLLLRILNCDEEIRPTPKNDEERMKNERRTMKNGEERGKEGGGCRPGELGCFHQKAPPSVGTPWKAQRSSKGCMPPNNGPRTKLAYDSSVL

SEQ ID NO: 167238 - protein, 188 aa, Glycine max
  Coding DNA Sequence Number=SeqID_75553
  Subcellular localization annotation: CTP_CleavageSite=26; ConfidenceScore=5.51e-01
MVKPKQQKKLPQQKQQHPQVHLRNARSRSRVNSFSYQWCFHQPRSLYLLPLSLLVTAPTADHNSRNSATEHLEDAVLRLTQDLSTNQELAVMLDVILFGYRLSLPLHHLPNHRRFPSTSTNQIRNQLCNLPPRRHQSWHLHQSSSESREDTRNRACSNKAATGLLMVIFHHGDAAEDKGKEVRGGAIH

SEQ ID NO: 167239 - protein, 193 aa, Glycine max
  Coding DNA Sequence Number=SeqID_75554
MIDAWKLDILVMMWAFLPRSSNLAQASEEDLILMWAFLTGRQIDWAHLVRYRMHKALWANAPLPYPQLITLFLRHFQIPLDDEPFVQVKRSFAIGAGAVTSFGYRKDRNGQWLKKDALPPQDERTPSPPPQRDDSALMNEVLTELRGLRSYVGERFDSLDKRFASMDIRLTQHEEDVGYIRQSFDLPPPPPPS

SEQ ID NO: 167240 - protein, 291 aa, Glycine max
  Coding DNA Sequence Number=SeqID_75555
  Homolog annotation: Hit_ID=Q2R3C4; Match level="QueryCoverage=33%, HitCoverage=6%, E-value=3e-07, Identity=36%"; Hit description =Transposon protein, putative, Mutator sub-class
MEGFLVSGKYVALQICDDKDVETMLESFQQQNQMSVLELYIEKDVTGGSMFYSANSLTSCGNNLSNNEAQPPTNVSNLHGDEDDDDDYLVSNSYVEESLDEDDSVDGISDTDDEVTDIIQPVRIVHPTEGVQGIENPFWSDALYYNNIDWSHLDEEDICDLEMSSSFNVGQELYVGMDFDTKDAVKKCTETICYEGRINSEFAYKVSYKKAWLAKQKAIALEYGDWEESYAKLSLWLTHMQNHSRGSYFQILHDDFIVGNTGTLLVATLQDENGGVLPLAFAVVEGETLTA

SEQ ID NO: 167241 - protein, 77 aa, Glycine max
  Coding DNA Sequence Number=SeqID_75556
  Homolog annotation: Hit_ID=A2XYT2; Match level="QueryCoverage=90%, HitCoverage=19%, E-value=7e-22, Identity=65%"; Hit description =Putative uncharacterized protein
METDGTWAGHMELQAASPVTRKHVPRWYIRNFGDRGIRMIHLSYHDGEHYNSVRLKDDPFDGPARPIVIKVLIISVC

SEQ ID NO: 167242 - protein, 120 aa, Glycine max
  Coding DNA Sequence Number=SeqID_75557
  Gene Ontology: Mol. function=helicase activity
  Homolog annotation: Hit_ID=A2Q378; Match level="QueryCoverage=67%, HitCoverage=5%, E-value=5e-12, Identity=44%"; Hit description =Putative uncharacterized protein
MVHLRILSLKNDEIKEYVDCRYISPCEATWRIFGFPIHARKPIVKRLHFHLLGQHSVIYEDDDDIDDILSKPSISDSKFLAWMNNNKCFSEGVITKPKELWNQTWNWLAEDIAYHYLYAE

SEQ ID NO: 167243 - protein, 89 aa, Glycine max
  Coding DNA Sequence Number=SeqID_75558
  Subcellular localization annotation: CTP_CleavageSite=39; ConfidenceScore=5.78e-01
MVSGIVSSRQHTFMSSMVSTPRPTPSTTFLKSSSAQKVNTSKVSPEILKNVKTTIIRKALIQDFFKIKPCLTMKGFKSFKAHVIDYQYM

SEQ ID NO: 167244 - protein, 328 aa, Glycine max
  Coding DNA Sequence Number=SeqID_75559
  Gene Ontology: Mol. function=nucleic acid binding
  Homolog annotation: Hit_ID=Q1SKZ9; Match level="QueryCoverage=20%, HitCoverage=13%, E-value=2e-13, Identity=49%"; Hit description=Zinc finger, CCHC-type
MEYYDESILMALVVVVGKPVKVDIKTINVSHGKFAHICVEIDQNQPVVGRVWFRNTWFNVEYEGMHLICNRATQAKEGGSGVNPSNHNIMRARPDSSKGSNGNFGQLVILTHEANMNITKAIDNHKGTERQLEGGRHDGGGLNFWSSVRRASNIYVFCHGTLWALPTSGVMAMKRSKIHGLRRPSREWYIDNQILHEEAIKYFKTLFCSRESISSKELRCDVGTLLLEARRALTNPITKQEQVGYSVWRFVPDAFVMGHFDARIIETFLTLQLFGFLEVIVSLIMHDISSTSISICWNDNKLEGSTLCFGAKNNKEVHEGNWEPIQLS

SEQ ID NO: 167245 - protein, 99 aa, Glycine max
  Coding DNA Sequence Number=SeqID_75560
GTSTWVVVTENKRGYISCGSVQVEGTSTWLFKENKGGYIPCGSLLEYLTYTGSLNLSYIQLSDAILPRKGPVTRAMSKRLQKDWARAAEEGPRVLMNLR

SEQ ID NO: 167246 - protein, 102 aa, Glycine max
  Coding DNA Sequence Number=SeqID_75561
MSSRKRKSIGARPTTQYDTRRFHSFEAWTRYTENVLGRHILAKRKVEIYHTELDEFMAELERRNFHKRLINLADSSIDLALVKEFYANLDSPEGPSPKQFRI

SEQ ID NO: 167247 - protein, 96 aa, Glycine max
  Coding DNA Sequence Number=SeqID_75562
MGEFSRSRRRGLSKEVRIRGIVEGKKAIISPATVASVSGCAEEGNIGVDVFKMASSVRDLQLKGETFMKMGIANNFPEYAQKRIKRNIKKEPKQES

SEQ ID NO: 167248 - protein, 402 aa, Glycine max
  Coding DNA Sequence Number=SeqID_75563
PNERKAYPHGLQFSPNERKAYPDVNKNVVLPWDRTTSEYGPELRMKLCAYREEIRLRKASFRRIEKLNIHMPFMHGSQFSCLATLETQFQIAMDKPMLYQKANCYKGKKILIKDDEDAPLTRYVKAHLFKHELETLKFYRLKAHYSILEPNEKPPTDVVHHEIGHRQASSCYQTLNNTLFLPYSRFTFTHHVQPIIEEVDSDIEVAVYPNDVAIEEYDPPPSREYVRLGVANLLKTNEALARDLEDCDYVEKEVVKWHLIGYYFYKKVTGREPLRTPTPPISPIFPAPFDLLSDSDSSSDEFCRKLDEKPTKKRGRKLLHQNVFHLPWRKGVLTSSFSNSMSKVVTRASKTSMEASGNSDEASAFGLSVIDSAKGKKKKGKGGKKSKVDPKDICNYCKELGH

SEQ ID NO: 167249 - protein, 96 aa, Glycine max
  Coding DNA Sequence Number=SeqID_75564
MVENTCSATTLKEAEDRVASRLETRLIHLAGPIPRGEHSLNLQYNCGIRLAHIDFPRFNGAKVHQWIYQAENYFSIDHTSNDYKVKIAIINGILHS

SEQ ID NO: 167250 - protein, 87 aa, Glycine max
  Coding DNA Sequence Number=SeqID_75565
  Subcellular localization annotation: CTP_CleavageSite=45; ConfidenceScore=5.34e-01
MDLKSDHQWEKCCFGGPSSKPLQPHSSKRKMRGGGCTAARPGELLASSRSNLARPGELSLSRRAGDFSPKLSGGPGEPEASLGELGA

SEQ ID NO: 167251 - protein, 47 aa, Glycine max
  Coding DNA Sequence Number=SeqID_75566
MLATGNRLLPSGIASTPGTTAARGGSIASGRCATTAMRGGPISEVPL

SEQ ID NO: 167252 - protein, 137 aa, Glycine max
  Coding DNA Sequence Number=SeqID_75567
MEGEGEREHKIGASKEEMALKKLSTKRSRKDAPGEYSSAAQPADTDFERHRFRSAKHQQHFETIEGWSFLRERQVQRRDDEFPNFQEEVARRRWAPLVMQSDPARALDRRLQVDWAKDPREGPRVLMSLRVDFEPMG

SEQ ID NO: 167253 - protein, 83 aa, Glycine max
  Coding DNA Sequence Number=SeqID_75568
MKPHILRAHKKIDVEAFPDATRCVTYDEVMLLQEAISVVMEACLWSFYGGWIFELQWGPLMVIFHHGDAAEDKGKEVRGGAIH

SEQ ID NO: 167254 - protein, 172 aa, Glycine max
  Coding DNA Sequence Number=SeqID_75569
  Homolog annotation: Hit_ID=A5AHK9; Match level="QueryCoverage=65%, HitCoverage=6%, E-value=5e-12, Identity=36%"; Hit description =Putative uncharacterized protein
MTIGNPSDLQPFDPEIDRTFNRLVRHHFIPFDHSEHSITGESVHSIIGNFEHPDLEHYNFEHSDFAHSENMAQPPPHETTLREMAAPDFIYESLCIQYPDEDVPYVLKTGLIHLLPKFHGLAGEDPHKHLKEFHIVCSTMKPPDVQEDHIFLKAFPHSLEGVAKDWLYYLAP

SEQ ID NO: 167255 - protein, 73 aa, Glycine max
  Coding DNA Sequence Number=SeqID_75570
MAENLHGITHGNVLDALRKCLGVDFLHGNDFFSLISSDPQILGGKMRDELATQLAQACEVVPSEGTSWRPNGP

SEQ ID NO: 167256 - protein, 354 aa, Glycine max
  Coding DNA Sequence Number=SeqID_75571
  Gene Ontology: Mol. function=ATP-dependent DNA helicase activity; Cellular component=periplasmic space; Biological process=DNA repair
  Homolog annotation: Hit_ID=Q5PEM8; Match level="QueryCoverage=48%, HitCoverage=14%, E-value=8e-73, Identity=81%"; Hit description =Exonuclease V subunit
MSGARTQAVLVEKKQNFSAECPCWAQIIQPVVPITSYARKSSSATRCLPSPMNVGRQWGLGSLLQSSDKQPAYLWQRYQAFFPQVEAKLRAMKPEEFAQIQQAVIAQVMQPPQTLGEEASQLSKDFDRGNLKFDSRDKVVAEIKQLTPQKVADFFHQAVIKPQGITILSQVSGSQNGKTEYGERLIEASAGTGKTFTIAALYLRLLLGLGGNAAFPRPLSVEELLVVTFTEAATAELRGRIRTNIHELRIACLRQSTDNPLYASLLEEIADKQQAAQWLLLAERQMDEASVFTIHGFCQRMLSLNAFESGLLFEQQLIEDESVLRYQACADFWRRHCYPLQRDIAEAVHELGIL

SEQ ID NO: 167257 - protein, 210 aa, Glycine max
  Coding DNA Sequence Number=SeqID_75572
  Homolog annotation: Hit_ID=Q6WAY4; Match level="QueryCoverage=88%, HitCoverage=33%, E-value=3e-21, Identity=35%"; Hit description =Putative uncharacterized protein
MGTNKNGKRFYQVKVKGLDVTSLKELGRLMGPLQRQAFRKVYGKILYLTAAEVFTEAVVSLAQYYDQPLRCFTFGDFQMVPTVEEFEEILGCPLGGRKLYLFSGFLPSLSKIAAVVRDSSKELDRMKQTQNGVVGLPRKYLEGKARDMASQEKWGPFTDILALLIFGVVLFPNVDGLVDLASIDAFLAYHHSKKSPVVAILVDLFDTFDR

SEQ ID NO: 167258 - protein, 74 aa, Glycine max
  Coding DNA Sequence Number=SeqID_75573
  Gene Ontology: Mol. function=nucleic acid binding
  Homolog annotation: Hit_ID=A5BMX7; Match level="QueryCoverage=95%, HitCoverage=9%, E-value=2e-13, Identity=46%"; Hit description =Putative uncharacterized protein
MDSSGDSENEVVNLSLMAKNYESEEEDSLKKGWYIDSGCFKHMTGDASKFTHISPKNNGHVTYGDNNKGKILGI

SEQ ID NO: 167259 - protein, 130 aa, Glycine max
  Coding DNA Sequence Number=SeqID_75574
MKPQLRLHHRHHVGNLEDAGKSSTTRLLLGIDLEHIEEAKEHHLDEDALIPHHVSSIGACRPRIFFINGFLCFLEDEWKRKRERRCHFKEKMSLEEAHHHRRPWIRAWRKNEMAEGREREEHEILCSKKL

SEQ ID NO: 167260 - protein, 76 aa, Glycine max
  Coding DNA Sequence Number=SeqID_75575
NSALKGLDDAPQPKSKAPARWIVVKCNRQKGSTECGYYVMHWMSTIILGTFRNNWEAKNDVNLPHAYTYFVVLLCL

SEQ ID NO: 167261 - protein, 144 aa, Glycine max
  Coding DNA Sequence Number=SeqID_75576
LKNETRKLRGLLVIDYQGRNKPLVIDYQIVMAAQLIHDRVEMEWLEGAWETLEGNARCRFRGTIRFTATSKSKCIEVTSSEEDPEENPEELSPEPAVDALDFLEDDEDPLPEVDSPEDVMSASEADSTEDSGPGEMAISGGSSS

SEQ ID NO: 167262 - protein, 45 aa, Glycine max
  Coding DNA Sequence Number=SeqID_75577
MFRVPSKISSQQARALTAMCDVMLVMPRALTEDPSNIFSHSFNER

SEQ ID NO: 167263 - protein, 371 aa, Glycine max
  Coding DNA Sequence Number=SeqID_75578
PGRQPARQPVIAPGVLAQPMQQIDAGRARADDRRRHIRGGGPGMIGQERAVGRWGHGNRRQFVAVLEMKRPWGLYGNDDFIAVSFHVQESRPDSCGGPAGQRLLAPLQLARGRRGRWPRAGGFPEPRADRDPPVAAGYPYAGFHAGQRHRGRGGVRHRLGAAAAGDRGRSRGAAGAGHGADALAVCQHAGAAAHRVAALWAGHRRAGQGHGQARLAARAGVGDRHHADRGRGGGHRSQPARGAGARIPEVGRGQAVTVFSSPRRMAVATAARRPRTCSLRQALRRWKLTVLSLMSRMRAVSQLVLPMALQCSEADSRGESRTGAGARGMAEAGLADMTDRALIAWKKTTHAPTPDGHRTSGDAATYLTLNL

SEQ ID NO: 167264 - protein, 214 aa, Glycine max
  Coding DNA Sequence Number=SeqID_75579
  Homolog annotation: Hit_ID=UPI00016621D1; Match level="QueryCoverage =88%, HitCoverage=41%, E-value=3e-16, Identity=30%"; Hit description =UPI00016621D1 related cluster
MGSPLQARDERQRLYLSPSEGYTITFRGLHALTFRGLHALTFKGLHVLAFRGLHVLAFRRRHALTIRDLQVLAFRGLHILTFEGLHALAFRGPHVLAIRGLHAFTSRGLHVLVIRGLHTLTFKGLHVLTIRELHALTFRGLHALTYRGLHILATRGLHALSFRGLDIIAFRGPHILAIRGQHALTFRGQHVLTIRGLHALTFRRLHVLTFRELH

SEQ ID NO: 167265 - protein, 63 aa, Glycine max
  Coding DNA Sequence Number=SeqID_75580
MKNKKKGSKSRKEHINLPVWATEWRLIPKTRENGKIDRGFGAVDELVIQEALAIDSSDKPGLG

SEQ ID NO: 167266 - protein, 61 aa, Glycine max
  Coding DNA Sequence Number=SeqID_75581
MGDLAKVVIKQDMKGAEHKYGFNNNKREKPEKMCIFQGLHVIPSSFNVFMSFLPREFEVLF

SEQ ID NO: 167267 - protein, 92 aa, Glycine max
  Coding DNA Sequence Number=SeqID_75582
VMLEEGNNVDYIISTRAKVMQSYPARALGRRLQVDWARYPREGPRVLMSLREESLAIRELLKEVFSKKLLKEVFSKKLLKEVFSRKLLKEAT

SEQ ID NO: 167268 - protein, 207 aa, Glycine max
  Coding DNA Sequence Number=SeqID_75583
MSCVSDHNSDLPLPKCQLVYAILTRMSVHVAQLIADAIYLFAGMPPTRHPLDPDKSNRALGFLALITGLCQSFGVPVTPSKVIRPPITWAFIEKYCTPRQAQGDAPQAADAPPPPHQADPTGSLGMERYLQHLVRQQAANHRGQGQGFVPFACPTLYQFRAEVAWPGDWSEAQAGVAPAEALGDAEEARMDEEMTDLLGFLGGSGAT

SEQ ID NO: 167269 - protein, 53 aa, Glycine max
  Coding DNA Sequence Number=SeqID_75584
KSRIVSGHGQKSRQINGRNQPRYIGTNASGDGVTTDQSLPLPGAKRAENVAAR

SEQ ID NO: 167270 - protein, 46 aa, Glycine max
  Coding DNA Sequence Number=SeqID_75585
DYDGYEAIAQRLERALNLKMDCQTIARGGASADGSVRARQRRRTEH

SEQ ID NO: 167271 - protein, 63 aa, Glycine max
  Coding DNA Sequence Number=SeqID_75586
MELSLRWEALNGNFSNMLLGIMFRLEPLSMSTLAITCSMHLTDTCKALLCPLSSARISSSMKV

SEQ ID NO: 167272 - protein, 91 aa, Glycine max
  Coding DNA Sequence Number=SeqID_75587
MTNLWLSECCLAKPRWHPRRGKALLPDLKLSMIPSDSILWTLGIDTTITFSVGISFRREICRFIILSFTSLKWNWRGIIYTNASPISKMEA

SEQ ID NO: 167273 - protein, 64 aa, Glycine max
  Coding DNA Sequence Number=SeqID_75588
  Homolog annotation: Hit_ID=A5ZYV5; Match level="QueryCoverage=92%, HitCoverage=89%, E-value=2e-09, Identity=47%"; Hit description =Putative uncharacterized protein
MFDVLTWRRDPAWGQCLVGSLTGAVSSQSVTEEHEGAKAGHSDPVVLYGRAIAQRIKGTPGITG

SEQ ID NO: 167274 - protein, 87 aa, Glycine max
  Coding DNA Sequence Number=SeqID_75589
MNLGISQSRISTPSQEVKQIGHLLVLVGLFSTAGSFWGCLSCLGLGPISGPCDLCPELPGQPDEVVVACLRPVEHPPEPVSGYSTSQ

SEQ ID NO: 167275 - protein, 58 aa, Glycine max
  Coding DNA Sequence Number=SeqID_75590
MVVRTSVILSFKSPFTKLMPHTKHISVHALSRESQALSAQPLHLRLIWSAKLAKVELS

SEQ ID NO: 167276 - protein, 72 aa, Glycine max
  Coding DNA Sequence Number=SeqID_75591
MVQLRAYRCAKPNIFTLCCTLSSSGAKPKSHLRLSAYCRKILGVAKSAKRNCHTKPQMLTGGYNFKLGLVRG

SEQ ID NO: 167277 - protein, 383 aa, Glycine max
  Coding DNA Sequence Number=SeqID_75592
  Gene Ontology: Mol. function=protein transporter activity; Cellular component=membrane; Biological process=protein secretion
  Homolog annotation: Hit_ID=A8IN11; Match level="QueryCoverage=99%, HitCoverage=95%, E-value=2e-37, Identity=27%"; Hit description =Secretion HlyD protein
  Pfam annotation: Domain name=Biotin_lipoyl; Domain location=54-119; Score=-13.1; E_value=0.081; Accession=PF00364.13; Description=Biotin- requiring enzyme
  Pfam annotation: Domain name=HlyD; Domain location=56-319; Score =16.3; E_value=0.0012; Accession=PF00529.11; Description=HlyD family secretion protein
  Pfam module annotation: Pfam domain module=Biotin_lipoyl::HlyD; Domain location=54-119::56-319
  Subcellular localization annotation: CTP_CleavageSite=61; ConfidenceScore=5.47e-01
MLTIAIAVVIFIIWHFSANSKTTRSASSVLSVTVQTIQSSPLNSSLELFGKVIALEQVPVYADMMQGRITKVLVDEGDHVKAGQQLAVVDTSLAKVQRVQSLAGKQRAIVGFSEAEAALEDAKKQLEQARAEKARGEKVAEDGLISKETLEQRVLAEQAAESKVNTARNQLRIALSDLLAANAQVDEADLKIKQAELIAPAAGRIIQKNAVVGQVLGQASQPQFLLAKDDTLEVDIQTTPEEATSLKNGMPVVIKVDGMSGTYRGTIRKKGVMVRDENQMVHIKVAFSKAPELMPGQSATVSAKLPHQDGIRLPDSAITAEGNQYFVYTVEQQHAKRIAVSIGQRVDGQVEILDGVTPGMRIIDKFAGFVRDGEPVNVIQAAN

SEQ ID NO: 167278 - protein, 301 aa, Glycine max
  Coding DNA Sequence Number=SeqID_75593
  Homolog annotation: Hit_ID=Q2HW90; Match level="QueryCoverage=78%, HitCoverage=64%, E-value=4e-23, Identity=30%"; Hit description =Putative uncharacterized protein
MVEAIASLTQYYDQSLRCFTFGDFQLAPTIEEFEGILECLNCLEKAKALADQGAWTSFIDILALLVFGTVLFPNVDGLVNLAAIDAFLAYHHSKESLVIAVLANEYDTFNLRCEKSIARIVYCTPALYVWLVSHIFCHEGRPVCPLQGFPNIPLIGTRGCINYNPMLAIRQLGYPMRGAPLEEIIAPFVARGFNEANVRILQRIHKAWNTVERKDKELRGSSNGVISGYHKWLRFRRQGITWLPKLKGPSGKEAEVLEESEEVQALKAELERMIMVKEKLKTTVTRVKKECDELRDVNMTM

SEQ ID NO: 167279 - protein, 301 aa, Glycine max
  Coding DNA Sequence Number=SeqID_75594
  Homolog annotation: Hit_ID=Q9FLX0; Match level="QueryCoverage=33%, HitCoverage=9%, E-value=4e-14, Identity=40%"; Hit description =Arabidopsis thaliana genomic DNA, chromosome 5, P1 clone:MXC20
MAGCGKGCTYWVLDVFYQIPTLGGIDGDPVLRGTRIRATWEYVNSVEGVQLGMVDLCVICGCGESTCTIARSPPCTTYDGVVPEDMSRGSGDLGDVRRAPGSQPIKEQRPQSKEACVVAGQLWILSDIWNMASGNRLQRSNRSLVIDYQLCVIDYTVYIAGFHVLKLCNLSWPLGGPGMITTVIQVVKLMDNLQSRGALRTRRECHYINAEYLLSELGHLKKKSANWNNTQGDEEIGSSSTKVWTQDIKNKLDDVIKGFALPLAVTVTKMIINESQIDLRRRKKLVLDGDLERQIKDLHEK

SEQ ID NO: 167280 - protein, 312 aa, Glycine max
  Coding DNA Sequence Number=SeqID_75595
  Gene Ontology: Mol. function=long-chain-fatty-acid-CoA ligase activity; Cellular component=endoplasmic reticulum membrane; Biological process=metabolic process
  Homolog annotation: Hit_ID=A7P971; Match level="QueryCoverage=60%, HitCoverage=34%, E-value=2e-85, Identity=78%"; Hit description =Chromosome chr3 scaffold_8, whole genome shotgun sequence
MLENYSHANDVLVTIKVTSLASLTESCAGCFTTIGDVYSMTRTIGVPMTTIEARLESVPEMGYDALSNVPRGEICLRGNTLFFGYHKREDLTKEVMVDGWFHTGDIGEWQSNRAMKIIDRKKNLFKLSQGEYIAVENIENKYLQCPLIASIWVYGNNFESFLVAVVVPERKAIEDWAKEHNLTDDFKSLCNNLKARKHILDELNNTGQKHQNRKPSSMYRGVQRRKWGKYVAEIKDPKEIRKLTDHGGSQQLHFWEMPHRSQARALSRTHSMSSTAHNGHSREKGVSVWATRVRNKDGLIRGPSLPYIKVTF

SEQ ID NO: 167281 - protein, 76 aa, Glycine max
  Coding DNA Sequence Number=SeqID_75596
MAAEWRRKKERRRHFKEKMSLEEAHHHKRPWIRAWRKKEMNEGRGREEHKILCSKRALKSEHTNPRSSTRFSTKCA

SEQ ID NO: 167282 - protein, 84 aa, Glycine max
  Coding DNA Sequence Number=SeqID_75597
MTPSQRYHGPIPTPNAPLGTQWNVPGPIPNMGDLLGVDLHHKFSGEADEEEAGRHRGRRNPDRQARRWDRPCCTSSRHRGHQNE

SEQ ID NO: 167283 - protein, 54 aa, Glycine max
  Coding DNA Sequence Number=SeqID_75598
MGIQKNSQAGDTKEFRRLVLRSFEKGRRETQKEFRRLVLGEFFLAKGEENEKDE

SEQ ID NO: 167284 - protein, 204 aa, Glycine max
  Coding DNA Sequence Number=SeqID_75599
WATGDGVLMPMLVKMGYLFCAIAQSPPSTKYDGVVPEDMSRGSGDLGDVRRAPGSQPIKEQKSTKQGGLCGGWPAIYLGLLSEKFPLIAMAAQLIHDRVVMECLEGQPARTLQQPVEWILPTPTPYRLVEPVQLIEVSSSEEDLKEDPEELPPEPAVDASDLPEDDEDPLLDVDSPEDIMSASEADSTEESGPGGTSNSDDSSS

SEQ ID NO: 167285 - protein, 98 aa, Glycine max
  Coding DNA Sequence Number=SeqID_75600
MKFKHCRNLPFGGRAMHGSRVRLPRKENTRSRHQRLSEENVGKIGKVWSTKFNRERFRSCFYARGSPCLTDKSKKDRLRRWTLKRFLVIFTDKARFVS

SEQ ID NO: 167286 - protein, 38 aa, Glycine max
  Coding DNA Sequence Number=SeqID_75601
MAMSMRIPWWCYGVSIHSDAQVNIGRRGIIIIVWGTHL

SEQ ID NO: 167287 - protein, 99 aa, Glycine max
  Coding DNA Sequence Number=SeqID_75602
  Pfam annotation: Domain name=zf-BED; Domain location=45-91; Score =21.4; E_value=0.0017; Accession=PF02892.6; Description=BED zinc finger
MDSFGVNVDENDNESIDVDVHKNIIHEDEPIESKMSKKRARNYSSHVWNFFEKPVIHSDGNVRSKCKYCLKDHVGGDNKNGTSTLQRHMGKYDVYLKTF

SEQ ID NO: 167288 - protein, 354 aa, Glycine max
  Coding DNA Sequence Number=SeqID_75603
  Gene Ontology: Mol. function=hydrolase activity; Cellular component =vacuole; Biological process=lipid catabolic process
  Homolog annotation: Hit_ID=O23179; Match level="QueryCoverage=95%, HitCoverage=86%, E-value=7e-61, Identity=39%"; Hit description =Patatin-like protein
  Pfam annotation: Domain name=Patatin; Domain location=5-171; Score =107.4; E_value=4.5e-29; Accession=PF01734.13; Description=Patatin -like phospholipase
AKDPTTSLAHYFDVISGTSTGGLMTAMLAAPNSSNANSPLFTPSDVVQFYKKYGPKIFEPTRAWYEFYECPKINGEVLHDITRKILKETRLNKTLTNVVIPTFDERKIKPVIFSNYKLKTETYLNAKLSDICIGTSAAPTYLPPHQFQNDGVQFDLVDGAMSANNPALVAVSEVIQHNEHKEILLLSLGTGTIKAEEKLSGFFDDLLDDLYDDLCGLKWLASSRNVFYEALYSTNMIHYYLATVFPGVLPADNYLRIEEYNLDPSMKEMDNADKENMDKLEKVGKSLLLQKALRMNVNTFVPVELDQTNAEALDRLSEKLYAERQLRLKRKSMEKGGSRIIESVKVPSGRMHAT

SEQ ID NO: 167289 - protein, 123 aa, Glycine max
  Coding DNA Sequence Number=SeqID_75604
MAEDTNNNFNGGCQLQKGTTASNEGNQISNGEGNEGAKEEGNIGEEEARMEIAGCTGKKQARKQGEEESNRKIKLEKRNSRANCARRQRSGMVFARQQCEATEAFGSLAGNVKEKKKVHENEN

SEQ ID NO: 167290 - protein, 69 aa, Glycine max
  Coding DNA Sequence Number=SeqID_75605
  Subcellular localization annotation: CTP_CleavageSite=45; ConfidenceScore=5.19e-01
MQPKVLNLDPSNPQLRYLTSHTRNPNANETESSKITTSRLAPPSRLAQVSGFELSASHALSLAKDNHHA

SEQ ID NO: 167291 - protein, 121 aa, Glycine max
  Coding DNA Sequence Number=SeqID_75606
  Pfam annotation: Domain name=zf-CCHC; Domain location=49-66; Score =17.7; E_value=0.0032; Accession=PF00098.14; Description=Zinc knuckle
MAAQDEESEDEEDFSLFVKKFHKFVKKRRIERRQNFNHGKRFQEDSPTLRCYKFNQLGHIKANCPSNEQWPEKNEKKSHEERRSKKAYIAWDDNDSSDGSEKDINLLSKDYESDENISQED

SEQ ID NO: 167292 - protein, 114 aa, Glycine max
  Coding DNA Sequence Number=SeqID_75607
MGESLVVHQKSMLERKITSSVKVVAGETADDDINIIPVEFDEEETEEDVYESFRSETYLGDGGDLVVVGGVLENIVGPFSLKSKKVKGISPRKPREKKKYPPIILPGYLGHWKG

SEQ ID NO: 167293 - protein, 104 aa, Glycine max
  Coding DNA Sequence Number=SeqID_75608
MHALLGSFNIGNWFDSKVLDSTGLSCCAITRNQESDGGGVNIGARESDRGFGEERENEKFWEWGIVVERGGGRECLAEPAKLGSMESRALKRVQEEFGPEKGLE

SEQ ID NO: 167294 - protein, 233 aa, Glycine max
  Coding DNA Sequence Number=SeqID_75609
  Homolog annotation: Hit_ID=Q6WAY4; Match level="QueryCoverage=72%, HitCoverage=30%, E-value=3e-16, Identity=32%"; Hit description =Putative uncharacterized protein
MGTNQIGKRFYQVKIKGLDVTSLRELGWLMGPLQRQAFRKVYRKILDLTTTEVFTEVVVSLAQYYDQPLRCFTFGDFQIVPTVEEFEEILGCPLGGRKSYLFSGFLLSLSKIAVVVGDSTRELDRMKQTRNGVVGLPQKYLEGKARDMVSQEEWVPFADILALLIFRVVLFPNVDGLVDLATIDAFLAYHHSKESPVVREEQRTDCLLPTRSLCVVGFAPIPKRHKALVSGIL

SEQ ID NO: 167295 - protein, 66 aa, Glycine max
  Coding DNA Sequence Number=SeqID_75610
MVFHLRLVMSFKTKKGEHRLKGAIKGINSRKHQQELSQGYCAINQWGKTHQKIMMMDGSNSDKEEK

SEQ ID NO: 167296 - protein, 279 aa, Glycine max
  Coding DNA Sequence Number=SeqID_75611
  Gene Ontology: Mol. function=protein-disulfide reductase activity; Cellular component=integral to membrane; Biological process =cytochrome complex assembly
  Homolog annotation: Hit_ID=A8G8S1; Match level="QueryCoverage=89%, HitCoverage=44%, E-value=2e-89, Identity=66%"; Hit description =Protein-disulfide reductase precursor
  Subcellular localization annotation: CTP_CleavageSite=22; ConfidenceScore=5.06e-01
MAARFSRLLSLCLALLFCLSAQASLFSPTTNNRFVPVDQAFGFDFSQQGHQLTLSWKVKDGYYLYRQQFHISAQHAQLAPVTLPPGQPHEDEFYGKSEIYPQDVQLPITLRQADAGATLSVTYQGCAAAGFCYPPETRSVPLTAIAADSATPAIAASPAADRTPLPFSPLWALLIGIGVAFTPCVLPMYPLISGIILGGQRRYSLGRLFALALVYVQGMALTYTLLGMVVAAAGLRFQAALQHPYVLIGLSVLFVLLALSMFGLFTLQLPASLQTRPDA

SEQ ID NO: 167297 - protein, 196 aa, Glycine max
  Coding DNA Sequence Number=SeqID_75612
  Homolog annotation: Hit_ID=A5BKB8; Match level="QueryCoverage=45%, HitCoverage=25%, E-value=3e-40, Identity=92%"; Hit description =Putative uncharacterized protein
MGGGAWPFLVGGAICLVNSVNERDLSLLNSYVEIIAIVGLQRGIPSKRESSARVDYVPALCTHRPSLLPIEWSGEVFGLRRRERFAARDVVRSPLNLSFRGRRSRNKVSVGEPAEGSLSMPHNQIDPRTCLFIYRREGGDDHGAPCARPPRPRDKHKPRRFNPVNHRVFERKLRPKPLGRGHACLGVTHRFPNANM

SEQ ID NO: 167298 - protein, 120 aa, Glycine max
  Coding DNA Sequence Number=SeqID_75613
MCRRNNVARRKKEQQGDQEPSSSILSFSFPHPNFEEHIMAEDRPCRITLEDYSSTSTPQYFISIALLKIEICNTMKIVGVPEDAIHLNLFSFSLAGEAKRWLHSFKGNSLRTWEEVVEKF

SEQ ID NO: 167299 - protein, 137 aa, Glycine max
  Coding DNA Sequence Number=SeqID_75614
VDSRGSHIEKYCTQRQAQGDAPQAADAPPPHQAGLAGSFDTEQYLRHLVRQQAANHRAHVQTHDCLYQLSLSLQSQGFTSFPCPTPDQFRAEVAWPGDWPEARAGEAPAEAPDEADEAREDEEMTDLIDFLGGSRAT

SEQ ID NO: 167300 - protein, 39 aa, Glycine max
  Coding DNA Sequence Number=SeqID_75615
MVRDPKAREVVDQGCEGSQGVFKVCKGFTEIVENLKWVA

SEQ ID NO: 167301 - protein, 145 aa, Glycine max
  Coding DNA Sequence Number=SeqID_75616
MERGHGMYYTPTTFSEYPSQMYQYPFEGHHTDTSASEHSFGGVAETQAHFSWPTMTPSQQHDAPMATPNAPFAPQWNVLICVRNFLLRLSKQKRGDNAAEEILIVKREDGIDHVAHPHDIADTIMTDFMSLCKFLVVCKTFDFGN

SEQ ID NO: 167302 - protein, 120 aa, Glycine max
  Coding DNA Sequence Number=SeqID_75617
  Homolog annotation: Hit_ID=A5B5B8; Match level="QueryCoverage=66%, HitCoverage=8%, E-value=3e-09, Identity=32%"; Hit description =Putative uncharacterized protein
IDVYAGTLSMEFGDIIVHFNILDAMKHPSEDLSVFRVEIIDHIVDEYMTDLHSNLHVYHSSCIELPYPSCMRERAVTTTPIIQAPDWTAPFELMCDASNYTLGVVLAQKISLLQLTSFPP

SEQ ID NO: 167303 - protein, 93 aa, Glycine max
  Coding DNA Sequence Number=SeqID_75618
MRRRGERRRHPLGNKPWKKELHNHEIVLDKKLREEASMEEKKERGGEHKIEGGKEGEKLNFEVCLTRLSFIKVTTSVTHASIYSLGSFLEKLP

SEQ ID NO: 167304 - protein, 93 aa, Glycine max
  Coding DNA Sequence Number=SeqID_75619
  Subcellular localization annotation: CTP_CleavageSite=48; ConfidenceScore=5.34e-01
MCLCPCAFVLSSAYTSSHPCIILAFISHPSLPSKLSAPCALSLSVILMASKKRKPPATPFQVRYDRSRFTSLEAWERYTDIMVPRKIIPERNV

SEQ ID NO: 167305 - protein, 154 aa, Glycine max
  Coding DNA Sequence Number=SeqID_75620
LGHHFKNSVAPPTYLALLILLPVAAASGDKSCLTGVGTGERTRELPGETPGIFIVLSGFATSDLSVDFCDARQGGEPMENASNAAFYGLAFAGLLLTCSFCVSPDSVDNRITAFEKRKSAQYANRLSPRVGRFINAAGTTGFPTGKRAVSATQL

SEQ ID NO: 167306 - protein, 127 aa, Glycine max
  Coding DNA Sequence Number=SeqID_75621
MGSSAASEFDSHRFRERRVQLREDEYPDFQGEISHRHWTRLVTPMAKFDPEIVIEFYANAWPTEEGVRDMRSWVRGHWVPFDADVISQFLGDQLILKEDQQCEFSQRRSQADGFDEEAIAKLLCIPG

SEQ ID NO: 167307 - protein, 145 aa, Glycine max
  Coding DNA Sequence Number=SeqID_75622
  Gene Ontology: Mol. function=thymidylate synthase activity; Cellular component=cytoplasm; Biological process=nucleotide biosynthetic process
  Homolog annotation: Hit_ID=A1G0X5; Match level="QueryCoverage=53%, HitCoverage=29%, E-value=8e-39, Identity=98%"; Hit description =Thymidylate synthase precursor
  Pfam annotation: Domain name=Thymidylat_synt; Domain location=1-78; Score=-146.4; E_value=0.078; Accession=PF00303.10; Description =Thymidylate synthase
MVAQATGLGVGDFVHTLGDAHLYSNHLEQAREQLSREPRALPKLWLNPEVTDLFGFQFDDIRIDGYDPHPAIKAPVAAGPADALSLARQVNEQIVHKHMREEVQAFAGAFNGSTMMPQDVPEGCRAQMREAGNRHVHGDDRAPEG

SEQ ID NO: 167308 - protein, 260 aa, Glycine max
  Coding DNA Sequence Number=SeqID_75623
MHEITHAQAGGLRHHVGQQRVAGDVEGHAEEEVGAALVQLAESFFRNRAPRTDRALQGSSSQATSGRGCAVPCWSVSRPRESEVVVARHVGDLVDPRRREVGQEQRLAPSGRGAVPVGAQLVPDAQAPRSCSQRTLVAVPAQDCPAARGCRAGVHPLGGDQREALRQVEADLLPKRCGCRSPVRSPLACPDLHDLAQQVLVGGGDRSSGTLSPRGGPGCCRAPPGSTGSPRPGAGRRIPGCARPGGPARCWQEPSCPGRW

SEQ ID NO: 167309 - protein, 264 aa, Glycine max
  Coding DNA Sequence Number=SeqID_75624
  Homolog annotation: Hit_ID=UPI00006A2D9E; Match level="QueryCoverage =45%, HitCoverage=82%, E-value=5e-09, Identity=17%"; Hit description =UPI00006A2D9E related cluster
ELHVLTFRGLNVLAFRGLHILTFRGLHFLPFRGLHALTFRGLHLFAFKGLHALAFRGLHVLAFIGLHALAFRGLHVLTFRGLHTLAFKGLHLFALRGLHVLAFRGLHICSFRELKQPSYQRPPLRSPPAEVSAGLCHHDIRIAPTRHPVDLKKSNRALGHSVCPEKSNKVLGFLGLITSLRQFYGVPVAPNRVIRPLLTGLSSRSTAPPGRHRARHHSSGQQTHRHHLQSSPQLIHKKAGALPTTHGRPTGGHHHFHSSFKPTN

SEQ ID NO: 167310 - protein, 409 aa, Glycine max
  Coding DNA Sequence Number=SeqID_75625
  Gene Ontology: Mol. function=structural constituent of ribosome; Cellular component=ribonucleoprotein complex; Biological process =translation
  Homolog annotation: Hit_ID=P02358; Match level="QueryCoverage=32%, HitCoverage=96%, E-value=4e-62, Identity=90%"; Hit description=30S ribosomal protein S6 [Contains: 30S ribosomal protein S6, fully modified isoform; 30S ...
  Homolog annotation: Hit description=ribosomal protein S6, non -modified isoform]
  Pfam annotation: Domain name=Ribosomal_S6; Domain location=280-370; Score=172.4; E_value=1.2e-48; Accession=PF01250.8; Description =Ribosomal protein S6
  Subcellular localization annotation: CTP_CleavageSite=61; ConfidenceScore=5.10e-01
MGTMKARAELNSAAFSEMLGAADGKARQNKANPLSRITAQTMQNVTALFASAARAAPTHPAAAAGDAGGKRRAAANANELSADGAAIAQSGQGVQHAGAAQAVMRKAERPTGGAPLGADVHRAVVARFVQGDDAIRGRAALIGDFTDLAAGVIRRNHVLVQGDEADALALIGLVRRDLRGGHYVGGEQGGQRRCENDAFHSASLTFCRYGLTASVAAAKSHLSALNNLESFSSRCLRRIWFSHEQIVLFPITPRINANKTHAVLEFPALRQYDYASNSMRHYEIVFMVHPDQSEQVPGMIERYSATITNAQGQIHRLEDWGRRQLAYPINKLHKAHYVLLNVEAPQEAIDELETNFRFNDAVIRSMVMRVKHAVTEASPMVKAKDERRGDRREDFANETADDADAGDSE

SEQ ID NO: 167311 - protein, 72 aa, Glycine max
  Coding DNA Sequence Number=SeqID_75626
MENCTKQSLRIAPNSKGENGEFHYAITTHGSKLEGGGHMNENAIHGAPKRLRMENYTKQSLRIAPNSKVEDT

SEQ ID NO: 167312 - protein, 127 aa, Glycine max
  Coding DNA Sequence Number=SeqID_75627
MGQKQVLKGFMGPKGTSQGWKRLEDEHAKVSALQVEREARERVIESLHGEVVKWMDRFSCTVNGSQELPRLLARANAMANIYSALEGVHGLFDYCKHMVELMSHIIRNRLGVCIYALALGMINNIVS

SEQ ID NO: 167313 - protein, 236 aa, Glycine max
  Coding DNA Sequence Number=SeqID_75628
MVMGDFISRLSFPGRRIVFHSKSICCSKSVGIFVSLLKHVCILVEKTPRLFQVSQVIQNYVGARASLLSTTPPFVAITQQLVARGDTLRLSAPRHSVTPSVIDEQRPMWSSGLFRRCQTLCPMARRDRLVKFCTQVDTRRYLTVICTPLYADTVCPMARRDKFGHSAPMIRGDTLRLSAPLCYADDSCVRWHAETKFGHSAPMIRGDTLRLSAPLCYADTVVSDGTQRPSLVILHP

SEQ ID NO: 167314 - protein, 87 aa, Glycine max
  Coding DNA Sequence Number=SeqID_75629
MNTPVSQTETKGNYAKPMDKTLSLPTVIFQKSMHRVQEEYMDVHVSDAERATLRCHHHLVAPYRAPRPQNLVASFCCPFYIVSDVLL

SEQ ID NO: 167315 - protein, 227 aa, Glycine max
  Coding DNA Sequence Number=SeqID_75630
  Gene Ontology: Mol. function=phosphoprotein phosphatase activity; Cellular component=cytoplasm; Biological process=negative regulation of mitotic cell cycle
  Homolog annotation: Hit_ID=Q3EBH9; Match level="QueryCoverage=99%, HitCoverage=98%, E-value=4e-93, Identity=65%"; Hit description =Serine/threonine protein phosphatase
MDSVPSNSHGNLDEQISQLMQCKPLSEQEVRVLCDKAKEILMEESNVQPVKSPVTICGDIHGQFHDLAELFRIGGKVESEIFCLHGGLSPSIETLDNIRNFDRVQEVPHEGPMCDLLWSDPDDRCGWGISPRGAGYTFGQDISEQFNHTNNLKLIARAHQLVMEGYNWGHDQKVVTIFSAPNYCYRCGNMASILEVDDCKGHTFIQFEPAPRRGEPDVTRRTPDYFL

SEQ ID NO: 167316 - protein, 201 aa, Glycine max
  Coding DNA Sequence Number=SeqID_75631
  Gene Ontology: Mol. function=oxidoreductase activity; Cellular component=chloroplast; Biological process=electron transport
  Homolog annotation: Hit_ID=Q8W496; Match level="QueryCoverage=79%, HitCoverage=28%, E-value=3e-54, Identity=60%"; Hit description =Putative uncharacterized protein
  Pfam annotation: Domain name=Rieske; Domain location=86-185; Score =84.3; E_value=3.9e-22; Accession=PF00355.17; Description=Rieske [2Fe- 2S] domain
  Subcellular localization annotation: CTP_CleavageSite=43; ConfidenceScore=5.49e-01
MEAVYAFSVGTLHIPTAHETPNSFRKSIFLSNQVASPVSLVLRGASKSKLFTALSPPPLTESSNNQPEEAEPEFESHAEKFDWYSHWYPLMPICDLDKRKPHGKRVLGIDVVVWWDRNEGVWQVHDDACPHRLAPLSDGRIDQWGRLQCVYHGWCFNGKGECKLIPQAPPDGPPVRSYYVDAWNLGHWLYISLMLQTTLGH

SEQ ID NO: 167317 - protein, 360 aa, Glycine max
  Coding DNA Sequence Number=SeqID_75632
  Gene Ontology: Mol. function=zinc ion binding; Cellular component =intracellular; Biological process=biological_process
  Homolog annotation: Hit_ID=A7QHM4; Match level="QueryCoverage=99%, HitCoverage=72%, E-value=1e-75, Identity=47%"; Hit description =Chromosome chr5 scaffold_98, whole genome shotgun sequence
  Pfam annotation: Domain name=PUB; Domain location=263-348; Score =108.8; E_value=1.7e-29; Accession=PF09409.1; Description=PUB domain
MVKGQILPYKHAYGASKGGLSSQVACGGNAGLESAVNWIVEHENDPDIDQMPLVPTNTKIEAPKPSLTPEELKAKQQELRERARKKKEEEEKRMEREREKERIRIGKELLEAKRIEADNERKRSGSASKFIVAHLVFCFECTQLQEKNASSCRLLALRKAEKEEEKSAREKIKQKLEEDKAERRRRLGLPPEEPSAAKPSPAPVVEEKKSFVPVRPATKAEQMRECLRSLKQNHKQCFSTIVCLLKYCDTLAYLRVHLFLEQEDDARVKRAFQTLLTYVGNVARNPDEEKFRKIRLSNQSFQDRVGSLRGGIEFLENCGFEKIDGGEFLFLPRDKIEMAVLNSAGSELDSAIKNPFFGVL

SEQ ID NO: 167318 - protein, 119 aa, Glycine max
  Coding DNA Sequence Number=SeqID_75633
  Gene Ontology: Mol. function=solute:hydrogen antiporter activity; Cellular component=integral to membrane; Biological process =metabolic process
  Homolog annotation: Hit_ID=Q6X0P0; Match level="QueryCoverage=73%, HitCoverage=23%, E-value=3e-44, Identity=96%"; Hit description=CHX3
MRASPGAAVKLCLGDLLVMGSNPKTTSYARTISGPTYGVMMINIMVIASIVKWSVKLIYDPSRKYAGYPKRNIASLKPDSELRVVACLHKTHHASAVKDCLDLCCPTTEDPNCGCNASN

SEQ ID NO: 167319 - protein, 112 aa, Glycine max
  Coding DNA Sequence Number=SeqID_75634
MGFIGLVTWLRQGINYVEAKLHGEPKVIQRCFDDNNDDDKGDDKKLKDQSKNNSSESRTIQEFKIRIKKNSRTQEESLETRIKIQGLRSQESRSRFKTQDSRINRRLNQDKY

SEQ ID NO: 167320 - protein, 210 aa, Glycine max
  Coding DNA Sequence Number=SeqID_75635
MGSPLRKDKELRGIRNGIIGGYHEWLRVHTRGLDWLSKLKIINEENFEALEEDKEVQALKSELGKARLAKEKFKSVAIDIRKKCAELREENVATARALKRETKRARKEEHGRDKFRGALWGSNNELKFQREERDQSRVHGMVLKEELAACSRSKRSLAQHLEAMEQSMLAITGQYKEELNQSLIHEKKLVEDFAQADGSLLVGLLWRLDL

SEQ ID NO: 167321 - protein, 73 aa, Glycine max
  Coding DNA Sequence Number=SeqID_75636
MDQLISATIYCLQGSRLQDGRSTECLSPPARASGPLLIELSSRSTASPGRHRAKHHSSLGMAGSGQQMHRHHL

SEQ ID NO: 167322 - protein, 177 aa, Glycine max
  Coding DNA Sequence Number=SeqID_75637
  Homolog annotation: Hit_ID=A5AK77; Match level="QueryCoverage=53%, HitCoverage=11%, E-value=4e-11, Identity=39%"; Hit description =Putative uncharacterized protein
MTRGNPFDLQPFDPEIDRTFHRLVRHHFIPFDLPEHSITGESVHSVIGDFEHPDFEHYNFKHSDSKHSDFEYSENMAQPPPRERTLREMAAPDFTYESLCIQYPDEDVPYVLKTGLIHLLPKFHGLAGEDPHKHLKEFRIVCSTMKPPDVQEDHIFLKAFPHFLEGVAKDWLYYLAP

SEQ ID NO: 167323 - protein, 25 aa, Glycine max
  Coding DNA Sequence Number=SeqID_75638
EWAKTHGLRKTPPFDFRHITEFSRI

SEQ ID NO: 167324 - protein, 54 aa, Glycine max
  Coding DNA Sequence Number=SeqID_75639
MEFGKTKGRTARKPHYKRNLKESWASSSKGTTPENLAFHGFKQKTQLKHEQKRK

SEQ ID NO: 167325 - protein, 168 aa, Glycine max
  Coding DNA Sequence Number=SeqID_75640
MAAEKISRDYLTTELAVVLSCQSLSVLCVMRIMKLAKYRLKAQVEKDEGPSGEGQSPRVEKDKAPEWRRMKAQTYQGNPCGVYPDLSSFIGSGVYPDLSSLTGSGVYPDLSSFTGSGVYPDLSSFIGSGVYPDLSSFTGSGVIQKTLQPVSSDPPRMVHIIWYQSFGS

SEQ ID NO: 167326 - protein, 123 aa, Glycine max
  Coding DNA Sequence Number=SeqID_75641
MEDIRGHLESSDCSMHSEAEALEHMMKRDRGHQSVSLENKIGDSTVVKMSEKNNNADSGDYMILDDHEGEEHCCGKGTNARSVSFLPRSQEKIGDSAKVVIKQDMKGGEHKYGFNNNVRSQRR

SEQ ID NO: 167327 - protein, 220 aa, Glycine max
  Coding DNA Sequence Number=SeqID_75642
MASRKRKVIASRPQPHYDTYRFTSKDALNRYADNIRGWNILLERNGSIDVALVKKFYANLYVLGDKPPKQVRVRGHLIKFDVDSLNTFLETLVVLEPGETLPTYSKFCRLRPDPQELATRLCIPCRGFVLNAEGLPWKFLRKDLTTLVQTWSVLSYFNLAPTSHTSDLNLDRARLVYGLVMKMDMNVGALISGQITLMAQSNSSRLGFLALITALCMATR

SEQ ID NO: 167328 - protein, 121 aa, Glycine max
  Coding DNA Sequence Number=SeqID_75643
MSSMRTPSTLLKTPVVLEQGESLPSHSRFCRLRPDPQELAARLCIPRRGFVLNTEGLPWKLLRKDLTTLAQMLIRKVCEVLIFSFSPSQSAGLASHPLSAPLLRLSAPLLRLSVRKNLEEG

SEQ ID NO: 167329 - protein, 118 aa, Glycine max
  Coding DNA Sequence Number=SeqID_75644
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=41%, HitCoverage=26%, E-value=2e-10, Identity=66%"; Hit description =Chromosome chr4 scaffold_32, whole genome shotgun sequence
  Subcellular localization annotation: CTP_CleavageSite=52; ConfidenceScore=5.08e-01
RHPHCPTLISILSETARWNPQNPLSKKSRRKAYTVVGTVGQRKPYTALGIVVGAQRSKLSTLPVNKLIVLYVVFKLDESYTLSKVSIHAGDGFHNLKEIKTVGTREANWVGLSILVWS

SEQ ID NO: 167330 - protein, 61 aa, Glycine max
  Coding DNA Sequence Number=SeqID_75645
MDIIVLDTEPTMVMESSSMGNMASVGSMAGHYPKGSPSRNSQRPEPNPGLRGGLEIVFNQQ

SEQ ID NO: 167331 - protein, 120 aa, Glycine max
  Coding DNA Sequence Number=SeqID_75646
MGRNVSALIGKSVPHIPEKCKDTDVVIHLANRSVAYPVGFIEDVLVRVGPLGPSRRFLQKAVASGGSNPARLGELVVSVKKIQAETLPKRFRNVSVRNFAKVSTVLRRSSFVLHRSSIFN

SEQ ID NO: 167332 - protein, 74 aa, Glycine max
  Coding DNA Sequence Number=SeqID_75647
MEVDEPWLGLWLPLNYQVDMGASFVVDLGMAFVDDWVVGNEEGIFYLGTTVAAWVSPSFSPSSFAPVFSFVQAR

SEQ ID NO: 167333 - protein, 57 aa, Glycine max
  Coding DNA Sequence Number=SeqID_75648
MGANDIIIDKQSSGCGRDWRELSLKRKLFCKALDKILSDYEKPPCYGELNPQLVLPM

SEQ ID NO: 167334 - protein, 46 aa, Glycine max
  Coding DNA Sequence Number=SeqID_75649
MVVGNATIEKPREQWDEEERRKIFQESKELQDIILLIISLVTSQKG

SEQ ID NO: 167335 - protein, 135 aa, Glycine max
  Coding DNA Sequence Number=SeqID_75650
  Gene Ontology: Biological process=transposition, DNA-mediated
  Homolog annotation: Hit_ID=Q1J7G7; Match level="QueryCoverage=25%, HitCoverage=48%, E-value=7e-12, Identity=97%"; Hit description =Transposase
MVKVELYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSMSETNCKRGEIGHIKITFWG

SEQ ID NO: 167336 - protein, 67 aa, Glycine max
  Coding DNA Sequence Number=SeqID_75651
MKKEITSWQLANAKLAGVGGRLKNNGMCSGFVPYLHCSSVVPELASLFLLILFMFMSELKLPAEDQK

SEQ ID NO: 167337 - protein, 91 aa, Glycine max
  Coding DNA Sequence Number=SeqID_75652
MGLRKKARMEDCTRGSSLVNHEAWLQTLWWRMHERKRNSWGSEKKVRMEDCTRGSSLVNHEAWLQTLWWRMDERKTQFMGLRKNGEDGGLH

SEQ ID NO: 167338 - protein, 540 aa, Glycine max
  Coding DNA Sequence Number=SeqID_75653
  Gene Ontology: Mol. function=oxidoreductase activity; Biological process=metabolic process
  Homolog annotation: Hit_ID=A8GJ16; Match level="QueryCoverage=100%, HitCoverage=60%, E-value=0.0, Identity=95%"; Hit description=2-oxo -acid dehydrogenase E1 subunit, homodimeric type
MNETLDGDYQTFKSKDGAYVREHFFGRYPETAALVKDMTDDEIWALNRGGHDPKKIFAALKKAQDTKGKPTVILAHTIKGYGMGETAEGKNIAHQVKKMNMEGVHHFRDRFNVPVADADIEKLPYITFEKDSEEYKYLHERRQALKGYVPTRLPEFTQKLEMPALEDFSSLLEEQNKEISTTIAFVRALNVMLKNKSIKDRLVPIIADEARTFGMEGLFRQIGIYSPNGQQYTPQDREQVAYYKEDEKGQILQEGINELGAASSWLAAATSYSTNDLPMIPFYIYYSMFGFQRIGDLCWAAGDQQARGFLIGGTSGRTTLNGEGLQHEDGHSHIQSLTIPNCISYDPAYAYEVAVIMHDGLVRMYGDNPENVYYYLTTLNENYHMPAMPQGAEEGIRKGIYKLETLEGSKGKVQLLGSGAILRHVREAAQILAKDYGVGSDTYSVTSFTELARDGQDCERWNMLHPTETPRVPYIAQVMSDAPAVASTDYMKLFAEQVRTYVPASDYRVLGTDGFGRSDSRENLRHHFEVDASYVVVAAL

SEQ ID NO: 167339 - protein, 52 aa, Glycine max
  Coding DNA Sequence Number=SeqID_75654
MVRTKGLGRALGDVPRWRRPTAFARRQRVHVAVAEDVPHVTENVPHMTEDAP

SEQ ID NO: 167340 - protein, 554 aa, Glycine max
  Coding DNA Sequence Number=SeqID_75655
  Gene Ontology: Mol. function=transferase activity, transferring hexosyl groups; Cellular component=soluble fraction; Biological process=carbohydrate biosynthetic process
  Homolog annotation: Hit_ID=A7QB81; Match level="QueryCoverage=95%, HitCoverage=87%, E-value=0.0, Identity=70%"; Hit description =Chromosome chr4 scaffold_73, whole genome shotgun sequence
  Pfam annotation: Domain name=Glyco_transf_8; Domain location=232-424; Score=158.6; E_value=1.7e-44; Accession=PF01501.11; Description =Glycosyl transferase family 8
MELRIESTHRVKFISCRQNFVNRWVWGGLDRGYISNVDINWGDILQITAKLTGKKEFQGVGLLNFNNTELDHWEQLIPNVTHVVLELEYAAKNMTWESQYPEWIDEEEETEVPVCPSLPSLRSTGIRLNLIAVKLPHANGGNWSRDVARLHLQLAVARLTTSFKGNYPLYVLFVTNFFPIPNLFTCKELVGHVKGMFLGEKLHLPLGSCELAFPLRGKELSYVGNVRREAYATILHSAHVYVCGAIAAEQSIHMSGSTRDLVILVDETIRQFKGSEKDAYNEWNYNKFRLWQLTDYDKIIFIDADLLILRNIDFLFGMPEITATRNNGTLFNSGVMVVELSNCTFKLLMDHINEFESYNGGDQGYLNEIFTWWHRIPRHMNFLKHFWVGDEEEKKQMKTLLFGADPPILYVLHYLGMKPWLCFRDYDCNWNCDVFHEFPSDVAHERWWKVHDVMPELLQQFCMLKSKQKAQLEWDRRQAEVANYTSGHWQIKVKDTRLKKCIDNLCSWENMLKHWGETNWTDDESHTPTPPAIATSSLSDLRLVNLAFYHPCKC

SEQ ID NO: 167341 - protein, 371 aa, Glycine max
  Coding DNA Sequence Number=SeqID_75656
  Gene Ontology: Mol. function=oxidoreductase activity; Cellular component=integral to membrane; Biological process=electron transport
  Homolog annotation: Hit_ID=A7R2C6; Match level="QueryCoverage=99%, HitCoverage=99%, E-value=0.0, Identity=84%"; Hit description =Chromosome undetermined scaffold_419, whole genome shotgun sequence
  Pfam annotation: Domain name=GFO_IDH_MocA; Domain location=6-134; Score=130.2; E_value=5.9e-36; Accession=PF01408.13; Description =Oxidoreductase family, NAD-binding Rossmann fold
  Pfam annotation: Domain name=GFO_IDH_MocA_C; Domain location=146-256; Score=60.2; E_value=7.1e-15; Accession=PF02894.8; Description =Oxidoreductase family, C-terminal alphabeta domain
  Pfam annotation: Domain name=ox_reductase_C; Domain location=137-272; Score=-51.2; E_value=0.0099; Accession=PF08635.1; Description =Putative oxidoreductase C terminal
  Pfam module annotation: Pfam domain module=GFO_IDH_MocA::GFO_IDH_MocA_ C::ox_reductase_C; Domain location=6-134::146-256::137-272
MAGAIVKYGIIGVGMMGREHLVNLYHLRTQGVAVVAIADPHLPSQQLALDLAHSFTWPLKVFSGHQELLDSGLCDVLVVSTPNMTHHRILMDIINHSKPHHVLVEKPLCTTISHCKEVVNAARKRPDILVQVGLEYRYMPPVAKLIEIVKGGNLGHVKMVAIREHRFPFLVKVNNWNRFNINSGGTLVEKCCHFFDLMRLFVGANPVRVMASGAIDVNHKDEVYDGKVPDIIDNAYVIVEFDNGSRGMLDLCMFAEGSKNEQEISVVGDIGKGEAFVPESVVQFGTREAGRDGVQTLKAEDHRIKYDGLHHGSSYLEHLNFLSAIRAKGEKAPSVDLQDGLISVAMGVAAQLSIEYGRFVSIQEVMNECKI

SEQ ID NO: 167342 - protein, 725 aa, Glycine max
  Coding DNA Sequence Number=SeqID_75657
  Gene Ontology: Mol. function=transporter activity; Cellular component= membrane; Biological process=oligopeptide transport
  Homolog annotation: Hit_ID=A7P436; Match level="QueryCoverage=90%, HitCoverage=86%, E-value=0.0, Identity=62%"; Hit description =Chromosome chr1 scaffold_5, whole genome shotgun sequence
  Pfam annotation: Domain name=PTR2; Domain location=310-682; Score =351.8; E_value=1.2e-102; Accession=PF00854.12; Description=POT family
MSVVNVWPSSELQLILVPILPPDYMKETFLLKETSAYAAAIAAEWPPSPTGTSLAKQFRVAAGVAAIVAARVEELKILICVFPIWATGIIFAAAYAQMSTLFVEQGTMMNTCIGSFKLPLSTFDVMSVVLWVPLYDRIIVPIIRKFTGKERGLSMLQRMGIRLFISVLCMLSAAVVEIMHLQLAKELDLVDKHVAVPLSVLWQIPQYFFLGAAVVFTFVGQLEFLYDQSPDTMKTLGGKPGWIPDNLNKGNECCERLAFFGIATNLVTYLTTKVHEGNVSAPRNVSIWLGTSYLTPLIGAALGDGYWGRYWTIAVFSVGMCTLTLSASLPALKPAECLGSVCPSATPAQYAVFYFGLYVIALGIGGIKSCVPSFGAGQFDDTDPKGRVKKGSFFNWYYFSINLGAIVSSSIVVWIQDNAGWGLGFGIPTLFMVLSVISFFIGTPLYRFQKPGGSPVTRMCQVLCTSVRKWNFVIPEDSSLLYEMSDKRSAIKGSHKLLHSDDLRCLDRAATVSDYESKSGDYSNPWRLCPVTQVEELKIFICMFPMWATGAVFSAVYTQMSTLFVEQGTVMNTNIGSFEIPPASLATFDVLSVVLWAPDNCSQRGISVLQRVTIGNFISVLSMLAAVVVEIMRLRLARDLDLVDEPVAVPLTLSPLYFALGNYLSSFILTMVTYFTTHGGKLGWIPDNLNKGHLDYFFLLLAGLSFLSMLVYIVAAKRYKQTKTS

SEQ ID NO: 167343 - protein, 43 aa, Glycine max
  Coding DNA Sequence Number=SeqID_75658
MASQVVRTTSGGGHDGARATWILKTVDLYPTSSIVDQSALFVD

SEQ ID NO: 167344 - protein, 300 aa, Glycine max
  Coding DNA Sequence Number=SeqID_75659
  Gene Ontology: Mol. function=DNA binding; Cellular component =endoplasmic reticulum
  Homolog annotation: Hit_ID=A9PGQ7; Match level="QueryCoverage=100%, HitCoverage=100%, E-value=1e-128, Identity=76%"; Hit description =Putative uncharacterized protein
  Pfam annotation: Domain name=DUF124; Domain location=23-265; Score =223.4; E_value=5.3e-64; Accession=PF01987.8; Description=Protein of unknown function DUF124
MAAPFFSTPFQPYVYQSPQDAIIPFQILGGEAQVVQIMLKPQEKIIAKPGSMCFMSGSVEMENAYLPENEVGIWQWLFGKTITSIVLRNSGPSDGFVGIAAPYFARILPIDLAMFNGEILCQPDAFLCSVNDVKVSNIVDQRGRNAVASAEGFLRQKLSGQGLAFILAGGSVVQKNLEIGEVLAVDVSSIVAVTSAVNIQIKYNGPARRTMFGETQYPSPIPSHSEESLGNGGDNAVTAVLTGPGIVFIQSLPFHRFSQRIARAVTSPNMRENPKFFIQIAVFFFLAYVVIVSSLILTDV

SEQ ID NO: 167345 - protein, 146 aa, Glycine max
  Coding DNA Sequence Number=SeqID_75660
  Gene Ontology: Mol. function=pectinesterase activity; Cellular component=cell wall; Biological process=cell wall modification
  Homolog annotation: Hit_ID=A7QY79; Match level="QueryCoverage=56%, HitCoverage=31%, E-value=2e-18, Identity=50%"; Hit description =Chromosome chr2 scaffold_241, whole genome shotgun sequence
  Subcellular localization annotation: CTP_CleavageSite=40; ConfidenceScore=5.04e-01
MAPLFISMQMLLQVFSCILFHATTTTVTCTTYHHSTPKIVSSKNSSNWVEPIGHQVITVDANGRGHFREKVVVPVTKPYIMFHGAGRDVTVIEWHDRASDPCPNRQQLHTYRTASVTVSLPGISASRSNQFSSISCFIISLLSHII

SEQ ID NO: 167346 - protein, 2248 aa, Glycine max
  Coding DNA Sequence Number=SeqID_75661
  Gene Ontology: Mol. function=RNA binding; Cellular component =membrane; Biological process=pathogenesis
  Homolog annotation: Hit_ID=A5CBI0; Match level="QueryCoverage=99%, HitCoverage=97%, E-value=0.0, Identity=39%"; Hit description =Putative uncharacterized protein
  Pfam annotation: Domain name=Agenet; Domain location=1762-1835; Score= 33.8; E_value=6.3e-07; Accession=PF05641.3; Description=Agenet domain
  Pfam annotation: Domain name=Agenet; Domain location=1853-1908; Score= 2.6; E_value=0.13; Accession=PF05641.3; Description=Agenet domain
  Pfam module annotation: Pfam domain module=Agenet::Agenet; Domain location=1762-1835::1853-1908
MDYDDNDFQSQNLHLPGEGSTKFPPALRPYALPKFDFDESLQGHLRFDDSLVETEVYLGIGSNEDNQWIDAYSRGSSGIEFGTTAAESCSISRHNNVWSEATSSESVEMLLKSVGQEEFIPRETVIQESDACDELVCLAKQMEPDPKPDGRNEFKNNITDLQPTGFIDENLAGLKDEEREQSLAGVSQGVLSIDGSLSNLQPHDMLGNIDLPMARGILFTDDKSNDTNQGKVETVADGSLEEKTQEDSAASGGKTNITVTSVHNFTSCDVLNIQNVQNHVVGMGSEEQSSLQIQTNEQDLDSSVINKDSNVDTRTLDVNAVGGEAHHSDKPLCSFPKEEALESGNAVEGLETCGSSLEGSLSMVSDGISDLQNTERCNEDACFRDLSQGNAKEDTIVDNQSAVDTSGSPMVAIKDDSSSEGHIVGVSKSECITSPNFQQNVGTIEKTYAESSASMEKQLLNIGNQMDTEVLLSNSEASMFAVGDKNTSTVNKRNNDNKAGSFSSLGAVASTKSCILGEATQVCENSEPDKQGDRENFCQDVSAIDQENEIATFDSSLLHCDVDQSHLVDTGVSSSSVSAGNMETKLTTSTVSVDVEPVNNSASQYILENISSTSCEIVDVCVLSPSRIVSTHEVTDHCEVQGVTPVGSASIDEKEKAEAKIANEATIVNEASCEAKLANEASSEAKIVNEANCEAKIENEAGPEAKVVNEASSEAKIANEASTALLVGSSEQETAPCPETEIHFSDTSGQLLCKTVSSCVLTASEKMGKPQETLSDRVDQECSKEVGVAAVLCASTEKQGDKVAVSFTKDDKEAIQENHDKPSAKVSVSLHGKGDDLSANEGSNSLPDSCTKLHETGSSPANQSDNTCGVNVTFGSQPETEKDVNQVKASANRNPPVSECINKDALNTSTDRDPKGNDASKDEKSSAPVVNLVPNLSKKDVSEKTTKRSNLGKRQRAAAKKAPMVVEEPPLPSALGTPKTKVPGNISLGSRQISDGVIAHSVSQGTPERKTRRASNKTAGKETSRKGNKGKTPGRQSERGDRSTSVSVSPSPGFQVQSNEMQQFGHFDCISTKPFAILSASTSSLPDLNSSASPPVLFQQPFMDMQQVQLRAQIFVYGALIQGTVPDEAYMISAFGGPDGGRSIWQNAWSSCMEKQHGKKSHPMNLETPLQSRSGPRTTDVAVKQNALQGKGISSPLSLASSKATPTIANPLMPLSSPLWSLPTPSCDSLQSSAFARGSVVDYSQALTSSHPYQTPPLRNFLGHNTSWLSQATLCGAWTPTSAPDNNSSHLSASPLTDTIRLSSVKGYPVPPSSGIKNAPPGLPASSAGLQNVFIATAPPLDTSNVTVLNAQHSSDSKPKKRKKVMVSEDLGQKAMHLHSPLVLTPVVSSHISTAVATSTPVGSVPITTVEKSVLSVPPLSLADHLKSEWNVEKRILSDKSLTKIKEARVNAEEASALSAAAVNHSLEIWKQLDKQKNSGLVSDIEAKLASVAVAVAAAAAVAKAAAAAANVASNAALHAKLMADEALVSSDYESSCQISHSEGMTNLGKVTPASILKGTIGTNSSSSIIGAAKEVARRRVEAASAARKRAENMDAIVRAAELAAEAVSQAGKIVTMGDPLTLNELVEAGPEGCWNAAQESSQQVDLLKDVTSDRVNVDNVGDRPETSHICNTDNSSDEMRKKTAASEKSPFHTVHSEISQDHKKCIGGFSPIINQKSSKGPKGRKVSDLVNTIDVLPNSETEIQATSTAGNKPENLEDNNIKEGSIVEVFKDGEGFTAAWYTASILNLKDGKAYVCYVVLLDDEGAGPLKEWISLEGGEVKSPRIRTPHYLPGLHNEGTRKRQRAAMVDYTWSVGDRVDACSEESWQEGVITDQNKKDKTLTVHFPVSGKTKLVRAWHLRPSRFWKDGKWIEYPKVGTGDSSTHEGDTPHEKRPKLGSPAVEVKGKDRIPKGTNAVESANPGKLRLLDLTENDRVFNIGKYSKNENKSDAHRMVRTGLQKEGSRVIFGVPKPGKKRKFMEVSKHYVADGTSKINDGTDSVKLSNFLIPQGTGSRGWKNSSKNDTKEKLGADSRPTFKSGKSQSVLGRVVPPKENPLSNSRTNDLTSHAERIKDSSSHFKNVSQSENQVERALYSGSTGAGAGPILHSSLVSSTDSHPAKKTSTSRASKGKLAPAGGGRLGKIDEEKAFSGNPLKSTSENTEPRRSIRRIQPTSRLLEGLQSSLIISKIPSASHEKGHKNQNRKTSRG

SEQ ID NO: 167347 - protein, 96 aa, Glycine max
  Coding DNA Sequence Number=SeqID_75662
  Homolog annotation: Hit_ID=Q2A9S8; Match level="QueryCoverage=53%, HitCoverage=46%, E-value=6e-15, Identity=78%"; Hit description =Putative uncharacterized protein
  Subcellular localization annotation: CTP_CleavageSite=65; ConfidenceScore=5.86e-01
MASACSRIAQRTSISSIKSAIKSNIRASSFSKPASSSSPLRQSLLTRISPELRCAQSMLPLHSAVAAARMTSCLSVTSRSCRALSQGTLCCTSPGL

SEQ ID NO: 167348 - protein, 139 aa, Glycine max
  Coding DNA Sequence Number=SeqID_75663
MVSRYALNEIATEFECVRYVGNNFSSCYCAMRVTHGLCEAEVTIKEEIVTICKRFEELDVHTKGALKKPMNRSQRSTKCDPSYWEYVDAFHFVQSNNSSVKRSASSFPDLLKPLKPTRIILMLDQFDPFIQGFIDDILD

SEQ ID NO: 167349 - protein, 99 aa, Glycine max
  Coding DNA Sequence Number=SeqID_75664
  Subcellular localization annotation: CTP_CleavageSite=66; ConfidenceScore=5.04e-01
MKLLSLPVFALLLLFLSDLLFFFLVVVHSLGVFFFIPCASSLCLFFFFVEEVPEVACGGDPRKLPRRATVGEEVSASAVESMAETIVRNLNILYGSPDP

SEQ ID NO: 167350 - protein, 138 aa, Glycine max
  Coding DNA Sequence Number=SeqID_75665
DIEATAIPQEPLSSKASSSFPTQGQSHTILAEANIMVEEPRRVTLEDYSSSRNSLKTWDEVVEKFLKKYFPESKIAEGKAAISSFHQFPDESLRGKIKLKTPEEAMELIENMAASDHVVSYVVEHMSPTAVFPKKKTT

SEQ ID NO: 167351 - protein, 78 aa, Glycine max
  Coding DNA Sequence Number=SeqID_75666
EPARTLQQPVEWILPTPTSYRLVEPVQVIEVSSSEEDPEELPLEPAVDALDFPEDDEDPLPDVDSPEDIMSAFEADST

SEQ ID NO: 167352 - protein, 641 aa, Glycine max
  Coding DNA Sequence Number=SeqID_75667
  Gene Ontology: Mol. function=transferase activity, transferring phosphorus-containing groups; Cellular component=membrane; Biological process=two-component signal transduction system (phosphorelay)
  Homolog annotation: Hit_ID=Q3S4A7; Match level="QueryCoverage=93%, HitCoverage=55%, E-value=1e-144, Identity=50%"; Hit description =Cytokinin independent 2
  Pfam annotation: Domain name=HATPase_c; Domain location=104-301; Score=141.7; E_value=2e-39; Accession=PF02518.17; Description =Histidine kinase-, DNA gyrase B-, and HSP90-like ATPase
  Pfam annotation: Domain name=HisKA; Domain location=1-58; Score=53.5; E_value=7.2e-13; Accession=PF00512.16; Description=His Kinase A (phosphoacceptor) domain
  Pfam annotation: Domain name=Response_reg; Domain location=494-601; Score=41.6; E_value=2.7e-09; Accession=PF00072.15; Description =Response regulator receiver domain
  Pfam module annotation: Pfam domain module=HATPase_c::HisKA::Response_ reg; Domain location=104-301::1-58::494-601
MSHEIRSPLSGVVSMAEILSNTKLDWEQRQLLDVMLSSGDLVLQIINDILDLSKVESGVMKLEATKFRPREVVKHVLQTAVVSLQKILTLEGHVADDVPIEVIGDVLRMRQILTNLISNAIKFTHEGRVGINLYVVPKPNFAKAEDIQMMTPNQSTMSVNGVKEEQHLSKPQSGNDGNLLDGCQKHDDHPSQNHAFNDECGSPAKSECSMNGDTEEQPYSAETTVWIRCDVYDTGIGIPEDAIPTLFKRYMQVSADHTRKYGGTGLGLAICKQLVELMGGQLTVSSKEHYGSTFTFILPYKVSIACDHSDDPDELSDLENNDVASDDTIESFFQFQPRTLGSLFSSNGSSRTQKLLTHKIGYTSSHKLGGFSESLYSFPSNDIMSKGTCSVDDASSVVDAPETSESASSSGHSLETKNKSLVRRDKQHQDKARAWSFNGYADSSEVTVSNGEMAGATKSSEPQQTCQGQGKANTTTQCVTSSSTSEVTKSTIKPKILLVEDNKINVMVTQSMMKQLGHSIDVVNNGVEAVRAVQRHTYDLILMDVCMPVMDGLQATKLIRTFEETGNCDAARSAGIEESLPDQDYECYVPFTKRVPIVAVLLDYYKNISILNSFFRSLDFPACSILLISSYGLIQILLVTK

SEQ ID NO: 167353 - protein, 35 aa, Glycine max
  Coding DNA Sequence Number=SeqID_75668
MVILRLVSTKRNKFDSIKMMCREVHWPNGVSLERN

SEQ ID NO: 167354 - protein, 260 aa, Glycine max
  Coding DNA Sequence Number=SeqID_75669
  Pfam annotation: Domain name=Transposase_23; Domain location=131-201; Score=8.5; E_value=0.00014; Accession=PF03017.5; Description =TNP1ENSPM transposase
RIPRSFVPQGRQDVLAAAIERPEHPGCVYAAGAGVTIKQYFGSAPQTSHSASSLPPDELQQLTQQIRDQLEESITEKVTRQVMASFSHLQSQMQSQGVAVPPEPVVGPGPSSPRVSTKGSCVDPSGNDPEIGDSDRCGLYIEADPARLVAIGRVYEGSTVVHNTPLLPGQVKVSVEEVRDADAPVPVPTDEVSLVGQALHTFLAWPTHLVKSLSQQVRWDATVFGVINPDFPLYIKHEDLSEIAHGGQCLSISVLPLWIL

SEQ ID NO: 167355 - protein, 76 aa, Glycine max
  Coding DNA Sequence Number=SeqID_75670
MSRNLMDYATVPSLASEILRIFTDCALTLPFDSRHVAEFHGLPNDGYQVPRSGQVKVTSHQTDGPRTKLGYDTMFY

SEQ ID NO: 167356 - protein, 127 aa, Glycine max
  Coding DNA Sequence Number=SeqID_75671
  Pfam annotation: Domain name=G-patch; Domain location=1-37; Score =14.7; E_value=0.0031; Accession=PF01585.14; Description=G-patch domain
  Subcellular localization annotation: CTP_CleavageSite=77; ConfidenceScore=5.30e-01
MLGNGYKPGMGLGKDNGGRTSLVSTRGNRGKFGLGYKPTQADIRKSVTGRKSRSQGSQLGRQVKEGPSCHISRSFISAGLGHEGQVVAICKNDSPSGSDLVRPCPPDFRLGNWRVEEHPGIYATSIM

SEQ ID NO: 167357 - protein, 69 aa, Glycine max
  Coding DNA Sequence Number=SeqID_75672
MSRFTRDSPQISASPYQLDFTLYASGSYNAQWNAQGLLHDKHTLRSSRILRKMEVKEPWLGWSSSLEVR

SEQ ID NO: 167358 - protein, 328 aa, Glycine max
  Coding DNA Sequence Number=SeqID_75673
MGWSFHRERCVQLRDDEYMNFQEEIAHRHWTSLVTPMAKFDPDIVLGFYANAWPTEEGVRDMRSWVREEGQECEFSLRRNWADGFDEETIAQLLCIPGQDFARTAAGRWVRIMRTSMTTLTQMWMTLLLSNVLPSDHNSDLPLPKCQQVYAILTQMSVHVAQLIANAIYLFAGMPPTRHPLDPDKSNRALGFSALIAGLYQSYGVPVTPSKVIRPLITWAFIEKYCTPRQAQGDAPQAADALPITWVIRHGAIHECLYQLSLSQQGQGFVPFACPTPDQFRAEVAWPGDWPEAQAGEVPAEAPGDAEEAHMDEEMTNLLSFLGGSGAT

SEQ ID NO: 167359 - protein, 105 aa, Glycine max
  Coding DNA Sequence Number=SeqID_75674
MSSPLQGYTPSPSEDYMSSPYRGLHVLTFIGLHSLTFRGLHALALRGLLVLALRGLYDLTFRGLHALTFRELQVLAYRGLHVLTFIRLYVLACRGLHVLTIRGLH

SEQ ID NO: 167360 - protein, 88 aa, Glycine max
  Coding DNA Sequence Number=SeqID_75675
MIERDFDSLQIGRVRATICCLCVSSDLSSLDDEGVDNHEVSPHAIGPSSHDSRIETCLQSRSEDADISGNGADDHIGLCVSTDSLASS

SEQ ID NO: 167361 - protein, 174 aa, Glycine max
  Coding DNA Sequence Number=SeqID_75676
  Gene Ontology: Mol. function=electron carrier activity; Cellular component=integral to thylakoid membrane; Biological process =electron transport
  Homolog annotation: Hit_ID=P49161; Match level="QueryCoverage=100%, HitCoverage=81%, E-value=3e-70, Identity=99%"; Hit description =Apocytochrome f precursor
  Pfam annotation: Domain name=Apocytochr_F_C; Domain location=56-174; Score=293.5; E_value=4.2e-85; Accession=PF01333.10; Description =Apocytochrome F, C-terminal
HLANKPVDIEVPQAVFPDTVFEAVVRIPYDMQVKQVLANGGNRGRGQIYLDGSKSNNNVYNATAAGMVKKIIRKEKGGYEITIVDALDGREVIDIIPPGPELLVSEGESIKLDQPLTSNPNVGGFGQGDAEIVLQDPLRVQGLLFFFASIILAQIFLVLKKKQFEKVQLSEMNF

SEQ ID NO: 167362 - protein, 149 aa, Glycine max
  Coding DNA Sequence Number=SeqID_75677
IRKENAELRDINIATTKALEQETKRARREEHGRNKFQGALICLRSKRSLSQRLCETETNMLAIISKFQKELNLATTHEHKVADEYARVYVEKEARGKMIDSLHQEATMWMDRFALTLNGSQELPRLLAKARALADAYSAPEEIHRLLSY

SEQ ID NO: 167363 - protein, 67 aa, Glycine max
  Coding DNA Sequence Number=SeqID_75678
MMNAPDSTLRCNVETIQSSSKPPGCARNCPPIGDQPGAQRSSLPGDKSPQYKVHSAIIILFLVSYEL

SEQ ID NO: 167364 - protein, 152 aa, Glycine max
  Coding DNA Sequence Number=SeqID_75679
MAIYRDIMLKSHRLVDYEFPYPVLTSRFIDYFNINVSNEIVDFTKASNEITERHIKKLCMEYVDHEWVMVGEQSTTTHVDLVEEEAQQELTPQWNPFESLMIQRMDVQSQDSSNALNVVFKFGIIKAKMGEIVRDKGVATWKNLRLKLEAQG

SEQ ID NO: 167365 - protein, 294 aa, Glycine max
  Coding DNA Sequence Number=SeqID_75680
  Pfam annotation: Domain name=Transposase_23; Domain location=126-196; Score=-17.1; E_value=0.089; Accession=PF03017.5; Description =TNP1ENSPM transposase
  Subcellular localization annotation: CTP_CleavageSite=48; ConfidenceScore=5.28e-01
MGPKSTLRLIRILGPSLASLAQSTWSFLSNALAGMCAKRHRPSKNRTTAPHVSSNTLDWLHGRPAALPPCLLKNYSSRPTNQGPARGVHHRKRDVTAHDIIQPDVVPDSIPGTCTASRASGNDPETSDLDRCGLYIEADPNCLVALGRVYEGSTIVHNTTLLPGQVKVGVEEVTDADAPVLVSTDEVSLVGQAIHTFLAWPTLLVKSLSQQVVVSPAKPPPKPDPEVDDPLYLMTLTIPELFLRPYQVTWDATMFGAFNPDFPLYIKQRRPLRNRTRWSMSQHFSVTVVDYASH

SEQ ID NO: 167366 - protein, 523 aa, Glycine max
  Coding DNA Sequence Number=SeqID_75681
ALLGPQAFTNLPEQLLVDLGQLAGTFFHALFQLGMRRAQPLLVALTGQAGTDVLCDEGQQALVMHAENAVLAVALHHDRADHFVVAQQWYAQPAVRTRTGFTHFATGQQRIDLRARGQQRAPVAHHVFGQAPAEGPWRAAGIVLVHRIHEIQAVAGRVDQGDVEIACVEQAPNHAMHLSVELGQAVGRHRHLGNVVERGLQLFGATPLGYFVLQAVVGPLQFLGTPLYLLLQPHLRLAPVHRGLHMLRNETQQCALGLAIAGRLFIALNHDGTAYTAIAQHRHAQPVQAFRPTLRVVLLFHHLRQQFARGTTERFAMAQQRHGQAARHLAGVMALRGIGDEVIDLIGEVQEPDLVAHIVVFDDVAVLGIHQRAQHTMHVAQHLGHFKVGTGQVCNLEQGLLQPLGLFQCLDLAGLAAALSASSIACRATPHHAGEGTAPSTDNSRRAPSCSQPCWPSPAPGAAASPPAAAVGQPPWPRPSCGSSQPTRTTAVSGKSACNARTSAVLSTASCGGSSAGSACVDK

SEQ ID NO: 167367 - protein, 308 aa, Glycine max
  Coding DNA Sequence Number=SeqID_75682
NILPERKVELYHTEFDDFKTELERRNLHKRLTNLVDGSIDVALVKEFYENLYSSEGPLPKQARVRGHLVKINADSLNTFVETPVVLAEGETLPTYSRYCRLPLDPREIEAALCIPGRGFILNAEGHPGRILRKDLTTLAQVWSVLSYSNLAPTSHTSDLTVDRSNSSRLGFPALITALCRARGVVSNSLTFERLSPVINLAYIRKNCWNPDDLIVAIRGARRARARPADLPSTSAAPTLASTSATPLVPSQMDSQRFEAMLQSIHQGQIILLQSLQVVVPPGSIPSIEKFLKRVAWIGAQPSLHREDE

SEQ ID NO: 167368 - protein, 93 aa, Glycine max
  Coding DNA Sequence Number=SeqID_75683
  Homolog annotation: Hit_ID=A5AV98; Match level="QueryCoverage=84%, HitCoverage=10%, E-value=2e-11, Identity=44%"; Hit description =Putative uncharacterized protein
MTVADSIKTTFPKIESAKRFIGLVGEYSQIADKSVVGTLMSTLTTMKFDGSRTMYEHVNEMTNIIRFLTIQTISPNEKFGFHGKWSESSSGNN

SEQ ID NO: 167369 - protein, 43 aa, Glycine max
  Coding DNA Sequence Number=SeqID_75684
MSGRIQRRRPIKERTQVEARIKIDRSSSHAQLWTSGKHRWEAA

SEQ ID NO: 167370 - protein, 72 aa, Glycine max
  Coding DNA Sequence Number=SeqID_75685
MDSFASWKMNSSGIEKEERERRCHFKKKMSLEEAHHQRRRWIRAWRKKEMNERKGRVEHEILCSKRALKSEI

SEQ ID NO: 167371 - protein, 244 aa, Glycine max
  Coding DNA Sequence Number=SeqID_75686
MASRKRKSIGTRPTAQYDTQRFHSFKAWTRYIDNVLGRHILPERKVEIYHTELDEFKVELERRNFYKSLTNLVDNSIDLALVKEFYANLYISEGPSPKQVKVRGHVVKIDADSLNIFLETPVVLAEGETLPAYSKYCRLPTYIREIEAALCIADRGFVLNVEGHLGKILRKHLTTLAQVWSVLSYSNLAPTSHTSDLTVDRARLIFGLVSQMDMNVGALISGQITSMAQSNSSRLGFPALITAL

SEQ ID NO: 167372 - protein, 64 aa, Glycine max
  Coding DNA Sequence Number=SeqID_75687
VHCKGCQGMAEDLGAIAEDFERVINLRMVIEGIDLHDIMTRCLKRVRGNVADGSLRLRQRRRID

SEQ ID NO: 167373 - protein, 150 aa, Glycine max
  Coding DNA Sequence Number=SeqID_75688
  Homolog annotation: Hit_ID=A7PGP2; Match level="QueryCoverage=47%, HitCoverage=11%, E-value=1e-12, Identity=56%"; Hit description =Chromosome chr17 scaffold_16, whole genome shotgun sequence
  Subcellular localization annotation: CTP_CleavageSite=61; ConfidenceScore=5.07e-01
QSGKSGIDSVATSQKLKGDLRAIFNVLSKDMQQLMLSNPERASLLQPSPESPKLPGRPLIQVAVGSSTSPRGISTSGDFSPLMRDRKIELVVEAVTTNCFEVVGSGDLELVGKVVLRHDEKFSVEEHEASVGGANAVAMVDNAARASCIE

SEQ ID NO: 167374 - protein, 254 aa, Glycine max
  Coding DNA Sequence Number=SeqID_75689
MASKKRKSIGARPTAHFEDPSPKQARFRGHPVKIDADSLNPFLETPVVLEEGETLPTYSRYCRLPVDHGEIEATLCIPGMGFILNAEGHLGRILRKDLTTLAQVWSVLPYSNLAPTSHTSNLTMDRASLIFGLVSHMDMNIGALISGQMTSIAQSNSSRGVVSDNLTFERLSPIINLAYIRKNYWNPDDLTVAFRGARKARARPADIPSTSAAPAPTPASTSTAPSVPAHVDSHCFEAMLQTIHQGQILLLQSL

SEQ ID NO: 167375 - protein, 62 aa, Glycine max
  Coding DNA Sequence Number=SeqID_75690
MDKSLKVGEDEWREKESRSTKFCASKEENYKQLGLNPELGLDLKRAYNFILSNRILSRFYFI

SEQ ID NO: 167376 - protein, 91 aa, Glycine max
  Coding DNA Sequence Number=SeqID_75691
MVQPTNPRSSPRFSTKKCAKYSKGGQKGHFWGILQPLSHLDNFMMKSIMKKKKEKKKLKRRQIVTATDFYIVCHSFFIALRSFFVGSLFFI

SEQ ID NO: 167377 - protein, 258 aa, Glycine max
  Coding DNA Sequence Number=SeqID_75692
GTWRYVAGVRRPWGHQASSWQSTDIRNCDHKARRLVWWLASCESCVIYGLWLLVIDYQGLENEVRKLGELLVIDYQGASGNRLPVCVIDYTEEWVTGFHVLKLCDSSVASGNRLPRLCNRLPEMKSLEIPLLPACGGYETHCVAAGDGVPRGSLGDPRRQYEVPISGHDSIYGYFIVQVIEVTSSEEDPEEDPEELPPEPAVDALDFLEGDEDPLPEVDSPEDVMSASEADSTEDSGPREMAIIIDTEDLAMQGIEDN

SEQ ID NO: 167378 - protein, 79 aa, Glycine max
  Coding DNA Sequence Number=SeqID_75693
MCHTLISSGDHLFGGMQPLLDRIEQKKAKGVYLVNRGVQIAIRPTWTFQGVPTEGGAFWWKQPSSPGRVRQQPPPSFPL

SEQ ID NO: 167379 - protein, 32 aa, Glycine max
  Coding DNA Sequence Number=SeqID_75694
MDLKYDERKGLIKEGATKIWMMPLPVKEDKSG

SEQ ID NO: 167380 - protein, 78 aa, Glycine max
  Coding DNA Sequence Number=SeqID_75695
MVKAKGHFGGLAARPGELRLTPEVTSSPRRAGSFTLKSFGGPGELEASLGELGSRKLNEKILLSPFFGIFRILDQNTE

SEQ ID NO: 167381 - protein, 332 aa, Glycine max
  Coding DNA Sequence Number=SeqID_75696
MTSRKRKSTASRSQAQYDTRRFQSLEAWNRYSDNILDRRILPERNVKIYHIEFNEFKAKLERRNLHKCLTNLQEGSINLALVKGFDANLYNPDDQSRKQVRSLLLVSAPPAPPTSATPTLAAQDSQRFEAMLQSIHQGQILLLQNLQVVSPPGSILSVEQFIKKESWPGTLPSTVREGEGPSAQVPQQVQDASSEATIPGAFDFLGGRVNMRPEEAIFPEPVVPVIHEIVEASGSQLRQEAATPERTSQTPEDPPSPWVELSFAQQVADPPAPVHARPADPSTPILEIPEDPTTLVLTLNTTPPATPELHFTDKENTQDQDTQGTQDQSQEF

SEQ ID NO: 167382 - protein, 54 aa, Glycine max
  Coding DNA Sequence Number=SeqID_75697
MDSGRFQISIPGDGCPRTVFPPQNVRVVVVGDTKGPPKCLARVCHQTLAPQWHI

SEQ ID NO: 167383 - protein, 186 aa, Glycine max
  Coding DNA Sequence Number=SeqID_75698
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=51%, HitCoverage=33%, E-value=3e-45, Identity=94%"; Hit description=Beta -lactamase TEM precursor
MQAWHWPSYYNVVTGKTLALPNLIALQHIPLSPAGVNSEEARTDTPFPTVAQPEWRMAPDATSCDRLRELHVSEVFTVITETRETKGPRDTPIFIETLVKVKDAEDQLGARVGYIELDLNSGKILESFRPEERFPMMSTFKVLLCGAVLSRIDAGQEQLGRRIHYSQNDLVEYSPVTEKHLTDGMT

SEQ ID NO: 167384 - protein, 43 aa, Glycine max
  Coding DNA Sequence Number=SeqID_75699
MSKRLQEDWARAAEEGPGVLMNLRVGYPRNIGFFSPCIFGHLD

SEQ ID NO: 167385 - protein, 63 aa, Glycine max
  Coding DNA Sequence Number=SeqID_75700
  Subcellular localization annotation: CTP_CleavageSite=56; ConfidenceScore=5.24e-01
MGVCKIHSDIQSKESPLFAVPPGLLSSVESVSDADMTSSGESTSGSGSSSSSGKSRASTAGSG

SEQ ID NO: 167386 - protein, 131 aa, Glycine max
  Coding DNA Sequence Number=SeqID_75701
MTVKNLIGRLGVHDKTDQTLISQVTLTRETRGIRTREAARKPRQDFSIQKKIQKLFSSPTLLFFSLSPPPLLPIKAPNFAHHFYSKLQKEAIFGVMKRTSTLWDFKFQVEKCEILRAREAKFGVSVNWSLK

SEQ ID NO: 167387 - protein, 108 aa, Glycine max
  Coding DNA Sequence Number=SeqID_75702
MVRTRGGPCALGSGTGRGMGQDEHDVDVHVTEEVPQVTEDVPPQVTKDIPDVTEDVPHVDEDMTTVHVDATDVAADGVEGSPVDHGQGFLGGPRDTSVLTSFANHMSN

SEQ ID NO: 167388 - protein, 163 aa, Glycine max
  Coding DNA Sequence Number=SeqID_75703
  Gene Ontology: Mol. function=aspartic-type endopeptidase activity; Biological process=proteolysis
  Homolog annotation: Hit_ID=Q6Z3S5; Match level="QueryCoverage=63%, HitCoverage=10%, E-value=1e-19, Identity=40%"; Hit description =Putative uncharacterized protein OSJNBa0025J22.29
MDDWTHYAAVLMCLRDIRHNKFEDSLIGTVETSLGQGLVYFNCYPNKTVSLMDRNILDSLFLNIHFHGLNMKEGSIPTALIYRIQYKANVSLQRTIKWDEVTLPEKWVMNKSNKTTPGELPGNHITSETSKRVGLRPQKETTPENLAFHGFKQKMQLKHEAET

SEQ ID NO: 167389 - protein, 60 aa, Glycine max
  Coding DNA Sequence Number=SeqID_75704
MEVAVEAIDMKRIIMLTPFSITSMKNGGFDILLDGMPHVSIEHGALTNHGYGSTLVKNAK

SEQ ID NO: 167390 - protein, 179 aa, Glycine max
  Coding DNA Sequence Number=SeqID_75705
MNKIRIFHEKKIYPAEEASASSSATTKCSLRKKVLQDLPRDPQKITFFRWITRKILQNLLLLDHAEDPAEPSFVGSHGRSCRTFFCRNLRKNLPHFFRMTPRKNTFFRYSSQKPLSDARKKVLLTEEPSSSTSTTTGYFWYFIELLGAPAILLGAPSNTPTGKGTAEKPGPFTLVMFVA

SEQ ID NO: 167391 - protein, 146 aa, Glycine max
  Coding DNA Sequence Number=SeqID_75706
  Homolog annotation: Hit_ID=Q652R5; Match level="QueryCoverage=34%, HitCoverage=20%, E-value=1e-14, Identity=72%"; Hit description =Putative uncharacterized protein P0603C10.50
MAHLELSIPMARLNRAAAPSYLFKSFAPIPKSDERFARQYRCGPPPEFPLASPRSGIVHHLSGPDRYALTRTLHRRSGSVGGATHRGIPPISFLAPYGFTRPLTRTHVRLLGPCFKTGRMGSPQADARSAQVPRHAKGARCHPQSR

SEQ ID NO: 167392 - protein, 94 aa, Glycine max
  Coding DNA Sequence Number=SeqID_75707
AQGDAPQAAGAPPPPHQAGQAGAFDMEQYLRHLGFASFSCPTPDQFRAEVAWPGDWPEAQAGEAPPEAPGDGEEAHEDEEMADLLDFLGGSGDT

SEQ ID NO: 167393 - protein, 46 aa, Glycine max
  Coding DNA Sequence Number=SeqID_75708
MNDKFLGNKGAHFVMQSNPARALARRLQVDWARDPRKGPRVLMSLR

SEQ ID NO: 167394 - protein, 209 aa, Glycine max
  Coding DNA Sequence Number=SeqID_75709
MEVNAATVVAASTATELDPTHQPGFNQVNHPASDMVGQGGKALGSMGGPHFVQVQSKHSFPPYGLPPNYTPPNVAHVPDENVDNSAPIPIESQHPQSGHAQVSQPMGETHEAPRDHNLVNFEPHVGYATEGQAFCSVPLSNTFEGPQYRPLPQPLHFAVGRVPSAMVERERFDHIEERLRVIEGGGDYAFADMAELCLVSDVVIPLKFK

SEQ ID NO: 167395 - protein, 122 aa, Glycine max
  Coding DNA Sequence Number=SeqID_75710
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQPVTSVQRVGSSENLRKTALQ

SEQ ID NO: 167396 - protein, 72 aa, Glycine max
  Coding DNA Sequence Number=SeqID_75711
MREGSFGWRETPLPLVFMFPGAGVLAQANSARPGELTLYIFLKTQLCLPLVWSWAWDDDPSIMGLASTRVRP

SEQ ID NO: 167397 - protein, 437 aa, Glycine max
  Coding DNA Sequence Number=SeqID_75712
  Gene Ontology: Mol. function=binding; Cellular component=outer membrane; Biological process=cellulose biosynthetic process
  Homolog annotation: Hit_ID=A6TFD3; Match level="QueryCoverage=100%, HitCoverage=37%, E-value=0.0, Identity=83%"; Hit description =Putative cellulose synthase
  Pfam annotation: Domain name=BCSC_C; Domain location=281-437; Score= -56.6; E_value=7.8e-07; Accession=PF05420.2; Description=Cellulose synthase operon protein C C-terminus (BCSC_C)
  Pfam annotation: Domain name=TPR_4; Domain location=117-142; Score =15.6; E_value=0.19; Accession=PF07721.5; Description=Tetratricopeptid e repeat
  Pfam annotation: Domain name=TPR_4; Domain location=153-176; Score =0.4; E_value=35; Accession=PF07721.5; Description=Tetratricopeptide repeat
  Pfam annotation: Domain name=TPR_4; Domain location=83-108; Score =11.4; E_value=1.7; Accession=PF07721.5; Description=Tetratricopeptide repeat
  Pfam module annotation: Pfam domain module=BCSC_C::TPR_4::TPR_4::TPR _4; Domain location=281-437::117-142::153-176::83-108
MANRKPGDAERVYAYGLYLSGNNQDDRALAQINALPRGQWTDNIRELEGRLQSDKVMREANQLRDSGQEAQAIALIKQQPESIRYDLALADWAQQRGDSAEAIAQYHRVLSQQADNGDARLGLAEVYLAEGDKNAARAQVAQLKDADTESINMQRRVALARAGFDDTAGAQQIFDRIVPQAKSQPPSMESALVLRDAARFQTQSEQPQQALESYKDAMVAAGVTRVRSQDNDTFTRLTRNDSQDDWLKRGIRSDAADLYRQQDLNVTLEHDYWGSSGTGGYSDLKAHTTMLQVDAPLYDGRMFFRTDVVNMNAGSFSTNSDGGYSPSWGTCGEISCYGGSKNQSDGGASVAVGWKNDTWSGDIGTTPMGFNVVDVVGGLSYSGDAGPVGYTVNVHRRPISSSLLSFGGQKDNPNDGHTGTTWGGVRAAGGGISLSYD

SEQ ID NO: 167398 - protein, 64 aa, Glycine max
  Coding DNA Sequence Number=SeqID_75713
  Gene Ontology: Mol. function=serine carboxypeptidase activity; Biological process=proteolysis
  Homolog annotation: Hit_ID=Q0WPR4; Match level="QueryCoverage=62%, HitCoverage=8%, E-value=2e-12, Identity=75%"; Hit description=Serine carboxypeptidase-like 34 precursor
MTFESFKTSGEVQQYGGYITVNETQGIALFYWFFEATHKPEQKPILLWLNGGIERDEFDDNLWK

SEQ ID NO: 167399 - protein, 104 aa, Glycine max
  Coding DNA Sequence Number=SeqID_75714
MVFHLRLVMSFKIKKGKHRLKGLSKELIKGSINKNQAKAIVQAINGANTPNDYDDGSNSHKGWSKEVSSPTASTKKRFVRNGLSRCPLTLKLLFVESLLISTVP

SEQ ID NO: 167400 - protein, 112 aa, Glycine max
  Coding DNA Sequence Number=SeqID_75715
SFGVPVAPSKVIRPPITRAFIEKYCTQRQAQSDAPQATGAPPPPHQADPAGSFDTERYLRYSMRQHAANHRGLGQVHECLYQLSLSMQSQGFAPFPCPTPYQFKAEVAWPGD

SEQ ID NO: 167401 - protein, 118 aa, Glycine max
  Coding DNA Sequence Number=SeqID_75716
AADAPPPHQVGPAGSFDTEQYLRHLVRQQAANHRAHVQTHDCLYQMSLSLQSQGFTSFPCPTPDQFRAEVAWPGDWPEAQAGEALAGAPTEAPDEADEAREDEEMTDLLDFLGGSGAA

SEQ ID NO: 167402 - protein, 30 aa, Glycine max
  Coding DNA Sequence Number=SeqID_75717
MTGDASKFIHISPKNSGHVTYGDNNKVRSK

SEQ ID NO: 167403 - protein, 84 aa, Glycine max
  Coding DNA Sequence Number=SeqID_75718
  Subcellular localization annotation: CTP_CleavageSite=64; ConfidenceScore=5.32e-01
MKRKWLRESFPKRDLGGTPRLKGPVPLPSLTAIVSGALNTSSVSRPSKDGRSTERDASSSGTMSAQIFRKSSSSALDIAGHSHG

SEQ ID NO: 167404 - protein, 24 aa, Glycine max
  Coding DNA Sequence Number=SeqID_75719
MASSSSSQPGASAPNSHKPPLAKT

SEQ ID NO: 167405 - protein, 149 aa, Glycine max
  Coding DNA Sequence Number=SeqID_75720
  Homolog annotation: Hit_ID=Q2PEW8; Match level="QueryCoverage=94%, HitCoverage=46%, E-value=3e-29, Identity=38%"; Hit description =Putative uncharacterized protein
  Pfam annotation: Domain name=SURNod19; Domain location=3-149; Score= -184.7; E_value=0.00041; Accession=PF07712.3; Description=Stress up -regulated Nod 19
MDMRRNGLLNIMVIDTRGAQDKKACTQCRCDNMNLPKDFIMSQGIYITKIDYKYKGGLFCCQDNLQCKQIEGFQGSRRMAEYTIPAGGGGDSPHVQKANIPMENGGYLIYGTAHMHSGVVNATLYGQDGRTLCTSTPKYGTGKEAGNEK

SEQ ID NO: 167406 - protein, 143 aa, Glycine max
  Coding DNA Sequence Number=SeqID_75721
MVPNAWLTKKRCFFGHLNCIITFSMHSIRIPESFIFMKCCRSIGDQIVILWIMGLNQAHAFTERKKHVLRCPYLTRARARVMGEVEEVQEQMKANMEAMKEKMATIMEAMMSMKKIMEADAVVIAATSAVVKVNPMPPSDLNQ

SEQ ID NO: 167407 - protein, 161 aa, Glycine max
  Coding DNA Sequence Number=SeqID_75722
  Subcellular localization annotation: CTP_CleavageSite=31; ConfidenceScore=5.04e-01
VSFIYGLHSIMARRSLWINLNSINANMNCPCSSLVTSTPFFSHRPFQGAEPNAYECKILLIAILTWGWGASTLMKAPYTQLVVPRGNSPFKFNNAIVDHPNLIKISVADEFSNISNRVELAEAEYNSVLNSLKQNPQDPSLLALANRTRVLETLCLEKQSL

SEQ ID NO: 167408 - protein, 210 aa, Glycine max
  Coding DNA Sequence Number=SeqID_75723
  Gene Ontology: Mol. function=chlorophyll binding; Cellular component =integral to membrane; Biological process=photosynthetic electron transport
  Homolog annotation: Hit_ID=Q2MI75; Match level="QueryCoverage=98%, HitCoverage=47%, E-value=4e-94, Identity=75%"; Hit description =Photosystem II P680 chlorophyll A apoprotein
  Pfam annotation: Domain name=PSII; Domain location=1-210; Score=94.5; E_value=3.2e-25; Accession=PF00421.10; Description=Photosystem II protein
MGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGGIL

SEQ ID NO: 167409 - protein, 98 aa, Glycine max
  Coding DNA Sequence Number=SeqID_75724
MQRRSSAGVLILIDLEINATCRKRNAERNRKFLQDIEAAAIQEEPLSSEASSSFPKTGESYTVLLEANIMADEPRRVTLEDYSSTSVLQFFISIARPE

SEQ ID NO: 167410 - protein, 60 aa, Glycine max
  Coding DNA Sequence Number=SeqID_75725
MTLGAEFNVESLTCRDWNTSSKVSQKVQEKKRTTYISMKFSRFKKLGLGFDMLMKDRDTG

SEQ ID NO: 167411 - protein, 34 aa, Glycine max
  Coding DNA Sequence Number=SeqID_75726
MGILHFTTPPSQRFGYSHVCALLKDAVGTWAMTA

SEQ ID NO: 167412 - protein, 88 aa, Glycine max
  Coding DNA Sequence Number=SeqID_75727
MARSASSYNFESQSRMLCLCNVEVLLVTSWTEDNPEKGFYGCGLYRWHNPIVNSREKRIIVALMKKVKEKGLQTKISEMKLKGKFLGI

SEQ ID NO: 167413 - protein, 146 aa, Glycine max
  Coding DNA Sequence Number=SeqID_75728
  Homolog annotation: Hit_ID=Q0PN09; Match level="QueryCoverage=97%, HitCoverage=58%, E-value=4e-26, Identity=52%"; Hit description =Lateral organ boundaries domain protein
MTVVETVLRGGTVKPVPELLGLDAPTPTADDASEGEVICTNKWKVRDLNPNFWFLGLRSDKGGFGGKCKRFEELAKLQIAMMDLNLWLTPSFLQKVVSFSCRQEIRGSGSPSMNSEESGITTTCLESGIRDHYAPDGDRKVLNLFI

SEQ ID NO: 167414 - protein, 556 aa, Glycine max
  Coding DNA Sequence Number=SeqID_75729
  Gene Ontology: Mol. function=hydrolase activity; Cellular component =extracellular region; Biological process=metabolic process
  Homolog annotation: Hit_ID=A7QTL4; Match level="QueryCoverage=99%, HitCoverage=99%, E-value=0.0, Identity=64%"; Hit description =Chromosome chr11 scaffold_170, whole genome shotgun sequence
  Pfam annotation: Domain name=Glyco_hydro_79n; Domain location=34-369; Score=538.2; E_value=9e-159; Accession=PF03662.5; Description =Glycosyl hydrolase family 79, N-terminal domain
MSSRIRLLGICLWLHLTCFTFIFGNIVSVRGDATLQGTVAIDDKVVIGTIDDDFVCATLDWWPPEKCDYGRCSWGLASLLNLDLNNKIFLNAVKAFSPLKLRLGGSLQDKVIYGTEDNHQPCTPFVKNPSEMFGFTQGCLPMDRWDELNYFFEKAGAKIIFGLNALAGKSIHSGSAKGPWNYTNAESFIRYTVGNGYSIYGWELGNELSGSGVGTSITADQYALDVAALHDVVYNAYEKTEPKPLVIAPGGFFDANWFNIFISKSGKSIDVVTHHIYNLGPGVDEHLVERILDPSYLDKEASTFSGLKNILASTGTSATAWVGESGGAYNSGHHLVSDAFVYSFWLVATPHDSDFINDSLQLGYLDQLGMSAAYDTKTYCRQSLIGGNYGLLNTTNFLPNPDYYSALLWHRLMGRHVLSTTFSGTNKIRAYAHCAKQSKGITVLLINLDSNTTVEAEVTFNNNAESLRHRKMSSHSKRMELPLASETAREEYHLTPQDGDIHSQTMVLNGKALSVNSDGDIPPLEPIYVNSSEPIRVAAFSIVFAHLPDAVVSACC

SEQ ID NO: 167415 - protein, 132 aa, Glycine max
  Coding DNA Sequence Number=SeqID_75730
MLGFRILGSGELHLTGSSLPNLLIFAFKLSSLLKINAKVSASFGTLKFLLELYLLPGDYFGIGFPLRRTYLGDKLRLTMTCVPSVKANLNLPLICFSLVKKLCLCGGNSTPGLGRKKFFIVGQWIISSSTPP

SEQ ID NO: 167416 - protein, 128 aa, Glycine max
  Coding DNA Sequence Number=SeqID_75731
MSYRMSRHHASEHADYMCPYEQPLFTTFSPNHYPCDLYLRATLRYEKPRSLPLNHTPVFTIKSKTHQRSTLNKRDQLYTLEINSTHSGPTLDVRVPSRWLTKHSSPKTHKITLQSRTWYRTRAAFMVI

SEQ ID NO: 167417 - protein, 512 aa, Glycine max
  Coding DNA Sequence Number=SeqID_75732
  Homolog annotation: Hit_ID=Q6WAY4; Match level="QueryCoverage=89%, HitCoverage=87%, E-value=7e-42, Identity=27%"; Hit description =Putative uncharacterized protein
MGSNQDFSFTKRFAHVKLVTPQQCRDFVGTYGKILDLAMIEVPTVATTALVQYYDQQMWCFTFKDFQLVLMLEEFEKIVGCPLGGTKPFFPSGHSLSMPRLSEVLGITVTELREKEMNRNGVRSFPKELMEDKARECASKGEWGYFMSILALLIYGVVLFPSMIDRIDLVVVDAFLVYYYRWESPVVAILVDVYYTLDLSWEKKSTRVICCLLALYVWMVSHLVMHNGRPTCQLEDFCIAPDKSKINWEELLASMIAFPNVPLMGTKDCVNYNPMLGIRQLGYLICGPPSNGAIQPFIAQGLNEEHLGLHQQIRKAWDSPNKRDEELRKKDEGFVDSYPQWLENRVQEVKLPKKTNGERVEIDVPIETKEVRELKAKLQKSMGTKEKLKGVVIRVRKECNRLRDVNMSATEPLEQEMKRAKGEETNIKRYQGALSSNSNELKLRRAEKDQVITENVTLRDELEVCWVSKESLKEKLGMMEKNMLVIFDQYEVKMMRERQDLATIHGQALRNE

SEQ ID NO: 167418 - protein, 194 aa, Glycine max
  Coding DNA Sequence Number=SeqID_75733
MAVATPLYLKKLKNVPLESKPAILQKQNRQFDWRFTKPCPDSPAEVASSTSHQIAITSGVFHAMTKKKKKKKVEVAGVSLSEAYALSEALSSLSELGESGRESVIHARAQRAISSLNESFVSSRAQPAKLAKQKFTNSRLASLQDQKALKRLKLAKNKGVLWKRDVTESNNRAREKSLDEKPQPLRDSEFKSDY

SEQ ID NO: 167419 - protein, 133 aa, Glycine max
  Coding DNA Sequence Number=SeqID_75734
MTIDHTQNPELMPLMISNKKECKVILTKEDVEEEKKEEIERNEEKAQQWEKYSQVEIQRESILQVNTTPHQLIVKEERHEKHDKPLSVLLSLTTSTFLATIWKVFPAYMSFMASLAKRRKCKEDAFFVTFMPP

SEQ ID NO: 167420 - protein, 430 aa, Glycine max
  Coding DNA Sequence Number=SeqID_75735
MWHVNKHNGRQAIDMVLMDHTGAKIGATLWQELFPEFEPNLFVKTTFVKEVERPKIPPNVHVIIEFAYIITGVAPRDTLVDVVSVVVEVIKRKTVNPAYRVTVKLRDNSDVEIIMTKPLVIMLTLTKIKDSKDKYPLSVQNIKHGSKLYVNTDIVEIQQFRKSLRVPFYVGGVTNEGSASQSQYSQHSQRNSVEKFLHNAQMVNLGEISRLRQDCYCLTVATVDEVMIDTPWSYDSCPYCTTTFDPLKIGAVCRSCQNQVTHTVPRYKLVVKMEQNREKANFHFWDVTCIKIFGKMADECHQQLIASVDEIKVFPPCVDELLGKTWAVIFKYHFQMRQSSMLDVSKEEHHIHTLTSTLGLQDEPSIGKSPAVGAETSSQDYHLTSADYDPGKTVFVTPAKRMCDQQDSSEFEFDEYTPYELLTNTHMKVE

SEQ ID NO: 167421 - protein, 125 aa, Glycine max
  Coding DNA Sequence Number=SeqID_75736
MKMNTRSRSLLGLLKVVAKRKQMQTLHELIFVNKSCFIVNAVSKPFPLDLMMKYVQFQLSLAHQWAKRASTAKHNLSALSAIEESGRTSISRLHAKREISALSATVVFSQAQYMTGAKLKSTYSC

SEQ ID NO: 167422 - protein, 115 aa, Glycine max
  Coding DNA Sequence Number=SeqID_75737
  Subcellular localization annotation: CTP_CleavageSite=38; ConfidenceScore=5.20e-01
MCLSGKESMLMKFSHNRSTGSNKDRRKSLKVYQSHTVRGEKVASAQDFVSNQRERTTLGRGQGLTFSPWVKVYDKLGFWLKACRTAGHDICQGLASGSGIKGMSYIISMIHMQQR

SEQ ID NO: 167423 - protein, 167 aa, Glycine max
  Coding DNA Sequence Number=SeqID_75738
MTKLCQSLLSSSPFWMTKDVRITYSGISAYHRARRLWMIQGCRMTKLGLCLSSGPPPLDDKRVRITVRYLRVSSGPPPLDDTKGCRMTKLGLCLSSGPPPLDDKRVRITVRLEKSPSENADISGKGADDHIGLCSSISGPLESTSGMQAGANNHKVSPGIIGPAASG

SEQ ID NO: 167424 - protein, 34 aa, Glycine max
  Coding DNA Sequence Number=SeqID_75739
MPKQCSNNEVGDKKEHFQSDESKILSSVGVNYKK

SEQ ID NO: 167425 - protein, 130 aa, Glycine max
  Coding DNA Sequence Number=SeqID_75740
MMTLLLSNVLPSDHNSYLPLPKCQLVYAILTRMSVHVAQVIADAIYLFAGIPPTRHPLDPDKSKRALGFSALITGLCQSFGVPVAPSKYCTPRQAQGEAHQVADTPSPPHQADPVGSLGMERYLQHLVRQ

SEQ ID NO: 167426 - protein, 265 aa, Glycine max
  Coding DNA Sequence Number=SeqID_75741
  Homolog annotation: Hit_ID=Q6WAY4; Match level="QueryCoverage=76%, HitCoverage=38%, E-value=4e-19, Identity=34%"; Hit description =Putative uncharacterized protein
MGTNQNGKRFYQVKVKSLDVTSLKELGRLMGPLQRQAFRKVYGKIPDLTAAEVFTEAVVSLAQYYDQPLRCFTFGDRIFDQPLGGRKPYLFSDFLPSLSKIAAVVEDSAKELDRMKQTRNGVVGLPRKYLEGKARDMASQEKWGPFTDILALLIFGVVLFPNVDGLVDLAAIDAFLAYHHSKESPVVAVLADLFDTFDRRCEKNSARIVCCLPALYVWLVSHLFQQDTRHPCPLQSYRSCAEKGRVDWDQHLAGIGGSAINWFPR

SEQ ID NO: 167427 - protein, 67 aa, Glycine max
  Coding DNA Sequence Number=SeqID_75742
MACTHIPRFSSNFSQPVSIRLHTFMLRGHTMLNGMPQGSLHDKHTLRSSRILKKWRLRNLGWGYGYH

SEQ ID NO: 167428 - protein, 91 aa, Glycine max
  Coding DNA Sequence Number=SeqID_75743
MGVKHFEVVKRRSHADKQWFPNEIRTCLSLDDKGADNHEVYPRATGPLSLTDSKMRLFCSLDRKTLTSPEKVQMRTLVTKCYQALSPMNNK

SEQ ID NO: 167429 - protein, 83 aa, Glycine max
  Coding DNA Sequence Number=SeqID_75744
  Subcellular localization annotation: CTP_CleavageSite=43; ConfidenceScore=5.57e-01
MDKPSLRSPFLNVFLFHFALLFIPNKRWLRRSSPQRGLGVMPMGKALAPLWSSTVTGFGVPSTSSVLRPSRDNHSIGRGASSS

SEQ ID NO: 167430 - protein, 78 aa, Glycine max
  Coding DNA Sequence Number=SeqID_75745
MSAEKYQSGILHDRCRLLSFLFNPLMKYASCRRGATSRPMSAIEFSIQSLNDDVNLSRSGSFDTGYGGLDDATSGEGR

SEQ ID NO: 167431 - protein, 189 aa, Glycine max
  Coding DNA Sequence Number=SeqID_75746
  Homolog annotation: Hit_ID=A5ZQM3; Match level="QueryCoverage=28%, HitCoverage=48%, E-value=7e-19, Identity=83%"; Hit description =Putative uncharacterized protein
MSVKMRTTCTWTERPYEASLFPGIGFGLFLRSLGGGQRRPPSGGARAISLPKGNGGVQPFPRARRRLALECKGRRELDCKTHPSSRDETHIDGKVWHLDVGSSPPGAVVCSKGWAVRPLKRYVSWVQNVVRQFGPYPYERTGKDALWCASYRAHGKRWVAKASGSTAETAMGSLPQRGWSERSFENSRE

SEQ ID NO: 167432 - protein, 40 aa, Glycine max
  Coding DNA Sequence Number=SeqID_75747
MWDIPFYPETAGQTHALTYVMSSRSTSFEPKSQLTINLDP

SEQ ID NO: 167433 - protein, 150 aa, Glycine max
  Coding DNA Sequence Number=SeqID_75748
  Homolog annotation: Hit_ID=Q6WAY6; Match level="QueryCoverage=80%, HitCoverage=20%, E-value=1e-09, Identity=30%"; Hit description =Putative uncharacterized protein
MARIAKVVKISAEELDRAKQNRNGVVGIPRKHLEEKAKALADEGEWASFIDVSALLVFGVVLFPNVDGLVDLATIDAFLAYHHSKESPVVPVLANAYDTFDRRCEKSGARIVCYTPALYVWLVLHLFHHESRPICPLQGHRICTEKGKAN

SEQ ID NO: 167434 - protein, 280 aa, Glycine max
  Coding DNA Sequence Number=SeqID_75749
  Gene Ontology: Mol. function=dihydrodipicolinate synthase activity; Cellular component=cytoplasm; Biological process=diaminopimelate biosynthetic process
  Homolog annotation: Hit_ID=A7ZPS4; Match level="QueryCoverage=100%, HitCoverage=95%, E-value=1e-147, Identity=92%"; Hit description =Dihydrodipicolinate synthase
  Pfam annotation: Domain name=DHDPS; Domain location=1-278; Score =534.9; E_value=8.6e-158; Accession=PF00701.13; Description =Dihydrodipicolinate synthetase family
MDEKGNVCRSSMKKLIDYHVANGTSAIVSVGTTGESATLSHDEHGDVVMLTLELADGRIPVIAGTGANATAEAISLTKRFNDSGIVGCLTVTPYYNRPTQEGLFQHFKAIAEHTDLPQILYNVPSRTGCDMLPETVGRLSEVKNIIGIKEATGNLSRVHQIKELVSDDFILLSGDDATALDFMQLGGHGVISVTANVAARDMAEMCKLAAAGHFDEARVINQRLMPLHNKLFVEPNPIPVKWACKELGLVATDTLRLPMTPITDHGRDIVRAALKHAGLL

SEQ ID NO: 167435 - protein, 150 aa, Glycine max
  Coding DNA Sequence Number=SeqID_75750
  Gene Ontology: Mol. function=sodium:dicarboxylate symporter activity; Cellular component=membrane; Biological process=dicarboxylic acid transport
  Homolog annotation: Hit_ID=P0AFJ0; Match level="QueryCoverage=99%, HitCoverage=42%, E-value=5e-52, Identity=71%"; Hit description =Putative permease perM
  Pfam annotation: Domain name=UPF0118; Domain location=1-142; Score= -79.3; E_value=0.035; Accession=PF01594.7; Description=Domain of unknown function DUF20
MNQQITNYIRGKVLEMIVVGVATWIGFLIFGLNYSLLLAVLVGLSVLIPYIGAFVVTIPVVGVALFQFGLGTEFWSCFAVYLIIQGLDGNLLVPVLFSEAVNLHPLVIILSVVIFGGLWGFWGVFFAIPLATLIKAVVHAWPDVPAVEEK

SEQ ID NO: 167436 - protein, 74 aa, Glycine max
  Coding DNA Sequence Number=SeqID_75751
  Subcellular localization annotation: CTP_CleavageSite=71; ConfidenceScore=5.70e-01
MSMIISGLTGEASRGRSAVSNPSVRLSCQSASGTSVIRAKGAQPKRVSATPSCPRISAISGVSGSNGQAVRAMR

SEQ ID NO: 167437 - protein, 51 aa, Glycine max
  Coding DNA Sequence Number=SeqID_75752
MEMQQKIKEKSFLEILEKLEFSYTPPLIAKVTSLRSFLQKLELSYTQPSNS

SEQ ID NO: 167438 - protein, 129 aa, Glycine max
  Coding DNA Sequence Number=SeqID_75753
MGKSRFSSVLRQELEDDVDIRWVIFESAQVEDCQEYLWQWTNIGNRKNFLKSIELNHGGSQRKKASDLSKNRLSKLHHPNASQVHWHEVIMSEQSQKDAYYSFRQCHSVEEYEDKRTDGECHALTKKKK

SEQ ID NO: 167439 - protein, 102 aa, Glycine max
  Coding DNA Sequence Number=SeqID_75754
  Subcellular localization annotation: CTP_CleavageSite=56; ConfidenceScore=5.45e-01
MPKKGGKRVFSLSFLDPSSPRLAFGTPGPPNDFSVKELASLGEPFTSGLSLSSPGRAAMKDIERNKREEEERRGNEVEALLNRDCDQSLHRSLFDVRHVTID

SEQ ID NO: 167440 - protein, 78 aa, Glycine max
  Coding DNA Sequence Number=SeqID_75755
EEAGETQGRQVATATPERSLEATSEPPALVVDLPSPQHTVDPSTPILEIPEDPTTPFLAMDTSPPAIPVLHLTDEEDV

SEQ ID NO: 167441 - protein, 70 aa, Glycine max
  Coding DNA Sequence Number=SeqID_75756
PRVQPSSHGGGEASTAQEPQPDPKTTPAAQEDELETTPPESFVPKTDPEADPVIAEASPQHHQYRHQCWS

SEQ ID NO: 167442 - protein, 72 aa, Glycine max
  Coding DNA Sequence Number=SeqID_75757
MTDYDLHGLDDGYRAIIDAVNARDTPIVTTCPSRAREGEAHGCASQRRKDARSRHQRLFVENVGKSEGNRSK

SEQ ID NO: 167443 - protein, 132 aa, Glycine max
  Coding DNA Sequence Number=SeqID_75758
MDNKKKRPIICRTKIDLNKTFKEATKAIEVAQVQISLMAGDHKILKFKLDNWQNNYLNMEVDLSQQPHSEKVEEKVVSEEEKKSNEQATNKELSLHGLGTSLFFRRRMKTWQILLIISLKETELLNHDHQGE

SEQ ID NO: 167444 - protein, 76 aa, Glycine max
  Coding DNA Sequence Number=SeqID_75759
MALKKLSTKRSRRDATGEGSSAASEFDSHRFRSAEHQERRVQLREDEYSDFQEEIARRHWTPLVTPMAKFDPEIVL

SEQ ID NO: 167445 - protein, 165 aa, Glycine max
  Coding DNA Sequence Number=SeqID_75760
MEIFIQSIDPSAWNAIVKGPFIPTKEVNGELKDYKESFSDDEDVENFSLMVKKFVKFLKRFNDRKFSKPSKKKESNNNTFTCFERGKQGHIKFEYPIYLRKQKKKAYIAWEDNASTSSDSSSEEEVANVCLMADSIDDSSTIEETEVNSEFEEVLDASDEMYEEA

SEQ ID NO: 167446 - protein, 241 aa, Glycine max
  Coding DNA Sequence Number=SeqID_75761
  Gene Ontology: Mol. function=fructose-bisphosphate aldolase activity; Cellular component=integral to membrane; Biological process=metabolic process
  Homolog annotation: Hit_ID=Q6DAB6; Match level="QueryCoverage=99%, HitCoverage=96%, E-value=5e-76, Identity=57%"; Hit description =Probable sugar-bisphosphate aldolase
  Pfam annotation: Domain name=F_bP_aldolase; Domain location=1-241; Score=69.2; E_value=1.4e-17; Accession=PF01116.11; Description =Fructose-bisphosphate aldolase class-II
DAFQHKYAVLAINCFNLETARAAIQAAEQQRAPLILNVYQGHSAHFPPAVAAPLVQALAAQAAVPVALALDHGKAFPLIGQAFRAGFTGLMIDASAEPLADNIRQTAAVVKMAHTAGVCVEGELGHIADAPTYELADAAVKMTRPKIDFERLQQLHAVTTRPLALHGGSGTPAEDIRRVSACGVAKINVGAAVFDAGKHAVQQALRQHPQAELADVLALMESACREVVIEYLSWSGSANRY

SEQ ID NO: 167447 - protein, 114 aa, Glycine max
  Coding DNA Sequence Number=SeqID_75762
MRGADSFTATSLVHPEEPARMLQRTVEWILPTPTPYLLVEPVLVIEVTSSEEDPEEDPEELPPEPAVDALDFLEGNEDPLPEVDSLEDVMSASEADSTEESGPGGIATCGGSSS

SEQ ID NO: 167448 - protein, 117 aa, Glycine max
  Coding DNA Sequence Number=SeqID_75763
  Gene Ontology: Mol. function=protein serine/threonine kinase activity; Biological process=recognition or rejection of self pollen
  Homolog annotation: Hit_ID=A7PZN1; Match level="QueryCoverage=99%, HitCoverage=14%, E-value=1e-33, Identity=57%"; Hit description =Chromosome chr15 scaffold_40, whole genome shotgun sequence
MNLTRLNSLLSWRTETDPSPGLYSLRLKPPFYGEFELVFNDTVPYWSTGNWTNGSFLNIPEMSIPYLYNFHFLSPFSPAAAFGFSERAESEAGNRPPTMFRVEPFGQIQQYTWNSQA

SEQ ID NO: 167449 - protein, 644 aa, Glycine max
  Coding DNA Sequence Number=SeqID_75764
  Gene Ontology: Mol. function=binding; Cellular component=nucleus; Biological process=protein amino acid phosphorylation
  Homolog annotation: Hit_ID=A7PZM9; Match level="QueryCoverage=94%, HitCoverage=89%, E-value=0.0, Identity=53%"; Hit description =Chromosome chr15 scaffold_40, whole genome shotgun sequence
  Pfam annotation: Domain name=PPR; Domain location=159-193; Score=7.3; E_value=1.1; Accession=PF01535.11; Description=PPR repeat
  Pfam annotation: Domain name=PPR; Domain location=225-259; Score =28.8; E_value=2e-05; Accession=PF01535.11; Description=PPR repeat
  Pfam annotation: Domain name=PPR; Domain location=326-360; Score =42.7; E_value=1.3e-09; Accession=PF01535.11; Description=PPR repeat
  Pfam annotation: Domain name=PPR; Domain location=427-461; Score =48.1; E_value=3e-11; Accession=PF01535.11; Description=PPR repeat
  Pfam annotation: Domain name=PPR; Domain location=462-496; Score=2.7; E_value=3.8; Accession=PF01535.11; Description=PPR repeat
  Pfam annotation: Domain name=PPR; Domain location=498-531; Score=9.1; E_value=0.66; Accession=PF01535.11; Description=PPR repeat
  Pfam annotation: Domain name=PPR; Domain location=86-120; Score=0.1; E_value=7.5; Accession=PF01535.11; Description=PPR repeat
  Pfam module annotation: Pfam domain module=PPR::PPR::PPR::PPR::PPR::PP R::PPR; Domain location=159-193::225-259::326-360::427-461::462 -496::498-531::86-120
MLCKFHFKKQLRFPPIPYSFVTQCTHSWSIIRASVPVPDETHFRDPHTVHLFCANALKVSAKRALLPEGKQLHAHLIKFGFCHVLSLQNQILGVYLKCTEADDAEKLFEELSVRNVVSWNILIRGIVGCGDANENDSNQQQCFSYFKRMLLELVVPDSTTFNGLFGVCVKFHDIDMGFQLHCFAVKLGLDLDCFVGSVLVDLYAQCGLVENARRVFLVVQHRDLVVWNVMISCYALNCLPEEAFVMFNLMRWDGANGDEFTFSNLLSICDSLEYYDFGKQVHGHILRLSFDSDVLVASALINMYAKNENIVDAHRLFDNMVIRNVVAWNTIIVGYGNRREGNEVMKLLREMLREGFSPDELTISSTISLCGYVSAITETMQAHAFAVKSSFQEFLSVANSLISAYSKCGSITSACKCFRLTREPDLVSWTSLINAYAFHGLAKEATEVFEKMLSCGIIPDQISFLGVLSACSHCGLVTKGLHYFNLMTSVYKIVPDSGHYTCLVDLLGRYGLINEAFEFLRSMPMEAESNTLGAFVASCNLHANIGLAKWAAEKLFTIEPEKNVNYAVMSNIYASHRHWSDVERVRRMMGNKCDARVPGCSWIEITNQVHSFVSNDKIHPKALEMHATLKMLLWPMKEKSGMNS

SEQ ID NO: 167450 - protein, 141 aa, Glycine max
  Coding DNA Sequence Number=SeqID_75765
  Homolog annotation: Hit_ID=A5CB76; Match level="QueryCoverage=88%, HitCoverage=40%, E-value=3e-12, Identity=33%"; Hit description =Putative uncharacterized protein
  Pfam annotation: Domain name=zf-CCHC; Domain location=99-116; Score =12.7; E_value=0.019; Accession=PF00098.14; Description=Zinc knuckle
MTLEEMKRRLDKLFMVVILWTLHSDFDHVCDQFLAGEQVPSMYSLVTRLLRVPTSVKGENSVVAVETSAAPTETSAMVASRGRGGRGNRGGCGSRGGCPQCTHCKKPGHTQEKCYALHGYPDNVAHVTKSEKSKSKFSDED

SEQ ID NO: 167451 - protein, 2099 aa, Glycine max
  Coding DNA Sequence Number=SeqID_75766
  Homolog annotation: Hit_ID=Q2HTJ2; Match level="QueryCoverage=97%, HitCoverage=93%, E-value=0.0, Identity=64%"; Hit description=2-oxo acid dehydrogenase, lipoyl-binding site
  Pfam annotation: Domain name=Med12; Domain location=69-125; Score =72.5; E_value=1.4e-18; Accession=PF09497.1; Description =Transcription mediator subunit Med12
MHTTHGVRKRDRSVYKRVKSTHGLREGGIDRAVSSRKERAVASTVPLGDRKRRGGRLAQIVKVGTGEQPRSLSNSVKILLQGLSQQHKRLRSLADHVPHGYKRTSLLEVLIRNNVPLLRATWFIKVTYLNQVRPGSVGISSGAADKIQLSRSDVWTKDVINYLQTLVDEFLSKNALHSASHGRERSPQMSYTGSLQNKNDPLLSVSDGEGPSLHFRWWYIVRLLQWNHAEGLLHPSLVIDWVFNQLQEKDLLEVWQLLLPIIYGFLETIVLSQTYVRTLAGLALHVIRDPAPGGSDLVDNSRRAYTAYAVIEMLRYLILVVPDTFVALDCFPLPSSVISHTMNDGNFVLKSTEAAGKIKNSSDDFGHIISCIQKHTEDLVKAASPGYPGHCLAKVAKALDKALVLGDLRVAYKFLFEDLCGGTVSEGWISKVSPCLRDFCSTPPRDIKFTGRKDLSQVHIAVRLLKMKIRDVKISQKQTNENHRASHLAKHSSQRHNWNYVGNVSRLRSSSKSTGSSVFESPGPLHDIVVCWIDQHVVQKGEGPKRLNLFMVELIRAGIFYPLAYVRQLIVSGIMDVNVNVVDLERQRRHYRILKQLPGCFIHDVLEESGIVEGSQLKEALQIYLNERRLILRGHLSVSCGSNLSALKKKKYPASTKDEVFAVPIDQRNVISTTISSKNAKDTNIEELRTAISVLLQLPNCSSNLSTTGDESEGSDRRAIGSPYGKIDPVEGTPGCEECSRAKRQRLSEERSTFVQGHSPVQSDDDDTWWVKKGMKSPEPLKVDQPQKSTKQVTKSRLKNVRKTQSLAQLAASRIEGSQGASTSHVCGNRVSCPHHKTAMDGDGQRSVDSIRTSHFGDIVSIGKALKQLRFVEKRAIAAWLLTVVRQVIEDVEKNIGKVGQFSKPFPVVDDRGSIQWKLGEDELSVILYLMDISDDLVSVVKFLLWLLPKVLNSPNSTIHSGRNVVMLPRNVENQVCDVGEAFLLSSLRRYENILVAADLIPEALSSAMHRVATVIASNGRVSGSGALAFARYLLRKYSNVASVIEWEKTFKTTSDARLSSELESGRSVDGELGLPLGVPAGVEDHDDFFRQKISGGRLPSRVGAGMRDIVQRNVEEAFHYLFGKDRKLFAAGTPKGPTLEKWDNGYQIAQQIVMGLIDCIRQTGGAAQEGDPSLVSSAVSAIVGSVGPTLAKMPDFSSGNSHSNTMPATNALNYARCILQMHIACLCLLKEALGERQSRVFDIALATEASNALAGVFSPSKASRSQFPMSPEAHDSSNTISNDMGSNSSKVVAKTTKIAAAVSALLVGAIIYGVTSLERMVTVLRLKEGLDVVQFVRSTRSNSNGNARSLMAFKVDNSIEVHVHWFRLLVGNCRTICEGLVVELLGEPSIMALSRMQHMLPLNLVFPPAYSIFAFVRWRPFILNATVREDMNQIYQSLTMAITDAIKHLPFRDVCFRDCQGLYDFMAADASDSEFATLLEFNGSDMHLRSTAFVPLRSRLFLNAMIDCKMPQSIYTKDDGSRMSGPGESKIKFTDSESKLQDMLVHVLDTLQPAKFHWQWVVLRLLLNEQALIEKLENRDVSLADAIKLSSPSTEKAAAASENEKNFIQILLTRLLVRPDAAPLFSELIHLFGRSLEDSMLSQAKWFLAGQDVLFGRKTIRQRLHNIAVKKNLSVKTQFWEPWGWCSLSTDPLTVKGDNKKFDSTSLEEGEVVEEGMDLKRCQLQVTERALIEMLLPCIDQSSDESRNSFASDMVKQLSYIEQQITAVTGGSKSVGSAPPGVEGQPNKVNNRKNMRGGSPALTRRQTVATDSSPPSPAALRASMSLRLQLLLRFLPILCTDREPSVRSMRQFLATVIFRLLGSRVVHEDVDISVNAVPSLSIREAESSSEVASAAFVDSSSGSLFDRLLLVLHGLLSSYPPSWLRAKPVSKTISEPTREISGIDRELLETLQNDLDRMQLPDTIRWHIQAAMPILIPSMRCSLSCQPPSISNSALVCLQPSITNPGSNSSSSTIPQRNPVLSRVASNASGKSKQQDNDLEIDPWTLLEDGTGSYSSAGNTASIGSGDHANIRATSWLKGAVRVRRTDLTYVGAVDDDG

SEQ ID NO: 167452 - protein, 367 aa, Glycine max
  Coding DNA Sequence Number=SeqID_75767
  Gene Ontology: Cellular component=nucleus; Biological process=meiotic telophase I
  Homolog annotation: Hit_ID=A9P914; Match level="QueryCoverage=86%, HitCoverage=93%, E-value=3e-47, Identity=36%"; Hit description =Putative uncharacterized protein
  Subcellular localization annotation: CTP_CleavageSite=74; ConfidenceScore=5.47e-01
MKINKACDLNSISVFPPPLVYPRKANNISSGLQASHSQHRSQPSQQSLSQGLSSQHGVLSHFSQNSLDEAVTTNDQRVGSQEHENSLRRISSLSRPTYSREESQAPNSRSSSNLMLKWNSADHKSQLSEGLEHRIGIMETSLSRFTMILDSVQSDVMQTKGQEEIKAIIERSLKSLAEQMSHVSKKEKLQDVYLAVSALPQLIEASLQNVRELHDLDIKSGQGIFLDFSEAKVSIQATVAPEVESGGWKPVKKERVTFSDRTSEKVQKKKEPHTQKYIRGGRDCAIVIESDEEIDGGFSCLVQENAGVNLLGNLTKEALEETERILRKARRRKRKTKNSNMDVILMPLSWLCRRNLILSDAEGKTPG

SEQ ID NO: 167453 - protein, 81 aa, Glycine max
  Coding DNA Sequence Number=SeqID_75768
MGTILYGIYIFQNSQIKLYTSNQNGKFEPVVLPSDDVMRGTLENSESKCSECWKKPRGGGLMVFLAARIYASYHKLIATAT

SEQ ID NO: 167454 - protein, 556 aa, Glycine max
  Coding DNA Sequence Number=SeqID_75769
  Gene Ontology: Mol. function=DNA binding; Cellular component =intracellular
  Homolog annotation: Hit_ID=Q2HUC6; Match level="QueryCoverage=77%, HitCoverage=63%, E-value=1e-105, Identity=48%"; Hit description =ELM2; AT-rich interaction region; Homeodomain-related
  Pfam annotation: Domain name=ELM2; Domain location=354-405; Score =20.5; E_value=0.00089; Accession=PF01448.15; Description=ELM2 domain
  Pfam annotation: Domain name=Myb_DNA-binding; Domain location=451 -501; Score=19.9; E_value=0.0094; Accession=PF00249.22; Description =Myb-like DNA-binding domain
  Pfam module annotation: Pfam domain module=ELM2::Myb_DNA-binding; Domain location=354-405::451-501
RWRVLSGCGEGDVAREEVKGRVDDDDDNVDGRKSCGDGNGGCLPDLEVPEGDMNESVIGSGGEGNEVDGGEGDRNGGYHDLEMPDREVNESVNGNSGEGNDAMEVGEEFDRGIMSKEQVVDVSDGVNYSVAGLLSGGQKCGGNDDKGLVLDPSGGDSDGRKRKRDMLDLSDGDSDSDSSDRKRMREFALDMLSWVTGAAKNPCDPEVGSIPEKAKWKSYSNQEVWKQVLLFRESAFLKEVLIQAVNNVAGRWQGKHDLYYEPFLLKAWMTYGSVSPFRRSQKMHPCLYEDHLGTNYNLRDRLKRDKKILVGQSTPSARSSSDSSVGAENRTPSPHTEDPSDANSGLDRCATVRIPLGANHQAEIPEWTGVISEGYSKFSGTPIWPLATANTRLLIERDPIGKGRQDSCGCPVPGSVECVRFHITEKRAKVHLELGAVFYDWNFDQVGEDVKLLWMEEEEKKFKDVIRSNPPSPETYFWDHIFRAFPTKSRADLVSYYFNVFILERRGYQNRHTPNNINSDDEDDEAGPLRNVFGQQTQNSRGSILLTPKKSQTKKK

SEQ ID NO: 167455 - protein, 211 aa, Glycine max
  Coding DNA Sequence Number=SeqID_75770
  Gene Ontology: Mol. function=tetracycline:hydrogen antiporter activity; Cellular component=integral to membrane; Biological process=response to antibiotic
  Homolog annotation: Hit_ID=Q9HWJ4; Match level="QueryCoverage=85%, HitCoverage=40%, E-value=1e-61, Identity=66%"; Hit description =Probable major facilitator superfamily (MFS) transporter
MAFVAIFWTCSVIPVFAVYAFAPKVLDALHLRGNWASYGSVAITLLFVVGCVIATRLINVLGRRKLLLHSFLWSGLALLLLGFLRDGPSAVILLMFGLYALFIGGAQVLQLVYPNEIFPTEIRAGAVGVGTSLSRIGAAVGTWLVPLSLQNIGIGPTMYIAAAITFFGLIVSWFMAPETNARSLEDASSLEEELPRNKVSMQGVMPKRHSL

SEQ ID NO: 167456 - protein, 106 aa, Glycine max
  Coding DNA Sequence Number=SeqID_75771
MALGLKRMLDMLVKKDMMEKIHLFFQRFWIGLMVFKPLLVKGLTLWNYKWACASMRWSQESPRSCHHKKGGDCRSKLHDESRLIQRSIDDNKGDDKKLKGQEHFMI

SEQ ID NO: 167457 - protein, 33 aa, Glycine max
  Coding DNA Sequence Number=SeqID_75772
MRERGGLGRRIGHCLDREIRNHMHAWQLKELGI

SEQ ID NO: 167458 - protein, 107 aa, Glycine max
  Coding DNA Sequence Number=SeqID_75773
  Homolog annotation: Hit_ID=A5C5C1; Match level="QueryCoverage=97%, HitCoverage=9%, E-value=4e-13, Identity=41%"; Hit description =Putative uncharacterized protein
MDALEIYLNEVERQLDKKVKVVRSDKDGEYYKTYNQTRQHLSLFAKLLHKRGICAQYTMPVVVRNNNEEEQHNNEPMIHNKPIVKEQQEVALKRSQREMRPTISKTM

SEQ ID NO: 167459 - protein, 238 aa, Glycine max
  Coding DNA Sequence Number=SeqID_75774
  Homolog annotation: Hit_ID=A5BEV8; Match level="QueryCoverage=86%, HitCoverage=27%, E-value=4e-10, Identity=26%"; Hit description =Putative uncharacterized protein
MDNWGTLVDCPFEQAFAESLQKFQIACSPWPMNALNEIVGEVKRLRYLGNDPSSCGCVMRSTLGLPCAWLCETEVSIKEEIETISKIFEELDVNTKGASKKLMKISQRSTKCDLSYWEYVDAFHFVQSNNSSVKCSALSSKPSKPTRIIPMLDQFVPFIQNFIHNVVDVKADDSWPLVCNELIKELGRWSHDYTNLFGGTERFEQLRLSLLVDGFSKVSVDKWMDITEMGYVIASQYN

SEQ ID NO: 167460 - protein, 91 aa, Glycine max
  Coding DNA Sequence Number=SeqID_75775
  Homolog annotation: Hit_ID=A5BP71; Match level="QueryCoverage=82%, HitCoverage=19%, E-value=4e-11, Identity=46%"; Hit description =Putative uncharacterized protein
  Pfam annotation: Domain name=zf-CCHC; Domain location=64-81; Score =22.2; E_value=0.00065; Accession=PF00098.14; Description=Zinc knuckle
MAIIVNAEAYSAQWWPLGNEAAIPPFDEAWTLIPDPTTIRAKGRPKSSRIRNEMDWVEPSDHRQKCSRCGAEGHNRRQCPMQSDRGSNSFN

SEQ ID NO: 167461 - protein, 64 aa, Glycine max
  Coding DNA Sequence Number=SeqID_75776
MGTIKCNDHGQIKAPMHPRSKCLDSLTTLVPHEWAIRQGKINMQQGQAVILIAKFPYLNYGVKT

SEQ ID NO: 167462 - protein, 154 aa, Glycine max
  Coding DNA Sequence Number=SeqID_75777
LCQSFEVPVAPTKVIRPPITRAFIEKYCTQRQAQGDAPQATGAPPPPHQAGPAGSFDMEQYLRHLVRQQAANHRAHVQTHDCLYQLSLSMQSQGFSSFSCPTPDQFRAEVAWPGDWPEAQVGEAPPEAPDDGEEAHEDEEMADLLDFLGGSGAT

SEQ ID NO: 167463 - protein, 106 aa, Glycine max
  Coding DNA Sequence Number=SeqID_75778
MGNSACQRACPAIDEGRRRHVSLYVLAGFSLTDSKECLYGKPLGISARFSSYRQQKVYTDNHSGISARQRDSKVSMTDLVSAEDDVNLRVSTGLSAAIDEGRRRRR

SEQ ID NO: 167464 - protein, 54 aa, Glycine max
  Coding DNA Sequence Number=SeqID_75779
MFAYSPLAKRIFCHVLSGESQALSAQPSHLKLIWSTKLAKAKLSPFRFNLNPAK

SEQ ID NO: 167465 - protein, 25 aa, Glycine max
  Coding DNA Sequence Number=SeqID_75780
VFRKLRMQIPEEGLPEVVIPDLPPS

SEQ ID NO: 167466 - protein, 275 aa, Glycine max
  Coding DNA Sequence Number=SeqID_75781
  Homolog annotation: Hit_ID=Q5XM22; Match level="QueryCoverage=35%, HitCoverage=54%, E-value=3e-18, Identity=50%"; Hit description =Resistance-like protein HAAS-2
MLVELLMVTVEAATAETAQCRGPYVLLQWVRDIYERRCQAEHWTAAAHTFLLHLLGCTLFANKSATNVHVVFLETLRDLSQTRRYAWGVVMLVHMYNHLNDASISTSRQLSGYITMLQRESCGSLDTPRSFLLRLPIHGCRLMIYMTGGCTIRTIWLQQVTAALCQGSVSATTWTGSFALCQGSEPSDPRANGHATQPRVATQDPDTDICPITKPAAPSTSARSDVAEPRHAVEACHAIAERLESHLNPGVVTPSTSTHELIEECLRIIRSVTQN

SEQ ID NO: 167467 - protein, 115 aa, Glycine max
  Coding DNA Sequence Number=SeqID_75782
MENCTTHDSKLVGGGRKKGLNENAIHRAPKKAITTHDSKLVGRGRMNEKTQFMGLRKRVENRRIALSNNYAWFQTRGWRMHERKRNSWGSEKGLRMENCSKQSLCMAANSWVEDA

SEQ ID NO: 167468 - protein, 94 aa, Glycine max
  Coding DNA Sequence Number=SeqID_75783
MRGYRMVIRTFRQPGANEPVDAQRLTSSSAPFVILTEVRGKRPVDAQETNVVLSAPFVNHGRSGYCMVIPPFVTRANEPVDPQRLTSSSAPFVI

SEQ ID NO: 167469 - protein, 111 aa, Glycine max
  Coding DNA Sequence Number=SeqID_75784
MAFLGETSSQTIVNSSLGFIFPNESMIHNDSGVYFQTSTPVVIRVPNTCDFATLKTRIHNTLQLTDKQFLDEIYHRQPFTDTGCTIDELKDLIKQVTPQGIPPHGIHESQT

SEQ ID NO: 167470 - protein, 139 aa, Glycine max
  Coding DNA Sequence Number=SeqID_75785
WLPEFYANLYVPKDKEPKQVRVRGHLIKFYADSLNTFLETLVVVEQRGILPSYSKFARLRLDPQELAARLCLPGRGFVLNVEGLSWKLLRKDLTTLAQTWSVLSYSNLAPTSHTSNLNLDRDKFHSLLNPTPRGLDFQP

SEQ ID NO: 167471 - protein, 106 aa, Glycine max
  Coding DNA Sequence Number=SeqID_75786
MLPFDFRCVTETYGLCINIFLVFRHVLEFHKLPNDGCQAPHKDQRKVACHQAKIDSRSFDDNKDDDKKLKSQDHFMITKMMTFKNEFKIESRTLQGSRIKFKIQDS

SEQ ID NO: 167472 - protein, 155 aa, Glycine max
  Coding DNA Sequence Number=SeqID_75787
MDTLTAVSASCTEVAVFESGPLVEEEMDKRGPEDGCGFSGMLPEIAWEKIRAQIQWLGFALFVTKNKSGISCLRHQQALRRPTTPTLRSPSMMIPWWRLVARSSSVSRAATTSCIARERHLCARHHRCQPRQLGERVRVHPHRQLGHERRGDDVP

SEQ ID NO: 167473 - protein, 483 aa, Glycine max
  Coding DNA Sequence Number=SeqID_75788
  Gene Ontology: Mol. function=hydrolase activity, acting on carbon -nitrogen (but not peptide) bonds
  Homolog annotation: Hit_ID=A7Q5F6; Match level="QueryCoverage=100%, HitCoverage=88%, E-value=0.0, Identity=64%"; Hit description =Chromosome undetermined scaffold_53, whole genome shotgun sequence
  Pfam annotation: Domain name=Amidohydro_1; Domain location=34-456; Score=-10.3; E_value=3.4e-05; Accession=PF01979.11; Description =Amidohydrolase family
  Pfam annotation: Domain name=Amidohydro_3; Domain location=34-454; Score=283.2; E_value=5.4e-82; Accession=PF07969.2; Description =Amidohydrolase family
  Pfam module annotation: Pfam domain module=Amidohydro_1::Amidohydro _3; Domain location=34-456::34-454
MAVANGRVLCVGNRSFVQEFEGYGTQVLDLGGKVVVPGFIDSHVHFIDGGLQVKLRGVNKKEEFIRRIKDAAQSTKQGSWILGGGWNNDLWGGDLPAASWINDVTPNNPVWLSRVDGHMGLANSVALTLAGITNLTDDPRGGTILRTANGEPTGVLIDSARTLVTSQIPEDSVDDRREALHRASNLALTRGVTTVVDMGRYYPGFSTELSWDDFSVGHALSEWIYIGGVKAFADGSLGSNSALLYEPYVDDPDNYGLQVTELEALLNMTTESDLNGLQVAIHAIGDKANDLILDMYGLVASTNGMRDRRFRELQLCFQIEHAQQLAAGTPGRFGKQRVVASMQPDQLLDDADSTSKKLGKDRAEKESYLFRSLLNNNALVAFGSDWPVVDINPLSGIKTAMKRRPPNWQSAWIPSECISLDDAIKAYTISAARASFLDKDLGSLSPGKLADFVILSTDSWKDFAEDASANVEETYVSGVRAYP

SEQ ID NO: 167474 - protein, 580 aa, Glycine max
  Coding DNA Sequence Number=SeqID_75789
  Gene Ontology: Mol. function=ribonuclease activity; Cellular component=nucleolar ribonuclease P complex; Biological process=tRNA processing
  Homolog annotation: Hit_ID=A7NZ94; Match level="QueryCoverage=75%, HitCoverage=67%, E-value=1e-114, Identity=52%"; Hit description =Chromosome chr6 scaffold_3, whole genome shotgun sequence
  Pfam annotation: Domain name=RNase_P_p30; Domain location=95-245; Score=137.9; E_value=2.8e-38; Accession=PF01876.7; Description=RNase P subunit p30
MGYFDLNIPYPDPSPANKPTEQGNRTRLAVKAMEFGYTGIAYNRTIKGVMSDHHRCSISPLTLSSLLNVLPSLSLSANLHRHLLHVPLSTPFRQYTRLTVCVDSASQAQALNSGNPILKTYDLVAVKPLNQIAFDLACERMEVDIISIDFSAKLPFRLKQPMVKAATQRGVCFEVTYSGLFADIQIRRQLISSAKLLMDWTRGQNIVFSSAAPTVNELRGPCDVANLLSLFGLSKERANAAISKNCRILLANSLRKKRFYKETIRVEVLSSDAASHSKEDRYQELLKWDPISSGEGDILLDDMQKSSLVSCKASKPAKAIDFASVVKSLPSHGFEIKDILPANNAFPVCGDNKINFPPVAEKLSQSTHVPNNLTEKSNILVCPEQDENSVPDAITRGQILRCDNIFENNICSGTTDAVNLKETNTPAAIDSISVAEGLPSPGFHDKCNNEKSSDVNLNEQIGRICEALPNEDLKIAEQPVLELNTSISDTSMEDKRETDALELDEMKMEDDSTAAKHLLPDVIMKDKRLSEVSTDSDQFASVASIMKYISIISRWIESEAKDASGTTFIPLQAIAESNAF

SEQ ID NO: 167475 - protein, 99 aa, Glycine max
  Coding DNA Sequence Number=SeqID_75790
  Homolog annotation: Hit_ID=A5AH23; Match level="QueryCoverage=91%, HitCoverage=37%, E-value=2e-13, Identity=42%"; Hit description =Putative uncharacterized protein
MENEKGKSEQRRQQHMGNICHRCGCKDHCSSACQTPRHLVEQYQESLKTKEKQIKTHFGYEEGDFRYGLMDVTHLNIADFFADPDGKIDHLIGDGSVKK

SEQ ID NO: 167476 - protein, 338 aa, Glycine max
  Coding DNA Sequence Number=SeqID_75791
  Gene Ontology: Mol. function=ARF GTPase activator activity; Cellular component=plasma membrane; Biological process=regulation of ARF GTPase activity
  Homolog annotation: Hit_ID=Q8L7A4; Match level="QueryCoverage=96%, HitCoverage=81%, E-value=1e-121, Identity=68%"; Hit description =Putative GTPase-activating protein
  Pfam annotation: Domain name=ArfGap; Domain location=2-109; Score =83.8; E_value=5.5e-22; Accession=PF01412.9; Description=Putative GTPase activating protein for Arf
  Pfam annotation: Domain name=C2; Domain location=184-263; Score =108.0; E_value=2.8e-29; Accession=PF00168.21; Description=C2 domain
  Pfam module annotation: Pfam domain module=ArfGap::C2; Domain location=2-109::184-263
MAIIDVINLFNIRSSSLGVFICIKCSGIHRSLGVHISKVLSLKLDEWTDEQVDALAKLGGNTLLNKKYEACLPSNIRKPKPHSSIEERSEFIRRKYEMQQFVDCDDNLSCPIIPSQGRSISLALAQSSTSYYNSFMDKKPSEKQQSKHRIGNAFRNSWGRKDSEHKAAKKSTSLAGMVEFVGLIKVNVVKGTHLAIRDVMTSDPYVILSLGHQSVKTRVIKSNLNPVWNESLMLSIPENIPPLKVLVYDKDTFSTDDFMGEAEIDIQPLVIAAKAYEKSNINESMQLGKFVASNDNTLVRDGIISLDEGKIKQEISVRLQNIERGELELELECVPLTQ

SEQ ID NO: 167477 - protein, 649 aa, Glycine max
  Coding DNA Sequence Number=SeqID_75792
  Gene Ontology: Mol. function=sulfotransferase activity; Cellular component=cytoplasm; Biological process=postreplication repair
  Homolog annotation: Hit_ID=A4Q377; Match level="QueryCoverage=67%, HitCoverage=74%, E-value=2e-64, Identity=44%"; Hit description=WD40 -like
  Pfam annotation: Domain name=Sulfotransfer_1; Domain location=1-146; Score=70.8; E_value=4.7e-18; Accession=PF00685.18; Description =Sulfotransferase domain
  Pfam annotation: Domain name=WD40; Domain location=284-322; Score =7.2; E_value=4.1; Accession=PF00400.23; Description=WD domain, G -beta repeat
  Pfam annotation: Domain name=WD40; Domain location=326-364; Score =25.1; E_value=0.00026; Accession=PF00400.23; Description=WD domain, G-beta repeat
  Pfam annotation: Domain name=WD40; Domain location=368-403; Score =9.6; E_value=2.1; Accession=PF00400.23; Description=WD domain, G -beta repeat
  Pfam module annotation: Pfam domain module=Sulfotransfer _1::WD40::WD40::WD40; Domain location=1-146::284-322::326-364::368-403
MSLPALTMEEAFEKYCNGIMDYGPWWSHMLGYWNESIANPNKVLFLKYEDLKEDTNFHVKRIAEFLGCPFTQKEESSGVIQSIIKLCSFENMKDLEVNKSGKIGRGGIEKKDFFRKGEKGDWVNYFTPSMQEKLSAIVEEKLSGSVTMMYNDPQQQQQQHQYQQQQQQQHFHHQPPGPEFHRGPLPPSLPPPVMRQGSASSTNLAPEFHHPGPGGPPPPHYDVGEWNEGGVDCELELWTGTLGLKGFGECIAYDLSWMGETEKCFREIFGSKVVTRLEDKCSSDEKLSMLRWSIHWRERLEWTPTGRRLITGSQTGEFTLWNGQSFNFEMILQAHDQAIRSMVWSHNDNWMVSGDDGGAIKYWQNNMNNVKANKSAHKESVRDLRTDLKFCSCSDDTTVKVWDFARCQEECSLTGGKEREGELNRMDWWQHWNGDGDERIMEKEERENGYLEEGVTEEGGSSDHTTKFWCRNRPGDPARDRFNTGMQGYAEQSPVAGRTGGNFPIAEGPTTPGPFAPGLTRNEGTIPGVGVAMPLSIPSLDMPQGEQKQPHPVSMGAPPLPPGPHPSLINANQQQPYQQNPQQMPQHQHQALPQQMGSLPMPPNMQQLQHPSHSPFPNMPRPPPQMPIGMPGSIPGISSVPTSHPMPMP

SEQ ID NO: 167478 - protein, 135 aa, Glycine max
  Coding DNA Sequence Number=SeqID_75793
  Gene Ontology: Mol. function=transporter activity; Cellular component= membrane; Biological process=oligopeptide transport
  Homolog annotation: Hit_ID=A7Q5G1; Match level="QueryCoverage=62%, HitCoverage=14%, E-value=8e-29, Identity=75%"; Hit description =Chromosome undetermined scaffold_53, whole genome shotgun sequence
MADGSSSNTKRNSLILHHPTNLKGGWNAAIFIIFVEFAERFAYQGLASNLIQYLTNVLNEPITQAAKDVNTWVGASSLFPLLGGFIADSYLGRFNTILLSSVIYFAIMNNTIVGSLSINYTCNEKREKVEDNPNP

SEQ ID NO: 167479 - protein, 418 aa, Glycine max
  Coding DNA Sequence Number=SeqID_75794
  Homolog annotation: Hit_ID=A7PWC2; Match level="QueryCoverage=18%, HitCoverage=23%, E-value=6e-11, Identity=40%"; Hit description =Chromosome chr8 scaffold_34, whole genome shotgun sequence
  Pfam annotation: Domain name=PHD; Domain location=36-89; Score=11.5; E_value=0.00059; Accession=PF00628.20; Description=PHD-finger
MRRKSRGKRRRAASATTLSPSSLSAIPILWDAYDTICIHCNNKGEEAKEDGLLICSGRGCPVAVHATCLATGPKFDGSGNFCCPYCWYKRAVDTCRRLREKALEAKGDLSRFLDNHDHARAAAHVDLVVQDSEELMEETGTQAQSKDNKDEEGEARVNQVHDREETETEPEGNKEKEGKVRDNEELVEERERKTVTEAQSQENKAEEDKFQDDSEELVVETETETEVQCEENKEEGKVRDSEEHVEEMETETGAEAQPEEKKDEGKVRDSEKLVEETQTETEGQSEEKKDEEGKVAVMSSSVSETYDSDSVAVSMKKRKDKKKKVTSARKSLSLQQEHKNKHYKTRGKVANEEEVTSFKTTSLGQQPQRMKQSSLAAKRKRLLWTAEEEKVLKLKFNQGYGGSGMEVLIISAQENRPE

SEQ ID NO: 167480 - protein, 34 aa, Glycine max
  Coding DNA Sequence Number=SeqID_75795
MTNKAKGKGKEVAGKGSAGKHKAPSTMTRPALFE

SEQ ID NO: 167481 - protein, 83 aa, Glycine max
  Coding DNA Sequence Number=SeqID_75796
  Subcellular localization annotation: CTP_CleavageSite=36; ConfidenceScore=5.13e-01
MGLGIRFVGGGYTNSATQSVRGTLDSMTNSARQSIRGASDFDGGGCMIDNQFKGFRIRFVSGGYANSARQPVRGAPVSMVEDA

SEQ ID NO: 167482 - protein, 44 aa, Glycine max
  Coding DNA Sequence Number=SeqID_75797
MGAKHLTRTKERSHVIKQRSPDEIRGKFCIEPYALLESKQGIRR

SEQ ID NO: 167483 - protein, 124 aa, Glycine max
  Coding DNA Sequence Number=SeqID_75798
  Subcellular localization annotation: CTP_CleavageSite=74; ConfidenceScore=5.10e-01
MATTWTPLKTVPSGVANCRNLPFGGRGDAGLTGASSKKGKCEESPPTFIRGQCQKNRNVWSTNFNRERFGSCIYARGRRETLRRWTINDLLVFESREMLRRWTINDLWVVDKSGAFPPTYPQLR

SEQ ID NO: 167484 - protein, 116 aa, Glycine max
  Coding DNA Sequence Number=SeqID_75799
MASRKRKTTASRPQEPYDMTRFISEYDEFRWELKRHRWHKALTRQPNGRIDVAPVKEFYANLFDPKDKSPRQVRVQGRLIKFYRETVNAFLETPVVLEPGECYTAYSRFCSTHPDP

SEQ ID NO: 167485 - protein, 150 aa, Glycine max
  Coding DNA Sequence Number=SeqID_75800
MGEVEEVQEQMKTDMEAMKEQMATMMEAMMSIKGIMEVNAVAIATTNTVVEVDLTPPYGLNQINHPTSDMVGLEGKELGGAGDPYLVRKTSMPSHHMACLLTIRHPMWRTLPMRMSITPLLYSWRAKNLNLIMHMSLDPLGRHMKCPTII

SEQ ID NO: 167486 - protein, 107 aa, Glycine max
  Coding DNA Sequence Number=SeqID_75801
KYCTPKQAQGEAPQQLGDDQQRATGALSPPLESTSTHLQRLERYLRLVANQQATKSKAKEEAPLKRVPVWPHKPTQALANTDFRAWNISSISRPSRDGHSSDRDMGS

SEQ ID NO: 167487 - protein, 72 aa, Glycine max
  Coding DNA Sequence Number=SeqID_75802
  Homolog annotation: Hit_ID=Q5NRP4; Match level="QueryCoverage=75%, HitCoverage=3%, E-value=4e-08, Identity=52%"; Hit description =Putative gag-pol polyprotein, identical
MCYLGNLGNMIEMLSTMGSPIIILSCIKVKSAFELPQGFDTPLKEFEDVFPQDIPHGLPPLRGIEHQINLVS

SEQ ID NO: 167488 - protein, 49 aa, Glycine max
  Coding DNA Sequence Number=SeqID_75803
MGQQSRDRAEERAHGGIVHRDGDVVTLGDGAQWWLNGTPWARAEADAVV

SEQ ID NO: 167489 - protein, 85 aa, Glycine max
  Coding DNA Sequence Number=SeqID_75804
MASEKAVGWLMSLDIGDHRPHDRAYLQVLLILQLPVYPTDCGHKYWNIALQVRSGRHGAIHITIDIKHSKVYKVSTTYLNQNETL

SEQ ID NO: 167490 - protein, 145 aa, Glycine max
  Coding DNA Sequence Number=SeqID_75805
  Homolog annotation: Hit_ID=A5C995; Match level="QueryCoverage=68%, HitCoverage=6%, E-value=8e-10, Identity=38%"; Hit description =Putative uncharacterized protein
MTRGNPSDLQPFDPEIDRTFHRLVRHHLVPFEHPEHSVIGDFEHYSFEHSENMTQPPPRERTLREMAAPDFTYESLCIQYPDEDVPYVLKTGLIHLLPKFHGLASEDPHKHLKEFHIVCSTMKPPDVKEDHIFLKAFPHSLEGVA

SEQ ID NO: 167491 - protein, 104 aa, Glycine max
  Coding DNA Sequence Number=SeqID_75806
MYIKYGSKYIMKHGQQNMLSNETKTPTLIPKTIPKLQNSLRIWKGKQGSKGLSKELSQGKSIWLEAYKNKIASIISKYACELGSINKNQAKAIVQAINRAKHTK

SEQ ID NO: 167492 - protein, 144 aa, Glycine max
  Coding DNA Sequence Number=SeqID_75807
ERKDIELVDEEEAQIGADRSSETSNKCEIYKEEARNAAQKHKAKRAESVNADVEAFAEALEHMKKRDTGHQSVSLENKTGDSTVLKIGDSAKVVIKQDMKGRKHKYGFNNNKREKPEKVRVVDDETGDKHELYEVLRMPSKTKY

SEQ ID NO: 167493 - protein, 102 aa, Glycine max
  Coding DNA Sequence Number=SeqID_75808
MTWKYDLFIDVGNALACACCVCSWGALCTDLSGSLALAFGHVHTLDVVYDRGGHCALTLSDGPYGAVTWVGNTFWAPRADHLWEGGCYVHKPGGLDKLSTVP

SEQ ID NO: 167494 - protein, 202 aa, Glycine max
  Coding DNA Sequence Number=SeqID_75809
  Homolog annotation: Hit_ID=A5C4I3; Match level="QueryCoverage=23%, HitCoverage=19%, E-value=3e-14, Identity=81%"; Hit description =Putative uncharacterized protein
MAARALGVPRHLRAPGVGLWAPHSARLETRTKESDMCASQRASKPVRRKEADWWDPPHTCRDPKDGELCLSGAKPEETLVEARSDTDVQIDSWSPRASSIGWVYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 167495 - protein, 74 aa, Glycine max
  Coding DNA Sequence Number=SeqID_75810
  Homolog annotation: Hit_ID=A5AYJ3; Match level="QueryCoverage=66%, HitCoverage=3%, E-value=1e-10, Identity=63%"; Hit description =Putative uncharacterized protein
MQKGNCSITSSSDTIISDSLSMGTNLQLVIQKLNGKNYVEWAQSVKLALDGKGKLGYLMGDTSQPGVTGPFLPR

SEQ ID NO: 167496 - protein, 73 aa, Glycine max
  Coding DNA Sequence Number=SeqID_75811
MAEEHDQRITLEDYSSSSVPQFITSIARPEVQANNINYPHSLIHLIQGNLFQGLPNEDPYAHLTTFFFLYVTL

SEQ ID NO: 167497 - protein, 60 aa, Glycine max
  Coding DNA Sequence Number=SeqID_75812
  Subcellular localization annotation: CTP_CleavageSite=45; ConfidenceScore=5.67e-01
MTGRPTITTNSNTVNRGSTNPTRSGNVSNNKNTSDGRPKVPSRVFAMSGSETAAFDDLIQ

SEQ ID NO: 167498 - protein, 381 aa, Glycine max
  Coding DNA Sequence Number=SeqID_75813
  Gene Ontology: Mol. function=protein transporter activity; Cellular component=integral to membrane; Biological process=bacteriocin transport
  Homolog annotation: Hit_ID=A7FCX8; Match level="QueryCoverage=99%, HitCoverage=88%, E-value=1e-128, Identity=59%"; Hit description =Auxiliary transport protein, membrane fusion protein (MFP) family
  Pfam annotation: Domain name=HlyD; Domain location=20-354; Score =48.4; E_value=2.5e-11; Accession=PF00529.11; Description=HlyD family secretion protein
MGGHYTRRINVYGEITTFPRSVNVFAPQQGFISERFVEVGDVVKKGQRLYQIDVSRVTDNGKVSANTRLALENQLKHVDSIILKLQDNKRMTLENLRAQKKQYELAHMQSKQLLDNAREGVAFAQDNMRSYKEYQQRGLITKDQLSGQTYSFYQQQSLFQNLHSQHIQESLQITNLESDIVTRAADFDNQISQYQFQRNDLQRQLAEADASGALIVNAPSDGRIESLSVTPGQMVNSGDSLVQIIPRNGAIYQLVLWLPNASVPYVSAGDAINIRYDAFPYEKFGQFPGRIESIAYVPASMQEMSTYSSSPVHQPNAQTASYYKVTVSLDETHISYQGKALQLTNGMRAQSTLFLEKRPLYQWMFSPFYDMKNSLMGPIND

SEQ ID NO: 167499 - protein, 171 aa, Glycine max; identical to SEQ ID NO: 132608
  Coding DNA Sequence Number=SeqID_75814
  Gene Ontology: Cellular component=mitochondrion
  Homolog annotation: Hit_ID=O63700; Match level="QueryCoverage=57%, HitCoverage=35%, E-value=9e-07, Identity=38%"; Hit description =Putative uncharacterized protein

SEQ ID NO: 167500 - protein, 149 aa, Glycine max
  Coding DNA Sequence Number=SeqID_75815
MFPFDSRHVAELNGLPNDGCQVPRSGQVKGKAINSWGSRYDGGGCMNSARQSIHGAPDSMAINSSGSELDDGGCMNSARQSIHGAPDLMVENVRTAQGNQFMGIRTQWWRMHEQRLAINSWGSRLDDGGCTNSARQSIRGAPDLMAEDA

SEQ ID NO: 167501 - protein, 98 aa, Glycine max
  Coding DNA Sequence Number=SeqID_75816
MSISPYGRIVPTRHPVDPEKSNRSLRFPALVTGLCQSYRVPVTPARSCHRDIGIAPARPPVDPEKSNRVLGFSALITSLCQFYGVFVAPNKVIKPPVN

SEQ ID NO: 167502 - protein, 113 aa, Glycine max
  Coding DNA Sequence Number=SeqID_75817
MATPMSTTCYLDKDEAGESVDIKKYRGMIESLLYLLISSQSQIISPKHYDEDMTKSKGKDPLEGLGGPMTRARARKAKEALQQVLSILFEYKPKFQGEKFKVVSCIMAQMEED

SEQ ID NO: 167503 - protein, 194 aa, Glycine max
  Coding DNA Sequence Number=SeqID_75818
  Gene Ontology: Mol. function=oxidoreductase activity; Cellular component=chloroplast; Biological process=metabolic process
  Homolog annotation: Hit_ID=P76149; Match level="QueryCoverage=86%, HitCoverage=36%, E-value=1e-61, Identity=68%"; Hit description =Aldehyde dehydrogenase-like protein yneI
  Pfam annotation: Domain name=Aldedh; Domain location=1-189; Score= -133.7; E_value=2.2e-08; Accession=PF00171.13; Description=Aldehyde dehydrogenase family
MAAKRFIIEESIAEAFEARFSAAVQALKVGDPLQEETYIGPMARYDLRDELDHQVQETLQQGARLVLGGHKIEGVGNYYAPTILADVTPAMTAFRQEIFGPVAAITVARDAQHALQLANDSEFGLSATVWSGNEALAQELAEQLETGAVFINGNGASDPRVAIGGVKKSGYGRELSSFGVHEFCNIQTVWKNRR

SEQ ID NO: 167504 - protein, 179 aa, Glycine max
  Coding DNA Sequence Number=SeqID_75819
RIPLVRTSSELTVRRPGKRPRRARSQSVPRPARDDPLSPRKQLEQSTDSRRVRDWDPRAQPSEPILFPRGCSPWRPDAVMSTTGRGRHSVLRIFKGRRGRTGHHATCGALPAAGPYLRLSRFQGGQAVKQKRYSFRGPADVSDSLTLPSARHVPGSGILTRFPFGVRAQSAIRRASPVP

SEQ ID NO: 167505 - protein, 84 aa, Glycine max
  Coding DNA Sequence Number=SeqID_75820
MDSLMGWNLKDWRSYGGWVRDMEIVPCLDENNLVVGATREEYVTGFPWKNESFGFEERVVVAMAAIVSDDDIWIKRKESRGQES

SEQ ID NO: 167506 - protein, 417 aa, Glycine max
  Coding DNA Sequence Number=SeqID_75821
  Homolog annotation: Hit_ID=A5B5G7; Match level="QueryCoverage=48%, HitCoverage=14%, E-value=7e-12, Identity=28%"; Hit description =Putative uncharacterized protein
MASRKRRAVPTPGEASNWDISRFTSEIAWHRYQDNIQLRNILPERNVELGPGMFDEFLQELRRRRWDQVLTHLPEKRIDVALVKEFYSNLYDPEDHSPRFCMVRGQVVRFDADTINDFLDTPVILEDGEEYTTYTRYLSTHPDPDTIAATLCTPGGRFVLNADGLPWKLLRKDMTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPGPHRTRTRASASAFEAPLPTQSPSQPSQRPRHPPASTAASMDMHGQMLRSLHVGQQLIMENMHRLSLHLQMDPPLTTPEAYRQRVAWPGDQPSTDRGEEPSGAAEDPAVDEDLIADLATADWGPWADLGGGS

SEQ ID NO: 167507 - protein, 312 aa, Glycine max
  Coding DNA Sequence Number=SeqID_75822
  Gene Ontology: Mol. function=protein serine/threonine kinase activity; Cellular component=integral to membrane; Biological process=protein amino acid phosphorylation
  Homolog annotation: Hit_ID=A7R7S6; Match level="QueryCoverage=77%, HitCoverage=31%, E-value=2e-55, Identity=47%"; Hit description =Chromosome undetermined scaffold_1996, whole genome shotgun sequence
  Pfam annotation: Domain name=DUF26; Domain location=196-250; Score =71.9; E_value=2.2e-18; Accession=PF01657.8; Description=Domain of unknown function DUF26
  Pfam annotation: Domain name=DUF26; Domain location=77-133; Score =54.8; E_value=2.9e-13; Accession=PF01657.8; Description=Domain of unknown function DUF26
  Pfam module annotation: Pfam domain module=DUF26::DUF26; Domain location=196-250::77-133
MVTQRASFYLCLLVILITQATAEPDDQYPVCLSRGGDYAPNSTYHTNLNTVLSRLTSNTQIDYGFYNSSYGQDSDRVYATGLCRGDVSRHTCLTCLNNSSFFLLKNCPHQKEAVGFGGYDKCILHYADQSMFSYQDSSFRFYFWEETNVTNWDQYSYVLNQLLSRLRVKAATSNSNLNRKFAAGNATVPTPSSQTIYAVVQCYPDLTAAECNDCLIGAFSEIPKNCNNRSGCGVTILSCNFRYENSSFYEPTPDTITLQFSPQGSPSPTPSITSNSSESTYHGIYYYSMVTSTILIPKLNPSPTNVYLVHHK

SEQ ID NO: 167508 - protein, 164 aa, Glycine max
  Coding DNA Sequence Number=SeqID_75823
  Gene Ontology: Mol. function=protein serine/threonine kinase activity; Cellular component=integral to membrane; Biological process=protein amino acid phosphorylation
  Homolog annotation: Hit_ID=Q9XED4; Match level="QueryCoverage=100%, HitCoverage=23%, E-value=1e-63, Identity=73%"; Hit description =Receptor-like protein kinase homolog RK20-1
MAPEYAMHGQFSVKSDVFSFGVLVLEIVSGQKNSGISNGENMEDLLSFAWRNWKEGTAINIVDPSLNNNSRNEMMRSIHIGLLCVQENLADRPTMANIILMLNSYSLSLPIPAEPAFYMNSRTQSRPDMQSWEYNSRETGTSEPILKSAQESENEASITELYPR

SEQ ID NO: 167509 - protein, 724 aa, Glycine max
  Coding DNA Sequence Number=SeqID_75824
  Gene Ontology: Mol. function=protein serine/threonine kinase activity; Cellular component=integral to membrane; Biological process=protein amino acid phosphorylation
  Homolog annotation: Hit_ID=A7R7S6; Match level="QueryCoverage=95%, HitCoverage=70%, E-value=2e-58, Identity=55%"; Hit description =Chromosome undetermined scaffold_1996, whole genome shotgun sequence
  Pfam annotation: Domain name=DUF26; Domain location=203-257; Score =62.9; E_value=1.1e-15; Accession=PF01657.8; Description=Domain of unknown function DUF26
  Pfam annotation: Domain name=DUF26; Domain location=334-390; Score =88.9; E_value=1.7e-23; Accession=PF01657.8; Description=Domain of unknown function DUF26
  Pfam annotation: Domain name=DUF26; Domain location=449-503; Score =70.8; E_value=4.6e-18; Accession=PF01657.8; Description=Domain of unknown function DUF26
  Pfam annotation: Domain name=DUF26; Domain location=87-144; Score =84.3; E_value=4e-22; Accession=PF01657.8; Description=Domain of unknown function DUF26
  Pfam module annotation: Pfam domain module=DUF26::DUF26::DUF26::DUF26; Domain location=203-257::334-390::449-503::87-144
MAVLSLRSLSFVCCLLLITNFTTQASADNSPQNFFYFCDDHNNGRGNYTVNSTYDTNLNTVLSTLTSNTEIDYGFYNFTYGENTDKVYAIGLCRGDVKPDECRNCLQHSRANLTQQLCRNRKEAIGWYEDEKCMLRYSDRSIFNLNEIGPAYFMWSMLNATQVDQFNKVVKDLLDGLKTKAKSGDSQSKYATASVSGPDNRTIYGLVQCTPNLSGPQCDDCLVQSIKEVSHCCNSRLGVRIVRPSCNLRFETASLFYGTPAYPPSPSPSPSPSQPLLMPPPSSTVTNNNSSGGNYTANSTYHTNLNTLLSTLTSNTEIEYGFYNSSQGENTDKVYAIGLCRGDIKPDECRNCLNGSRANLTELCPNQKEAIGWYEDEKCMLRYSDRSILDLMETGPAFYANNMDNATDLDQFNKDVNTLLGNLKNEAALGDSRLKYAVGNTSGPDNKLIYGLVQCTPDLSGSECFDCLSQSIERIPIDCCKDRKGGRVVRPSCNMRFETSFLFYGDTAYVSPTPPSSTTTNTTSEDDLNKAYKERINLTYIPFFGNIPDLQNMLIFYYLNRWNVQLRILTCAVKSNKATIIAIAIAVPVVVFFAVVLIFFFICIRMRKPGEKFEAQQETYDDDDDNEIDISESLQFSFNTIGEATNDFSDSNKLGQGGFGAVYKLVHTPILLCSGYMAPEYAMHGQFSEKSDVFSFGVLVLEVVSGQRNSGIRHGENIDDLLSF

SEQ ID NO: 167510 - protein, 562 aa, Glycine max
  Coding DNA Sequence Number=SeqID_75825
  Gene Ontology: Mol. function=hydrolase activity, hydrolyzing O -glycosyl compounds; Cellular component=extracellular region; Biological process=cell wall organization and biogenesis
  Homolog annotation: Hit_ID=A7QH23; Match level="QueryCoverage=48%, HitCoverage=93%, E-value=1e-141, Identity=84%"; Hit description =Chromosome chr3 scaffold_95, whole genome shotgun sequence
  Pfam annotation: Domain name=Glyco_hydro_16; Domain location=34-215; Score=307.3; E_value=3e-89; Accession=PF00722.12; Description =Glycosyl hydrolases family 16
  Pfam annotation: Domain name=XET_C; Domain location=239-285; Score =52.7; E_value=1.2e-12; Accession=PF06955.3; Description=Xyloglucan endo-transglycosylase (XET
  Pfam module annotation: Pfam domain module=Glyco_hydro_16::XET_C; Domain location=34-215::239-285
  Subcellular localization annotation: CTP_CleavageSite=48; ConfidenceScore=5.07e-01
MKNCPTALLIFFIGFVSSSLFQVSVASIVSTGDFNKDFFLIWSPTHVNTSADGHARSLKLDQESGSGFASNQMFLFGQIDMQIKLVPGDSAGTVLAYYLTSDQPNRDEIDFEFLGNVSGQPYILQTNIFADGTDNREERIYLWFDPTKDFHTYSVLWNMHQIVLMVDMIPIRVYRNHADKGVAFPRWQPMSLKATLWNGDSWATRGGQDKIDWTKGPFIASFRNYKIDACVWKGNPRFCRAASPTNWWNQYSSSTLTSTQRRWFKWVRKYHMIYDYCQDNERNKGEEKAQGSSINRESETELSSLNLKPYSPLPPNHLLSTVAVVAFAVGRLHHVTSTSGRRVGRSQDFETADKRQQDMAERSKELLKFEHNGTPLSSLESTLLVCDNKKESDSQTRRLPPDGMLLTAPLPPSQLLGKVKDFLGVMSEANKRLELDAKDNPENYDIEELTGNESEVIEMDLMLGVADLHTQEAVAAAESAISTCQSVIPLAADGSETDSEESSTDNDSDDDINNSDDYLDDGNNSEKPSSLVQKSISSKDNIHGKTKGNGHSKKRPRIVELS

SEQ ID NO: 167511 - protein, 80 aa, Glycine max
  Coding DNA Sequence Number=SeqID_75826
  Subcellular localization annotation: CTP_CleavageSite=73; ConfidenceScore=5.38e-01
MKKQVSRLADRAMLQIVTNRTHQFFPAGASSANSSSNSNPLPPTIQNFMFHDGSMMRHHGFDYGRSAASLVHVCDMVSTD

SEQ ID NO: 167512 - protein, 315 aa, Glycine max
  Coding DNA Sequence Number=SeqID_75827
  Gene Ontology: Mol. function=DNA-directed RNA polymerase activity; Biological process=transcription
  Homolog annotation: Hit_ID=A5C7H5; Match level="QueryCoverage=64%, HitCoverage=29%, E-value=3e-56, Identity=56%"; Hit description =Putative uncharacterized protein
  Pfam annotation: Domain name=RNA_pol_Rpc82; Domain location=22-269; Score=81.6; E_value=2.6e-21; Accession=PF05645.4; Description=RNA polymerase III subunit RPC82
MKTKSIFGVGQENAVPTKVVRETLCKLLTARFVERCPAPEPVVSTSFKETTTRKRGAKSAKIFEAPETLEQRVVDAAVPGDVIRFSLAADTRCSVDRETNSDDAQMISVEEEVAKEGQILWRANFEEFIRHLRHKVLIENVRTQHDDGTATVLSAVLEATRSVQKKVKTENSVPLSLDTIITEVMKTDTGRTMTVDRIRASLVQLGCSPSMILEESYSIDLKKIIEPARNEEVESIVLKRYGTDGYRIFRLLAKDCCFHDTDQMFIVVVLVLFNTRGANCWKNCLNCGHTLAHLSCSLFGGCLKCNLEGGGLVPH

SEQ ID NO: 167513 - protein, 185 aa, Glycine max
  Coding DNA Sequence Number=SeqID_75828
MIAETEPFGSEENGEEEEKEGMVEICVPDRGSTHNRKGETNVEEKDVATEWLCVGPVTGSWEGVGGKCVVLVNGKVKSCHGKGRQRGFYCWWKQYGGIGGDFAKAEDGEGCLGTMIFSIRRMSSSLEAMEVWAAVVEVWIAASLVMAASRRSTQAVESSVSAIEEWQVGPIVSGGSLKFETKDNL

SEQ ID NO: 167514 - protein, 139 aa, Glycine max
  Coding DNA Sequence Number=SeqID_75829
CESSGILPDEPLLPESSRKTFSGSLPEEVFFRKTFGYFRKNTSSGNFPENVLPELPEEPLRGLPEDSSVSDFRHFFRRPLVFSPLVFYPSKWVQGLSEKLAEKKLVGEERREEAFCGRATVRKRENASGKKRNAFYIFN

SEQ ID NO: 167515 - protein, 178 aa, Glycine max
  Coding DNA Sequence Number=SeqID_75830
  Gene Ontology: Mol. function=cation transmembrane transporter activity; Cellular component=integral to membrane; Biological process=potassium ion transport
  Homolog annotation: Hit_ID=A9PGR8; Match level="QueryCoverage=80%, HitCoverage=71%, E-value=3e-80, Identity=97%"; Hit description =Putative uncharacterized protein
MVRALCIVLPIMRVSLGTTIRLLTFDLVAMTHKVQEHNHPHILLLQIGNTFCKLPGGRLKPGENEIEGLKRKLTSKLGANSPALVPDWQISECVAIWWRPNFETIMYPYCPPHITKPKECKKLFLVHLSEREYFAVPKNLKLLAVPLFELYDNVQRYGPVISTIPQQLSRFQFKMITN

SEQ ID NO: 167516 - protein, 97 aa, Glycine max
  Coding DNA Sequence Number=SeqID_75831
MDGCVVGFERTGEVFCNWQVVACEVSKLLLDHLFGLFLSQHPKAQDPSSNVNDSPLRFGLPLQIQNFNISNSFETTKFAFMFLSSFGRMTSKQSEAL

SEQ ID NO: 167517 - protein, 38 aa, Glycine max
  Coding DNA Sequence Number=SeqID_75832
MAGFDWRLGHDIVVVGVVDCGRDDKWLGTPQMGDRYHE

SEQ ID NO: 167518 - protein, 293 aa, Glycine max
  Coding DNA Sequence Number=SeqID_75833
  Gene Ontology: Mol. function=protein binding; Biological process =ubiquitin cycle
  Homolog annotation: Hit_ID=A7QVJ9; Match level="QueryCoverage=88%, HitCoverage=92%, E-value=1e-107, Identity=65%"; Hit description =Chromosome chr16 scaffold_189, whole genome shotgun sequence
  Pfam annotation: Domain name=F-box; Domain location=28-75; Score =26.6; E_value=9.3e-05; Accession=PF00646.24; Description=F-box domain
MGAGVSSCNKVEKEGGGSISSSSRDSRPGLGDIPESCISSLFMNLDPPDICKLARVNRAFHRASSADFVWESKLPPSYKFLANKVLGEENIATMTKKEIYAKLCLPNRFDGGTKEVWLDKCSGQVCLFMSSKSLKITGIDDRRYWNYIPTEESRFQSVAYLQQMWWVEVVGELEFEFPVGSYSLIFRLQLGKASKRLGRRVCNVDQVHGWDIKPIRFQLSTSDGQLSLSECYLCGPGEWVYYHVGDFVVEKPNEPINIKFSLAQIDCTHTKGGLCVDSAIICPTEFKERLKQS

SEQ ID NO: 167519 - protein, 275 aa, Glycine max
  Coding DNA Sequence Number=SeqID_75834
  Gene Ontology: Mol. function=serine-type endopeptidase activity; Cellular component=integral to membrane
  Homolog annotation: Hit_ID=A7QVI2; Match level="QueryCoverage=97%, HitCoverage=96%, E-value=5e-79, Identity=48%"; Hit description =Chromosome chr16 scaffold_189, whole genome shotgun sequence
  Pfam annotation: Domain name=Rhomboid; Domain location=111-249; Score= 72.6; E_value=1.3e-18; Accession=PF01694.13; Description=Rhomboid family
MARRDLESGGGVTKNNRSAEENYSAPESSHVYDSETHWTSWLVPMFVVANIAVFVITMYINNCPRNNIRFQGRCVARFLGRFSFQPMQENPLLGPSSSTLTKMGALRWDNVVNRHQGWRLVTCIWLHAGVIHLLANMLSLVFIGIRLEQQFGDHISVGASGALFGLLGAMLSELITNWTIYSNKAMALITLLVIIVINLGIGILPHRRLPAGVQMKSKYKTHQYVLGVVSLILLIAGLSTALVMLFRGEKGYDHCHWCRYLTCVPTSKWECSNDS

SEQ ID NO: 167520 - protein, 460 aa, Glycine max
  Coding DNA Sequence Number=SeqID_75835
  Gene Ontology: Mol. function=drug transporter activity; Cellular component=membrane; Biological process=multidrug transport
  Homolog annotation: Hit_ID=Q0WWD0; Match level="QueryCoverage=99%, HitCoverage=99%, E-value=1e-150, Identity=57%"; Hit description =Putative uncharacterized protein At4g25640
  Pfam annotation: Domain name=MatE; Domain location=233-396; Score =119.2; E_value=1.3e-32; Accession=PF01554.9; Description=MatE
  Pfam annotation: Domain name=MatE; Domain location=48-174; Score =62.4; E_value=1.5e-15; Accession=PF01554.9; Description=MatE
  Pfam module annotation: Pfam domain module=MatE::MatE; Domain location=233-396::48-174
MDAPLLLAKGEGAALVTENGDYVAVRELKEVKKVFWIETKRVWQIAMPIVFNIWCQFGVNSVTSMFVGHLGDIQLSAISLINSVIGTFAFGFMLGMGSATETLCGQAFGAGQFLGQQEDIADLAGSFSILVIPQFLSLPFNFPTQKFLQAQSKVNIIAWIGLVALILHIGMLWLLIYVLDFGLAGAALAFDITSWGITVAQLVYVVIWCKDGWTGLSWLAFKDIWAFVRLSLASAVMLCLEVWYMMSVIVLAGNLDNALVAVDSLSICMNINGWEAMLFIGVNAAVSVRVSNELGLGHPRAAKYSVYVTVFQSLFLGIFFMAIILATRDYYAIIFTNSEVLHKAVAKLGYLLAVTMVLNSVQPVVSGVAIGGGWQALVAYINIGCYYLFGLPLGFLLGYEANLGVEGLWGGMICGIVIQTLLLLLILYKTNWKKEVEQTTERMRIWGGQDIGVDKIVAST

SEQ ID NO: 167521 - protein, 250 aa, Glycine max
  Coding DNA Sequence Number=SeqID_75836
  Gene Ontology: Mol. function=P-P-bond-hydrolysis-driven protein transmembrane transporter activity; Cellular component=integral to membrane; Biological process=protein transport
  Homolog annotation: Hit_ID=A9PET0; Match level="QueryCoverage=91%, HitCoverage=90%, E-value=6e-67, Identity=61%"; Hit description =Putative uncharacterized protein
  Pfam annotation: Domain name=MttA_Hcf106; Domain location=77-189; Score=111.2; E_value=3e-30; Accession=PF02416.7; Description =mttAHcf106 family
  Subcellular localization annotation: CTP_CleavageSite=50; ConfidenceScore=5.25e-01
MASSSMLCPKLGSCAVSHTKFQAFHLSSMFSPLGRGLVSPWSGLKHLGISAKAKPLIHIDRKGGCKGKVVYASLFGVGAPEALVIGVVALLVFGPKGLAEVARNLGKTLRTFQPTIKELQDVSREFKSTLEREIGLDDNLSPTQNTYNSNIRNTTPTSSSTSTVDPNGTPDPTKAYSSEEYLKITEEQLKASAAQQQGQTPSKEGDNEPQIQPSAEETATTVPPPQKPEMGSTIGTRDEKGQAILLPASH

SEQ ID NO: 167522 - protein, 121 aa, Glycine max
  Coding DNA Sequence Number=SeqID_75837
MKNKDKMDGLMKMSSFEVITSKKMHSFSDKASLYWQAMVIGSAMLVSPRSYSDLTQAQVSQANQRQFNVQAPIQVENCFSEQISNRAPLSWHVNCHYFGSFLPKVSISNMPRESCPLAALA

SEQ ID NO: 167523 - protein, 316 aa, Glycine max
  Coding DNA Sequence Number=SeqID_75838
  Gene Ontology: Mol. function=catalytic activity; Cellular component =nucleus; Biological process=regulation of transcription
  Homolog annotation: Hit_ID=A7PY71; Match level="QueryCoverage=84%, HitCoverage=77%, E-value=2e-61, Identity=51%"; Hit description =Chromosome chr15 scaffold_37, whole genome shotgun sequence
  Pfam annotation: Domain name=TCP; Domain location=58-256; Score =149.9; E_value=7e-42; Accession=PF03634.4; Description=TCP family transcription factor
MEVNPTHDGGDDTSETPLPPMVDPSPSPSPQMKEEVMDAEQGGDVSLPMSVVPASLTVSTEAAAKRSSKDRHTKVEGRGRRIRMPATCAARIFQLTRELGHKSDGETIRWLLEHAEPAIIEATGTGTIPAIAVSVGGTLKIPTSSEARAQGEEDTPKKRRRRALKSEFINLNENQVSVSSGLAPIAQSSAYGSGGGGLVPLWHGNGAAAGPFFVFPNASNPPQYWAIPATAAPFFNVQARPISGFVSALQMQHDNHHHSLINAAASGSVKSSSTVSVTSSAASTQMLKDFSFEIYDKKELQFLGEGYEDDMWHFLS

SEQ ID NO: 167524 - protein, 232 aa, Glycine max
  Coding DNA Sequence Number=SeqID_75839
  Gene Ontology: Mol. function=oxidoreductase activity; Cellular component=extracellular region; Biological process=hydrogen peroxide catabolic process
  Homolog annotation: Hit_ID=A7R3H8; Match level="QueryCoverage=98%, HitCoverage=98%, E-value=2e-67, Identity=70%"; Hit description =Chromosome undetermined scaffold_523, whole genome shotgun sequence
  Pfam annotation: Domain name=peroxidase; Domain location=43-198; Score=176.5; E_value=7e-50; Accession=PF00141.14; Description =Peroxidase
MAPLPAENILPIIFLLLIIFSVSKAELHAHYYDQTCPQVEKIISETVLKASKHDPKVPARILRMFFHDCFIRGCDASILLDSTATNQAEKDGPPNISVRSFYVIDEAKAKLELACPRTVSCADIIAISASNVVAMSGGPYWNVLKGRKDGRVSKASDTINLPAPTSNVSQLIQSFAKRDQSLVGDHRTRWFVEAFVKDQSLFFKEFTASMLKLGNLRGSRNGEVRLNCRIVN

SEQ ID NO: 167525 - protein, 622 aa, Glycine max
  Coding DNA Sequence Number=SeqID_75840
  Gene Ontology: Mol. function=intramolecular transferase activity, phosphotransferases; Cellular component=chloroplast; Biological process=carbohydrate metabolic process
  Homolog annotation: Hit_ID=Q9SM59; Match level="QueryCoverage=100%, HitCoverage=100%, E-value=0.0, Identity=78%"; Hit description =Phosphoglucomutase, chloroplast precursor
  Pfam annotation: Domain name=PGM_PMM_I; Domain location=84-227; Score= 115.1; E_value=2.1e-31; Accession=PF02878.7; Description =Phosphoglucomutasephosphomannomutase, alphabetaalpha domain I
  Pfam annotation: Domain name=PGM_PMM_II; Domain location=256-365; Score=107.1; E_value=5.4e-29; Accession=PF02879.7; Description =Phosphoglucomutasephosphomannomutase, alphabetaalpha domain II
  Pfam annotation: Domain name=PGM_PMM_III; Domain location=367-485; Score=91.5; E_value=2.7e-24; Accession=PF02880.7; Description =Phosphoglucomutasephosphomannomutase, alphabetaalpha domain III
  Pfam annotation: Domain name=PGM_PMM_IV; Domain location=510-611; Score=44.4; E_value=4.1e-10; Accession=PF00408.11; Description =Phosphoglucomutasephosphomannomutase
  Pfam module annotation: Pfam domain module=PGM_PMM_I::PGM_PMM_II::PGM_ PMM_III::PGM_PMM_IV; Domain location=84-227::256-365::367-485::510-611
  Subcellular localization annotation: CTP_CleavageSite=54; ConfidenceScore=5.59e-01
MAFSCKLDSFILSAYKPQNSILPLSIQPSSFLPSPSSLKPQKLPFRIRYGSTIRATSSSSTPSATIAEPEGIKIKSIPTKPIDGQKTGTSGLRKKVKVFMQDNYLANWIQALFNSLPPEDYKNGLLVLGGDGRYFNQEAAQIIIKIAAGNGVGKILGRYFVNTSRFCCYKKEKGMPANGGFIMSASHNPGGPEYDWGIKFNYSSGQPAPESITDKIYGNTLSISEIKIADIPDVDLSKVGVTNFGSFSVEVIDPVSDYLELLETVFDFQLIRGLLSRPDFRFIFDAMHAVTGAYAKPIFVDKLGASLDSISNGIPLEDFGHGHPDPNLTYAKDLVNILYAENGPDFGAASDGDGDRNMILGRSFFVTPSDSVAVIAANAREAIPYFKNGVKASHIFRHSSQITRDGPWIQVPTGWKFFGNLMDAGNLSVCGEESFGTGSDHIREKDGIWAVLAWLSIIAHRNKDKNPGEKLISVSDVVMEHWATYGRNFFSRYDYEECESEGANKMIEYLRDILSKSKPGDQYGSYVLQFADDFTYTDPVDGSVVSKQGVRFVFTDGSRIIYRLSGTGSAGATVRVYIEQFEPDVSKHDVDAQIALKPLIDLAISVSKLKDFTGREKPTVIT

SEQ ID NO: 167526 - protein, 766 aa, Glycine max
  Coding DNA Sequence Number=SeqID_75841
  Gene Ontology: Mol. function=alpha-L-fucosidase activity; Cellular component=extracellular region; Biological process=carbohydrate metabolic process
  Homolog annotation: Hit_ID=A7QGW6; Match level="QueryCoverage=57%, HitCoverage=88%, E-value=1e-179, Identity=67%"; Hit description =Chromosome chr16 scaffold_94, whole genome shotgun sequence
  Pfam annotation: Domain name=Alpha_L_fucos; Domain location=159-506; Score=-189.5; E_value=0.0033; Accession=PF01120.8; Description=Alpha- L-fucosidase
  Pfam annotation: Domain name=F5_F8_type_C; Domain location=500-604; Score=10.2; E_value=0.016; Accession=PF00754.16; Description=F58 type C domain
  Pfam module annotation: Pfam domain module=Alpha_L_fucos::F5_F8_type _C; Domain location=159-506::500-604
MTVEVKEGEEQKPLQFTTSMSMSRGERNVVQGRGEACLFTLSRGMEDFGHESYAFTVKNLQHGSIFKKCCKRHPAVAWRGNASPGNKQGGNIVAQNGTLVPGFAQVRRYKAKEDLRILKEGPLTGGRIGQGGFHLHGREEYGFGWKWLPLRDLSSNVDMVFCTRSRAVDSVQTPTPPLPILPLPTYSQLKWQQREIIMFFHFGVNTFSDREWGTGQENPAIFNPTGLNTTQWATVAADAGVSLMILTAKHHDGFCLWPSKYTDHSVISSPWQGGKGDVVQDFVNAATAQGIDVGVYLSPWDRHDPRYGNDLLYNQYYLAQLQELLKKYPNVREIWFDGAKGANAKNMTYYFSDWFSMVKELQSSINIFSDAGPDVRWVGDETGSAGYTCWSTINRTSLSIGSPDIIQYINTGDPKGTDWLPAECDVSIRKGWFWHKSESPKKLSELLDIYYNSVGRNCVLLLNVPPNTSGLITEVDANRLKEFRSAIKTIFHQNLAEDCFVKVSSQRGGFGPEKMLDSDHLWSYWAPRDDDDEKDHWVEIWAKEGRLRFNVVRIQEAIGLGQRIKRHEIYVDGKLIIKATTVGYKRLHRLDGGEVHARGVRIRIRKARGVPLISSIGLHYDPFWHSKKKGERKSWEGEGGSKGTTGGEGRKRGEGEGHVGKKEGGEREKKKLKKLKKERKWKVGKKKLTNSLTMVSNDDVSSQFPQFSTQIGLDEIVIDEIGRSLTKRKSQVAFAVKEDTHLISSWLNILTDPIVGGLRSQFGIYH

SEQ ID NO: 167527 - protein, 93 aa, Glycine max
  Coding DNA Sequence Number=SeqID_75842
  Homolog annotation: Hit_ID=Q9LVB6; Match level="QueryCoverage=60%, HitCoverage=24%, E-value=4e-17, Identity=67%"; Hit description =Similarity to embryo-specific protein 3
  Pfam annotation: Domain name=ATS3; Domain location=1-58; Score=-9.3; E_value=4e-07; Accession=PF06232.2; Description=Embryo-specific protein 3, (ATS3)
MHQDWMIQLQICYVYLYRSGLDGWKPESVKINSYNGRAVTFYYNTYIPRDTWYGFNLCNGASSSSYQFMVCLMFEQEGPPIVSAEPFMFHLRE

SEQ ID NO: 167528 - protein, 313 aa, Glycine max
  Coding DNA Sequence Number=SeqID_75843
  Homolog annotation: Hit_ID=A7QGU9; Match level="QueryCoverage=81%, HitCoverage=83%, E-value=1e-32, Identity=35%"; Hit description =Chromosome chr16 scaffold_94, whole genome shotgun sequence
MNETGKKKHVREPPSVPFIWEVKPGIPKKDWKPEPEPEVPKTPLKLIASVPFVWEEKPGKPLPNFSVDHPVPPKPLLIHVASSSAFSFACNFGHDHDKDKGSLSSSDNESITTLDLEAFSFDEDESFVSSVPSLLANCLVPSAKVSTAIPLRETTPSSPASSSETDSGTSSYATGMSSPIGATFLECLFPLFPPKSGFLERDENLEKVTSSPQELREKELVHENCASDLVRKPPTLGELIMISRRRSCRRKAIQMKKWDPPKKITRKQAFGCFSVVTDSNMIEGLLKRKYFPKLKLVSCNLWVSCVKNVESGF

SEQ ID NO: 167529 - protein, 274 aa, Glycine max
  Coding DNA Sequence Number=SeqID_75844
  Gene Ontology: Mol. function=nucleic acid binding; Cellular component= cytoplasm; Biological process=multicellular organismal development
  Homolog annotation: Hit_ID=A7NWU9; Match level="QueryCoverage=98%, HitCoverage=31%, E-value=1e-136, Identity=79%"; Hit description =Chromosome chr5 scaffold_2, whole genome shotgun sequence
  Pfam annotation: Domain name=PAZ; Domain location=10-147; Score =175.8; E_value=1.1e-49; Accession=PF02170.13; Description=PAZ domain
MASAAFIEPLPVVEFVGQLLAKDVLSRPLSDADRIKIKKALRGVKVEVTHRGSVRRKYRVSGLTSQPTRELVFPVDENSTMKSVVEYFQEMYGFTIQYTHLPCLQVGNQKKANYLPMEACKIVEGQRYTKRLNEKQITALLKVTCQRPRDRENDILRTVQHNAYDQDPYAKEFGIKISEKLASVEARILPAPWLKYHESGKEKNCLPQVGQWNMMNKEFNPESVIPIYNAKPEQVEKALKHVYHVSGSKIKGKELELLLAILPDNNGSLYAQGQ

SEQ ID NO: 167530 - protein, 723 aa, Glycine max
  Coding DNA Sequence Number=SeqID_75845
  Gene Ontology: Cellular component=integral to membrane
  Homolog annotation: Hit_ID=A7NWT8; Match level="QueryCoverage=96%, HitCoverage=99%, E-value=0.0, Identity=72%"; Hit description =Chromosome chr5 scaffold_2, whole genome shotgun sequence
MGSAPSTPRRGGAFSPEAAEYLIGTFVGDTPFPLSSEFWQKLLELPLNVQWPTQRVQQACELLAKNNCHTRHLAKILFHLACCLQESMSSSGASPLVYEKAFNAVYISSIFLKHLIESDQGENIQLYPSLEDNEDVQKDVLRDQTIENLVMRNVLSFIASVEVSPDTFLLHLELLNFMIIAMSTQLLCGPSPGPNDVNPFLDAAMDQDSSLVGAVVRRLLLNFMVRSNVPSNRATYSILYDGNQSSVLQRVGSAAANIVLFPFSYLVSSGGEESKSPIADISIHVLLVLVHYHKCLVSEDYANHKSSTSDSLLKENPHFSDNPYCKALEHAIDCEYIEGNAHSAPHIKLPFASLFDTLGICLADEAAVLLLYSLLQGNSAFLEYVLVRTDLDTLLMPILEALYNAPSRTANQIYMLLIILLILSQDSSFNASIHKLILTGVPWYKERLLHQTSLGSLMVVILIRTVQYNLSKLRDVYLQTTCLATLANVAPHVHRLSAYASQRLVSLFDMLSRKYIKLAERRDNKLHTAKGDSEGNNLVEDMTLLVQSTELHIYTDFLRLVLEIINAILTYALPRNPEVVYAIMHRQEVFQPFKNHPRFNELIDNIYTVLDFFNSRMDAQREDGDWSVHEVLQVIIVNCRSWRGDGMKMFTQLRFTYEQESHPEEFFIPYVWQLVLSRCGFSFNTGAINLFPVDLQTERLENGVVGTTLQNGDFDKPEYQLDP

SEQ ID NO: 167531 - protein, 31 aa, Glycine max
  Coding DNA Sequence Number=SeqID_75846
MEAMKDTGETDSLIGVLGETDSHQIFAQLDL

SEQ ID NO: 167532 - protein, 357 aa, Glycine max
  Coding DNA Sequence Number=SeqID_75847
  Homolog annotation: Hit_ID=A7NWT2; Match level="QueryCoverage=88%, HitCoverage=63%, E-value=4e-82, Identity=53%"; Hit description =Chromosome chr5 scaffold_2, whole genome shotgun sequence
  Pfam annotation: Domain name=DUF828; Domain location=3-179; Score =88.7; E_value=1.9e-23; Accession=PF05703.2; Description=Plant protein of unknown function (DUF828)
  Pfam annotation: Domain name=PH_2; Domain location=244-352; Score =221.9; E_value=1.5e-63; Accession=PF08458.1; Description=Plant pleckstrin homology-like region
  Pfam module annotation: Pfam domain module=DUF828::PH_2; Domain location=3-179::244-352
  Subcellular localization annotation: CTP_CleavageSite=29; ConfidenceScore=5.14e-01
MASTKSSLQYTRANNIASSLSLNFRTTATAAAPGGGKTVGRWLKDRKEKKKEETRAHNAQLHAAVSVAGVAAAIAAIAAATAATSGAGKDEQMAKTDMAVASAATLVAAQCVEAAEALGAEREHLASVVSSSVNVRSAGDIMTLTAAAATALRGAATLKARALKEVWNIAAVIPVEKNLAVAGGHNNNNNASNGNSKSSFSGELVPEENFLGICSRELLARGCELLKRTRKGLWGLVNGKGFYLMRELCAGDLHWKVVSVYVNRMNQVILKMKSRHVAGTITKKKKNVVLEVIKDVPAWPGRHLLEGGEDRRYFGLKTVMRGLVEFECRNQREYDVWTQGVSRLLSIAAEKNNKNRI

SEQ ID NO: 167533 - protein, 178 aa, Glycine max
  Coding DNA Sequence Number=SeqID_75848
MEWSITTLELKGGGDGTGTGKMGGQITDDEKEVPQCRRLTTFACRQQTTVAVAKNVDHVDHAADELHEQPRELVTDHEHTELKLTFHGRKVGKFGRSALEIEGIVTATELSSLIICLLETSAFHTFDAIDVDKVVDLLIELLEANTQEARDEIEQCKWAYVCLASLRDIYRSKYDTRQ

SEQ ID NO: 167534 - protein, 580 aa, Glycine max
  Coding DNA Sequence Number=SeqID_75849
  Homolog annotation: Hit_ID=A7NWS3; Match level="QueryCoverage=96%, HitCoverage=97%, E-value=3e-40, Identity=35%"; Hit description =Chromosome chr5 scaffold_2, whole genome shotgun sequence
  Subcellular localization annotation: CTP_CleavageSite=97; ConfidenceScore=5.09e-01
MDTPDRSKINTPLSQFEDSPVFNYISNLSPIEPVKSVHLTHTFNSYSFSSPPSVFTSPHGNCHKESRFLKRHNLLETSKPKVWSEDVNSVYSSEETLADSTQACHESSEQQENTAQKISIGDASIEPCNENPNISIELPQVLKCNLGSPGYEPLLCCDEANSLLELPGNGKPASDVAYVPEGSEKDSIEGEMHLLGLCQIEEAKVEGPNCGVDSLITEVSDLLMLSPPNVTEAFKGLNKQLNPSIELGNFMTLIPQSATNDGQQMHIGNAVASGSEHEIEDHPSESAAATGTGQRQDNLANVALVASHPSENMDNKLVYARHRGIRRRCLDFEMAIVQWKNPADNSNTNSSTAISDEGNVGNEKQLLPTKHSGDSRRQPNLHCSPSSVQLSASQELQLSLVPASSEIDLVPSENEVQPGSVPSGLEAEPEEETEACEKGVVENASLKTETKNTEDHPDQSLATTPLPLSRSLLPLSFSSKCKPPRSSVITISSSGLLVGQKLGKSNAPWSQSQPKCEKPLETVPDDDSSVTCIKTSSPNGKRISSPNCKVGSSPTRRAFLHPSSIGSRLQFVAVGAVCLV

SEQ ID NO: 167535 - protein, 189 aa, Glycine max
  Coding DNA Sequence Number=SeqID_75850
  Gene Ontology: Mol. function=protein serine/threonine kinase activity; Cellular component=focal adhesion; Biological process =protein amino acid phosphorylation
  Homolog annotation: Hit_ID=A7PUE0; Match level="QueryCoverage=65%, HitCoverage=32%, E-value=2e-38, Identity=61%"; Hit description =Chromosome chr7 scaffold_31, whole genome shotgun sequence
  Pfam annotation: Domain name=Pkinase; Domain location=1-184; Score= -67.2; E_value=0.00014; Accession=PF00069.16; Description=Protein kinase domain
  Pfam annotation: Domain name=Pkinase_Tyr; Domain location=5-151; Score=-137.2; E_value=0.00052; Accession=PF07714.8; Description =Protein tyrosine kinase
  Pfam module annotation: Pfam domain module=Pkinase::Pkinase_Tyr; Domain location=1-184::5-151
MDPSNLKIPMPSCGQKPVPSKACCVIAEFLPGGTLKQYLFKNRQNKLPYKVLIQLALDLSRGLSYLHSKKIVHRDVKTDNMLSDANQNVKMADFDVARVEAINQSEMTGETGTYELWHRRPYSKLSLVAVSRAVISQKSSGAAEDDFISYIGKWRDAGASLFGGCSKTTPNTMRGTAEATYGKLKDKCI

SEQ ID NO: 167536 - protein, 143 aa, Glycine max
  Coding DNA Sequence Number=SeqID_75851
  Gene Ontology: Mol. function=histone-lysine N-methyltransferase activity; Cellular component=nucleus; Biological process=chromatin modification
  Homolog annotation: Hit_ID=A5BRH3; Match level="QueryCoverage=82%, HitCoverage=35%, E-value=1e-38, Identity=64%"; Hit description =Putative uncharacterized protein
  Pfam annotation: Domain name=SET; Domain location=2-122; Score=10.4; E_value=0.00023; Accession=PF00856.19; Description=SET domain
MTKRWRCNAKEEEALLIQCVLPYLTPSELADLQIPPQRLVNSQGGFSSALLVVREHLPSGKACLRTGNVARFVNHSCDGGNLSTKLVRSSGSLFPRLCFFASKHIQVDDELTFSYGEIRKRPNGLPCFCNSPSCFGTSPSQDT

SEQ ID NO: 167537 - protein, 503 aa, Glycine max
  Coding DNA Sequence Number=SeqID_75852
  Gene Ontology: Mol. function=nutrient reservoir activity; Cellular component=vacuole; Biological process=defense response to bacterium
  Homolog annotation: Hit_ID=P25974; Match level="QueryCoverage=52%, HitCoverage=69%, E-value=6e-65, Identity=49%"; Hit description=Beta -conglycinin, beta chain precursor
  Pfam annotation: Domain name=Cupin_1; Domain location=137-262; Score=- 0.8; E_value=0.00065; Accession=PF00190.13; Description=Cupin
MMRARYPLLLLLGIVFLASVSVLFGIIQKQQCLQSCEIERAGSVQAATIVRSNKKKKKKENINEHNPNHHTRRGDPMRVRRRKRNKTTVSNLVRFHVLITNSTNSTNGLMEILKNVKVRMSQSQKRNNLYHFSSNSFDTLFKNQYGHIRLFQRFNQRSPQLENLRDYHVVEFKFNPNALFLPHHADSEFLLERLHPGDALRIPAGTTYYLVNPDYKETFPIVKIINLCLFRVEFLPIQQSYLQGFSENILEASFNTEFEEINRVLLGEEGQQQGVQRLQERVMVELSKEQIQELSRHAKSSSRKTITSKNEPFNLRSRKPIYSNKFGALLLPHFNSKAIVILVINEGEANIELVSLREQQQEEEPLEVQSLSICRQISISLLLVLMPRTTRETSLQTTEKMFESHIYNKYIKRRQEAIFKTSLIQRAPFDCDKINWKIVIGGRELESCLGSAPWMTIDPANHPPLLRHRLHDPRRVNGLHHHLSVALCISDCLRCLLLPPNSN

SEQ ID NO: 167538 - protein, 351 aa, Glycine max
  Coding DNA Sequence Number=SeqID_75853
  Homolog annotation: Hit_ID=A7NWQ0; Match level="QueryCoverage=94%, HitCoverage=87%, E-value=7e-95, Identity=55%"; Hit description =Chromosome chr5 scaffold_2, whole genome shotgun sequence
  Pfam annotation: Domain name=ERG2_Sigma1R; Domain location=124-333; Score=-103.6; E_value=0.021; Accession=PF04622.3; Description=ERG2 and Sigma1 receptor like protein
MRTVFLQSKTKSSTSSSDEDNNSCYFPGCKKDANCNCEMCLASINATLDLMPNSVHKGTLTKLSASKPNVACTPISFDASILSTPRSSEFQLSSSTPLSKSRARSDLSKKMEKHKKGQQASGFSFLRLMLFFGFFLSADLVFPLVVSGVFQPSLSPDVVKRVGEKCSLVRDLNGKLRLLQKELASVVVGEVSNCSFTDTLWEISQDGLLLNSRCTLYKSAIEEVTIWGWPLQTAGLLTNGFSSRTFTLLSGRVTQWNGGQIGYSIRTANASWVQPKWDASAVQLDPNTWVLEYQMSYIFDGTRLHSAALEFLKYRISRIVARLKKDFWLFIAFEDKQYNGFTAKNGPQIPT

SEQ ID NO: 167539 - protein, 58 aa, Glycine max
  Coding DNA Sequence Number=SeqID_75854
MRRRPVRVTLFCENASTIWDQHKLKRALKPGVFILKAYTPKSPSGPLPPDSGLTQKIF

SEQ ID NO: 167540 - protein, 207 aa, Glycine max
  Coding DNA Sequence Number=SeqID_75855
  Gene Ontology: Mol. function=catalytic activity; Cellular component =nucleus; Biological process=metabolic process
  Homolog annotation: Hit_ID=A7NWP2; Match level="QueryCoverage=87%, HitCoverage=52%, E-value=2e-53, Identity=43%"; Hit description =Chromosome chr5 scaffold_2, whole genome shotgun sequence
  Pfam annotation: Domain name=PPR; Domain location=75-109; Score=34.6; E_value=3.6e-07; Accession=PF01535.11; Description=PPR repeat
MNVPRPPNLLGSFLESAVLSRSSLLGRAVHAHILRTHDTPLPSFLCNHLVNMYSKLDLPNSAQLVLSLTNPRTVVTWTSLISGCVHNRRFTSALLHFSNMRRECVLPNDFTFPCVFKASASLHMPVTGKQLHALALKGGNILDVFVGCSAFDMYSKTGLRPEARNMFDEMPHRNLATWNAYMSNAVQMVGVWMQLQRLRVSLCGWRA

SEQ ID NO: 167541 - protein, 143 aa, Glycine max
  Coding DNA Sequence Number=SeqID_75856
  Homolog annotation: Hit_ID=A7NWN1; Match level="QueryCoverage=81%, HitCoverage=19%, E-value=4e-45, Identity=73%"; Hit description =Chromosome chr5 scaffold_2, whole genome shotgun sequence
  Pfam annotation: Domain name=XS; Domain location=8-97; Score=60.4; E _value=6.3e-15; Accession=PF03468.5; Description=XS domain
MVSSSKLGFDTIINKKIMELFKAVTELGFVGGKSKSLYGRDGHLGITLVKFAGDESGFKEAIRLAEHFEKENHGRKDWAHVQSQTLGKDDENNANLVKVDEKKGDKRRVLYGYLGTAFDLDKVDFDTRKKAVIESRREYKPPM

SEQ ID NO: 167542 - protein, 52 aa, Glycine max
  Coding DNA Sequence Number=SeqID_75857
MELLGKRWEMGSEKGEAEEKMNRSIRCRILGIGVGCPIFSPRFCINVDKTLP

SEQ ID NO: 167543 - protein, 378 aa, Glycine max
  Coding DNA Sequence Number=SeqID_75858
  Gene Ontology: Mol. function=transporter activity; Cellular component= intracellular; Biological process=transport
  Homolog annotation: Hit_ID=A5BR09; Match level="QueryCoverage=76%, HitCoverage=64%, E-value=1e-101, Identity=65%"; Hit description =Putative uncharacterized protein
  Pfam annotation: Domain name=CRAL_TRIO_N; Domain location=2-75; Score= 6.8; E_value=0.018; Accession=PF03765.6; Description=CRALTRIO, N -terminus
MGKKTELKDHKETTKVEAVLELLRKQTPLTVKQEKFCNYACVKRFLKAKGDNVKKAAKQLKACLAWRESVITDHLIADDFSAELADGLAYVSGHDDESRPVMIFRLKQDYQKLHSHKMFTRLLAFTLEVAISTMPKNVEQFVILFDARPEGHTESVRSAPEESPINGHIREGFYRSASAFMNLLLPALKIVAEYYPGRLCKAFVIDPPSLFAYLWKGVRPFVELSSWTTVVSSLDFEESLDFNDFAAYPRASSLRFEGASVKSTAKIGSCSSSRFSFTVSHHLDSLKPCTHLTAERAVALVRVARRENPPRPPGHQKGPLPVHPPAAARDGDAADLVSSVAGDVLPAREPRRREGREVPRIVLAVCEVLPKTVRRDGV

SEQ ID NO: 167544 - protein, 72 aa, Glycine max
  Coding DNA Sequence Number=SeqID_75859
MLQPYGINISLKEHSNRVYLSSRPTLRRVRQDLSLLIQDRFGAEKERVLGGGKGKTKVRGRGDVEAIASLKN

SEQ ID NO: 167545 - protein, 21 aa, Glycine max
  Coding DNA Sequence Number=SeqID_75860
MGEEAQRGRGMYIWFILDFKQ

SEQ ID NO: 167546 - protein, 468 aa, Glycine max
  Coding DNA Sequence Number=SeqID_75861
  Gene Ontology: Mol. function=sugar:hydrogen symporter activity; Cellular component=integral to membrane; Biological process =carbohydrate transport
  Homolog annotation: Hit_ID=Q10PW9; Match level="QueryCoverage=99%, HitCoverage=96%, E-value=1e-170, Identity=64%"; Hit description =Sugar carrier protein C, putative, expressed
  Pfam annotation: Domain name=DUF81; Domain location=122-386; Score= -59.8; E_value=0.014; Accession=PF01925.10; Description=Domain of unknown function DUF81
  Pfam annotation: Domain name=MFS_1; Domain location=24-413; Score =60.9; E_value=4.2e-15; Accession=PF07690.7; Description=Major Facilitator Superfamily
  Pfam annotation: Domain name=Sugar_tr; Domain location=18-443; Score =358.1; E_value=1.5e-104; Accession=PF00083.15; Description=Sugar (and other) transporter
  Pfam module annotation: Pfam domain module=DUF81::MFS_1::Sugar_tr; Domain location=122-386::24-413::18-443
MAGGGEFEAKITPIVILSCMMAATGGLMFGYDIGVSGGVTSMPAFLKEFFPEVYRKTVEEEELDSNYCKYDNEKLQLFTSCLYLAGLIATFFASHITRRQGRRATMLISGFIFIAGVAFNAAAQNLAMLIIGRVLLGSGVGFANQAVPVFLSEIAPSQIRGALNILFQLNITLGILFSNLVNYATNKLSLGLGGLPALLLTLGAFMVVDTPNSLIERGHLEEGKVVLRKIRGIDNIEPEFLELLHASRVAKEVKHPFRNILKRKNRPQLVICIALQIFQQFTGINAIMFYAPVLFNTLGFKNDASLYSAVIIGAVNVVSTVVSIYSVDRLGRRILLLEAGVQMFLSQLVIAVIIGMKVKDHSEDLSKGYAVLVVVLVCIFVSAFAWSWGPLSWLIPSLSLNAVFLQVWHLLVLLWMCLAHVHLCAFPSPRDKECPIEEMTQSVWKQHWLWKRFIEDDCVKEEKVDTGN

SEQ ID NO: 167547 - protein, 24 aa, Glycine max
  Coding DNA Sequence Number=SeqID_75862
MEKPLRPRSYIFGALITMPTMRPA

SEQ ID NO: 167548 - protein, 262 aa, Glycine max
  Coding DNA Sequence Number=SeqID_75863
  Gene Ontology: Biological process=cell division
  Homolog annotation: Hit_ID=Q6EEW1; Match level="QueryCoverage=92%, HitCoverage=84%, E-value=2e-64, Identity=49%"; Hit description =Cyclin T1
  Pfam annotation: Domain name=Cyclin_N; Domain location=90-207; Score=- 22.4; E_value=0.012; Accession=PF00134.14; Description=Cyclin, N -terminal domain
MSFVRNYQAEDRSLHSGYWSTFDGNNYGNNNRKRSRNNYYNRNCNIYNDNRTKFGDHFNFYNADHANYARYDAVRSSLKRRKYSAPVWQESQQYYVPPMVHDNIPSAYNFQGPPTRSDGDASTSASCKRDCSIFEDDKPVFMSRDEIDRHSPSRKDGIDLIATAALFLTAKSEEAPRHLNNDWFEQYRERVLEAEQLILTTLNFELNVQHPYVPLTSVLNKLGLSKTVLVNLALNLVSEGTKLVGSNQICMQCSELLADVLF

SEQ ID NO: 167549 - protein, 523 aa, Glycine max
  Coding DNA Sequence Number=SeqID_75864
  Gene Ontology: Mol. function=protein binding; Cellular component =integral to membrane; Biological process=protein amino acid phosphorylation
  Homolog annotation: Hit_ID=A7NWJ5; Match level="QueryCoverage=68%, HitCoverage=87%, E-value=1e-146, Identity=71%"; Hit description =Chromosome chr5 scaffold_2, whole genome shotgun sequence
  Pfam annotation: Domain name=LRRNT_2; Domain location=428-467; Score =33.1; E_value=9.8e-07; Accession=PF08263.3; Description=Leucine rich repeat N-terminal domain
MEDNYSVQDFQKDEKGAIVLMTEEKRATVVAVSDGSSVEGSLEIFENKEAQLAKNELEEAIAEEKFKICTTNDWLRPSFRKINLFGPLRLSSKKSRGFLINCGAHSAAQFQNRTWLPDSAFISSGTPLNVTTPVLFPTLHTLRSFPRRVNKHCYNIPVYRGAQYLVRTTYFYGGVNGADHPSPPVFDQILDGTLWSVVNTTRDYADGNSSFYEGVFLAQGKIMSLCIGSNTYTDSDPFISALEFVILEGSLYNSTDFTRYGLALIARHGFGYSGPPIRYPDDQFDRVWEPFGQSNSTKASTDNVSVSGFWNLPPAKIFETHIGSDQLETLELRWPTASLPSSNSKYYYIALYFADDTAGSRIFNISVNGITYYHNLNVIPSGVVVFASQWPLSGPTTITLTPAASSSLGPSINAGEVFDVLPLGGRTLTRDVIALQKVKESLRNPPLDWNGDPCMPRQYSWTGITCSEGPRIRVVTLNLTSKDLSGSLSPFVANMTALTNIWLGNNSLSGQIPDLSSLKILET

SEQ ID NO: 167550 - protein, 586 aa, Glycine max
  Coding DNA Sequence Number=SeqID_75865
  Gene Ontology: Mol. function=protein binding; Cellular component =vacuolar membrane; Biological process=vacuole fusion, non-autophagic
  Homolog annotation: Hit_ID=A7PU99; Match level="QueryCoverage=91%, HitCoverage=76%, E-value=0.0, Identity=80%"; Hit description =Chromosome chr7 scaffold_31, whole genome shotgun sequence
  Pfam annotation: Domain name=Arm; Domain location=141-181; Score =43.7; E_value=6.7e-10; Accession=PF00514.14; Description =Armadillobeta-catenin-like repeat
  Pfam annotation: Domain name=Arm; Domain location=183-223; Score =14.5; E_value=0.16; Accession=PF00514.14; Description=Armadillobeta -catenin-like repeat
  Pfam annotation: Domain name=Arm; Domain location=225-265; Score =32.6; E_value=1.5e-06; Accession=PF00514.14; Description =Armadillobeta-catenin-like repeat
  Pfam annotation: Domain name=Arm; Domain location=266-306; Score =20.0; E_value=0.009; Accession=PF00514.14; Description=Armadillobeta- catenin-like repeat
  Pfam annotation: Domain name=Arm; Domain location=381-421; Score =17.0; E_value=0.07; Accession=PF00514.14; Description=Armadillobeta -catenin-like repeat
  Pfam annotation: Domain name=Arm; Domain location=49-97; Score=20.1; E_value=0.0081; Accession=PF00514.14; Description=Armadillobeta -catenin-like repeat
  Pfam annotation: Domain name=Arm; Domain location=99-139; Score=37.8; E_value=3.9e-08; Accession=PF00514.14; Description=Armadillobeta -catenin-like repeat
  Pfam annotation: Domain name=BTB; Domain location=442-545; Score =79.5; E_value=1.1e-20; Accession=PF00651.22; Description=BTBPOZ domain
  Pfam annotation: Domain name=HEAT; Domain location=105-141; Score =4.2; E_value=6.4; Accession=PF02985.13; Description=HEAT repeat
  Pfam annotation: Domain name=HEAT; Domain location=146-183; Score =10.0; E_value=0.86; Accession=PF02985.13; Description=HEAT repeat
  Pfam annotation: Domain name=HEAT; Domain location=189-225; Score =3.3; E_value=8.7; Accession=PF02985.13; Description=HEAT repeat
  Pfam annotation: Domain name=HEAT; Domain location=231-267; Score =19.1; E_value=0.017; Accession=PF02985.13; Description=HEAT repeat
  Pfam annotation: Domain name=HEAT; Domain location=277-308; Score =4.5; E_value=5.8; Accession=PF02985.13; Description=HEAT repeat
  Pfam annotation: Domain name=HEAT; Domain location=346-382; Score =1.7; E_value=15; Accession=PF02985.13; Description=HEAT repeat
  Pfam annotation: Domain name=HEAT_PBS; Domain location=126-163; Score= 1.8; E_value=55; Accession=PF03130.7; Description=PBS lyase HEAT-like repeat
  Pfam annotation: Domain name=HEAT_PBS; Domain location=210-247; Score= 9.8; E_value=3.5; Accession=PF03130.7; Description=PBS lyase HEAT -like repeat
  Pfam annotation: Domain name=HEAT_PBS; Domain location=252-288; Score= 5.7; E_value=14; Accession=PF03130.7; Description=PBS lyase HEAT-like repeat
  Pfam annotation: Domain name=HEAT_PBS; Domain location=84-121; Score =1.4; E_value=64; Accession=PF03130.7; Description=PBS lyase HEAT -like repeat
  Pfam module annotation: Pfam domain module=Arm::Arm::Arm::Arm::Arm::Ar m::Arm::BTB::HEAT::HEAT::HEAT::HEAT::HEAT::HEAT::HEAT_PBS::HEAT _PBS::HEAT_PBS::HEAT_PBS; Domain location=141-181::183-223::225 -265::266-306::381-421::...
  Pfam module annotation: Domain location=49-97::99-139::442-545::105 -141::146-183::189-225::231-267::277-308::346-382::126-163::210 -247::252-288::84-121
MEMLVVCTIIQFQFCSVLCCFFMLAHSRDGVQLKQRGEKNQGCEAIRQMPEHQQFIVDSGALTHLVDLLKRHRNGLTSRAINSLIRRAADAITNLAHENSSIKTRVRMEGGIPPLVHLLDFADAKVQRAAAGALRTLAFKNDENKNQIVECNALPTLILMLRSEDAGVHYEAVGVIGNLVHSSPNIKKEVLLAGALQPVIGLLSSCCSESQREAALLLGQFAATDSDCKVHIVQRGAVQPLIEMLQSPDVQLREMSAFALGRLAQDPHNQAGIAHNGGLVPLLKLLDSKNGSLQHNAAFALYGLADNEDNASDFIRVGGVQRLQDGEFIVQATKDCVAKTLKRLEEKIHGRVLNHLLYLMRVSEKGCQRRVALALAHLCSSDDQRIIFIDHYGLELLIGLLGSSSSKQQLDGAVALCKLADKASTLSPVDAAPPSPTPQVYLGEQYVNNATLSDVTFLVEGKRFYAHRICLLASSDAFRAMFDGGYREKEARDIEIPNIRWEVFELMMRSFDVTLDIAQDLLRAADQYLLEGLKRLCEYTIAQDISLENVSSMYELTEAFNAISLRHACILFILEQFDKLSSRPGY

SEQ ID NO: 167551 - protein, 581 aa, Glycine max
  Coding DNA Sequence Number=SeqID_75866
  Gene Ontology: Mol. function=nucleic acid binding; Cellular component= intracellular; Biological process=intracellular protein transport
  Homolog annotation: Hit_ID=A7QUM0; Match level="QueryCoverage=97%, HitCoverage=66%, E-value=1e-111, Identity=41%"; Hit description =Chromosome chr10 scaffold_179, whole genome shotgun sequence
MSEYAVASWLFERDYPHPAVDLGVAKALGRHVEVSERQRKRKQFPASITHSFINGQQHQSPRALIEAYGSDKSQQTSSSKSLLVEPLDINGIDNMSTSLQNTEEEEFDWEDMSPTLLSSTIGFSRERPVVPANATLSEQDASKGWGIRDFRHAPLGEVPRFQNQINYSLGSSQPHDPSKISLHLSNSSQHNFNNRGRARSLTIPPVDNIRNTDINPYLVRPTSFEIRPSTNLNVTRPPTLNPITPLQKRVRNQFEATHTSDPIVNHVNKSSFMPEQSFDRIENKDASISKIHQLPNQHPGLISSNQQNHGQAPQLQFFPSQDPTPSQFSPGSSLQLHDASISTAMSNPLHGIQFPSPVQSFANNPFIRYTSLISSLMSQGVISLANQLPAQDSIGTEFNPDILKVRHESPANALYRDLPRQCKTCGLRFRCQEKHSSHMDWHVTKNRMSKSCKQKPSRKWFASLKLWLSGAEALGTESVPHFLATESIDYEERKDHEEFAVPTEEDQSTCALCGESFDEFYSDEMEEWMYRGAAYLNAPARKTSAGMDRSQLGPIIHAKCRSDSNLQCANEEDTRRKRMRS

SEQ ID NO: 167552 - protein, 119 aa, Glycine max
  Coding DNA Sequence Number=SeqID_75867
  Gene Ontology: Mol. function=transporter activity; Cellular component= membrane; Biological process=oligopeptide transport
  Homolog annotation: Hit_ID=A6H5A5; Match level="QueryCoverage=90%, HitCoverage=62%, E-value=4e-55, Identity=91%"; Hit description =Putative proton-dependent oligopeptide transport (POT) family protein
MAEDDGYTKDGTVDYCGNPANKKETGTWKACPYILGNECCERLAYYGMSTNLVLYFKNRLNQHSATASKNVSNWSGTCYITPLIGAYLADSYLGRYWTIAVFSIIYAIVSMVSSIVYDY

SEQ ID NO: 167553 - protein, 544 aa, Glycine max
  Coding DNA Sequence Number=SeqID_75868
  Gene Ontology: Cellular component=chloroplast
  Homolog annotation: Hit_ID=A7NYL1; Match level="QueryCoverage=95%, HitCoverage=95%, E-value=7e-75, Identity=35%"; Hit description =Chromosome chr6 scaffold_3, whole genome shotgun sequence
  Pfam annotation: Domain name=DUF740; Domain location=1-529; Score =378.5; E_value=1.1e-110; Accession=PF05340.3; Description=Protein of unknown function (DUF740)
  Subcellular localization annotation: CTP_CleavageSite=59; ConfidenceScore=5.18e-01
MTSKTHRFTTCHRHPSTPVTGFCASCLRERLAGIDSSSAESPELRRTKSFSGRTTDAPSSSAAPEPRRRSCEVRLPPLGGSLSDLFNVDDKKKKPPNRNAEICSSTTGGGIGEKERGDPVRVSGDDDGEGKTMKEFIDLELRSKKNTGRDFRDIAASFREAASVFSKRLMKWRRKQNAKRNRYNDGLGAGAGVGPVEKLGLRTLHEAQSEVGEYGIALGRRSCDTDPRLSVDDSRFSFEAPRASWDGYLIGKAYPGVSRMVRVGDRVLLEEEEEEEGEESLENGEECCPGGSAQTKHYYSNWHRRRRSFDRSNSRRKSSMGEVDELRAISNAKVSPATTELFYGAKVLITENDLRDANLKPINSVQSDNVMGSASKDDACDVAIGDDQKGLNRFHKWGRLWSKLGLMQKRREDRLEEGEYAGGGGGDVVDKPIAESWQKLRRVVNGQVSESVSQKLIRSYSVSCRDSSRTAGLVSGFVGSETKGHVFNGRQKFMLQRNRSVRYSPSNVDNGLLRFYLTPLKSYRRSRSGKSSLKSSNPTARSFF

SEQ ID NO: 167554 - protein, 94 aa, Glycine max
  Coding DNA Sequence Number=SeqID_75869
MSRLVIRLQTYLPKDFLWCYLRIFETVSVSVDLPLRLRGKILRQSVSNCTLENNKKTDVSIVHLKAKASAIWAQNNLEAKERLLPKHLHYDPCK

SEQ ID NO: 167555 - protein, 383 aa, Glycine max
  Coding DNA Sequence Number=SeqID_75870
  Gene Ontology: Mol. function=cation transmembrane transporter activity; Cellular component=integral to membrane; Biological process=cation transport
  Homolog annotation: Hit_ID=A7NYF8; Match level="QueryCoverage=81%, HitCoverage=80%, E-value=1e-102, Identity=60%"; Hit description =Chromosome chr6 scaffold_3, whole genome shotgun sequence
  Pfam annotation: Domain name=Na_Ca_ex; Domain location=245-359; Score= 77.2; E_value=5.5e-20; Accession=PF01699.15; Description =Sodiumcalcium exchanger protein
  Pfam annotation: Domain name=Na_Ca_ex; Domain location=98-207; Score =25.8; E_value=0.00016; Accession=PF01699.15; Description =Sodiumcalcium exchanger protein
  Pfam module annotation: Pfam domain module=Na_Ca_ex::Na_Ca_ex; Domain location=245-359::98-207
MEEDLNILEVNTEPCNNNAITSAKIAPPQGKNLSPNVTKKCLFLVTKLRFQMLGNFTTNLREVIFGTKLAVLFPAVPLAVVADFYKLGRPWIFALSLLGLTPLAERVSFLTEQIAYYTGPTVGGLLNATCGNATEMIISLLALHQNKKQADVNSLLLLLGLLCHLLPLLLRYALAGEYPSIATSNLQLSRASSIVMLLAYAGYIFFQLKTHRQLFDAQEEDENEDEEKAVIGFWSAFSWLVGMTLIISLLSEYVVATIEAASDSWGISVSFISIILLPIVGNAAEHAGSIIFAFKNKLDISLGVAMGSATQISMFVVPFSVVVAWIMGIEMDLDFNLLETGCLAFTIIVTAFTLQIKHRVGSISELDHKLGLFKEIGATIVPG

SEQ ID NO: 167556 - protein, 200 aa, Glycine max
  Coding DNA Sequence Number=SeqID_75871
  Gene Ontology: Mol. function=peptidyl-prolyl cis-trans isomerase activity; Cellular component=endoplasmic reticulum; Biological process=protein folding
  Homolog annotation: Hit_ID=Q9SP02; Match level="QueryCoverage=90%, HitCoverage=90%, E-value=2e-89, Identity=88%"; Hit description =Peptidyl-prolyl cis-trans isomerase CYP20-1 precursor
  Pfam annotation: Domain name=Pro_isomerase; Domain location=36-198; Score=387.1; E_value=2.7e-113; Accession=PF00160.12; Description =Cyclophilin type peptidyl-prolyl cis-tr
MAKTTSLLLFTLLLFGTLALIQAKKSKEDLKEVTHKVYFDVEINGKEAGRIVMGLYGKAVPKTAENFRALCTGEKGTGKSGKPLHYKGSSFHRIIPSFMLQGGDFTQGNGMGGESIYGEKFADENFKLKHTGPGLLSMANAGPNTNGSQFFITTVTTSWHVVFGKVLSGMDVVYKIEAEGTQSGTPKSKVVIVDSGELPL

SEQ ID NO: 167557 - protein, 21 aa, Glycine max
  Coding DNA Sequence Number=SeqID_75872
MGMNKNVMLELRKTYCLPNIS

SEQ ID NO: 167558 - protein, 653 aa, Glycine max
  Coding DNA Sequence Number=SeqID_75873
  Gene Ontology: Mol. function=protein binding; Cellular component =cytoplasm; Biological process=protein metabolic process
  Homolog annotation: Hit_ID=A5BAL3; Match level="QueryCoverage=95%, HitCoverage=56%, E-value=1e-125, Identity=42%"; Hit description =Putative uncharacterized protein
  Pfam annotation: Domain name=AAA_2; Domain location=288-441; Score= -25.3; E_value=0.00092; Accession=PF07724.5; Description=ATPase family associated with various c
MFLSNLVLHHVPCFNDSICGCILFKNELHHPVQTNEENTSLNKKIFGLQRKWSDICQRLHQNRSLPEFDITKARFQATSHEGFQFGPGSSSKGPLHSEIQYPNQISYMSKVSQSAFPFKQILPVSVPFDTVSITDEADHIPKVSKSHMHGTWISPSPKANMSLLDPTTSSSLTPVTTDLGLGTIYTSAAHEPDTPKLSDHKKPLHHLSDSLSTDFDAMNESTSHQIARSSSCSGPNLEGRFETVDFKSFYHLLTEKVGWQDEAIYAINRTVSRCRSCAGKRSSGSHVRADIWLAFLGPDRLGKRKVASALAEILFGNKQSLITVDLSSQDRSYPTNSIFEFQNTYCHDVLMRKTVLDYVAGELSKKPHSVVFLENVDQADFLVQNSLFQAIKTGKFPYSHGREISINNAMFIVTSSVFKGSGSFSLEGDPKMFPEERILEAKRCQMQLSLGHASEDAKRSGCTNVKVAQRKGTSKTTFLNKRKLIESGDSKEKASCKTLKQVGEASRSYLDLNMPLEEVEEGNNYNDYESDAWLNDLCDQVDEKVVFKPFNFDSIAEKVIKSIDTQFQKMLGSEFILEIEYEVMTQILAAAWLSDKKKAVEDWVEHVLGRSLAEAHQKYRFVPEFVMKLVNCERIFLEEQSPGVCLPARINLN

SEQ ID NO: 167559 - protein, 90 aa, Glycine max
  Coding DNA Sequence Number=SeqID_75874
MASNKSNVGSGSGDVVVSGSGSGNGSYSKVKAHLLQVKGQGIAICKKVARQDRIEMTRAEEEFERKKESRAKDVPLPCQSQSELDSSSKK

SEQ ID NO: 167560 - protein, 84 aa, Glycine max
  Coding DNA Sequence Number=SeqID_75875
MKNLIQTWWWRNGLCCHGHTWNSLEPILKANSKCKWGRKRNEGVLGEEGVCDAKVVVLSCESEVREHCAISGARHQRGGDACKT

SEQ ID NO: 167561 - protein, 74 aa, Glycine max
  Coding DNA Sequence Number=SeqID_75876
MCMRVSRFPSNILRVLLHESNKNDDGGSVSSKSGRNINGGCSDNGDGGGGGGAANAVGDDDNNDSGISGGNQWY

SEQ ID NO: 167562 - protein, 116 aa, Glycine max
  Coding DNA Sequence Number=SeqID_75877
MVPSSNDNEGINGANSIREVNRRERVIGAVEAGARKRNDEILAHIRVGNGVNLAELVEGDEAGVDDVDDGGGCRRDGVGDGNFEEELRGENVVLHVGVRDVDGVHGEKRDGIDLEE

SEQ ID NO: 167563 - protein, 29 aa, Glycine max
  Coding DNA Sequence Number=SeqID_75878
MLWVVKGGAGVSTVGDWVVTEKEHSAKSK

SEQ ID NO: 167564 - protein, 142 aa, Glycine max
  Coding DNA Sequence Number=SeqID_75879
  Gene Ontology: Mol. function=protein binding; Cellular component=RCAF complex; Biological process=female meiosis chromosome segregation
  Homolog annotation: Hit_ID=P59259; Match level="QueryCoverage=57%, HitCoverage=79%, E-value=4e-39, Identity=100%"; Hit description =Histone H4
  Pfam annotation: Domain name=CBFD_NFYB_HMF; Domain location=67-130; Score=5.0; E_value=0.055; Accession=PF00808.14; Description=Histone -like transcription factor (CBFNF-Y) and archaeal histone
  Pfam annotation: Domain name=Histone; Domain location=64-133; Score =68.8; E_value=1.8e-17; Accession=PF00125.15; Description=Core histone H2AH2BH3H4
  Pfam annotation: Domain name=TAF; Domain location=67-131; Score=-6.7; E_value=0.024; Accession=PF02969.8; Description=TATA box binding protein associated factor (TAF)
  Pfam module annotation: Pfam domain module=CBFD_NFYB_HMF::Histone::TAF ; Domain location=67-130::64-133::67-131
MKLQTSEDSLPAPINTAISKFKSKSQILKFDFLPISLEKMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 167565 - protein, 441 aa, Glycine max
  Coding DNA Sequence Number=SeqID_75880
  Gene Ontology: Mol. function=hydrolase activity, acting on ester bonds; Cellular component=plasma membrane; Biological process =pathogenesis
  Homolog annotation: Hit_ID=A7NYG7; Match level="QueryCoverage=90%, HitCoverage=92%, E-value=0.0, Identity=78%"; Hit description =Chromosome chr6 scaffold_3, whole genome shotgun sequence
  Pfam annotation: Domain name=Phosphoesterase; Domain location=37-396; Score=573.9; E_value=1.6e-169; Accession=PF04185.5; Description =Phosphoesterase family
MSLRRGVPLSLLVLFLLLVSPAATLAFRKKHKIPGPIKTIVVIVMENRSFDHVLGWLKSSRPDIDGLTGSESNPLSVSSPSSATIPVTDDALFIDADPGHSFQAIREQIFGSNDTSAVPPPMNGFAQQAESILLGMSKTVMSGFKPHTLPVYTALANQFGLFDKWFASVPASTQPNRFYIHSATSHGAMSNVRKDLIHGFPQKTIFDSLNENGLSFGVYYQNIPATLFFKSLRKLKNAVKFHDYALKFKKHAEKGKLPNYVVVEQRYFDVEVFPANDDHPSHDVAAGQMFVKEVYEVLRKSPQWEEMAVLITYDEHGGFYDHVATPVEGVPNPDGIVGPHPYYFRFDRLGVRVPTFIISPWIDKGTVIHEAEGPTPYSQYEHSSIPATVKKLFNLKSNFLTKRDAWAGTFEKYFYIRDTPRDDCPVSSPGIQCKQPFPDQT

SEQ ID NO: 167566 - protein, 121 aa, Glycine max
  Coding DNA Sequence Number=SeqID_75881
  Subcellular localization annotation: CTP_CleavageSite=65; ConfidenceScore=5.44e-01
MNALSTPAALSLFITTVNFFGFPDDPAKRTMLSANMLLFFSPLNKAKRNCYAKPLLSVKEAKRALCAKPKGHSSKAELSPACYAKPKPSSVLKIMASKKRKAPATPSQVRYDRSRFTSPEA

SEQ ID NO: 167567 - protein, 90 aa, Glycine max
  Coding DNA Sequence Number=SeqID_75882
  Subcellular localization annotation: CTP_CleavageSite=79; ConfidenceScore=5.20e-01
TYQGNPCGVYPDLSSFTGSGVYPDLSSLTGSGVYPDLSSFTEVASTQTYLPSPEVASTQTYLPSPEVASTLTYLPSPEVASSKNSTACIK

SEQ ID NO: 167568 - protein, 78 aa, Glycine max
  Coding DNA Sequence Number=SeqID_75883
MRDDKRSSYVIGIGVNSGVGLGGKFLIALELAPKSALPAGRVGVGAGAWGASLGMGAGALGCASAEMEESPTRAEKLE

SEQ ID NO: 167569 - protein, 144 aa, Glycine max
  Coding DNA Sequence Number=SeqID_75884
  Gene Ontology: Mol. function=nicotinate-nucleotide adenylyltransferase activity; Biological process=pyridine nucleotide biosynthetic process
  Homolog annotation: Hit_ID=UPI00005F7873; Match level="QueryCoverage =65%, HitCoverage=42%, E-value=3e-36, Identity=75%"; Hit description =COG1057: Nicotinic acid mononucleotide adenylyltransferase
  Pfam annotation: Domain name=CTP_transf_2; Domain location=7-128; Score=70.5; E_value=5.7e-18; Accession=PF01467.17; Description =Cytidylyltransferase
MSDLYALFGGTFDPIHYGHLRPVTALAQQVGLQKVTLLPNNVPPHRPQPEASAQQRVAMLRCAIADRPLFDIDTRELTRTTPSWTVDTLETLRAERGFSANVRKMASLAGTAVAVSPAGLSASRLRRADGYARDAAVAGCSPRA

SEQ ID NO: 167570 - protein, 43 aa, Glycine max
  Coding DNA Sequence Number=SeqID_75885
MTEDIFVFEMCADYCIGRLRMLPDFSQITIGYLCMSPDSHMSG

SEQ ID NO: 167571 - protein, 293 aa, Glycine max
  Coding DNA Sequence Number=SeqID_75886
  Gene Ontology: Mol. function=non-membrane spanning protein tyrosine kinase activity; Cellular component=integral to membrane; Biological process=capsule polysaccharide biosynthetic process
  Homolog annotation: Hit_ID=A6TBF7; Match level="QueryCoverage=85%, HitCoverage=37%, E-value=5e-83, Identity=60%"; Hit description =Tyrosine autokinase
  Pfam annotation: Domain name=Wzz; Domain location=53-267; Score =265.1; E_value=1.4e-76; Accession=PF02706.6; Description=Chain length determinant protein
MLFGHWLNGKEIPDPYRKSDEAFNSVYQLIELASQSWAAKLATTNKPATPDSDEIDLGRLLGELIDHRKLIISVTAVFTLLAILYALLATPIYQSDALIQVEQKQGNAILSNISQMLPDSQPQSAPEIALLQSRMILGKTVDDLNLQAQVTQKYFPLVGRGIARIMGEKPKTVTVSRLYLPSNTDDDEVPNIMITVKDKQHYQVNAIDAEPGDQFIIRQFTKLKAIADLQRIFNVSDQGKDTGMLTLTLTGDNPDLISQILDSISQNYLAQNIARQAAQDAKSLDFLNQQLPV

SEQ ID NO: 167572 - protein, 173 aa, Glycine max
  Coding DNA Sequence Number=SeqID_75887
  Gene Ontology: Mol. function=endonuclease activity; Cellular component=integral to membrane; Biological process=sodium ion transport
  Homolog annotation: Hit_ID=Q9AY32; Match level="QueryCoverage=33%, HitCoverage=87%, E-value=8e-24, Identity=96%"; Hit description=RRNA intron-encoded homing endonuclease
MVVTVKKLVVGPWVGSIGPPPVCTGRLVPSAGDALLSLTGRVVPPHGITPQDSDPIVLAFGIGVMINRDSRGHSYFIVRGEILGFMKDEQLRKHLPRMFSLIKNESWGLEDDQIPVLVSTINDADQGSADVAFRTPLAPYEKSKSLGSGGSMVARLKLKGIDGRAPPGVEPAA

SEQ ID NO: 167573 - protein, 41 aa, Glycine max
  Coding DNA Sequence Number=SeqID_75888
MILRGRLLLLMMTDIPLCLITLIMEVADPTCITARTCSGSV

SEQ ID NO: 167574 - protein, 162 aa, Glycine max
  Coding DNA Sequence Number=SeqID_75889
MDEVDIFVPHPFTNASLLIQLSPKCGCKPLVYLLKRPMLLSFDFQDRSIRDYSSCTLKVCLLERSELSRIGCWTNGLSYLKKGGVELRYKYYAPIKLSLSLFGLTMHTGTTLPLCSGILYNKRPRSLNPFSEIRRREEEISLKRDRLYNEDQSKFLIEYANG

SEQ ID NO: 167575 - protein, 97 aa, Glycine max
  Coding DNA Sequence Number=SeqID_75890
MTTLCKSRRRYQRVIIFISMGNLDTSKMITQSRFVTIRTISPNEKFVFMGNRVKAPTEAVGIYRIKLDTRHHLDLLESLCVPSLSKNLVSLSKLDVT

SEQ ID NO: 167576 - protein, 99 aa, Glycine max
  Coding DNA Sequence Number=SeqID_75891
MYQYPFQGHHTDTSASEHSFGGVAKTHPHFSWLTMTPSQQYHGPIPTPNAPLGTQWNVSGPIPNMGDLLGVDLRHEFSAEPDEEEAGRHRGRRNPDRQA

SEQ ID NO: 167577 - protein, 141 aa, Glycine max
  Coding DNA Sequence Number=SeqID_75892
  Homolog annotation: Hit_ID=A5ATR3; Match level="QueryCoverage=86%, HitCoverage=27%, E-value=5e-09, Identity=34%"; Hit description =Putative uncharacterized protein
MNPNETIQDMQKRFTHIINHLASLGKIFPNEDLINKVLRCLSKEWQPKEHEMELMRLNQNKENDKKKKGIALKASSSTQEGSDKEDSIEIDEDDDLSLFVKRFNKFLRVRGNQRRSNFQSKKTAEDSSSTPKCYECINMDI

SEQ ID NO: 167578 - protein, 85 aa, Glycine max
  Coding DNA Sequence Number=SeqID_75893
GQNRLRPQSEVETKLKAETNQEARVMTDKSSSLPSSGQAENATVRQPRDGLRPRVHPEAMGHATLPPLACYSCLNMRPPSARGIL

SEQ ID NO: 167579 - protein, 102 aa, Glycine max
  Coding DNA Sequence Number=SeqID_75894
  Subcellular localization annotation: CTP_CleavageSite=62; ConfidenceScore=5.06e-01
MYPLRKTLLTSILNSLKSIIPAKASNDLMASNLATGVSYPNFVRGPLFGGMQPSLDRLEGVQIATKPTWAFQGVPTEGGAFWWKQPSLPGRAGRQPPPSFLL

SEQ ID NO: 167580 - protein, 145 aa, Glycine max
  Coding DNA Sequence Number=SeqID_75895
  Homolog annotation: Hit_ID=A5B4G8; Match level="QueryCoverage=67%, HitCoverage=12%, E-value=3e-08, Identity=33%"; Hit description =Putative uncharacterized protein
MTRGNPSDLQPFDPEIDRTFHRLVRHHFVPFDHPEHSVIGDFEHPDFEHYNFEHSENMAQPPPRERTLREMAAPDFTYESLCIQYPDEDVPYVLKTGLIHLLPKFHGLAGEDPHKHLKEFHIVCSTMKPLDVQEDHIFLRLFLIL

SEQ ID NO: 167581 - protein, 119 aa, Glycine max
  Coding DNA Sequence Number=SeqID_75896
  Homolog annotation: Hit_ID=A5AD63; Match level="QueryCoverage=56%, HitCoverage=10%, E-value=1e-10, Identity=50%"; Hit description =Putative uncharacterized protein
MQQQQQQQQQRQQATEALPQPCIIGNNKFENAMLDLGALVNVIPLSIFNSLSLGPLQSIDVVIHLANESVAYPAGNIHFYLICILVIPYALNLNLSLNLILYLIFILRVNLNLNLVLIF

SEQ ID NO: 167582 - protein, 270 aa, Glycine max
  Coding DNA Sequence Number=SeqID_75897
  Homolog annotation: Hit_ID=Q84VH5; Match level="QueryCoverage=100%, HitCoverage=63%, E-value=1e-71, Identity=67%"; Hit description =Envelope-like protein
  Subcellular localization annotation: CTP_CleavageSite=21; ConfidenceScore=5.25e-01
MATSPKETSAPGSPSVPSSPSSTKAPSNQERPEFNIQPIQMIPGQAPVPEKLVPKRQQGVKISENPSLATSPREVDTEMDKKIRSIVSNIPGPPQMFLFLMHHWNSTSIPLPNAERSEIRFNADFLERELGRAALDARSHGPLITAAGLLKTVTKLGDCYESLVREFIVNIPSDITNRKSDEYQRVFVRGKCVRFSPAVINKYLGRPTDGVVDITVSEHQIAKEITAKQIQHWPKKGKLSAGKLSVKYAILHRIGAANWVPTNHTSTVAT

SEQ ID NO: 167583 - protein, 108 aa, Glycine max
  Coding DNA Sequence Number=SeqID_75898
  Homolog annotation: Hit_ID=A7QKD3; Match level="QueryCoverage=50%, HitCoverage=8%, E-value=1e-15, Identity=67%"; Hit description =Chromosome chr2 scaffold_112, whole genome shotgun sequence
VNGDTLFLTSNFKEFKVENHESSTWDENNALTSTVDYLASIDSATHASLDINSDLQLAIALQQQEFEQQPPRQDNSQQQSSISGSSRLVTGPKPMDGIIFNFVGNLYY

SEQ ID NO: 167584 - protein, 262 aa, Glycine max
  Coding DNA Sequence Number=SeqID_75899
  Homolog annotation: Hit_ID=Q84VH5; Match level="QueryCoverage=92%, HitCoverage=39%, E-value=1e-116, Identity=80%"; Hit description =Envelope-like protein
MDLIKAAGLLKTVTKLGDCYESLVREFIVNIPSDITNRKSDDYQRVFVRGKCVRFSPAVINKYLGRPTDGVMDIAVSEHQIAKEITAKRVQHWPKKGKLSAGKLSVKYAILHRIGAANWVPTNHTSTVATESFAVKLPIAFPTVLCGIMLSQHPNILNYTDSVMKRESPLSLHYKLFEGTHVPDIVSTSGKAAASGAVSKDALIAELKDTCKVLEATIKANTEKKMELERMIRRLSESGIDDGEAAEEEEEAAEEEEEAAEA

SEQ ID NO: 167585 - protein, 77 aa, Glycine max
  Coding DNA Sequence Number=SeqID_75900
MIHLDEARWGHRVHFSNSADSGNCNRIIFFMLIMASIIVVIFSLMASMSAFICSCTSFTSPITLALARIRGKCKDHA

SEQ ID NO: 167586 - protein, 558 aa, Glycine max
  Coding DNA Sequence Number=SeqID_75901
  Gene Ontology: Cellular component=exocyst; Biological process=vesicle docking during exocytosis
  Homolog annotation: Hit_ID=A7PHZ9; Match level="QueryCoverage=91%, HitCoverage=69%, E-value=0.0, Identity=69%"; Hit description =Chromosome chr13 scaffold_17, whole genome shotgun sequence
MENVPGAYNAAGSTLLENDDELPTTTAVALAAHNSQPLSRRTRSLKGDNQNSLQIDGSYRPASMDGGSFDGHDEADSNEEATLDGNMATARINGNDIPKDSNNALRQMPTWLSNSTPDEFLETIRKSDAPLHVKYLQTMVECLCMLGKVAAAGAIICQRLRPTLHEIITSKIKAHAELLNSSRSIGQGSRTGTGNLHFIKGQLESYQLPKQKHKNGISIAGTLLAVSPVSPLMAPGGKAQVAAKELLDSILDAVVRIFENHVIVGELLEAKASQHADLNTPKSLPVDVNWSPDSEASQVTGGYSIGFSLTVLQSECQQLICEILRATPEAASADAAVQTARLASKVPSKDKRQDEPYCNGMFAALDGSEDGLTFAFRFTDATISVPNQGVDLVRQGWSRKGPNVLQEGYGSAAVLPEEGIYLAASIYRPVLQFTDKVASMLPTKYSQLGAHVATTYTSSIEKGRPVLQGLLAIDHLTKEVLGWARAMPKFSNDLVKYVQTFLERTYERCRTAYMEAAVRDRCVAAGARRRCLCRCVAAGGRRGCMRVRLRVSRLGARV

SEQ ID NO: 167587 - protein, 68 aa, Glycine max
  Coding DNA Sequence Number=SeqID_75902
  Subcellular localization annotation: CTP_CleavageSite=50; ConfidenceScore=5.71e-01
MAWNSLFSSGNSLLTSQTLGFPPLFNRSKTKFFPLQLKRTMRYPPPPLITNEKVASCIRTYICSTESS

SEQ ID NO: 167588 - protein, 331 aa, Glycine max
  Coding DNA Sequence Number=SeqID_75903
  Gene Ontology: Mol. function=DNA binding; Biological process =regulation of transcription
  Homolog annotation: Hit_ID=A7QBX3; Match level="QueryCoverage=87%, HitCoverage=90%, E-value=6e-46, Identity=64%"; Hit description =Chromosome chr1 scaffold_75, whole genome shotgun sequence
  Subcellular localization annotation: CTP_CleavageSite=55; ConfidenceScore=5.10e-01
MSDPSTLLPSSHHHHNHHVPLIQGGATAPSSSSTTLAREYRKGNWTIQETLILITAKKLDDERRLKTPAACSTSTTTTRTSGELRWKWVENYCWSHGCLRSQNQCNDKWDNLLRDYKKVRDYESKSNDNDNNNNKHFPSYWTLNKQQRKEQNLPSNMVFEVYQTIADVLQRKQTQSQRQHQQPLAIPLVTSSPSPLQTLPPPPLPPPPPPPPPPPPVSSTTPVGSERSESSGTEHSEDDDDGSESKRRKVKNLGSRIMQSASVLARALRSCEEKKEKRHREMIELEQRRIQMEEARNEVHRQGIATLVAAVTNLSGAIESLINNSERHGQR

SEQ ID NO: 167589 - protein, 151 aa, Glycine max
  Coding DNA Sequence Number=SeqID_75904
MGATQWESTCILSTPVSVSGDADRLVNIAGSVASKVECSGEGEISGVKLCGGRWRQTRYADGVCASRTYGWLPDQMDKDEWMYEIMSERADMDYENAESCGANEPHVDCSEAFKTSQCRENVLRWARSVAHENGFVVVILRSDTNTSSRGR

SEQ ID NO: 167590 - protein, 61 aa, Glycine max
  Coding DNA Sequence Number=SeqID_75905
MVVVVLLAESVAAEECHYHPILNLLFLAQGASSQRVVIHSDINQKMKEVGVELNQKELRAR

SEQ ID NO: 167591 - protein, 171 aa, Glycine max
  Coding DNA Sequence Number=SeqID_75906
  Gene Ontology: Cellular component=exocyst; Biological process=vesicle docking during exocytosis
  Homolog annotation: Hit_ID=A9P896; Match level="QueryCoverage=61%, HitCoverage=11%, E-value=1e-29, Identity=66%"; Hit description =Putative uncharacterized protein
MAPPSQTRHATAIRWRFFEKPPWPPFNNTGNNHWLIIIKKLRTQFYDQMAVLEKQSYMLIGRHDIEKLMRIDPSSAYLPNLLGQLNVESNSSDAETIEAELELGELLLNLRPIKQENLIHDDNKLILLASLSDSLEYVADSIERFWVVEQSHSQQESCFGGIVEGLQRLVE

SEQ ID NO: 167592 - protein, 170 aa, Glycine max
  Coding DNA Sequence Number=SeqID_75907
  Homolog annotation: Hit_ID=A5B2I6; Match level="QueryCoverage=67%, HitCoverage=6%, E-value=6e-08, Identity=27%"; Hit description =Putative uncharacterized protein
MVTKANARMETCMEAMEKAIEENREAVELQLSSIEGMIQRLAAAWEKKTPETNVHVVDKSGEDEAVREKDKLEAVMVAMDGEALGWFQWWESWNPNHSWDGFKIAVTQRFQASSLENPFQEPFLVEVFLTGLKEEISIEVRLHEPKNMMEAMVKAQRVEDKNRISGKLLV

SEQ ID NO: 167593 - protein, 1906 aa, Glycine max
  Coding DNA Sequence Number=SeqID_75908
  Gene Ontology: Mol. function=binding; Cellular component=centrosome; Biological process=establishment and/or maintenance of microtubule cytoskeleton polarity
  Homolog annotation: Hit_ID=Q8S912; Match level="QueryCoverage=99%, HitCoverage=92%, E-value=0.0, Identity=69%"; Hit description =Microtubule bundling polypeptide TMBP200
  Pfam annotation: Domain name=HEAT; Domain location=1140-1175; Score =2.5; E_value=11; Accession=PF02985.13; Description=HEAT repeat
  Pfam annotation: Domain name=HEAT; Domain location=1178-1210; Score =8.2; E_value=1.6; Accession=PF02985.13; Description=HEAT repeat
  Pfam annotation: Domain name=HEAT; Domain location=214-250; Score =15.8; E_value=0.12; Accession=PF02985.13; Description=HEAT repeat
  Pfam annotation: Domain name=HEAT; Domain location=256-291; Score =1.4; E_value=17; Accession=PF02985.13; Description=HEAT repeat
  Pfam annotation: Domain name=HEAT; Domain location=30-67; Score=0.9; E_value=20; Accession=PF02985.13; Description=HEAT repeat
  Pfam annotation: Domain name=HEAT; Domain location=309-344; Score =30.3; E_value=7.1e-06; Accession=PF02985.13; Description=HEAT repeat
  Pfam annotation: Domain name=HEAT; Domain location=545-583; Score =2.6; E_value=11; Accession=PF02985.13; Description=HEAT repeat
  Pfam annotation: Domain name=HEAT; Domain location=623-660; Score =6.5; E_value=2.9; Accession=PF02985.13; Description=HEAT repeat
  Pfam annotation: Domain name=HEAT; Domain location=727-763; Score =25.2; E_value=0.00024; Accession=PF02985.13; Description=HEAT repeat
  Pfam annotation: Domain name=HEAT; Domain location=769-805; Score =3.0; E_value=9.7; Accession=PF02985.13; Description=HEAT repeat
  Pfam annotation: Domain name=HEAT; Domain location=810-846; Score =7.9; E_value=1.8; Accession=PF02985.13; Description=HEAT repeat
  Pfam annotation: Domain name=HEAT; Domain location=887-922; Score =14.1; E_value=0.21; Accession=PF02985.13; Description=HEAT repeat
  Pfam annotation: Domain name=VHS; Domain location=727-868; Score= -39.0; E_value=0.047; Accession=PF00790.10; Description=VHS domain
  Pfam module annotation: Pfam domain module=HEAT::HEAT::HEAT::HEAT::HEA T::HEAT::HEAT::HEAT::HEAT::HEAT::HEAT::HEAT::VHS; Domain location =1140-1175::1178-1210::214-250::256-291::30-67::309-344::545-583::623- 660::727-763::...
  Pfam module annotation: Domain location=769-805::810-846::887 -922::727-868
MEKAIKNKVAKAVVPAIDVMFQALSDFGAKIVPPKRILKMLPELFDHQDQNVRASSKGLTLELCRWIGKDSVKSILFEKMRDTMKKELEAELVNVTGTAKPTRKIRWMLILMVLNFPIPMYGHYHFILSCRRSEQDKEPEQEAVSEVVGPGPSEESGNDAPQEIDEYELVDPVDILIPLEKSGFWDGVKATKWSERKEAVAELTKLASTKRISPGDFSEVCRTLKKLITDVNIAVAVEAVQAIGNLARGLRTHFSSSSRFLLPVLLEKLKEKKPALAEALTQTLQAMHKAGCISLIDIVEGSNKGVIMKVHKDYVPICMECLNDGTPEVRDAAFSALAGIAKSVGMRPLERSLEKLDDVRRKKLSEMISGSEDAVPGASSAASVQNTRVSASSAESSESAFVKRSAAGMLSGKRPVQSVPVAKKGGVVKSGTNKKTDGVPQVKASKSVEPPEDVEPTEMSLEEIESRIGSLIQSDTITQLKSAVWKERLEAISSLKQQVEGLQDLDQSVEILIRLVCTLPGWSEKNVQVQQQVIEVITHIGSTATKFPKKCVVLCLSGLSERVADIKTRAHAMKCLSTLSEAVGPGFIFERLYKILKEHKNPKVLSEGILWMVSAVEDFGVSHIKLKDLIDFLKEIGLQSSNAATRNASIKFLGVLHRFVGPGSKVFLLADIKGFLTDVKPALLSALDTEYEKNPFEGASAVTKRTVRASDSSSTAVAGGLDSLPREDISGKITPTLLKSLESPDWKVRMESVDAVNKILEEANKRIQATGTGELFGALRGRLVDSNKNIVMASLTTIGNVASAMGQAVEKASKGILSDVLKCLGDNKKHMRECVLNTLDAWLAAVHLDKMVSYIAIALMDSKLGAEGRKDLFDWLSKQLSELSSFAEAAQLLKPASSAMTDKSSDVRKASEACINEILRVSGHEMIEKMVKDIHGPALTLVLEKLKPYGAFQGTFFESFESGRAVSVGATSKAKAGKSTANGVSKHGNRAVSSRVVATKGTKSESISVQDIAVQSQALLNIKDSNKEDRERMVVRRFKFEDPRIEQIQDLENDMMKYFREDLHRRLLSADFKKQVDGLEMLQKALPSIAKEVIEVLDILLRWFVLQFCKSNTTCLLKVLEFLPELLDTLKDEGYSLTESEVAVFLPCLVEKLGHNIEKVREKMRELTKQFVAIYSASKCFPYILEGLRSKNNRTRIECADLVGFIIDHHGAEISGQLKSLQIVASLTAERDGETRKAALNALATGYKILGEDIWRYVGKLTDAQKSMLDDRFKWKVREMEKKKEGKPGEARANLRRSVRENGSDVAEQSGEMARSLTGPMLRKNYAQPDSNIDRQLMPHPMTVASGPTDWNEALDIISFGSPEQSVDGMKVVCHELAQATSDPEGSAMDELVKDADRLVSCLANKVARTFDFSLTGGASSRSCKYVLNTLMQTFQNKRLAHAVKESTLDSLITELLLWLLDDRVPHMDDGSQLLKALNVLMLKILDNADRTSSFVVLINLLRPLDSSRWPSPALNESLASRNQKFSDLVVKCLIKLTKVLQSTIYDVDLDRILQSIHLYLQDLGMEEIRRRAGADDKPLRMVKTVLHELVKLRGAAIKGHLSMVPIDAKPQPIILAYIELNLETLAAARMLTASGPGGQNHWGDSATNNSASGTHSADAQLKQELAAIFKKIGEKQTCTIGLYELYRITQLYPKVDIFAQLQNASEAFRTYIRDGLAQMEKNAAAGRTPSSLPMPTPPPASLNISSPDFAPLSPVNTNPLGDAKLNVKPDPTNFNLPPSSYNEENRAVNAITSRALNSDYTLGDQRNDRFMTGVTSGTLDAIRERMKSMQLAAAAGSTESGGRHLTSANDNLNHGLPPPSQIPHASEHVGTENTMHGGVLPMDEKALSGLQARMERLKSGSLEPL

SEQ ID NO: 167594 - protein, 66 aa, Glycine max
  Coding DNA Sequence Number=SeqID_75909
  Gene Ontology: Mol. function=protein binding
  Homolog annotation: Hit_ID=Q2HVB4; Match level="QueryCoverage=66%, HitCoverage=10%, E-value=1e-12, Identity=84%"; Hit description =BTB/POZ; MATH
MHTVSSSNGSGGGVLASRTSLRSVTETVNGSHKFVIKGYSLAKEIGVEKHIASEMFTCKLLPLRTV

SEQ ID NO: 167595 - protein, 155 aa, Glycine max
  Coding DNA Sequence Number=SeqID_75910
MNIQYEDKERLASVYTMYSHSPMAEQAIRLVRVVGEEVVKDNAKGSDIDLRVVVVDTAEDLRHGNVEELVVEVLSEGREAEVEDLEVQKAADDSLSEADWLSETHPLSKASNSLSGWKILEEDNELSRAKKSKSLQNTEVGGNEKGNWSRATRRV

SEQ ID NO: 167596 - protein, 90 aa, Glycine max
  Coding DNA Sequence Number=SeqID_75911
MASYDGDLLLNSSSPGSGVSSLSSFSILLPFIFQEAKELIDEEDPRPASSNGAYIRKGPVTRAMSKRLQEDWARAAEQGPRVLMNLNVDF

SEQ ID NO: 167597 - protein, 154 aa, Glycine max
  Coding DNA Sequence Number=SeqID_75912
ALGFPSLIIGLCQSFGVPVAPTKGNSAAHHQRQAQGDAPQAASAPPPPHQAGQAGAFDMEQYLRHLVRQHVANHRAHVQTHDCLYQMSLSMQSQGFASFSCPTPDQFRAEVAWPGDWPEAQAGEAPPEAPGDGEEAHEDEEMADLLDFLGGTGD

SEQ ID NO: 167598 - protein, 115 aa, Glycine max
  Coding DNA Sequence Number=SeqID_75913
MEAQLIHDRVVMECLEGVWETLEGNERCRFRGTIRLTATSLPVQVIEVSSSEEDPEEDPEELPPEPAVDALDLPEDDEDPLLDVDFPEDIMSASEADSIEDSGLGGTANSEDSSS

SEQ ID NO: 167599 - protein, 101 aa, Glycine max
  Coding DNA Sequence Number=SeqID_75914
MVAITPTKVHQPPFLREYDSNATCACHGESPGHSIEHYRGLKRKVQGLIDAGWQKFEENRVIFKCKPLVYLLKRPVTIQSEITRLTRWWGCHKTTSKVQNK

SEQ ID NO: 167600 - protein, 91 aa, Glycine max
  Coding DNA Sequence Number=SeqID_75915
DDKGDDKKLKDQSKNNASESKINQRTTQVNQEEFKTQEESLESRIKIQGSRSQESRFKVQDLKNQDQDSRLKIQKSREGSIKISMKSFSKN

SEQ ID NO: 167601 - protein, 89 aa, Glycine max
  Coding DNA Sequence Number=SeqID_75916
MNPKERWSLVSSDNKQEVIPTSCNEPKDVGLLCLVINQEANVASCNEPKERWSLVFSVCNQEDLFLKTVTKSRSLEKLFVRMEERKKIE

SEQ ID NO: 167602 - protein, 141 aa, Glycine max
  Coding DNA Sequence Number=SeqID_75917
MHLRTREPRKSSLLTAHLGAQCPMCAVKKTIWIFRLPTTKDETHIQRMCDGMMQMRKSAIGECTEGMEYQRQHIIKRESSRRGFTIIKQVDKSGALAPTYPPSKRKSDLRSSSFKGESSDSFYLKGDHFKALDLKNDPFTW

SEQ ID NO: 167603 - protein, 85 aa, Glycine max
  Coding DNA Sequence Number=SeqID_75918
MKDKRAEEEKLEKQKKKKDSKALSSKAKGEEKEEKDSSKKIVKKENHFATKEIPPGLPPLRGIEHQIDLVPSVRSSGLRIIRKGG

SEQ ID NO: 167604 - protein, 128 aa, Glycine max
  Coding DNA Sequence Number=SeqID_75919
MSKSCGFGMTGPLDESISCFLIRVDPWVLVPITFRGLHLLANRGLHALTFRGLHVLALRGLHALTLGLHVLTIRGLHALTSRGLHVLALRGLHALTLGTSYPHRQRTTRPRLERTTRPHHQRAARPYL

SEQ ID NO: 167605 - protein, 70 aa, Glycine max
  Coding DNA Sequence Number=SeqID_75920
  Gene Ontology: Mol. function=helicase activity; Biological process =viral genome replication
  Homolog annotation: Hit_ID=Q9C8V4; Match level="QueryCoverage=97%, HitCoverage=9%, E-value=3e-22, Identity=77%"; Hit description =Putative uncharacterized protein T22A15.15
MTINKSQGQSLSMVGLYLPKPIFSHEQLYVALSRVNSRKGLKILIHDKDQKNMTSTTNVVFKEVFKNLTS

SEQ ID NO: 167606 - protein, 122 aa, Glycine max
  Coding DNA Sequence Number=SeqID_75921
SQVIQNYVGLSSSLRIRRSKNLAFVGRPTISVILTLRSCEPDDMRETNYGHFRTLFLHSEHESCPSGRRDKLWSFCALLSFRDKTNYGHSAPFHPSSIVSDGTQRQIMVILRLCVIQRNEFD

SEQ ID NO: 167607 - protein, 230 aa, Glycine max
  Coding DNA Sequence Number=SeqID_75922
MTTLTQIWMTLLLSNILPSDHNSDLPLPKCQLVYAILTRMSIYVAQLIADAIYIFAGITPTRHPLDPDKSNRALGFPALITGLCQSFDVPVAPSKVIRPPITRAFIEKYCTQRQVQGDAPQAADAPPPHQAGPAGSFDTEQYLRHLVRQQAANHRAHVQTHDCLYQMSLSLQSQGFTSFPCPTPDQFRPEARAGEASAEAPAEAPDEADEAREDEEMTDLLDSLGGSGAT

SEQ ID NO: 167608 - protein, 65 aa, Glycine max
  Coding DNA Sequence Number=SeqID_75923
MHLRDQGSHNHSQTHLKLSNWLLLQALVSAELHTAKSLKTLWNWTFLSLETLDMQSSESQSKLPL

SEQ ID NO: 167609 - protein, 108 aa, Glycine max
  Coding DNA Sequence Number=SeqID_75924
MRRYLMVIHTFCQPEASEPVDTQRLTSSSAPLSSRDVKSDDMRRYPSGYLYKRFLLILAREVRWRAEIPERLSVQRRILLILIREVRWQVEIPYGYPQILSIKGKRAR

SEQ ID NO: 167610 - protein, 54 aa, Glycine max
  Coding DNA Sequence Number=SeqID_75925
MDKSLKVEEDERRERKRRSTKFSVSKEVRFSPLIQDQVQDSPLSVLRCHGASKA

SEQ ID NO: 167611 - protein, 132 aa, Glycine max
  Coding DNA Sequence Number=SeqID_75926
METNSFINVKPTTTIGKNLADTTPFDLEITKTERKNRKKKKEETTITPENNMVERGGEGNRPPRRTLGDYAYHQGPKHYNSIVIPPFSNKVVELKPTLLSLIGSHLFAGMDHEDPYTTFVYLHGTMKYYGSF

SEQ ID NO: 167612 - protein, 89 aa, Glycine max
  Coding DNA Sequence Number=SeqID_75927
MPPIVVMTLAKVYVKNLATIIEGTIVHILNIIPKEEKSIEGFKRLNNSLLAIILAKRENFHWLPLAFKGMPYIGGLPLLGNEGFMGILQ

SEQ ID NO: 167613 - protein, 233 aa, Glycine max
  Coding DNA Sequence Number=SeqID_75928
  Gene Ontology: Mol. function=allantoin uptake transmembrane transporter activity; Cellular component=integral to membrane; Biological process=allantoin transport
  Homolog annotation: Hit_ID=Q2QQ91; Match level="QueryCoverage=95%, HitCoverage=51%, E-value=3e-69, Identity=59%"; Hit description =Ureide permease 2, putative, expressed
  Pfam annotation: Domain name=FAE_3-kCoA_syn1; Domain location=1-183; Score=175.3; E_value=1.6e-49; Accession=PF07168.2; Description=Fatty acid elongase 3-ketoacyl-CoA sy
MTSYPIAQRLFAMRRGTSVTTFKETSEVESKDLEDGTHKAKAGTAAFLIELEKKRSIKVLGKSTFIGLAITFFAGVCFSLFSPAFNLATNDQWHTLKKGVHHLSVYTAFFYFSVSCFVIAIILNITFLYHPVLNLPKSSLKAYLSDWDGRGWAFLAGLLCGFGNGLQFMGGQAAGYAAADAVQALPLVSTFWGIVLFGEYRKSSRRTYVLLGSMLLMFVAAVAVLMASSGHRK

SEQ ID NO: 167614 - protein, 98 aa, Glycine max
  Coding DNA Sequence Number=SeqID_75929
  Subcellular localization annotation: CTP_CleavageSite=42; ConfidenceScore=5.12e-01
MSQASNKAFKGFGRKLVTHKLNFGFCKVKHNGIFTEFNCKVKHSGRGNLLPPSPMTPPGLHLREPGNDIHSRNILLERNVILYITEFDEFHQELERWN

SEQ ID NO: 167615 - protein, 116 aa, Glycine max
  Coding DNA Sequence Number=SeqID_75930
MEVSGGGGRKKRKGRGKDMLGRRKEKKEERKKNRHEKGKRKRRRRRRRDRRKGGGESRGVGKWNVGKEKRHEREEVEHWKEVVGNNVMLNAYAICKKDSVFQIEQKSNAKADGSGE

SEQ ID NO: 167616 - protein, 320 aa, Glycine max
  Coding DNA Sequence Number=SeqID_75931
  Gene Ontology: Cellular component=cytoplasm
  Homolog annotation: Hit_ID=O04237; Match level="QueryCoverage=39%, HitCoverage=32%, E-value=6e-26, Identity=50%"; Hit description =Transcription factor
  Pfam annotation: Domain name=HABP4_PAI-RBP1; Domain location=184-274; Score=40.4; E_value=6.2e-09; Accession=PF04774.6; Description =Hyaluronan  mRNA binding family
  Subcellular localization annotation: CTP_CleavageSite=41; ConfidenceScore=5.43e-01
MTLMPLLRSCPPYFTRVVHSLPHLGRALTSSFTHRLTKCLLCVTSSSCATIIKEVRTLLYFVAVSFNIRSLLFQQSKARVNNPKTLLLRIVVEIGCIERALWYKGIELPIGCTTTTCGIRDSSNDENSFPTSGDPYNQVSFKGDAGKSFERRGYGGPRGPYRGGGGHRGGFSNGEIGEAEEGQPQRAFDRCNGIGRGNEFKREGSGRGNWGTQTDELAQVTDKVANETEKNLGDEKPTIEEDIVDGGTNFVRTLDPKAVNDENCTGNTSDGGNNTCNSPSLSLSWGIRRCKNLVKCRLGEEQDESEEEAKRATVLFPNKK

SEQ ID NO: 167617 - protein, 65 aa, Glycine max
  Coding DNA Sequence Number=SeqID_75932
MDTLEFSAQGTVLPEEVEDGGTLQLAEEKKRRKRRKKRDMNLSHEVEDRELFISETEENRGGRKK

SEQ ID NO: 167618 - protein, 378 aa, Glycine max
  Coding DNA Sequence Number=SeqID_75933
  Gene Ontology: Mol. function=ATPase activity, coupled to transmembrane movement of substances; Cellular component=integral to membrane; Biological process=transport
  Homolog annotation: Hit_ID=A7P2I5; Match level="QueryCoverage=51%, HitCoverage=49%, E-value=2e-82, Identity=81%"; Hit description =Chromosome chr1 scaffold_5, whole genome shotgun sequence
  Pfam annotation: Domain name=cobW; Domain location=204-374; Score =211.6; E_value=1.8e-60; Accession=PF02492.10; Description=Cobalamin synthesis proteinP47K
MAKGLSLARMHTWNNLSLGQSFSNLVAFSKGKADGYKLMEFIKQKPTIVEDSSEGNYPSRPDVFIFRNFSIFFPAGKTVAAVGGSESGKITVVSLIESYNADHFEMPKQTLQLKWLGYQIGLVNQEPALFATTILENILYGKPVATMAEVEAATSAANAHSFITLLPNGYNTQWILHDEDEVPPLAVQIQGNDDSVYQRSSSVGVTLITGYLGAGKSTLVNHILNTQYGKRIAVILNEFGEEKGVERAMINEGGKGALVEEWVELANGCICCTVKHSLVQALEQLVQRKERLDHILLETTGLANPAPLASVLWLDEQLESEVRLDSIVTVVDAKNLRFQLEEHRGSSSFPEAYFQITFADIIILNKVDLVCAESSGET

SEQ ID NO: 167619 - protein, 42 aa, Glycine max
  Coding DNA Sequence Number=SeqID_75934
MDGTQSDVCSGLMQLGFCFVSLRFGLEKMEGRNGSVEPSVLD

SEQ ID NO: 167620 - protein, 82 aa, Glycine max
  Coding DNA Sequence Number=SeqID_75935
MKEHVKFQGHGLECFAKGNMVNASNLAASFPHDHECSDEILEAVARKVPPMRLKLNRFERISRSPPSPDEGLRSIPAPKNFW

SEQ ID NO: 167621 - protein, 91 aa, Glycine max
  Coding DNA Sequence Number=SeqID_75936
MSPSPLGSHNHSQTHLKHSEWLPLRTCISADLHTAKSLRTVWNLDLSLSRTFVHAELLKKCPNSLCKSDFRPLKVALSEFSLSQQLGLAKE

SEQ ID NO: 167622 - protein, 108 aa, Glycine max
  Coding DNA Sequence Number=SeqID_75937
  Homolog annotation: Hit_ID=A5CBJ4; Match level="QueryCoverage=54%, HitCoverage=5%, E-value=1e-08, Identity=49%"; Hit description =Putative uncharacterized protein
MTRGNPGDLQPFDPEIDRTFHILFRHSVHPDHSVHSEHSVHFEYSVAGEDPHKHLKEFHIVCSTMKPPDVQEDHIFLKAFPHSLEGVAKDWLYYLAPRSITSWDDLKR

SEQ ID NO: 167623 - protein, 118 aa, Glycine max
  Coding DNA Sequence Number=SeqID_75938
METTSKRFEQLNICGKVHFKSKLREIAYLDMNSMCPSPEKVKTKGAPKKPLTKQEKSTKRDRSYWEYVDALHSVQNKMVMQSYPARALDRRLQVDWARDPTEGPRVLMSLRVDFEPVG

SEQ ID NO: 167624 - protein, 115 aa, Glycine max
  Coding DNA Sequence Number=SeqID_75939
AMQFRMHQEVLDCVATFFGTKGIDGGSSQYCIIIMILQRILLGERAVYAMMLVFPPEFSPLKTILFGNPSQDTVEPLMEALEEDYKDGNEINESRQFIGGVLDLEKRINRLDTLT

SEQ ID NO: 167625 - protein, 49 aa, Glycine max
  Coding DNA Sequence Number=SeqID_75940
MGLKAETNQGKTVLRDGRKKRLGSRSIDRHLMPCTRLAGSATGAQPSIL

SEQ ID NO: 167626 - protein, 156 aa, Glycine max
  Coding DNA Sequence Number=SeqID_75941
MYEYLEEQRVPDLESILADFMTYQASSKGSCYGMQQQGTQFQRNQSSTGYHWESCWLPDYDDKAEGVINLDDLLMQFKDAVESMQHAFRRIATQISKLVDDMANTEARQEEERVEIETYQESIFQVTSIHHHMTTEEETSKVSSTPEYSCSAAAGY

SEQ ID NO: 167627 - protein, 107 aa, Glycine max
  Coding DNA Sequence Number=SeqID_75942
MAKNVHRLIMKMSRKHYGSVKPLPLSPLHPFIAKIREEIDAQLAQTLVSIATPLGLEVIPQVKELLDEGLVCKSLNPCALLVPKIAPHIKLVRNHVPSSEDAQERGF

SEQ ID NO: 167628 - protein, 59 aa, Glycine max
  Coding DNA Sequence Number=SeqID_75943
MMLMLRMTMRRDNVDVDDNIEEYLYLGHVPRFGTPLRLRLITVGGELPVHDKVTSTLTA

SEQ ID NO: 167629 - protein, 39 aa, Glycine max
  Coding DNA Sequence Number=SeqID_75944
MTMKKRLSFEVQKVAVGLSVHPPLSAASVCLAPRRIWQS

SEQ ID NO: 167630 - protein, 76 aa, Glycine max
  Coding DNA Sequence Number=SeqID_75945
MVFHLRLVMSFKTKKGEHRLKGAIKENNSRKHQQESSQGYCASNQWGKTHQKIMMMDGSNSHKGNHFQIEEQLPIS

SEQ ID NO: 167631 - protein, 44 aa, Glycine max
  Coding DNA Sequence Number=SeqID_75946
MAEEWRRRKGDWRCHFNEKMSQELKVMVQPTNPRSSPRFSTKCA

SEQ ID NO: 167632 - protein, 344 aa, Glycine max
  Coding DNA Sequence Number=SeqID_75947
  Gene Ontology: Mol. function=transporter activity; Cellular component= cell outer membrane; Biological process=nutrient import
  Homolog annotation: Hit_ID=Q6DB45; Match level="QueryCoverage=84%, HitCoverage=34%, E-value=1e-130, Identity=74%"; Hit description =Putative TonB-dependent heme receptor
  Pfam annotation: Domain name=TonB_dep_Rec; Domain location=86-262; Score=16.2; E_value=0.0034; Accession=PF00593.15; Description=TonB dependent receptor
MYYPSQVKNASYNYGYFQPYYMPAGEQETRSVYLQDAVSFGSLTVTPGVRYDHVTNTGQPNRAPRYNDSDPLVGHDYSSVTYTGWSPHLGVMWKATSNLSLFADVSRTWRAPVIDEQYEVQYAASSVPGTSRGLQVERMTGVRLGAVLDFNDVSMARDSLQIRTTLFRNRGKDEIFYRRGVVCDAARHGGQCGQPLSNYRNLPGYTIEGVELESFYDSESLFGSLSFSSIRGKRDASPRDPWGNETWIAEIPPVTAHAMLGMKVPQWDMAFGWTGDFVRKQDRSPADGDPMALSGRCRKRRVMHCTACSPRGSQRFAGLRKLASRWTTCSTAIITLTWANRCPA

SEQ ID NO: 167633 - protein, 266 aa, Glycine max
  Coding DNA Sequence Number=SeqID_75948
  Gene Ontology: Mol. function=motor activity; Cellular component=cell projection
  Homolog annotation: Hit_ID=UPI00016621D1; Match level="QueryCoverage =79%, HitCoverage=40%, E-value=3e-16, Identity=29%"; Hit description =UPI00016621D1 related cluster
GLHVLAFRGLRALALRGLHILAFRGLHALTFKGLHILAFRALHVLDFRGLHVFAFRGLHALSFRGLHILTFKGLHLLDFRGLHVLALRGLHILAFRGLQVLSFKGLHALAFRGLDVLAFRGVHVLDFRGLHVLALSGLHVLPLKGLHVLALRGLHVLAFRGLHILDFKGLHALAFRGLHVLAFRGLHVLPFKGLHILPFRGLHVLAFRGLRALALRGQHILTFRGLHALTFKGLCRNLPFGGRATRDSRDACSTKGIRAESPPTFI

SEQ ID NO: 167634 - protein, 54 aa, Glycine max
  Coding DNA Sequence Number=SeqID_75949
MGVQIAPRPTWALRNIPPEGAEALPKRFRNVFREEFRKDFNRSSFVLHRSSIFN

SEQ ID NO: 167635 - protein, 89 aa, Glycine max
  Coding DNA Sequence Number=SeqID_75950
RVFASWMLICSGIGFTMSACLMLFGVFVGYDLRTVEPMARLDQQNWKIGNMWPWMGGSRKVAIGLAKLFCVALLVALFFEYASSVYVIS

SEQ ID NO: 167636 - protein, 521 aa, Glycine max
  Coding DNA Sequence Number=SeqID_75951
  Gene Ontology: Mol. function=transporter activity; Cellular component= cell outer membrane; Biological process=transport
  Homolog annotation: Hit_ID=A6Q7N3; Match level="QueryCoverage=100%, HitCoverage=74%, E-value=1e-118, Identity=42%"; Hit description=TonB- dependent receptor
  Pfam annotation: Domain name=TonB_dep_Rec; Domain location=346-502; Score=22.1; E_value=0.0012; Accession=PF00593.15; Description=TonB dependent receptor
MGILSQYDNPVNPSVGLIIDGIDFSRLGGAATMFDIDAVEVLQGPQGTKFGPNAIAGAITMRSAEPTKAFKMRAQAGAGEYNTRNFGVAVGGTIVEDQLLGRASIYTHKSDGYMQNDTLGRDDTQKQDELTFRSKFKLFATENLTLDFTLMHVNVNNGYDAFTLDNSRHSTSNQPGVDTQNTNAFAVKANWQASDAIMIQSEASYLNSSSTYSFDGDWRTLDDNEKHNRDRDNYSFEVRVLSDKAGRIFNSSTDWTVGFYRFVQDEQFNSRVDYRSYGPTYLTQLAGKYKTENTALFGQLDSHLTDKLTLVSGLRLEDFQARYSDSGFVESAPSSMKKNVSEILFGAKLGLNYQANEHQLLYTSLTRGYKPGGINNNASLSQNQRQFNTEYMWNFETGLKSSWLDGTLITNLAAFYAKRLNAQTQSSAQVPSTGIFTEFYDNAARATHQGVEASIDWFITEQFRMMGSLGVLDAKFDSYQNPDPTAYNPQGRQVAHAPKYTFNLGSEYFANDHWTLRANVE

SEQ ID NO: 167637 - protein, 38 aa, Glycine max
  Coding DNA Sequence Number=SeqID_75952
EVTNVPSSIRRHVKLKMTYTKKTGQMTFEVAKEIANKI

SEQ ID NO: 167638 - protein, 149 aa, Glycine max
  Coding DNA Sequence Number=SeqID_75953
MADLGGGFAKKRHRIAVAWRVWDGGAMAAAIAMAVVAVMAGWRKNGGICLVFVRGRSWADPTQPYPVIFPLNVVPRRTQPFPHLCVLPSPLRPSLTPPHPAAAATGDTRTVRAPNRRRPRHPYTKTKAIFARAPATQPPATATPLLSVS

SEQ ID NO: 167639 - protein, 167 aa, Glycine max
  Coding DNA Sequence Number=SeqID_75954
MKRTTYLIMMVITGISKPPTKPKLLLYFRGGHEILPLREADISDHGCKGALWKEDLVKEEVRFGVDLKGTEGSNRLPVANILFKLIYKAVIDYHNHRIQGTNRLRILCLNTLECTSFVVQVERTSTWVVLLRTRDGTSLVDQFKWSVHPLGCSKRTTEGTSFVDLCL

SEQ ID NO: 167640 - protein, 357 aa, Glycine max
  Coding DNA Sequence Number=SeqID_75955
  Gene Ontology: Mol. function=helicase activity; Biological process =viral genome replication
  Homolog annotation: Hit_ID=Q9C8V4; Match level="QueryCoverage=59%, HitCoverage=31%, E-value=2e-25, Identity=35%"; Hit description =Putative uncharacterized protein T22A15.15
  Pfam annotation: Domain name=DUF889; Domain location=165-345; Score =9.8; E_value=3.8e-12; Accession=PF05970.5; Description=Eukaryotic protein of unknown function (DUF889)
MMLTVCKGPTSFEDIKTVAGVQYPTYKEACFAMATMNKPEEVWAQTWHWLSDDIVYNRRKSTTTPELHVDDDNLMNLVLLEVEQLLQANQRSLRDYPSMLYPENGNFATHLDNVLILSTLNFNNEDLISEFLYLFSQMTALDQSLRDIIKAKSSSDKNFSGKVMVFGGDFRQILSVIPRGKFCQSFLGTTALIFNIDATDRKETAAFAQWILDIGDGIVGQQNDGYATVQIPQDLLITEYDDPLYGIVNFTFPDLCHHYTNPEYFQSKVILASTNETVQQANDYILSLIPAMHGANADGIFDRDEPRGMSPLQLATKDCMSPLQRCMEALLEGATRGGDLLEREAPVGLARSASGGI

SEQ ID NO: 167641 - protein, 149 aa, Glycine max
  Coding DNA Sequence Number=SeqID_75956
MRCRERGSERRICMGIFMQSANMNSASLTHATRGCVASATGDTSGIATCNDALVMQSGVAAERANPTGASLSSKSPPRVAPSSYGRSSCRCCSLRLQLCKTEVAGQTSASMHLWSGDMQSFVASCSGDMPRGSSLSKMPSALAPCMAGT

SEQ ID NO: 167642 - protein, 70 aa, Glycine max
  Coding DNA Sequence Number=SeqID_75957
MSRNKERHCFDKTSHNWIYYDEDHLPQWSFKGGKGTTDSVRAGAIVHLDLVCWGHKDAVVVVLVEGLLET

SEQ ID NO: 167643 - protein, 58 aa, Glycine max
  Coding DNA Sequence Number=SeqID_75958
ILLKNIIDVKADGNRGYREIIVLLGMGEESRLLMRNHLHKELTSWSEEYINLLGGIEI

SEQ ID NO: 167644 - protein, 53 aa, Glycine max
  Coding DNA Sequence Number=SeqID_75959
MTRGCHSLRLNTPQHLFMVLPGGVDSAASPRFVAPRPDSRGRVASPTSGGSRG

SEQ ID NO: 167645 - protein, 107 aa, Glycine max
  Coding DNA Sequence Number=SeqID_75960
MRFRDCNHIVEFVFVEFVSATYRLRLCFRDCNHIVELVFVEFMSATYRLRSKKTTKGKGGKRFWKSIVVGFKTPREAIEEFVEKIPLGSAPHTQESIKAALVLTAAV

SEQ ID NO: 167646 - protein, 88 aa, Glycine max
  Coding DNA Sequence Number=SeqID_75961
  Homolog annotation: Hit_ID=A7Q6C4; Match level="QueryCoverage=40%, HitCoverage=11%, E-value=5e-08, Identity=61%"; Hit description =Chromosome chr11 scaffold_56, whole genome shotgun sequence
MARNVVPKKDVVETIQRFNIQVNNLTQVLLRSQHQGHRIDIWSAGVTLLYMFSNHGSLEHHGFARNKFWNLDPNPPAFPTNSTNKVFK

SEQ ID NO: 167647 - protein, 185 aa, Glycine max
  Coding DNA Sequence Number=SeqID_75962
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q93XQ3; Match level="QueryCoverage=39%, HitCoverage=3%, E-value=5e-17, Identity=61%"; Hit description =Putative beta-1,3-glucan synthase
  Subcellular localization annotation: CTP_CleavageSite=77; ConfidenceScore=5.16e-01
MLAHSHLAMFYLFYSLSHWQLPLPHLTTTIFAFSPLPHFLAPSPVARLLLLASALEVYLMAIMSVAIVVSVVEERISASRRSEAAKFAQLWNEVICSFREEDIISDRKGFEAKLFSCFFSEMDLLMVPYSLDPSLKIIQWPSFLLASKVHIEVTIGTKVFLKASTNFFHIKAYNTKNELYSSMEA

SEQ ID NO: 167648 - protein, 83 aa, Glycine max
  Coding DNA Sequence Number=SeqID_75963
MEKSSSLRSKTNGGRLSCWGRLKLKLPWAKRTSSYKPIGGFNYDPLSYAQNFDEGWVEDDEESLHRGFSARYAAPSSHKLFKQ

SEQ ID NO: 167649 - protein, 163 aa, Glycine max
  Coding DNA Sequence Number=SeqID_75964
MQGTLFRSNKFMGHASVPLVSQPAEKESLLVEFDDDDDDDDTETEDQDVEGERIVARNNDNGKGPPVIGGENVDKKADEFIAKFREQIRLPRIESIKTSTRSARNSSSTTYISKIALGNNNTLWLCMHTKRCIVCLHRILSSIVLLILMTVPRSKIGNEKKES

SEQ ID NO: 167650 - protein, 122 aa, Glycine max
  Coding DNA Sequence Number=SeqID_75965
MRGLKERGPKDSLKDQASQGSFVAQGRQDVLTVVIGRPEHRGRVRATRAGVTIKQYFGPTPRTSHTSSSMALEDLEQLTQKIKDQLEESITEKNDSTSNVVLQRDAIPVSIVDAITGTRTTS

SEQ ID NO: 167651 - protein, 198 aa, Glycine max
  Coding DNA Sequence Number=SeqID_75966
  Gene Ontology: Mol. function=ubiquitin-protein ligase activity; Cellular component=intracellular; Biological process=protein modification process
  Homolog annotation: Hit_ID=A7P8B1; Match level="QueryCoverage=91%, HitCoverage=21%, E-value=1e-27, Identity=39%"; Hit description =Chromosome chr3 scaffold_8, whole genome shotgun sequence
  Subcellular localization annotation: CTP_CleavageSite=41; ConfidenceScore=5.41e-01
VAIPSTIEVGIVAPMTVLVQKLQNALSSLERFRAVLSHSSRSSSGSARLSSGLSVLSQPFNEFGQKSIVPTRNSKSGTTHAEAGVSFPTTCRHSTRSRSSVNIGDTSRKEITQDKSTSSSKGKGKVVLKPAQEVARGPQTRNATPRRAALDKDAQMKPVNDDFTSKDEDLDISPVEIDEALVIEDDDISDDEDDDHEH

SEQ ID NO: 167652 - protein, 127 aa, Glycine max
  Coding DNA Sequence Number=SeqID_75967
  Homolog annotation: Hit_ID=A5AWV0; Match level="QueryCoverage=75%, HitCoverage=6%, E-value=2e-08, Identity=33%"; Hit description =Putative uncharacterized protein
MQSSKHDVYLGAYQNGGHWQIVVILPKENLVVWFCSLHNRPDNYLKGIIKSAFKGLDDTPQPKSKAGAWWIVVKCNRQKGSTECGYYAMHWMSTIILGTFRNNWETYFNDVRPLEAKRLKSLRIHWT

SEQ ID NO: 167653 - protein, 157 aa, Glycine max
  Coding DNA Sequence Number=SeqID_75968
  Subcellular localization annotation: CTP_CleavageSite=27; ConfidenceScore=5.30e-01
VLGDGYEWTLGPWSTNHYPASGSGRSRSATGRQPKMAPKKLSNKRSRKDAIGEGSNAASDFGSHRFRSAENQQCFEAIKGWSFHKEKRVQLREDEYPDFQGEVARRHWARLVTPMAKFDTEIVIEFNANAWPTEEGVWDMRPWVRGHWIPFDANDIS

SEQ ID NO: 167654 - protein, 122 aa, Glycine max
  Coding DNA Sequence Number=SeqID_75969
MRGYLLVTHTFRNPGANEPVDVQRLTSSLAPFVILTREVRITLWLPVPFINQGANELINVKRLTSSSAPFVIQGQFLLSSSGNIQAQQRARFFTAGQRRSGAMAKESVVVVQLCRFQDTKVC

SEQ ID NO: 167655 - protein, 90 aa, Glycine max
  Coding DNA Sequence Number=SeqID_75970
MACSGIPGKDSTSDSPQISASPYQLDLAPYASEPYNAQWNAPGHLRDKHTLRSSRILGEMEVDEPWLGLWLPLNYQVVFVIGSVVDRLCG

SEQ ID NO: 167656 - protein, 107 aa, Glycine max
  Coding DNA Sequence Number=SeqID_75971
  Subcellular localization annotation: CTP_CleavageSite=50; ConfidenceScore=5.43e-01
MYTRSFTNPQFLKLGLTRKKVPSGVTNCRNVPFAGERGRGSWVRFPKEERCTESPSTFICGKRRKNRRKPVKMKILSSGVVFTFEEGRQKRGFCSYVSSFGEEIRPT

SEQ ID NO: 167657 - protein, 214 aa, Glycine max
  Coding DNA Sequence Number=SeqID_75972
  Homolog annotation: Hit_ID=Q5CDC4; Match level="QueryCoverage=19%, HitCoverage=32%, E-value=2e-15, Identity=100%"; Hit description =LacOPZ-alpha peptide from pUC9
  Pfam annotation: Domain name=Ins_element1; Domain location=43-118; Score=-25.5; E_value=0.042; Accession=PF03811.4; Description =Insertion element protein
MVKVGTSYVPINVSFSPKVGPELPGINRDTRIYLFCEVIFRHSCPSCSATDGVVRNGKSTAGHQGWQSVAVTLRVTTTPAALNAPLQGASHSPFRLRNCWEGRSVRASSLLRQLAKGGCAARRLSWLAQHCLVTHDLGVGHDVGSRRRGTGQFDQVGDQAYRYRRPRGGARYQLLFPLVRVNFELGVIMVIAVSCVKLLSAHNSTQHTSRKHKV

SEQ ID NO: 167658 - protein, 79 aa, Glycine max
  Coding DNA Sequence Number=SeqID_75973
MFKLDAVITEVCHTQMKITVSSGRKIWFSQVYYQLVPEFTMSLNCNQAAQVVTPGIAVFTWDYSQMTAWALGLQSVMGC

SEQ ID NO: 167659 - protein, 21 aa, Glycine max
  Coding DNA Sequence Number=SeqID_75974
MVVTTSTVAKVNPMPPSDLNQ

SEQ ID NO: 167660 - protein, 81 aa, Glycine max
  Coding DNA Sequence Number=SeqID_75975
  Subcellular localization annotation: CTP_CleavageSite=32; ConfidenceScore=5.51e-01
MRTRSPLKARMCSPLKARACSPLKGRTFSPLKARTRSPLKVRMCSPLKIDCPFERGDNSCNLILSLQISLGTPSECLFCLI

SEQ ID NO: 167661 - protein, 106 aa, Glycine max
  Coding DNA Sequence Number=SeqID_75976
MIKESKELASMSMDALFGKLLAYEHELIQQSHAKETEKKRDYTQAWEDNASTSSNSSSEEKVANVCLMANTKDDSSIIEETEVNSKFEEVLETFNEMYEEAQGLAV

SEQ ID NO: 167662 - protein, 68 aa, Glycine max
  Coding DNA Sequence Number=SeqID_75977
  Subcellular localization annotation: CTP_CleavageSite=29; ConfidenceScore=5.00e-01
MHIAAYGMKEFLVPQNFSAPTIQPIGSVPMNAGSSTFLDQMCISSISNIGSPLKIRQIGPIVRNQELK

SEQ ID NO: 167663 - protein, 304 aa, Glycine max
  Coding DNA Sequence Number=SeqID_75978
MAKFDPDIVLEFYANAWPTEEGVRDMRSWVRGQWILFDADVIGQLLGYPLVLEEGQECEYGQRRNRSDGFDEEAIAQLLCIPGQDFARTAAGRRVRIMHTNMTTLTQIWMTLLLSNILPTDHNSDLPLPKCQLVWRLPGILWIQIKSNKALGFPALITGLCQSFGVPVTPTKVIRPPITRAFIEKYCTQRQAQGDVPQAAGAPPQPHQAGPAGSFDMEQYLRHLVRQQAANHRAHVQTHDCLYQLSLSMQSQGFSSFSCPTLDQFRAEVAWPGDWLEAQAGEAPPEAPGDGARGPRGRGDGRFA

SEQ ID NO: 167664 - protein, 163 aa, Glycine max
  Coding DNA Sequence Number=SeqID_75979
MERSMIDAANGRALGDITPTEARNLIEKMASNSQQFSARNDVIVLRGVHEVATDSSSSTENKKLEGKLDALVNLVTQLAMNQKSASAPVARVCGWRNHPNLRWASPPQQQQPVPPFQNAAGPSKPYVPPLIPQQQQHQSQQIQQATKAPPQPSLEELVRKMTI

SEQ ID NO: 167665 - protein, 242 aa, Glycine max
  Coding DNA Sequence Number=SeqID_75980
  Homolog annotation: Hit_ID=Q84VH5; Match level="QueryCoverage=85%, HitCoverage=30%, E-value=6e-77, Identity=74%"; Hit description =Envelope-like protein
  Subcellular localization annotation: CTP_CleavageSite=21; ConfidenceScore=5.26e-01
MATSPKETSTPGSPSVPSSPSSTKAPSNQERPEFNIQPIQMIPGQAPVPDKLVPKRQQGVKISENPSPATSPREVDTEMDKKIRSIVSNILKNASVPDADEDVPTSSTPNVSVPDAEKDVPTSSNPNAESPLFLQQRGSTEEDDQATEETPAPRAPEPAPGDLIDLEEVESDKEPIANKLAPGIAERLQSRKGKTPIKRSGRIKTMAQKKSTPITPTTSRRSKGLPRRGKKFPHLILMMMSN

SEQ ID NO: 167666 - protein, 116 aa, Glycine max
  Coding DNA Sequence Number=SeqID_75981
MAPKKLPSKRARKTATGEGSKIARRHWTQLAQPMTKYDPEIVMEFYANAWTTKERVIHKRSKRCYQPNLKESIDLRGGTTMQIHKEKVMQSYLPRALDRRLQEDWDRDARVGSRVD

SEQ ID NO: 167667 - protein, 98 aa, Glycine max
  Coding DNA Sequence Number=SeqID_75982
  Subcellular localization annotation: CTP_CleavageSite=32; ConfidenceScore=5.12e-01
MDKFDIFVPHPLTNTSLLIQLSPCRNLPFGGRAMRDSRERLPRKEYARSRYQRLFEENVGKTEKDVARLTGALSKGGKMRGVATNVYLWKMSEKPKET

SEQ ID NO: 167668 - protein, 77 aa, Glycine max
  Coding DNA Sequence Number=SeqID_75983
LRRSDFLITIEEYVGAKGNALVDYKKWRLRAYSFLGTRTRESRVALPPKGRLRQGANFVLDNDVIKELADAHGKTAA

SEQ ID NO: 167669 - protein, 125 aa, Glycine max
  Coding DNA Sequence Number=SeqID_75984
MSGFTRDSPQISASPHQLDLAPYASEPYNAQWNAPGLLRDKHTLRSNHILGEMEVDEPWLGLWLPLNYQVDMGASQHRTLELGWCSSDFVVDLGVTFVDNWAVGKEKVCYWLSNDIVGLVGNLAV

SEQ ID NO: 167670 - protein, 196 aa, Glycine max
  Coding DNA Sequence Number=SeqID_75985
NIQPSDHNFDLPLSKCQLVYAVLTRMSIHVAQLIANAIYLFVGMASTRHPLDPDKSNRALGFPALITGLCQSFGVPVAPSKVIWPPITWAFNEKYCMQRSAQGDAPQAADAPPPHQAGLAGSFDSEQYLRHVVRQQAANHRAHVAWPGDWPEAQAGEAPAEAPGEADEAREDEEMINLLDFLGGGAEPHDLEIPRS

SEQ ID NO: 167671 - protein, 17 aa, Glycine max
  Coding DNA Sequence Number=SeqID_75986
MADQQANKSKAKGSKIP

SEQ ID NO: 167672 - protein, 77 aa, Glycine max
  Coding DNA Sequence Number=SeqID_75987
MELSLSPIMPSPLGGDFLFSEGEVIVGCDVIDDPLKALYGDVLGYVSFIQDFYQQSSVRLRAHEQVQKGDSSRGLVE

SEQ ID NO: 167673 - protein, 81 aa, Glycine max
  Coding DNA Sequence Number=SeqID_75988
MELQIHAYMQHVTGQQAANHRGQSQDLSPFPWPTPEQFGATVACPGDDLNFQTGAGPVGAHGDEDGAQKDDDMADVLDYFL

SEQ ID NO: 167674 - protein, 129 aa, Glycine max
  Coding DNA Sequence Number=SeqID_75989
MHSLRELAQNKPIVPLEYFLEKVVWPEAQLPLVRTNEATPLEPTPAQVEPMPAEPRTPVVNPPPSPELEVVPPSPPLIIISYASSNEAVAPSNSPAEETVDPPASPVGGIVDLSDSSSGEVVALTDSPV

SEQ ID NO: 167675 - protein, 142 aa, Glycine max
  Coding DNA Sequence Number=SeqID_75990
MGILGEASSIGFCLGTALVFMVSPKACMLEVVSNPWRFTVGNWLCDSDLVSPTGIERVLTEKDLLDDSYSDLEASILDEKEFLLLKVISTFPELSCLICSMVGAGRGIDGFNRTLDAQVFMTLYWIQYIKAAGIDPSFMSRP

SEQ ID NO: 167676 - protein, 108 aa, Glycine max
  Coding DNA Sequence Number=SeqID_75991
  Homolog annotation: Hit_ID=A5BEK1; Match level="QueryCoverage=96%, HitCoverage=7%, E-value=2e-10, Identity=35%"; Hit description =Putative uncharacterized protein
MALYREKGLYYNYDEKWSSSHRCKGRVLLFIADPDDPDCATLNNPSPALPPSPNDPCPLEPTPTNPHISLYALVGLPATDTFRVYGYIKHACITILIDSDSTHNFVQP

SEQ ID NO: 167677 - protein, 51 aa, Glycine max
  Coding DNA Sequence Number=SeqID_75992
MEKSLKKNFSEKKLKKAYITWDENDMESSEDSENEEINIFLMAKSYESDEE

SEQ ID NO: 167678 - protein, 132 aa, Glycine max
  Coding DNA Sequence Number=SeqID_75993
  Gene Ontology: Mol. function=methionyl aminopeptidase activity; Cellular component=chloroplast; Biological process=proteolysis
  Homolog annotation: Hit_ID=Q9FV52; Match level="QueryCoverage=50%, HitCoverage=17%, E-value=6e-26, Identity=83%"; Hit description =Methionine aminopeptidase 1B, chloroplast precursor
  Pfam annotation: Domain name=Peptidase_M24; Domain location=12-131; Score=-101.9; E_value=0.1; Accession=PF00557.15; Description =metallopeptidase family M24
MPVLIPHPLAMVDFRKVCAHLLMSACAMEYLILGSYRFYEPILLFLTLSLACILLVTDDNDLFLQNGDIINIDVTVYLDGYHGDTSKTFFCGEVGDELKNLVKVTEECLEKGIAACKDGALFRKIGKRIRLY

SEQ ID NO: 167679 - protein, 79 aa, Glycine max
  Coding DNA Sequence Number=SeqID_75994
MRSLVVGEVTATLEEAIDGVEGDGDGEVGKGGRVDEGGEERVDGAKGSKLEAIDDIRGGEDGEAIVVGEGNGVDEGGEE

SEQ ID NO: 167680 - protein, 153 aa, Glycine max
  Coding DNA Sequence Number=SeqID_75995
  Homolog annotation: Hit_ID=A5BB71; Match level="QueryCoverage=49%, HitCoverage=7%, E-value=3e-08, Identity=41%"; Hit description =Putative uncharacterized protein
MEELINKTQLSPKIISTSSRRLGGSTKESHFSSTTIVILLPRTKVHDHHRYQPHGTKIARECMTMEEEKEVQTCQEELDGMEEKPAGHVVFKELKKNSPAEKAIVEVKTLPEHLKYVFLGENEVNSVIISSSLRKEEEDQLVKVLKKHKATIG

SEQ ID NO: 167681 - protein, 98 aa, Glycine max
  Coding DNA Sequence Number=SeqID_75996
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=57%, HitCoverage=29%, E-value=3e-22, Identity=87%"; Hit description =Chromosome chr4 scaffold_32, whole genome shotgun sequence
  Pfam annotation: Domain name=APC10; Domain location=1-97; Score= -48.4; E_value=5.4e-05; Accession=PF03256.7; Description=Anaphase -promoting complex, subunit 10 (APC10)
MKVVNVNTAREGCRGSEVKTLDCSWNSRGCSKLKAFYTNKLIVLYVVFKLDESYTPSKVSIRAGDGFHNLKEIKTVELVKPTGWVYLSLSGADPRFLA

SEQ ID NO: 167682 - protein, 122 aa, Glycine max
  Coding DNA Sequence Number=SeqID_75997
MCALQGMIPLSAIDGYRLKSLSETLSLSVIFLFVLFFRWPPRNVKPPPVDLRLQNQPGIPPDSPLRWLGIDIKIIFIFRTFFQRGTSKLAYTDYDEFLEELEKRHWDRKLTRLAKKNIEWPW

SEQ ID NO: 167683 - protein, 85 aa, Glycine max
  Coding DNA Sequence Number=SeqID_75998
MAGSTGQGVQILKLMTQSKIQQGLLVRFGITMIATVVIIVVFTTIADNGGRDSDNHGDEGGGYNGGHDGDNDNYSDDCNELIEIF

SEQ ID NO: 167684 - protein, 203 aa, Glycine max
  Coding DNA Sequence Number=SeqID_75999
MELHDIPTKKSILELTSQDALLAQNKLLAKQIETLTEMLRKLPQQLHAVQPTHSSIMQIGGCNIYGGAHESGMCMAQDDASKEVNYMTNPHRQGFHQGGPPRYHQGGNFSQHQVQGWRSHPGNNFNEDQGGPSIWPPNQGLNLYERTTKLEDTLTQFMQALLWPTWRRIQRRSARKKDDWRCHFKEKMRLEEAHHHRKPWIRA

SEQ ID NO: 167685 - protein, 157 aa, Glycine max
  Coding DNA Sequence Number=SeqID_76000
MEKYLPAARTSYANEPMATSRRRRCLGLEMRSDKPDKSMTREKKVPRLTHDSHKSDKLQPFPKEPRDVSSISRTSQSLTNSSQALRTASSSSSGGFVHARALSAILNRLARISEFRLSAAFLAQRDGPSLSEQAQLILLPDSSSLLAEDCCTQRIAR

SEQ ID NO: 167686 - protein, 266 aa, Glycine max
  Coding DNA Sequence Number=SeqID_76001
  Subcellular localization annotation: CTP_CleavageSite=73; ConfidenceScore=5.48e-01
MTLAQVWSVLSYSNLAPTSHTSNLTVGRARQIFGLVSRMDMNIGALISSQMTYIAQSNSSRLGFPALITALCRARGVVSNILTFEHLSPVINLAYIRKNCWNPDDLTISIRGARRVKARPTELPSTSAVPSPTSTSAAPLVPGQTIPSVEQFLERVAWLGAQPSLHREDEGPTAQVPQHVEDASSEATVLEPFIIEEEAVRHRLDRKLLLLLRGHIRSTHTSGGPILTSACSRPLHSYTRDTRGPDYTSPKSKHFSSNYSSTSSDR

SEQ ID NO: 167687 - protein, 65 aa, Glycine max
  Coding DNA Sequence Number=SeqID_76002
MFAYSPFAKRKLPAKRIFGHVLSRESLLLSAQPLHLKLTRSAKLVKGELSPFQFDLNWAKRRPAR

SEQ ID NO: 167688 - protein, 43 aa, Glycine max
  Coding DNA Sequence Number=SeqID_76003
MEGLMLLEITGKPSSKVMCVGPCGLNNLKRDRLRMQKKQQQSI

SEQ ID NO: 167689 - protein, 128 aa, Glycine max
  Coding DNA Sequence Number=SeqID_76004
MSSKVILIMPKNQELSKFQRFKNQVSRIKIQDSRIKFQDSRFKNNQDQDSRIKRRLNQDNRRYIYLGIVILRTREGTSLVDQFKWRVHPLGFFKENKGGYIPCGSLACKGFYKVERNLKNRMLLGDWM

SEQ ID NO: 167690 - protein, 91 aa, Glycine max
  Coding DNA Sequence Number=SeqID_76005
MEKDESIDEMFNRFTMIINDLKSMVKTYNTQDQIRNILKSYLKEIMDEIQPKKGKNIALKASISSRKFVHHPIAFKEEGTTFKEEESIEKV

SEQ ID NO: 167691 - protein, 135 aa, Glycine max
  Coding DNA Sequence Number=SeqID_76006
MFGFFVFQVFRVSGHPPRAPRILQVSWSPPLPGWYKCNIDGAARGMPRLVAYGAELIGAMEAIDIAFKKDGKLGCYGTWVTSGNPCLSVLGNPSLETGWVPACDVVMPWCQPSWGYAFHENLNREIDVLLEATSG

SEQ ID NO: 167692 - protein, 203 aa, Glycine max
  Coding DNA Sequence Number=SeqID_76007
  Homolog annotation: Hit_ID=Q6WAY6; Match level="QueryCoverage=75%, HitCoverage=27%, E-value=2e-08, Identity=24%"; Hit description =Putative uncharacterized protein
MGVKYLEAVKRRLHATKQWFPDKIRWIDQVRRQAFRKTYGKIWDLTMIEVFVEVIASFTQYYDQPLRCFTFGDFQLVPTVEEFEGILGCSLGGRKSYLFSGFYPSMARVAKVVKISVQELERVKQNRNGVVGIPKKRLEEKAKALADQGEWTSFIDVLALLVFGVVLFPNVDGLMDLAAINAFLAYHHSKESSAVVVLVDAYD

SEQ ID NO: 167693 - protein, 138 aa, Glycine max
  Coding DNA Sequence Number=SeqID_76008
METCLEVEELLQRMIDQGRLEVGIEGKEEQHICMQSTEGSGVAKPKPLVIYFTKSAASQKPGHPLMAKPVPFPYQNSHAVPWRYTPPGKKEEEVTDVSSLSAKWSCVRTSGPTGPTRRRQGKRKSGGGTRWRSTPRFE

SEQ ID NO: 167694 - protein, 60 aa, Glycine max
  Coding DNA Sequence Number=SeqID_76009
MATIMEVMMSMRKIMEANAVAVAATRAVAKAHKMPHHNLADFEPCLGYATKGQVVGDIPL

SEQ ID NO: 167695 - protein, 63 aa, Glycine max
  Coding DNA Sequence Number=SeqID_76010
MDKTIRLRIKSLIQYQDSLNALNVVFIYGIIKAKKGEIVRDRGRSMSNMVNNLRLKLEAQGKA

SEQ ID NO: 167696 - protein, 93 aa, Glycine max
  Coding DNA Sequence Number=SeqID_76011
EITPAKTTPVDRRSPTRVLELSSSNYGSLSVLQSADTSNKGIRPPTNRAFIEKYYVSRQAQGETPQQSRDGQQRATDAPPSPLEFTSAHPQKG

SEQ ID NO: 167697 - protein, 63 aa, Glycine max
  Coding DNA Sequence Number=SeqID_76012
MNACPKNMCKPNCPMACFPTKNHALMPLRHFTEHLVGARLGVNSKRTGTIGGSPRRAQLAQAS

SEQ ID NO: 167698 - protein, 195 aa, Glycine max
  Coding DNA Sequence Number=SeqID_76013
  Gene Ontology: Mol. function=triacylglycerol lipase activity; Biological process=lipid metabolic process
  Homolog annotation: Hit_ID=A1FRY0; Match level="QueryCoverage=80%, HitCoverage=35%, E-value=2e-83, Identity=98%"; Hit description =Putative lipase
SWQKTTPGVSEEYRDDVESLRRGVTRAARGIPGGAIDLYDHIRGPLQPGEPARREAEKNGHHTSMLRMDDANHLGNPLFNDAIRGVHAQDVRVGRVPDVMSTQLAGSLAAEMHAAGGKRIDEVVMNADASRSFAVQGQGGDPAHLRVSVDTAVAMNTPLEQSSQRIDQQAAGQRLAQDRDQQLEQQQNQTRSMQA

SEQ ID NO: 167699 - protein, 54 aa, Glycine max
  Coding DNA Sequence Number=SeqID_76014
MESPTVATYPSAGGRRGARSVKGSGVVFMHGEGISTPRVRHKGRQTLIKCANMT

SEQ ID NO: 167700 - protein, 182 aa, Glycine max
  Coding DNA Sequence Number=SeqID_76015
MKAQVEKDECPEAEALSRQFMLLKAQSNLKAQTYQGNPCGVYPDLSSFTESGVYPDLSSFIGSGVYPDLSSFTGSGVIQNLRSLYQTIRSYSGSHHHTYQGNPCGVYPDLSSFTGSGVYPDLSSFTGSGVYPDLSSFIGSGVIQTFVTCIKRSTRKVHITFLDPDRSSFLADVDCHFFLSYR

SEQ ID NO: 167701 - protein, 103 aa, Glycine max
  Coding DNA Sequence Number=SeqID_76016
MHKKRSSAGELIPVDLEINTICRRRNQEKIRKFLQDLEAAAIPEEEPQSSEAFSSFPIAEHSHLDPSEDYIMAEEPRRVTLEDYSSSNVPQFFTSIAQPEVQA

SEQ ID NO: 167702 - protein, 100 aa, Glycine max
  Coding DNA Sequence Number=SeqID_76017
MGKEQEIDKVATTMELHSPLEKALINQMKCLTKEEEHEVQTCLKELDGARENSEGHSAFEELKNSGQIEKPKVELKTLPAHLKYVFLEGKNSKPVIIVSR

SEQ ID NO: 167703 - protein, 103 aa, Glycine max
  Coding DNA Sequence Number=SeqID_76018
  Homolog annotation: Hit_ID=Q96467; Match level="QueryCoverage=69%, HitCoverage=21%, E-value=1e-07, Identity=38%"; Hit description =Putative uncharacterized protein
MVDRGGEGNRSPRRTLGNYAYQQEPKHYNNIVIPPFNNKVVELKLALLSLIVLHPFVGMDHEDPYTHLSTFMELCSIVGASNEDVEAVYLRAFPFSLACKAKT

SEQ ID NO: 167704 - protein, 48 aa, Glycine max
  Coding DNA Sequence Number=SeqID_76019
MARTHIPMEAEMNYTQFSSNFSQPASIGPCTLRFEVMQCSMECPGASP

SEQ ID NO: 167705 - protein, 78 aa, Glycine max
  Coding DNA Sequence Number=SeqID_76020
MAAEWRTRRVERRRYFKEKMSQEEAHHHRKPWIRPWRQDKNGGRRREGAQNLCLKRAMVQPTNPRSSSKLSTKYAYVA

SEQ ID NO: 167706 - protein, 38 aa, Glycine max
  Coding DNA Sequence Number=SeqID_76021
MHDAIKEQAKGLSVTMHHQKRKTLDEAFTIIKRVGDPA

SEQ ID NO: 167707 - protein, 63 aa, Glycine max
  Coding DNA Sequence Number=SeqID_76022
  Gene Ontology: Mol. function=RNA-directed DNA polymerase activity; Cellular component=chromatin; Biological process=RNA-dependent DNA replication
  Homolog annotation: Hit_ID=Q53L74; Match level="QueryCoverage=57%, HitCoverage=2%, E-value=4e-09, Identity=77%"; Hit description =Retrotransposon protein, putative, Ty3-gypsy sub-class
EFKDVFPKEIPHGLLPSRGIGHQIDLLPGASLPNRANAFQEGRNDENPKTAQIQGSMTKSRTK

SEQ ID NO: 167708 - protein, 179 aa, Glycine max
  Coding DNA Sequence Number=SeqID_76023
  Homolog annotation: Hit_ID=Q6WAY4; Match level="QueryCoverage=91%, HitCoverage=29%, E-value=2e-12, Identity=29%"; Hit description =Putative uncharacterized protein
MAEVSTEAIASLTQYYDQPLRCFTFGDFQLTPTVEEFQEILGCPLGGRKPYLFSGFYPSLARISKIVKISTQGLDRGKQVENVLVGVPRKCLEAKARVLASQGEWAPFMDILVLLIFGVVLFPNVDGLVDRAAIDAFLAFYDRKEIPFVVILADLYDTFGRRCEKNNARIVCYMSAFYV

SEQ ID NO: 167709 - protein, 187 aa, Glycine max
  Coding DNA Sequence Number=SeqID_76024
PMGLTRRPLPNCYVYRVRICPDRCREAGADHAHQHDYPNPDGDDIAAEQCPTQHSLDPDKSNRALGFPALITGLCQSFGVPVTLSKVIRPPITRAFIEKYCTPRQAQDAPPPPNQADPVGSLGMERYLQNLVRQQAANHRGQVQIHECLYQLCLSQQGQGAPDDAEDARMDEEMTDLLGFLGGSRAT

SEQ ID NO: 167710 - protein, 77 aa, Glycine max
  Coding DNA Sequence Number=SeqID_76025
MSRNFTDYAIIASLTSGMLWNFTDCTTMLPFGFRHVAELHGLPNDGCLVPRSGQAKVASHQTNGPRTKLGYDTDLPS

SEQ ID NO: 167711 - protein, 128 aa, Glycine max
  Coding DNA Sequence Number=SeqID_76026
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=66%, HitCoverage=72%, E-value=3e-24, Identity=69%"; Hit description=LacZ protein
GASHSPFRLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVSSLSIPSTTRFSTKCA

SEQ ID NO: 167712 - protein, 133 aa, Glycine max
  Coding DNA Sequence Number=SeqID_76027
MERSMIDAASGGALGDMTPVEARNLIEKMTSNCQQFSARNDAIVLRGVYEVATDSSSSTENKKLEGKLDALVNLVTQLAMNKKSAPIARVCGLCSSVDHHTDLYPSLQQSGVNEQPEAYAANIYNRPPQQQNQ

SEQ ID NO: 167713 - protein, 167 aa, Glycine max
  Coding DNA Sequence Number=SeqID_76028
  Homolog annotation: Hit_ID=A5BEV8; Match level="QueryCoverage=43%, HitCoverage=9%, E-value=3e-07, Identity=40%"; Hit description =Putative uncharacterized protein
MLDQFHQCIKDSIENIIDVKVDDNCGYRAIATLLGMGEESWSLVRNHLHKELISWLEEYINLVGDIERFEELKYSLLVDRLSMVCYQEQVDEYYGYEICHCFTIQRDRCSSFTTTMHDIFSLRSFFMRPLSFTTIGIVVEYTLSFSSKVVAHSVHRVECSVAQICIC

SEQ ID NO: 167714 - protein, 64 aa, Glycine max
  Coding DNA Sequence Number=SeqID_76029
MIMRGQNIYSSQEETLLLPLLLVEVKMKQGVKSLVRKSTPMKKHKISFQVNLTIIPYPKPYKLQ

SEQ ID NO: 167715 - protein, 274 aa, Glycine max
  Coding DNA Sequence Number=SeqID_76030
MEELINKTQFSPQIILTSSRRLGGSTEESHFLSSTAVILLPRTKVRDHHMYQPHGTKIARGLADFLHRILEEDSEDSAPIKVFLLVWGFDDKQQRLAMATNGLGWWKNEVLGFGWCFGEEESEKSSKFPLGLELRLAHPCSLSVIPSRIGIALSASFSRSDTSKVVIFKIPMVRLWKHVLGSSRKNLKMIQRFHLPNREVTITLDDVASLLHLPVVGSFHSFELLHVDDAVEMLVELLEVSAAKARVETIQCHGSYVRLLWMHDLYELKIKACD

SEQ ID NO: 167716 - protein, 269 aa, Glycine max
  Coding DNA Sequence Number=SeqID_76031
  Gene Ontology: Mol. function=phosphoinositide binding; Biological process=cell communication
  Homolog annotation: Hit_ID=A7Q3Q2; Match level="QueryCoverage=52%, HitCoverage=25%, E-value=5e-44, Identity=65%"; Hit description =Chromosome chr13 scaffold_48, whole genome shotgun sequence
  Pfam annotation: Domain name=PX; Domain location=97-215; Score=71.0; E_value=3.9e-18; Accession=PF00787.15; Description=PX domain
MTHSNRNENEGKCMKQEQKRVDYSRKAREIQKRVALASKSSSTFTGLQTSSTSIASVLWMLSLSRRHRSLCNQTIVAWQRMLVGGDGGCENGRGEKQRLRIREERDAPRPPRSATFYTYLITTLINLLEYGGAGSEFAVKRRFRDVVALSKQLAEAYRGFFIPERLDKSMMESQVMQKQEFVGQRRVALEKYLRKLAAHSVIGRSEELRLFLEAKGRLPLAKTTYVASRMLDGTVRLPRQLFSGEAELGEMAQLAKGRRDLLKIFKELK

SEQ ID NO: 167717 - protein, 141 aa, Glycine max
  Coding DNA Sequence Number=SeqID_76032
MDRNGESTKRTMRYSLVKNSNPYMKQKKDGHGTKTNMGNNIVIATNSGTGNATLYRYYKQCVDDNKPDMLVVLETRVDPRKLRHTFSILGYDGVDFVDGQGFAGRIIVAWRTHIWCRVKFDDGDYWWFSILVNLKNRDDTG

SEQ ID NO: 167718 - protein, 70 aa, Glycine max
  Coding DNA Sequence Number=SeqID_76033
MYLLLFSITTTQVDVPSTCTTKYTGNRLHHLMHSYTPRALDRRLQEDWARDAREGPKVLMSLRVDFGPLG

SEQ ID NO: 167719 - protein, 70 aa, Glycine max
  Coding DNA Sequence Number=SeqID_76034
MDDGNLDKTNNLKEPLQEMEGLMTRAKTKRFKEVLQDLVMEVQAKEDPTKFEYNTKFVTCLQLEDNISPI

SEQ ID NO: 167720 - protein, 127 aa, Glycine max
  Coding DNA Sequence Number=SeqID_76035
MTNKERNHDPCVVVFKSLDFILHSNNPFGICTSFLPGWDWLKSKQCVMVERRSASAYGVLTRMVGDNGCQMYRYCYWEKKMWSRFYYWNPFVGSGEICWADVQGSTPLSIVVWFKELNELCNMDLQS

SEQ ID NO: 167721 - protein, 111 aa, Glycine max
  Coding DNA Sequence Number=SeqID_76036
MFSKKEGMMRIIKLAKYRLKVQVKKDERPSGEGQSPRVEKDEGPKTFGIFIKFGESFSLGSLLNQSQTYQGNPCGVYPDLSSFTGSGIIQISVACIKRSAPSQDHIKKYRL

SEQ ID NO: 167722 - protein, 106 aa, Glycine max
  Coding DNA Sequence Number=SeqID_76037
MSSYRDNLFKSLDAFTVVTIDDEDSDVFWFHVSVGKEVVEGTEPDLFSFFLSGGHEGMRGIGFGAPSKTPHVVDLDGNKDEDSDKGDGRDEGEEEGEAKENGMGGI

SEQ ID NO: 167723 - protein, 111 aa, Glycine max
  Coding DNA Sequence Number=SeqID_76038
MTPTYDALLYYNGRWNMSHQRDFVSYSFTGKNPKIFDIPSGCNINGLEDVIKQVSPQGIPPYGIHESQTLMKPYVYYFQGWTTALPDNGNVYSTTTPMVVKDNGLIKKPVT

SEQ ID NO: 167724 - protein, 209 aa, Glycine max
  Coding DNA Sequence Number=SeqID_76039
  Subcellular localization annotation: CTP_CleavageSite=82; ConfidenceScore=5.25e-01
MVIFWNILDLSSPRQASGSPRPWESFSLKQPTRLSELIPSSLSNWLAWTSFPCRGRVLGVGKLKKERKNTERRKRRRKEKNRGAAESNRRSFPTSFLLLALYPVQQSEMNVLLSIFFRHPVVREWRLIYGHVGFLTRLITVKPHLEFSSSGDALSLIVPIATIPSMVIFNHGDVVEDKGEEDELHHQESALDKKLREEASMEENNERER

SEQ ID NO: 167725 - protein, 185 aa, Glycine max
  Coding DNA Sequence Number=SeqID_76040
MAPKKFPAKRARQTVIGEGSSTTPPCRFEVIKDWSFLKERRFQLVEVVMEFYANAWPTEEDVMDKRSRVRGIAPPRHPMDPEKSNRALGFPALITIITTRARSTVATDSRRTTTASTSATILGVHLSPHAEDGTPNAHIHFRATIAWPRDRPNFQEEAGLADAQGAAQGDEGGVEDDVDMAYLLD

SEQ ID NO: 167726 - protein, 146 aa, Glycine max
  Coding DNA Sequence Number=SeqID_76041
MVIKKNERVLRHPYRTRAKARTMSEIEEVQEQMKADMEASKDQMTTMIEAMMSMRKMMEVNVAPVATTSATAEEDPTHSSSINQGRHPKYPETTLWPTSSLTSDMPLRGKHLVAYPCQTPWGALNTARSHNCNPYISRWGGYLLPW

SEQ ID NO: 167727 - protein, 43 aa, Glycine max
  Coding DNA Sequence Number=SeqID_76042
MKVSKDYLNFQPCTLEGVEANKWRWFERCIGALDETHSGYSFA

SEQ ID NO: 167728 - protein, 567 aa, Glycine max
  Coding DNA Sequence Number=SeqID_76043
  Gene Ontology: Mol. function=phosphoprotein phosphatase activity; Biological process=intracellular signaling cascade
  Homolog annotation: Hit_ID=A7UQU7; Match level="QueryCoverage=64%, HitCoverage=69%, E-value=1e-43, Identity=32%"; Hit description=IMP dehydrogenase/GMP reductase, putative
  Pfam annotation: Domain name=DUF1723; Domain location=143-192; Score =61.0; E_value=3.9e-15; Accession=PF08330.1; Description=Protein of unknown function (DUF1723)
MVRTRGLGHALARVIDRGRQDEHDVVNVTEDVPHMVDDVAQRSEDVPQMTVDVDATVAEDLGRDGAEGSHADEGFPGGPCDPSVPTSFAEHVAHAIWTGQERPELKLVSHGRKMALIGRPVPAIEGLVVATGLSPLIECSVVTGDPRLISAFVERWHRETSTFHLPVGELTITLDDVSSLLHLPISGAFHSFEAFSVDEAVFLLMELLEVSGEEARAETVRARGACVHLSWSATNVHVVHLEAFRDLGQSRGYAWGAAALVHMYDQLDEASRTTTRQIGGYLTLLQQFLSVHQCVIDNAYEETSPRASGWLTTKAHMKGIIGASYRAHCDALTVTDVCWFPYSDHRGVRGFELISSFQGQLRWGPTMVTVRSERVLRQFGYIQSIPPLPVSADYMEWFFQISHPFMIPIQAGDQPRHAPAPDHEDYMQPNIPQVPVAFDPPRHAVDDYEGYGRSQKGTKLHDIMQDCLKIARGVPMQMEMLGLDKDAAQSIDDLVCLGSSSSMDSFASWKMNGSGMEKEERERRCHFKEKMSLEEAHHHRRPWIRAWRKKEMNEGRGRKKHEILCSK

SEQ ID NO: 167729 - protein, 73 aa, Glycine max
  Coding DNA Sequence Number=SeqID_76044
MSSSHNTKIDEDMTKSKGKDPLEGLGGPMTRARARKAKEALQQVLSVLFEYKPKFQGEKSKVVSCIMAQMEED

SEQ ID NO: 167730 - protein, 125 aa, Glycine max
  Coding DNA Sequence Number=SeqID_76045
GKSGVSLKDSTLFGLLLLEPIKANFRSLALRCKLLISRFLAYLGCLDLVGFLLSLDFLAPTPTQLHTSLLLELLVVIEFFIGLLLCFWTVLLIITDMQSGSQSESFDVEMGDRLEDMICDLGGIL

SEQ ID NO: 167731 - protein, 45 aa, Glycine max
  Coding DNA Sequence Number=SeqID_76046
MESPTVATYPSMGGRCRAHGCIFQERIMRGVATNVYSRKTSEKPE

SEQ ID NO: 167732 - protein, 145 aa, Glycine max
  Coding DNA Sequence Number=SeqID_76047
  Subcellular localization annotation: CTP_CleavageSite=98; ConfidenceScore=5.24e-01
MFSPSGIENFLKISEKNCFREKNPSRGAFVTISRRFRKRFHGDSSPFFIVLRSLFVVHRSSTVRRPHLFRFFRRFPQINVGGDSASFPFLEDAPVNPRVALPPKGNGEPFLKEDANVVMTRSKRIQEDSEEKEDSSPKVVDDILP

SEQ ID NO: 167733 - protein, 207 aa, Glycine max
  Coding DNA Sequence Number=SeqID_76048
  Homolog annotation: Hit_ID=A5C7C5; Match level="QueryCoverage=100%, HitCoverage=34%, E-value=3e-14, Identity=24%"; Hit description =Putative uncharacterized protein
  Pfam annotation: Domain name=zf-CCHC; Domain location=145-162; Score =19.1; E_value=0.002; Accession=PF00098.14; Description=Zinc knuckle
MESVNRGIWSAVVNGYTIPAHVVDNKTIEKPYESWVSVCTTVKEMWDLIQVTHEGTLEVRKAQKNSLIQEYETIRMKQGETIRDTSIPSTNKSKDDNAEGSDAKNLNLLVRRFNKFLKKNKNYGNRTFYPKKNLKKGEPSSSNGYTCFECEKAGHIKVDCPIYQKKQQGDKKNKGSLKNKKNSYIASDDDELTTSSDNSEEDEANLC

SEQ ID NO: 167734 - protein, 89 aa, Glycine max
  Coding DNA Sequence Number=SeqID_76049
  Subcellular localization annotation: CTP_CleavageSite=75; ConfidenceScore=5.23e-01
MSAEKYQLWLFTTTDVGYCFSIQSLNSIWMMMSIGNVRSASSGDASFLNLDRLTFRADVGLNFLRSVSVNQGNVRSASSGDASSLNLDR

SEQ ID NO: 167735 - protein, 67 aa, Glycine max
  Coding DNA Sequence Number=SeqID_76050
AAVSPAKPPYRLDHEVDDPLYLMTLTIPQLFLKRLLVMWDATVFGVFNEHFPLYIKHEDLSEIAHGG

SEQ ID NO: 167736 - protein, 116 aa, Glycine max
  Coding DNA Sequence Number=SeqID_76051
  Subcellular localization annotation: CTP_CleavageSite=20; ConfidenceScore=5.55e-01
MGFPPTSPPSPPSDASALPSAVKRTRKASRLRSLSTKPLGAERPVVHVDPATGKADGPHRKKLRTYLGIVARDKVDVTYENWKEVPTAQKDLIWEDIQAEFDIPEASDSRMKRKLL

SEQ ID NO: 167737 - protein, 110 aa, Glycine max
  Coding DNA Sequence Number=SeqID_76052
MSTASSTASTERKNVIMRPPLIMQFIVAFNNDKNTIQLPAFYHTQWARNYPEMVHLTHNGAIYEKLPHCTEVPLRACSNHMTVLRRHGPPLQWKVETLNPAIGGKGVVQP

SEQ ID NO: 167738 - protein, 93 aa, Glycine max
  Coding DNA Sequence Number=SeqID_76053
MGSQIPQTISHNHIIIKGIKMVQKHKTPRALNFINQFALRHQLWFPKIPQAFPLVALLEFPSIREKEKGLKPQFYYLHDDPTVNVFGIIVLRR

SEQ ID NO: 167739 - protein, 37 aa, Glycine max
  Coding DNA Sequence Number=SeqID_76054
MEKLPEQPSQALMCNTEEIRITTEMNLQKIKVNADVI

SEQ ID NO: 167740 - protein, 134 aa, Glycine max
  Coding DNA Sequence Number=SeqID_76055
MASMMEVMLGMRQLMEKNMVTTAAVSSAVEANLTLLATAHHPPPNTVGRGRSTLGHNSNPHLGYNRMAYPYGLPPNYTPPVRQDDAGHVSSPILEGEPPRQPDEVHEDHQEYAQGDVEFYPPIPVEAPTPNTLP

SEQ ID NO: 167741 - protein, 151 aa, Glycine max
  Coding DNA Sequence Number=SeqID_76056
MTLLLGNILPSDRNANLPLQKYQLVCVVPTWGSHPQRRPVDLKKSNRALGFPALVTGLCRPYRAPVPPASSCHHDIGIVLARHLVDPKKANRVLELPALNTGLYQFKGVPVAPSRVIRPPLPIELSSRSAAPPDGRRARHHSSIGMAGSEQ

SEQ ID NO: 167742 - protein, 103 aa, Glycine max
  Coding DNA Sequence Number=SeqID_76057
MGPFGRGWRLSGLFLLPNLLRFVGCVLHAKAFDEGVKDVYGPRWESTVPGQCCPLEGRLEDTNVAPCRACRPWIFSINGFLCFLRSDCSRMEKEKDEWRRHFK

SEQ ID NO: 167743 - protein, 198 aa, Glycine max
  Coding DNA Sequence Number=SeqID_76058
MYLQLQRTTRPRRQRDYTSSPSGGYTPSPWVLVTLTVERTTRPCLERTTRPHHQRAARPHLQRTTCPRLQRTTRPHHQRGYTPSPWVLVTVTSERTSRPRHQRAARPHLQRTTCPRLERATRSHLWVLVTLTVDALTSRGLHVLALRGLHALTLGTSYPHRQRTTRPRLERTTRPRLEGSCTFNALRGLHVLALRGLH

SEQ ID NO: 167744 - protein, 156 aa, Glycine max
  Coding DNA Sequence Number=SeqID_76059
  Homolog annotation: Hit_ID=A5BSR3; Match level="QueryCoverage=42%, HitCoverage=21%, E-value=2e-07, Identity=45%"; Hit description =Putative uncharacterized protein
MEEKKKKRSKEVAQSGSNDTIVDPLCPIRQHVKWKMAFTKKFGQMTFEAVKEIADRIDSQEEQGSQGSFVVHGRQDVLTASIGWLEHPSRVYAVGTDVTIKQYFGVASRSSRMSTSMAPKDLEKMTQKIKDQHEESLKKSDSTTNVVLLARCNRRC

SEQ ID NO: 167745 - protein, 113 aa, Glycine max
  Coding DNA Sequence Number=SeqID_76060
MKPFVQVKRSFAIGVGAVTFFGYRKDRNGQWLKKDALPPQDERTPSPPPQREDSTLLNEVLTELRGLRSYVGERFDSLDTRFAGMYIRLTQVEEDVSFIRTCFDPPPPPPSSS

SEQ ID NO: 167746 - protein, 91 aa, Glycine max
  Coding DNA Sequence Number=SeqID_76061
MVGTDDRKKEKITTFDIMGVCERKRKKKGNYSDDVDSNSVENVVAMWERRLSLKLLLAALNGKDSAVATCRFCRLMGTTTAELLLNRFKDT

SEQ ID NO: 167747 - protein, 48 aa, Glycine max
  Coding DNA Sequence Number=SeqID_76062
MEKTQERKSGRSRNRKNPGKQRMNNNTEWFENYGAFNGVGQDWRWRVI

SEQ ID NO: 167748 - protein, 274 aa, Glycine max
  Coding DNA Sequence Number=SeqID_76063
MTGPLDESISCFLIKVDPWVLVPITFRGLYVLAIRGLHILACRGLHTLAFRGLRILIFRASSFLLSVPGPPLDIGGQPTVRAHPERETITHLLCIPGQDFTRAAAKRRVRIMRTNMTNLTWIWMMLPFSNILPSDHNANLRLQMYRLGSRPQDAQWTRRSPTGPWGFQLWLRASIVLQGARSLGNVTSSWHRDHACKTPSGLEEVQQGLGVFYGVPVTSSKGIRPPTNRAFIKKYCVPRQAQGEIPQQPRDGRQRATDAPPSPLEFTSAHPQKG

SEQ ID NO: 167749 - protein, 203 aa, Glycine max
  Coding DNA Sequence Number=SeqID_76064
MVCNDHVDMTGRLLAGSFTFECRIMHFILCRVLLPRSTNLAQVSEEDLILLWALQIGHQIDWAHLVRYRMHKALRANAPLSYPHLVTLFLHYFNVPLEDEPFVKVKRSFAIDAGAFTSFGYRKDMDGQWMRKQDLPPPIPDEHTPSLPPQRDTSYSLLNDVLTELRDLWAFIGDRFNAMDSCITRLEDDMSFIRHCFDPPVDS

SEQ ID NO: 167750 - protein, 29 aa, Glycine max
  Coding DNA Sequence Number=SeqID_76065
MPKDRGGIVIIKKGEIVEDLWCFDDDQKA

SEQ ID NO: 167751 - protein, 148 aa, Glycine max
  Coding DNA Sequence Number=SeqID_76066
MGKAEEVQEKVKADMEAMKEKMATMMEAMISMKKMMEANAVTIAATSTVAKVNPMPPSGLNQMNHPTSAMIGKIWEVRAAPMMCKFKTSTPSRHMACLSTIHHPMWRTLPIRMSIIPLLYPLRANNPKLIMHMSLKLWGRHMKFPTTI

SEQ ID NO: 167752 - protein, 80 aa, Glycine max
  Coding DNA Sequence Number=SeqID_76067
MQSSQRDVYLGAYLNGSTAADTGRWCALKGLDDAPQPKSKVSARWIVVKYFKDPRPLEPKRLKALRIQWAQFYLRVRDQA

SEQ ID NO: 167753 - protein, 246 aa, Glycine max
  Coding DNA Sequence Number=SeqID_76068
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 167754 - protein, 19 aa, Glycine max
  Coding DNA Sequence Number=SeqID_76069
MVQGKFVPNLRELLSRNES

SEQ ID NO: 167755 - protein, 71 aa, Glycine max
  Coding DNA Sequence Number=SeqID_76070
MTRARTKKAKEALQQRASAKRNTQWLSARKNPEEDELYRFTEHTAPGHQAHRFNSSAKREKRAKPKITNVR

SEQ ID NO: 167756 - protein, 241 aa, Glycine max
  Coding DNA Sequence Number=SeqID_76071
  Homolog annotation: Hit_ID=Q0ZCD0; Match level="QueryCoverage=53%, HitCoverage=11%, E-value=8e-08, Identity=30%"; Hit description =Integrase
MERSMIDAASGGALGDMTHVEARNLIEKMASNSQQFSARNDAIVLKGVHEVATDSSSSAENKKLEGKLDALANLVTQLAMNQKYASAPVARVWVNVHLQITIQISVLLCSNLEYNPGWRNHPNLRWASPPQEQQPIPHFQNTTGPSRPYVPPPMQQQQQQQQRQQETEAPSQPSLEELVGQMTIQNMQFQQETRASIQSLTNQMGQMATQLNQAQSQNSEKLPSQIVKNLKNVSAITLRSG

SEQ ID NO: 167757 - protein, 143 aa, Glycine max
  Coding DNA Sequence Number=SeqID_76072
  Subcellular localization annotation: CTP_CleavageSite=29; ConfidenceScore=5.40e-01
LPSLGTDVWGANTIPVRKYNSRTFHLKVRRSRLFRFFRRFPQINVGGDSARIPFVEHASRESRVALPPKGRLRHSRSNSLLEEGSGRPKWARLLFVPPFLLNAPPSTFLLSKKLRKLTDYAKTPLFDFRHIMEFHGLRKPASF

SEQ ID NO: 167758 - protein, 83 aa, Glycine max
  Coding DNA Sequence Number=SeqID_76073
MLTSPERAQMTTLASAHQSHLGSLNDEVGITVRCLRGLPALGSCISFLNDHLEETLGSTKIEENHSKCINLAQDFPWEWVLLV

SEQ ID NO: 167759 - protein, 41 aa, Glycine max
  Coding DNA Sequence Number=SeqID_76074
MRGFESECKIKVKEDETQDWQKAMLEGFAPWVNHGGWVPCQ

SEQ ID NO: 167760 - protein, 391 aa, Glycine max
  Coding DNA Sequence Number=SeqID_76075
  Gene Ontology: Mol. function=exonuclease activity; Cellular component= intracellular; Biological process=RNA-mediated gene silencing
  Homolog annotation: Hit_ID=A7P1T2; Match level="QueryCoverage=42%, HitCoverage=73%, E-value=6e-42, Identity=78%"; Hit description =Chromosome chr19 scaffold_4, whole genome shotgun sequence
MDDPIHLETFNHDCFRELLVNTAELNKIRSQDLDFFLVLDLEGRVEILEFPVLMISAKTLQVEDIFHSGNWDLKTKVPQQCEVSKIELPPYFMEWINLKDVYLNFYDRRATGMVTMMKELQIPMVGSHHLGIDDTRNIARVLQHMLLDGALVQITARRNPRSLRDVKKSDEANSSNSSEVFHSLMIKPRIKEDNRMPIFAVKADGGVIYSDKVNEHFIWDVAPAMCDSDCSCDEHDGDTDEETDDDEEDRWKLDPRPCKLPPPPQRRSDPENGPWTGIKKKYPEDPFWKEKRMAEILGWTHPSLKIPAAPIPCMMFSSTSYDQEFPFLDKKTDPMTKVSTKPYIIPTEVGPEGKLKSPSQAEEVLNWQTDNARAQNHFLKKIDEKIDRICT

SEQ ID NO: 167761 - protein, 181 aa, Glycine max
  Coding DNA Sequence Number=SeqID_76076
  Subcellular localization annotation: CTP_CleavageSite=55; ConfidenceScore=5.37e-01
MERSSNDSLDPLSDSSFDNRGSKPSMSSSEAIQNFRTATKVSEMLGNVNTSSALSAFEKMEEKGGVGDVGSGCGDDDKGNLIGSGGGDNDGDGNNINGDVDIDDNDDDDDDGVGSGTNGCDNIGNSCGGSDEGGGGSGDGDGGRCVVVASNDKGGGSGNDNGDGDGGNGSDGDSKEYHCQM

SEQ ID NO: 167762 - protein, 74 aa, Glycine max
  Coding DNA Sequence Number=SeqID_76077
MAGASDGGGDYHQLDGSQHLLLDVMTTQMQQLMNRNNEELYGRIEGRSDPDAYLDWEMTIEHVFSCNDYTEERK

SEQ ID NO: 167763 - protein, 194 aa, Glycine max
  Coding DNA Sequence Number=SeqID_76078
  Homolog annotation: Hit_ID=A2Q4P8; Match level="QueryCoverage=44%, HitCoverage=33%, E-value=7e-10, Identity=43%"; Hit description=IMP dehydrogenase/GMP reductase, related
  Pfam annotation: Domain name=DUF1723; Domain location=105-154; Score =43.5; E_value=7.5e-10; Accession=PF08330.1; Description=Protein of unknown function (DUF1723)
  Subcellular localization annotation: CTP_CleavageSite=42; ConfidenceScore=5.27e-01
MILPPPSLRVVLPPRCRHQIALSPLRSSPPPLFLFCRQACARRQREAAPSFEDVQHMDHAADEVHEQPKEATVDDEVVDVEGFPSGLHDTSVLNGYANHVAVIVWNREGLISVFAERWHNEISSFHLPVVEVTITLNDVAFLLHLPITGAFHSFETVHVEEVVLLLVELLEVSADEARAETIQCHGAYVRLSWL

SEQ ID NO: 167764 - protein, 58 aa, Glycine max
  Coding DNA Sequence Number=SeqID_76079
MVVFGGDFDDDGAKSNIAGSQATDEDFLHLHFTVAGVKISALALRRHHRRHWPDAGQD

SEQ ID NO: 167765 - protein, 136 aa, Glycine max
  Coding DNA Sequence Number=SeqID_76080
MAARGGHWWSWVVEKVLGFGWEFGEGERGKNRVFHTEEHIYNLQISLSELVLLSGSPLFALSATIHAKRNSLCTNSRSVQFPLGLELRLARHQNLLYSKSKRKRPVTRVMSKRLQEDWTRAAEEGPRVLMNLRVDF

SEQ ID NO: 167766 - protein, 111 aa, Glycine max
  Coding DNA Sequence Number=SeqID_76081
MRTSKARPGELRLTPKVMSLPKRARAWPGEPDAGLGELGPRKCKEKTLLPSFLEDQRTMVPVATYPSAGGRRVTRGMRVPRKEYARSRHQRLFEENVGKTGKDAIYELLSE

SEQ ID NO: 167767 - protein, 125 aa, Glycine max
  Coding DNA Sequence Number=SeqID_76082
MTIICLCVPSDTTVSEWQKVCGMTIICLRMSSGPPPLDDKRVQNDHNLSLRAIRHDCTEWQKVCGMTIICLRMSHDLRVSGDNRKVSPWATSSWVMVTKSGVVDKSEAFAPTYPPMRNSDLRSSG

SEQ ID NO: 167768 - protein, 158 aa, Glycine max
  Coding DNA Sequence Number=SeqID_76083
MRTSKARPGELRLTPKVMSLPKRARAWPGELVFLNPKVFYGLGEPDAGLEMLLNYKSMWNWMTYYIKQYGLNNNSRGKVQQKGTHPTISTRTGPTDPRRRETTRPIHMESRGHIASNCPTRRTMIMKVDGEITSEYEISEEEEVEEELEEEAMQHDSE

SEQ ID NO: 167769 - protein, 318 aa, Glycine max
  Coding DNA Sequence Number=SeqID_76084
MAQMTSKAAKEILDRIDSLEEQTTQGSFVPHGWDDILNTAIGKLEHPGQALAARLSTKGSNVETADVDPSGNKNVSLKPTMGLYVQRQHTTVLVALGKICEGGSAIHNVTYVDDVVRVSVDKVIEGDAEVPFPTSKIQYEFDTSPRKLPETNERGTNDFDHDPLRQLIKSLYFMYDTPVELKWDGSKFGLSNVDASFFLTFSDVNEIVAGYKCLNISILQLWMLFLDEWSSTLGHASVYGFLEPQSIHHAKDRRAECEHYLQAWLKESQREGPLATGSTVSYDQYVDHAIIISSAMKSANTTAKGTNNPATPKWIEVK

SEQ ID NO: 167770 - protein, 31 aa, Glycine max
  Coding DNA Sequence Number=SeqID_76085
MGESKKKQEEEEEGKKAPDQGSKEKEEMCRK

SEQ ID NO: 167771 - protein, 76 aa, Glycine max
  Coding DNA Sequence Number=SeqID_76086
MSSALHIFHDSKPFALLAFQEKVASICIPKIMFILGYNGRKRRRGEGRHHPLGNKPRKKELHHQELPWIRSLKRML

SEQ ID NO: 167772 - protein, 140 aa, Glycine max; identical to SEQ ID NO: 99143
  Coding DNA Sequence Number=SeqID_76087
  Homolog annotation: Hit_ID=O52175; Match level="QueryCoverage=58%, HitCoverage=94%, E-value=1e-32, Identity=85%"; Hit description =Salmonella berta plasmid pBERT, complete plasmid sequence

SEQ ID NO: 167773 - protein, 40 aa, Glycine max
  Coding DNA Sequence Number=SeqID_76088
GFLTIKTISTNEKFVFIGNRVKAPVEAVRTYHLKLDTGII

SEQ ID NO: 167774 - protein, 89 aa, Glycine max
  Coding DNA Sequence Number=SeqID_76089
MAKFDPEVVLEFYANAWPTEEGVRDMRSWVRGQWIPFDVDALSQFLGDPLVLEEGQECEFSQRRNMANGISPGTLQGGKCGSCAPASPP

SEQ ID NO: 167775 - protein, 74 aa, Glycine max
  Coding DNA Sequence Number=SeqID_76090
MNPDFNQPRGGCSREVSIHPAQQHCYMFALGKRYLSSLAHEAPGFVFVARTRRPGARGAVVIPSLPTVDECGIL

SEQ ID NO: 167776 - protein, 88 aa, Glycine max
  Coding DNA Sequence Number=SeqID_76091
MWTTTGKIGEELATQLAPGEQGCFLQKQQPSGGRIRKAQVGLIAICTPLFTKCTPFTFFAFEEVTKTHGLRKTPPFDFRHITEFSRIA

SEQ ID NO: 167777 - protein, 855 aa, Glycine max
  Coding DNA Sequence Number=SeqID_76092
  Gene Ontology: Mol. function=two-component sensor activity; Cellular component=integral to membrane; Biological process=two-component signal transduction system (phosphorelay)
  Homolog annotation: Hit_ID=A1JKY3; Match level="QueryCoverage=94%, HitCoverage=72%, E-value=0.0, Identity=54%"; Hit description =Putative inner membrane protein
  Pfam annotation: Domain name=GGDEF; Domain location=677-837; Score =190.5; E_value=4.1e-54; Accession=PF00990.12; Description=GGDEF domain
  Pfam annotation: Domain name=MASE1; Domain location=19-290; Score =60.8; E_value=4.6e-15; Accession=PF05231.5; Description=MASE1 domain
  Pfam annotation: Domain name=PAS; Domain location=301-413; Score =51.0; E_value=4e-12; Accession=PF00989.15; Description=PAS domain
  Pfam annotation: Domain name=PAS; Domain location=555-667; Score =34.5; E_value=3.8e-07; Accession=PF00989.15; Description=PAS domain
  Pfam annotation: Domain name=PAS_3; Domain location=323-416; Score =57.6; E_value=4.4e-14; Accession=PF08447.2; Description=PAS fold
  Pfam annotation: Domain name=PAS_3; Domain location=450-543; Score =91.4; E_value=2.8e-24; Accession=PF08447.2; Description=PAS fold
  Pfam annotation: Domain name=PAS_4; Domain location=307-418; Score =17.8; E_value=0.0037; Accession=PF08448.1; Description=PAS fold
  Pfam annotation: Domain name=PAS_4; Domain location=561-672; Score =44.2; E_value=4.7e-10; Accession=PF08448.1; Description=PAS fold
  Pfam module annotation: Pfam domain module=GGDEF::MASE1::PAS::PAS::PAS _3::PAS_3::PAS_4::PAS_4; Domain location=677-837::19-290::301 -413::555-667::323-416::450-543::307-418::561-672
MEISAPNTFGTHKGVVLTHFLLVALATFLLALLSLSLSSEASHFTPLWFPTAAAIAVLYRHAPRHWGLPLLASGLGIVLASFLLFGVSATPIKLAAINLLEAAVCALLLRRMLDPYDPLNDLASWLRFVVCAVIFTPLFSALLAAGLVPAPGQPFWQPFGTWFISEAIGVLSLAPIGLSYNRRTLTALNPFPLLLTLMVTLAFSFMALTYLPFPFTFVILPLLWAAIALPRFEAFTVCFCTLLLITVMISLGLLHFQASGKHLGDLGLYLPMLLILIPAHAMAVVMHAFRVEKQHIVESESRFRSALEYSAIGMALVSPQGKWLQVNQALCALLGYTPEALHKLTFQEITHPDDLTADLSQLHDLLDGHISSYTMEKRYIRSDGQTVWALLAVSLVRDAEGLPLYFISQVEDISDLKRSQAENNRLVERITLANQVGGVGIWEWVMSQENFTWDQRMFELYDLNPDQTPTLALWRTLLVPEDRDRTDRELAALLADPKPFVMEYRIVTRHGSVRHIRGQGNVILDDQGRPLRMIGTNIDMTELKSLAEALHEEKERLHITLDAIGEGVISTDSHLRITFMNPVAEQMCGWPLDLAIGMPVAGVVRLTNGKDGPEIENLTQYPRQWPADYALVLHSRDGRYFDVQQSVSPLKTLDGETMGAVMVLQDVTASRELMKKLSYSASHDALTGLPNRASFEKQLKAAIVAGGEPSPPHSLVFLDLDRFKAVNDTAGHAAGDALLRDIAQLMRHQLRNSDCLARLGGDEFGLILFDCRPEQAKSLMQQVVNQISQHPFYWEGKIYRVGASAGITRIGGDAKSSELLAQADIACYTAKHHGRGQVYLYEARQKQLLERQHEL

SEQ ID NO: 167778 - protein, 107 aa, Glycine max
  Coding DNA Sequence Number=SeqID_76093
  Gene Ontology: Mol. function=oxidoreductase activity
  Homolog annotation: Hit_ID=A8GHQ7; Match level="QueryCoverage=47%, HitCoverage=16%, E-value=2e-18, Identity=86%"; Hit description =Aldo/keto reductase
MAPGQNGDDDRNRRNQQAQQQGTTLGEDGIKMKEIWRNRQHCPNKWANHLTHGAFVMSKKQLGRSGIQVPALTFGGNVFGWTADQATSFSLLDALVDNQLNFIDTAD

SEQ ID NO: 167779 - protein, 113 aa, Glycine max
  Coding DNA Sequence Number=SeqID_76094
MVAITPAKVHQPPFLREYDSNATCAGHREAPRRSMEHCRALNRKVQVTMLNEMDEVDIFVPHPLTNASLLIQLSPECGCKPLVCLLKRPVLLSLDFQDLSIRDYSSCTLLGAP

SEQ ID NO: 167780 - protein, 228 aa, Glycine max
  Coding DNA Sequence Number=SeqID_76095
GWWVYARIVDVENLLCTIARPPPSTTCDGVVPGDMSRGLGDLGDVRRAPGSQQIKGEQDHKARRLVVAGQLLENEVRKLREPLIVMAAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDFLEGDEDPLLEVDSPEEVMSASEADSTEDSGPREMAISGGSSS

SEQ ID NO: 167781 - protein, 226 aa, Glycine max
  Coding DNA Sequence Number=SeqID_76096
  Gene Ontology: Mol. function=motor activity; Cellular component=cell projection
  Homolog annotation: Hit_ID=UPI00016621D1; Match level="QueryCoverage =99%, HitCoverage=41%, E-value=5e-19, Identity=32%"; Hit description =UPI00016621D1 related cluster
MPTLAFQGVPKESEALHFEVLHALAFRGLHVLTFRGLDANAFRGLHVLTFRGLHALAFKRLHALAFKGLDILAFRGLHVLAFRGLHVLAFRGLHALPIRGLHVLTFRGLHVLAFKGLPALAFRGLHVLAFRGLHVLPIRELHVLAIRGLHILAFRGLHVVTFKGLHTFAFEGLHALTFKGLHVLAFRGLHVLAFRGLQDLTFRGLHVLTLRGLHALAFRGLDVLTF

SEQ ID NO: 167782 - protein, 77 aa, Glycine max
  Coding DNA Sequence Number=SeqID_76097
MSEEIDMNVENKEDAGMKVEHVDCSDAFNTSRLAKGVVSIDLRRLIWLEHALAVENVDAHLSCMRSQFWEKNDGWGS

SEQ ID NO: 167783 - protein, 57 aa, Glycine max
  Coding DNA Sequence Number=SeqID_76098
MRVTTIQQHQSSDSKEESQRPVHREETTNWGVEEEACEGERERQEATTIWELAKKLG

SEQ ID NO: 167784 - protein, 175 aa, Glycine max
  Coding DNA Sequence Number=SeqID_76099
  Pfam annotation: Domain name=zf-CCHC; Domain location=111-128; Score =21.5; E_value=0.00084; Accession=PF00098.14; Description=Zinc knuckle
MKREKLASYSSHNSCKSLSEELCDYYEGRHRSHLRPHSHRRDKERKPQEANINLPYFHRKDNVEANIDWEIRKDQGQGILGVTPSKPKDDKGKTIEKQPLKASMQEKTSSMKCFKCLGRGHFTSQCPTKKTMIMRGQDIYSSEDEASTSPSSSESEEAKGKESSEEIYPQEEGGV

SEQ ID NO: 167785 - protein, 111 aa, Glycine max
  Coding DNA Sequence Number=SeqID_76100
MVQKKDEELRGSSNGPISGYHRWLKAYAQGLDWLPNLRTTKEMEGEAPKEDKEVQALKTELEKAQTAKEKFKSAVVRIRKENAELRDVNIATTNALEQRDQEGPRGRTWPE

SEQ ID NO: 167786 - protein, 75 aa, Glycine max
  Coding DNA Sequence Number=SeqID_76101
SDRWDFENNNFGLPQSENGALSAIPTKGNCAERPKAVLSPIPTEGNCAERPKAALSPIPTKGNCAEWPKGALREP

SEQ ID NO: 167787 - protein, 290 aa, Glycine max
  Coding DNA Sequence Number=SeqID_76102
  Homolog annotation: Hit_ID=A5B5G7; Match level="QueryCoverage=78%, HitCoverage=15%, E-value=5e-08, Identity=25%"; Hit description =Putative uncharacterized protein
MAYKKRKASYTPTQARYDKSRFTSQEAWERYTYIAVPKKLLPERNVVVYYTEFDEFKEELERRHWDEELTDFADSNIDIAIVKEFYANLYDPEDKSPKQVKVRGHLVKFDEDTLITFLKTPVILEEGENLCTYSRFTLLRPDPQELAAKLCIPRRGYELNADGQPLKILRKNMSTLAQTWSVFSFSNLIPTSHTSYVTLNRDKLIYGIMMKMDMNVGYLISHQISLTTQHDTSRLGFLALITAICKARGVQSDSRSLESLSPTINLAYIKRNCWNLDDPTVTFRGPRKAR

SEQ ID NO: 167788 - protein, 90 aa, Glycine max
  Coding DNA Sequence Number=SeqID_76103
MVKYRAKSKTEMNRGLARLGEHPLHEIVFFTKGKGKDPLEGLGGPMTRARARKAKEALQQVLSILFEYKPKFQGEKSKVVSCIMAQMEED

SEQ ID NO: 167789 - protein, 103 aa, Glycine max
  Coding DNA Sequence Number=SeqID_76104
MSNRVLGFPALITGICQFYGALIAPNKVIRAPTNRAFINKYCAPRQAQGETPQQPGDGRQRAIDTPPPPPELLNSSTKAGALPTTRGRPAGDQVQSQRHKLGR

SEQ ID NO: 167790 - protein, 38 aa, Glycine max
  Coding DNA Sequence Number=SeqID_76105
MASAMTCGGTLWFYFHHPETFKSDNTQDSSLLGRDNRV

SEQ ID NO: 167791 - protein, 80 aa, Glycine max
  Coding DNA Sequence Number=SeqID_76106
APNKVIRAPTNRAFINKYCAPRQAQGETPQQPGDGRQRAIDTPPPPPELLNSSTKAGALPTTRGRPAGDQVQSQRHKLGR

SEQ ID NO: 167792 - protein, 260 aa, Glycine max
  Coding DNA Sequence Number=SeqID_76107
MGYVGVRELSWRWATGDGGFMRALWMWKNLLCTIARPPPSTTCDGVKLPAFIVDHRVVPGDMSRGSGDLGDVRRAPGSQQIKGKQDHKARRLVVAGQLLENEVRKLRKPLVIDYQGIVMVAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDLLEGDEDPLLETLRRIAARGRWRSAEALHPSGQLFGLVLYTF

SEQ ID NO: 167793 - protein, 68 aa, Glycine max
  Coding DNA Sequence Number=SeqID_76108
MADGKLIEMKGKINLGQAQGETPQQPGDGRQRAIDAPPPPPEPLNSSTKAGALPTTRGRPAGGQVQSQ

SEQ ID NO: 167794 - protein, 95 aa, Glycine max
  Coding DNA Sequence Number=SeqID_76109
MEEFLSQVAWLGVQPSPLGGGEAFAAQEPNLVPPEPFIIETDPVAQEPISLVPMSPAPITNDSQPSAPASEPEQPVLQDPPAAPVLDLNDHAEDD

SEQ ID NO: 167795 - protein, 290 aa, Glycine max
  Coding DNA Sequence Number=SeqID_76110
ARYDRSRFVSQNAYDCYVDNALGQKILPKRNVKLYITEFDEFRREIERRNWHKELTNFSEGSINVALVKEFYANLYDLEDKSPKQVRVRGHLIKFDDDALNTFMKTPVVIEEGDNLLSYSRFCRLRPDPQELATRLCIPRRGFKLNADGLPLKILRKNLTTLEAANLGLEDWRHHLLQLLLHQLLLPLLSLQHQQLYFSGSFLLELRAILFYAAEPASGLAFDHAELEEFGPPVGEASAAQEPQQEDILEVAERTSPELFTLVSDPVVAGLAVSPQPEPSAPVPDLPLSK

SEQ ID NO: 167796 - protein, 206 aa, Glycine max
  Coding DNA Sequence Number=SeqID_76111
  Gene Ontology: Mol. function=hydrolase activity; Cellular component =extracellular region; Biological process=metabolic process
  Homolog annotation: Hit_ID=A7P632; Match level="QueryCoverage=38%, HitCoverage=17%, E-value=2e-30, Identity=77%"; Hit description =Chromosome chr4 scaffold_6, whole genome shotgun sequence
MGSRSCDCRIAILVSHQGSILGVEVSISRKSYSTQLVVMEDENGNQNSASPQNGGFLIPNIFTLTIPKLYYKATREAGGAYNSGGNHVSNRFLNNFWYLDQLGIASCYSTKVYCRQTLIGGNYGLLNTTTFALNPDYYSAVLWHRLMGKKVLAVSSDVHIKDFYLQLGNPSTWEASLRSKEGSFLGKLEEENFLEKLERGLLTPLP

SEQ ID NO: 167797 - protein, 130 aa, Glycine max
  Coding DNA Sequence Number=SeqID_76112
MDPGEATICRLCIIITCPWNKLCSIVVVIWELWASGPVDADGGAGVDERRAGSGICEGARGITRISMEEKGGSVEEEGDGASDGAEVERALVKIAIIHLWKVAGVLHKPNGISSSLSFLTTFIPPFFGTT

SEQ ID NO: 167798 - protein, 147 aa, Glycine max
  Coding DNA Sequence Number=SeqID_76113
  Gene Ontology: Mol. function=microtubule motor activity; Cellular component=microtubule associated complex; Biological process =microtubule-based movement
  Homolog annotation: Hit_ID=A7P9D5; Match level="QueryCoverage=66%, HitCoverage=3%, E-value=8e-23, Identity=54%"; Hit description =Chromosome chr3 scaffold_8, whole genome shotgun sequence
MLQVSENQELRTHIEGALAARKLADNELTERMKITESLEDEILEMNSVFSQMNDSFKNLSSDLHDVTNERDHLQGQVICLKNRLQKAEAQVEANEAITQEAQKRTKDALPEDLVFHINYPGAYQPTITLNFSKGDLIHYKVCTLLDP

SEQ ID NO: 167799 - protein, 115 aa, Glycine max
  Coding DNA Sequence Number=SeqID_76114
MQSLQSSGLQPMMSMEEFLSQVAWLGVQPSPSRGDEAFAAQEPKLVPPEPFIIETDPVAQEEPAAQEPISLVPISPAPITNDSQPSAPASEPEQPVLQDPPAAQVLDLNDHAEDD

SEQ ID NO: 167800 - protein, 93 aa, Glycine max
  Coding DNA Sequence Number=SeqID_76115
MSSFLGIELLYGLSPPKEGTSFVVQVEGTSTWVVVTENKRGYISCGSVQVESTSTWLLKENKGGYIPCGSLLVKVFTRLKRNLKDRRLLGDWM

SEQ ID NO: 167801 - protein, 122 aa, Glycine max
  Coding DNA Sequence Number=SeqID_76116
MTQHGLVDSDVDGELFLRDGSNRANLNPLPMLLPPRREVPDVLGGMRIFLFILGNWFCDSDLDNLTGIDRVLIEKDLLADSYSDLEAFILDEKEFLLLKVISTLSELSYLICSIVGAGLGTD

SEQ ID NO: 167802 - protein, 126 aa, Glycine max
  Coding DNA Sequence Number=SeqID_76117
  Pfam annotation: Domain name=zf-CCHC; Domain location=54-71; Score =26.8; E_value=7.8e-05; Accession=PF00098.14; Description=Zinc knuckle
MQEEEEEQQEEEYDDEEELSLFVKKFHKFLKNRRMERSHNFNNGKRSQEVSPTLKCYKCNQPGHIKANFPSNESWPEKNEKKSYKERRSKKAYISWDDNDSSDGSEKEINLLSKDYENDENISQEV

SEQ ID NO: 167803 - protein, 45 aa, Glycine max
  Coding DNA Sequence Number=SeqID_76118
MATRMPLQLADRSITRPYGEIEDVLVQVKELDEKVLKERTKVDPG

SEQ ID NO: 167804 - protein, 123 aa, Glycine max
  Coding DNA Sequence Number=SeqID_76119
MVKACQKGGKRGRWLPPSSPRRAGLLRPKGTAFCWNALEGPRLRNNALFDFWNVAELYRLCNNAPFRFLACCGTLRIVQQCFFSTSGMSRNFTDCLTMGVKYLEVVKQRLHATKQWSPDKIRV

SEQ ID NO: 167805 - protein, 61 aa, Glycine max
  Coding DNA Sequence Number=SeqID_76120
MFSGFFTSSCGSNVFQDYFDDDKESRVKQSSKESRVKQVSRIKIKIKDSRIIKIKIQDSSK

SEQ ID NO: 167806 - protein, 243 aa, Glycine max
  Coding DNA Sequence Number=SeqID_76121
  Gene Ontology: Mol. function=protein disulfide oxidoreductase activity; Cellular component=chloroplast; Biological process=cell redox homeostasis
  Homolog annotation: Hit_ID=A4TRG6; Match level="QueryCoverage=100%, HitCoverage=100%, E-value=1e-132, Identity=93%"; Hit description =Peroxiredoxin/glutaredoxin family protein
  Pfam annotation: Domain name=AhpC-TSA; Domain location=6-140; Score =25.4; E_value=1.3e-05; Accession=PF00578.12; Description=AhpCTSA family
  Pfam annotation: Domain name=DUF836; Domain location=172-242; Score =4.0; E_value=0.017; Accession=PF05768.5; Description=Protein of unknown function (DUF836)
  Pfam annotation: Domain name=Glutaredoxin; Domain location=173-231; Score=85.9; E_value=1.3e-22; Accession=PF00462.15; Description =Glutaredoxin
  Pfam annotation: Domain name=Redoxin; Domain location=5-163; Score =156.0; E_value=1e-43; Accession=PF08534.1; Description=Redoxin
  Pfam module annotation: Pfam domain module=AhpC-TSA::DUF836::Glutaredo xin::Redoxin; Domain location=6-140::172-242::173-231::5-163
MFTSQEGKKVPQVTFHTRQGDQWIDVTTDDLFKNKTVIVFSLPGAFTPTCSSSHLPRYNELSSVFKQHGVDGILCVSVNDTFVMNAWKADQHAENITFVPDGNGEFTKGMNMLVEKADLGFGPRSWRYSMLVRDGVVEKMFVEPNKPGDPFEVSDADTMLKYLAPEFKVQESVSLFTKPGCPFCAKAKQMLQERGIQYEEIVLGKDATTVSLRAVSGRATVPQVFIGGRHIGGSDDLETFLSA

SEQ ID NO: 167807 - protein, 71 aa, Glycine max
  Coding DNA Sequence Number=SeqID_76122
MKMLLIPHDVAPYGACRKLRKHVFVLINGVLCFLKFDGYRMEKEKDDWRLHFKEKMSLEEAHHHLKPWIRA

SEQ ID NO: 167808 - protein, 207 aa, Glycine max
  Coding DNA Sequence Number=SeqID_76123
  Gene Ontology: Mol. function=methyltransferase activity; Cellular component=endoplasmic reticulum membrane; Biological process=GPI anchor biosynthetic process
  Homolog annotation: Hit_ID=A7PVK0; Match level="QueryCoverage=64%, HitCoverage=54%, E-value=5e-58, Identity=72%"; Hit description =Chromosome chr9 scaffold_33, whole genome shotgun sequence
  Pfam annotation: Domain name=PIG-F; Domain location=2-152; Score =91.7; E_value=2.3e-24; Accession=PF06699.2; Description=GPI biosynthesis protein family Pig-F
  Subcellular localization annotation: CTP_CleavageSite=74; ConfidenceScore=5.33e-01
MHGNACSLISPKSSNSMISGYLRAVGRGVLGVPVGALLNFLGAIAVGAPVTFQYLPKTVNWALMMSVFTTIPASCVLGSSWADWRRIFAQTKPKGSIEYLICLPAHGAVIGAWFGAWPMPLDWERPWQEWPISVSYGTVAGYLVALVASLGFVLACGPVCRQWIMNYDDKGKIGAIKLQALAMTWSSMGLNPLWIYCRQYYLAFVRG

SEQ ID NO: 167809 - protein, 48 aa, Glycine max
  Coding DNA Sequence Number=SeqID_76124
MAKEVRDQPHIKSGCAIDNPCAALLASSVKCVIGIGQHNNDRAFFAMV

SEQ ID NO: 167810 - protein, 131 aa, Glycine max
  Coding DNA Sequence Number=SeqID_76125
MERSMIDAVSGGALRDMTPAEARNLIEKMASNSQQFSARNDAIVIRGVHEVAMNSSSSAETKKLEGKLDALVKLVTQLALNQKSVPVARLYGLCSSADHHTDLCPYMQQSEAIEQPEADAANIYNRPPQPQ

SEQ ID NO: 167811 - protein, 366 aa, Glycine max
  Coding DNA Sequence Number=SeqID_76126
MAPRKLASKRSRKDKAAEGTSSAPEYDSHRFRSAVHQQRFEAIKGWSFLRERRVQLRDDEYTDFQEEIGRRRWASLVTPMAKFDPEIVLEFYANAWPTEEVVRDMRSWVRGQWIPFDADAIGQLLGYPLVLEEGQECEYGQRRNRSDGFDEEAIAQLLCIPGQDFAWTATGRRVRIMRTNMTTLTQIWMTLLLINILPTNHNSDLPMPKHPLDPDKSNRALGFPALITGLCQSFGVPVAPTKRQAQGDAPQAAGAPPPPHQAGQAGSFDMEQYLQHLVRQQAANHRAHVQTHDCLYQMSLSMQSQGFASFSCPTPDQFRTEVAWPGDWPEAQAGEAPPEAPGDGEEAHEDEEMADLLDFLGGSGDT

SEQ ID NO: 167812 - protein, 284 aa, Glycine max
  Coding DNA Sequence Number=SeqID_76127
  Homolog annotation: Hit_ID=Q57H85; Match level="QueryCoverage=19%, HitCoverage=56%, E-value=3e-17, Identity=80%"; Hit description=ORF16- lacZ fusion protein
MAHTKRSDLARASGPHKVRRSPDWSLQLDSMKSESLVIVDQNATGAYHFVIHDWGEVVTRGDEGRANLRKAPARLTRRTGGTETSKYPEEKKSTEIPPVAASERGAAQSLNQLGDSPVHENAQAVNSKSRAGHVYREGKAKRTPARGVKKNLKPCTYKQWEHLRGGIDPKPGDLAMGRLKVGTVSARGPSRLTNPMQTTNTEECYHGRHTAGANVRREEGNNPDRQLRWPVRVAGGIRSANADISNDKAGEKPARRKTKGSCPTLIGAGGDGEGYVSRATVVPV

SEQ ID NO: 167813 - protein, 93 aa, Glycine max
  Coding DNA Sequence Number=SeqID_76128
LNRTSELKLIVVSFFSELPFSITSVSISYGTPSDIRVKSYYRLNLLRASVFNYERLDILRDSIGHPMSKVLSFDFTQSFRFQLRASRSITETQ

SEQ ID NO: 167814 - protein, 106 aa, Glycine max
  Coding DNA Sequence Number=SeqID_76129
  Homolog annotation: Hit_ID=Q84VH5; Match level="QueryCoverage=61%, HitCoverage=9%, E-value=6e-16, Identity=69%"; Hit description =Envelope-like protein
GTHVPDSVSTSGKAAASGAVSKDALIAELKDTCKVLEATIKATTEKKMELERLIERLTDSGIDDGEAAEEEEDPAEEEEAAEQEEEAAEEEEDAAEETESDSEATP

SEQ ID NO: 167815 - protein, 158 aa, Glycine max
  Coding DNA Sequence Number=SeqID_76130
MVGQGGEVLGNIGGPHMGHNRNAYPYVLPPNYMPPTMHMPNENANHVVPVTFEGQQPWEHAQCDFDPYPTFTAEGLAFNAMPQPNTTEAPQPHPLQQLCFLVGGPPPAVEGIEKLDLIEERLRAVEGFGDYLFANMAELCLVPDVVIPPKFKVPNFDK

SEQ ID NO: 167816 - protein, 78 aa, Glycine max
  Coding DNA Sequence Number=SeqID_76131
MLTKKNRYIHSDKIVVEGKTLIDLGANINLMPLSMCQRLGEVEIMPTRMTLQLAYRSITRLMEAYLWSFYGGWIFELQ

SEQ ID NO: 167817 - protein, 123 aa, Glycine max
  Coding DNA Sequence Number=SeqID_76132
MASRKRRAPTSRPQEPYDTSRFVSEVAWERYEQNIHARNILLERNVELQGKLIKFDVATLNEFLKTPVVLEPGERYSTYSRFCHTHPDPQELAARLCIPGWGFMLNAKGVPWKLLRKDLTTLA

SEQ ID NO: 167818 - protein, 160 aa, Glycine max
  Coding DNA Sequence Number=SeqID_76133
MALKEAIKKELSHKGSPESLLIQPDIQQLGAPVNTNGSNVVINRKDGTLGLVAMGKIMEGDSVMHIVAYEDDVVRDVEIIPHNEDAHVPKPANVDADDPLRGLIKYSFDIYEKPVEINFDGSCFGIADAPTSIFITYSDVSEIIAGDKTLNISVQQLWLM

SEQ ID NO: 167819 - protein, 89 aa, Glycine max
  Coding DNA Sequence Number=SeqID_76134
  Homolog annotation: Hit_ID=A0ST23; Match level="QueryCoverage=30%, HitCoverage=55%, E-value=2e-08, Identity=100%"; Hit description =Putative reverse transcriptase
QLGANCLPGTECQIKLIDTVDLEGGPVGKPVVPAALMNRPTRGERRFAYWALAECILAYYVGTDEGEKKGCTGASAEYVIQDIFRFLAH

SEQ ID NO: 167820 - protein, 121 aa, Glycine max
  Coding DNA Sequence Number=SeqID_76135
  Subcellular localization annotation: CTP_CleavageSite=60; ConfidenceScore=5.01e-01
MDDALFLAWSWLKASEKGGTLGALYLISSVPLIMGSPPASTPLPPLDASASPSIVKRTRKASRLRSLSTRPPGAERPVVHVDPATGKADSPLRKKLRTYLGIVVCDKVDVTYENWKEVPTA

SEQ ID NO: 167821 - protein, 53 aa, Glycine max
  Coding DNA Sequence Number=SeqID_76136
MAIACSLACIPNEPSGSSSIMWLASLHVEVRIRAQIKDFDLGIQAFGFECKKA

SEQ ID NO: 167822 - protein, 63 aa, Glycine max
  Coding DNA Sequence Number=SeqID_76137
EMLMMLKMHCDDVMLCMNMGGAVTLLDIPAEWRWKNDDWRRHFKEKMSQEKAHHHTKPWIRAE

SEQ ID NO: 167823 - protein, 116 aa, Glycine max
  Coding DNA Sequence Number=SeqID_76138
MVKPRNILLTLKEHNVNSYTTIKQIYNARNVYRSSIRDSNTEMQQLMKLLEAWENLVDCPSNQEFDGCLKKFEIACSPWPMFVEVESTHSALKRLLQNSLRELCSVREVMNNMITL

SEQ ID NO: 167824 - protein, 130 aa, Glycine max
  Coding DNA Sequence Number=SeqID_76139
VQPCVFMRDKSTIVPIDLEIEATCRRNNAARRRREQDIDTSPPLSPNHVQMDGEPVRRVTLEDFCQTTTPEFFTSITPPEVQALNISYPHSLIQLIQGNLFHGLPSEDPYTHLASFIETLVCLSPSSPLF

SEQ ID NO: 167825 - protein, 104 aa, Glycine max
  Coding DNA Sequence Number=SeqID_76140
  Homolog annotation: Hit_ID=A2Q246; Match level="QueryCoverage=69%, HitCoverage=29%, E-value=2e-27, Identity=86%"; Hit description=CENP -B protein
YPGENEACSEVQSLEDIVGTIIENNAEDDDEDDTVSLDPVTRKEALMASNTLHNFMIQYKNTTPELLDAIRKNAEEEEEEEEEEEEEEEEEEEEEEAINLTMFF

SEQ ID NO: 167826 - protein, 450 aa, Glycine max
  Coding DNA Sequence Number=SeqID_76141
  Gene Ontology: Mol. function=lithium ion binding; Cellular component =integral to membrane; Biological process=calcium ion transport
  Homolog annotation: Hit_ID=A7QRH9; Match level="QueryCoverage=94%, HitCoverage=78%, E-value=1e-132, Identity=55%"; Hit description =Chromosome chr8 scaffold_150, whole genome shotgun sequence
  Pfam annotation: Domain name=Na_Ca_ex; Domain location=21-196; Score =64.7; E_value=3.2e-16; Accession=PF01699.15; Description =Sodiumcalcium exchanger protein
  Pfam annotation: Domain name=Na_Ca_ex; Domain location=297-440; Score= 122.9; E_value=9.5e-34; Accession=PF01699.15; Description =Sodiumcalcium exchanger protein
  Pfam module annotation: Pfam domain module=Na_Ca_ex::Na_Ca_ex; Domain location=21-196::297-440
  Subcellular localization annotation: CTP_CleavageSite=25; ConfidenceScore=5.09e-01
MAALIFTSTQIMTPSAYMSNPMFTAASNYFCNNLEGLSDILRLSPTIAGVTLLSLGNGAPDFFASVVSFTRSNDGAVGLNSILGGAFFVSSAVLGVISFLVRANEIAIDKASFIRDVIFFLFSLFILLVIISIGDRTECELVSSSEDLTESGIPLLGCVDDEKSNVSNKEVIKDNNGDKQKCFGYDSFDFTYLSKFLQVLELPLSLPRRLTIPVVSEEGWSKPYAVISVTLAPVLFATLCNTQMENVSSKSSLVSYLTAALIGIVLGNMACVTTKSTSPPRKCLFPWLAGGFSMSVTWTYIIAEELVSLLVAIGSVIGVSPSILGLTVLAWGNSLGDLIANGAMAKNGGADGAQIAVSGCYAGPMFNILMGLGLPLVLSAWSEYPDSYVIPKDPSLYATLLFLMGGVLWALVILIKKKMKLDKSLGVGLLTIYLCFLFIRMAIAIGVIKF

SEQ ID NO: 167827 - protein, 70 aa, Glycine max
  Coding DNA Sequence Number=SeqID_76142
MAPSRVQYCGELLLRCGSLTREGAWRGGLGGEEWGAVSYMVRHHTWVWREGVGCGAGASCMRLKPRSKIK

SEQ ID NO: 167828 - protein, 307 aa, Glycine max
  Coding DNA Sequence Number=SeqID_76143
MVSEIYPEVHENPRVFFSNSSSILLEPLAHGSGDWSLPRGDFIKKGNVSTKRLGIREATKKKEKDKVISSPTTEGFVSEMEKPSKDYSEGPQNEEETPLIEAKNEKVGDHNQDIHPSEGAKAVKAQNNASFEPVQEDLNKEEEEEEEEPFEKVEKVEVVVETAHNVLEVTGGGRTLVGYVKDSLFNTKNMQNLFNSPIFDTSVKIACGIDPLHGEPSTLSISFPHELATTKPSMVQEEVHFIHISSPQPVVEPSTSYCSPTLINFRELMQSYLPRALDRRLQEDWAKDAGEGPRVIMSLRVDFGPMG

SEQ ID NO: 167829 - protein, 60 aa, Glycine max
  Coding DNA Sequence Number=SeqID_76144
MEESWGIPLSIVCMTLKHKDFQVYAITVNNSHNANNMDKFDVLISFSHNYIFAYLTFTRM

SEQ ID NO: 167830 - protein, 230 aa, Glycine max
  Coding DNA Sequence Number=SeqID_76145
ATRPHLQRTTRPHLQRATCPLLQRITQSSPSEDYRSSPSEDCTSSPSEDSTSSPFRGLHVLTFQEGYTVSPLEDYTVLAIQGLHAFTIRGMHFLTFRGLRALTFRGLHALAFREDYWSSPSEEYSTHLPSEGHTLAFRGTHPPFQRTTRLRPSPFRGLHALAFRGVRTPSPLEGLHPLPSEGYHALPFGGLHALTFKGLHALAFRGLHILAFRGLHALTFRGLHVLMEAC

SEQ ID NO: 167831 - protein, 118 aa, Glycine max
  Coding DNA Sequence Number=SeqID_76146
GGDGERSSAAYTGASFFTQDPSLSLQYPKEETTFASIEKDLLTLTKGSESRGTSKCCRNKDAHNQVVPDAKFECQRSSKKPSDHIRLVGTNHPVGIRNEKIELPLIIKCTLKWYTFTG

SEQ ID NO: 167832 - protein, 329 aa, Glycine max
  Coding DNA Sequence Number=SeqID_76147
  Homolog annotation: Hit_ID=Q6WAY6; Match level="QueryCoverage=76%, HitCoverage=41%, E-value=1e-30, Identity=33%"; Hit description =Putative uncharacterized protein
MDAIAFFTQYYDYRLRCFTFEDFQLVPTVEKFEEILGCQLGGRKPYLSSGFYPSMARVAKVVRISAQELDQVKQNKNGVVRVPRKCLEEKAKALASQGKWASFIDILALLIFGVVLFPNVDRLVDLAAMPAIDTFLAFHHSKESPIVAILANIYDTFDQRSEKSGARIVCCTSALSVWLVSHLFRQEGRHVCPQQGHRSCAKKREANWDQLLASIEGASINWFPRWKEGRTGILFSCEGFPNVPLMGTSGCINYNLVLAIRFFLQKAVASGGSNLARLGELGGKLLPYFAINRGRSEGRRGSAFLALLILSKLLRKIVSVKKIQAEALP

SEQ ID NO: 167833 - protein, 71 aa, Glycine max
  Coding DNA Sequence Number=SeqID_76148
MEKSGGKQNNFGSMKEREWKIFRPDKFSARWKTQWTVRFCQPPFSEPHECHCLALFMCPPPSSLELCFMTA

SEQ ID NO: 167834 - protein, 129 aa, Glycine max
  Coding DNA Sequence Number=SeqID_76149
  Subcellular localization annotation: CTP_CleavageSite=64; ConfidenceScore=5.56e-01
MRGYRMVTSTFRQPGANEPVDVQRLASSSAPFVVLTRKVLLSSFGNIQARRCARFFSAGQGRSSAMAKGSVGKLSYPNFVRGPLFGGMQPSLDRFEGCANSNQAHLGLLGGSNRRRCLLVEATQLAWAS

SEQ ID NO: 167835 - protein, 194 aa, Glycine max
  Coding DNA Sequence Number=SeqID_76150
GLHPQDTQWTRRSPTGPWGFQLWLRASVSPTGCPFPPARSCHHDIGVAPTSHPVDPEEPNRTLGFLALVTGLYQSYRAPVPPASSCRRNIGKDRARKTPSGPGEVQQGLGVSSSDYGLLSVLRSACHPGKVIRSPTNKAFIKKYCAPRQAQGETPQQLGDGWQRATNEPPPPLEFISAHPQKRLEHCLRHMADQ

SEQ ID NO: 167836 - protein, 254 aa, Glycine max
  Coding DNA Sequence Number=SeqID_76151
  Gene Ontology: Mol. function=hydrolase activity, hydrolyzing O -glycosyl compounds; Cellular component=cell wall; Biological process= carbohydrate metabolic process
  Homolog annotation: Hit_ID=A7Q8D6; Match level="QueryCoverage=50%, HitCoverage=54%, E-value=6e-30, Identity=55%"; Hit description =Chromosome chr5 scaffold_64, whole genome shotgun sequence
  Pfam annotation: Domain name=Glyco_hydro_16; Domain location=6-165; Score=-16.0; E_value=2.9e-06; Accession=PF00722.12; Description =Glycosyl hydrolases family 16
  Pfam annotation: Domain name=MtN3_slv; Domain location=98-184; Score =67.5; E_value=4.4e-17; Accession=PF03083.7; Description=MtN3saliva family
  Pfam module annotation: Pfam domain module=Glyco_hydro_16::MtN3_slv; Domain location=6-165::98-184
MDQSWFHKFYQWLKRWERKECKPNSLPILHKMQEMRFKSYLDEKGLSSQGPTHDEIHFEFLRNLSGDPYILRTNIFTQGKGNREQQFYLWFDPTRNFHTYSIISKPQHIMMQTYVLENIKIKKHGSTEDFLSLPYICTLLNCSLWTYYGIIKAREYLVATVNGFGIVVETIYVILFLIYAPKGIRGRTAILAVILDVAISAEAVATTQLALQGEARGGAVGVMGAGLNIVIYFSPLCHVRIRSGTKCFTTSHHH

SEQ ID NO: 167837 - protein, 154 aa, Glycine max
  Coding DNA Sequence Number=SeqID_76152
  Gene Ontology: Mol. function=oxidoreductase activity, acting on the aldehyde or oxo group of donors, NAD or NADP as acceptor; Cellular component=mitochondrial matrix; Biological process=metabolic process
  Homolog annotation: Hit_ID=A7QMK5; Match level="QueryCoverage=50%, HitCoverage=17%, E-value=2e-10, Identity=45%"; Hit description =Chromosome chr19 scaffold_126, whole genome shotgun sequence
MDVKHFEVVIRRSHADKQWSPDEIRLAAKFRNCGQTCVCANRIIVQEDICEKFANALRDVVHNMKVGDGFSEVSVFLLNQLPVDIAYLASLFFHGNIHSYGLQKMSHGVTHFISISKQGPLINEVVVKKIIDEANIYKIQTAIEFGRNTIVQNY

SEQ ID NO: 167838 - protein, 103 aa, Glycine max
  Coding DNA Sequence Number=SeqID_76153
VDSRGSPLPIEDRRTTKNERRTTNDEERLKIFMKSPTKRKIGEELATQLAQASQVASSRSNRLLEEQSGRPKILQKLKDCATTLPFDFQHITEFHGLRNNASF

SEQ ID NO: 167839 - protein, 105 aa, Glycine max
  Coding DNA Sequence Number=SeqID_76154
  Pfam annotation: Domain name=zf-CCHC; Domain location=85-102; Score =23.9; E_value=0.00036; Accession=PF00098.14; Description=Zinc knuckle
MSQSNEETDKRKRSIALKASSSIQEEEEEEEEEEEEEEEEEEESDDEEVFSLFVKNFHKFVKNKRMERSHNFNNGKRSQEVSPTLKCYKCNQPGHIKANYPSNES

SEQ ID NO: 167840 - protein, 400 aa, Glycine max
  Coding DNA Sequence Number=SeqID_76155
MGLDQARSFKKRFYHVKVKNLEVASLRKLGQWMDQVQRQAFSKMLHFWGLSVSTDHRGVRRDLRVPDRRKEAIYLFTGYYLSMVRIAGVAETLASQGEWVSFINILALLAFGTVLFENVDGLVDLAVIDAFLAYHHSKESLVITVLAYAYDTFDLRCEKSSARIVCCTPALCVWRKSVMLVATYPSAGGRRGAHGCVFYGRKMRGVATNVYSRKTSEKSERDTHVFEPVHGGWPPAGKPNAVNNALRPVTHLDWPAKVVAVRLRTDDWQRPMIRAGNPRALLDFYGSRGCLDGIHQLALRQREVRVVVARQDIAEQQRHPYLGQGSHAGAHDLHPPPCSGPGEILPRYAQQLGDGFLIETVCLAPPLGDLTLLTFLQNQRVAQELNEGICVEGNPLTPHP

SEQ ID NO: 167841 - protein, 46 aa, Glycine max
  Coding DNA Sequence Number=SeqID_76156
MGPVTRAMRKRLQDNWARAGKEGPRVLMNLRVCMVPYKLRAPYPIS

SEQ ID NO: 167842 - protein, 130 aa, Glycine max
  Coding DNA Sequence Number=SeqID_76157
MPASSLLHPISCIFAFFCIFTHQSINDTNNVLGRNILPERKVELYHTEFDDFKTELESSEGPSPKQAKVRGHLVKINADSHKTFLETPVVLVEDPREIEAALCIPSRGFILNAEGHPGRILRKNLTTLAQ

SEQ ID NO: 167843 - protein, 147 aa, Glycine max
  Coding DNA Sequence Number=SeqID_76158
MHRSPTGNLVPLDLEIEATLRRRNRAKRRRKLLQDRTVASILEEETYFSDSSSSDSPSSRESATYLPKAVSMADEHQQRVTLEDYSSSSVPQFFTSIARPEVQAHIINYTYSFIHLIQGNLFQGLPNEDPYAHLATFIEICNTVKIT

SEQ ID NO: 167844 - protein, 347 aa, Glycine max
  Coding DNA Sequence Number=SeqID_76159
MASRNTHVIEAIPTMEITIIHNDNEPSIHVILLSDTIAKATRCLREGNTYLEGWERNYNSHITRALYRYNADKASDKKTIVYNFMCGKEKIWDNILNNSVLHKAGSKTIDLHKFMRFHLTGNLLFDLPHIIYINILRNIKGLGVYYVFNKMDEDSKHILIVNGLVVAKQQKFSKNNLKAMKTDDDDDDEGLVRVALQKMKVVAPDAPTPKKAKKAQPIAKPKTFVLTSAIPCWINTRATKANPKIGDKEWAISFTRNKEDPALSSSDGESIDGTPITPLRKFAPTPQQCPSPSPLHLDRFKRATPRVPLSDAQCFLLVFSHVREEGARVEANYKTAASASYGHPTLT

SEQ ID NO: 167845 - protein, 97 aa, Glycine max
  Coding DNA Sequence Number=SeqID_76160
  Homolog annotation: Hit_ID=Q0GPF6; Match level="QueryCoverage=56%, HitCoverage=33%, E-value=5e-08, Identity=60%"; Hit description=BZIP transcription factor bZIP126
MACSSGTSLGSLSLLQNSSSEEDLQAMMEYHRKRKRMISNRESARRSRMRKKEALGRGAQAEGGKVLAGAGGGTGGEGGVGGEAAEVDNHLDGEGML

SEQ ID NO: 167846 - protein, 80 aa, Glycine max
  Coding DNA Sequence Number=SeqID_76161
MSTWEELDDTLFGEETKKEEKVNLCLMVDTASEESDSELDEEESHEDSTSGGFNLFSVSLTFGNSIGAVGGITEGISGNR

SEQ ID NO: 167847 - protein, 179 aa, Glycine max
  Coding DNA Sequence Number=SeqID_76162
  Homolog annotation: Hit_ID=Q0ZCD6; Match level="QueryCoverage=96%, HitCoverage=21%, E-value=5e-08, Identity=25%"; Hit description =Integrase
  Subcellular localization annotation: CTP_CleavageSite=12; ConfidenceScore=5.03e-01
QNQLQKNNYDLSSNSYNPCWRNHPNLRWTSPPQQQQSVPHFQNDADPSKPYVPLPIQQHQSQQRQQATEAPPQPSLEELVRQMTIQNMQFQQETRASIQSLTNQMGQMATQLNQAQSQNSDKLPSQTVQNLKNVSAITLRSGNQIQVPPPVAAPTPEPIKLHSTPEKEDEIVALKRNLP

SEQ ID NO: 167848 - protein, 157 aa, Glycine max
  Coding DNA Sequence Number=SeqID_76163
MASSLPSIGGVTKLHGWDLGVITTYGYNVYRSPSSHLQKVVFLDYRNARFPFAQELHCVGSKDSVSDLHEFVLFHLMDKIPFDLPHTVYISILKNMKTLGEVDDIYYVAFEWTRTPSARAVSLEHEDKLLHVLRGHKKAIGQTLADLLGINLSICMN

SEQ ID NO: 167849 - protein, 64 aa, Glycine max
  Coding DNA Sequence Number=SeqID_76164
MRREDEDGDFSSLPGGLKFVSRKIVKLNSPPDENPETGQIQAKGPSGEGRRPKWRRIKPPSGEG

SEQ ID NO: 167850 - protein, 147 aa, Glycine max
  Coding DNA Sequence Number=SeqID_76165
MTLATLFGKFQKHKMELLRLNQHEENDKKKKGIAFKASSSIQEESDKEIDLDEDDDLSLFKNMEKSEKTNFSEKKMKKAYITWEDNDMESSEDSENEEINLCLMAKSYESDEEVTSSNNLAISFDELQDAFAGLHKVNQTCKVSFIF

SEQ ID NO: 167851 - protein, 298 aa, Glycine max
  Coding DNA Sequence Number=SeqID_76166
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSISISAHCNLCLRGSSNENSKEATVHIKPVRAPVQVIPTLCPHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 167852 - protein, 208 aa, Glycine max
  Coding DNA Sequence Number=SeqID_76167
  Homolog annotation: Hit_ID=A6EES9; Match level="QueryCoverage=99%, HitCoverage=38%, E-value=1e-71, Identity=62%"; Hit description =Porphobilinogen deaminase
  Pfam annotation: Domain name=HEM4; Domain location=1-202; Score=33.3; E_value=4.2e-08; Accession=PF02602.6; Description=Uroporphyrinogen -III synthase HemD
MAKHNISIEGRSLIKIFPIINKLDPFILKHVDWIIFSSKNGIEHFFNLEPRLSKKTKIGVIGRGSEEILRKYDRVADFSGDSEGINMEEIAKKFAELANGGTVLIPRAKESLETIQKALSPETKIINIPVYETVLEENVDPSNAEVLVFTSPSNVEAYFADNLLEPGQKVICIGRSTGAKFDEMNVPYTLPYSPDEIGLSEAVFGLEY

SEQ ID NO: 167853 - protein, 122 aa, Glycine max
  Coding DNA Sequence Number=SeqID_76168
  Subcellular localization annotation: CTP_CleavageSite=58; ConfidenceScore=5.75e-01
MSLPSAVLVSSTYESGAPRSYCVALFANSPFSTFFPSPMAVIAYCSPRMSLPSVVHVSSTYESGAPRRSSSSMDSFASWKMNGSGMEKEEGEGTPLQGEDESRRSSPPYEAMDKSLEKEGDE

SEQ ID NO: 167854 - protein, 135 aa, Glycine max
  Coding DNA Sequence Number=SeqID_76169
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MLARTDEPTKIENLPSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 167855 - protein, 164 aa, Glycine max
  Coding DNA Sequence Number=SeqID_76170
MTTLIWIWMTLLFSNILPSDHNVNLPLQMYQLESRPLDAQWTRRSPTGPWGFQLWLRASVVLQGARSPRQGHGSRLQDTQWTRRSRIGSWSCQALITDLCQFYGVPITPSKVIRPHTNRAFIKKYCIPRQAQGETPQQPGDGRQRATDAPPSPLEFTSAHPQKG

SEQ ID NO: 167856 - protein, 102 aa, Glycine max
  Coding DNA Sequence Number=SeqID_76171
  Subcellular localization annotation: CTP_CleavageSite=52; ConfidenceScore=5.19e-01
MKLGGRQRYLSGYPYKHSFAIRQTQSPKSGGSRGYRMVIRTFHQPQANEPVNAQRLTSSSAPFVIQGQQVRWQAEIPYGRLHLSSTKVNEFNGIRMMLVVRF

SEQ ID NO: 167857 - protein, 118 aa, Glycine max
  Coding DNA Sequence Number=SeqID_76172
MYVYNYSTYAKTGLTFNYYYNMLREEADADRAINWLIKKSRNLPISVLVKSTYVRCNALFNERGREATRMLAFDQVYTKVLSKVIEDALKKANTHNVLEFDRRDTQFLVQETINLREV

SEQ ID NO: 167858 - protein, 230 aa, Glycine max
  Coding DNA Sequence Number=SeqID_76173
IGNERRSGGTCGTTYWITPVRHEAADAESAPMPLAMPCLVPRHGGGQKGEGCEGGLVIHTSGQMNGGPTDPGFHERWRVLECLSRALAHTPGTQQRGTTRPYTASGEDGTTGKDRPAKTPQARSVVGRTVEEPGGAGSFDGNGRLFPIREGPLKSRGNSAAYTRISFRGRAVSISLQDLRMNAGLGHLEWREPHAGRPARGANDPLRLTYLQLHPRAAVKRRRECKMPAE

SEQ ID NO: 167859 - protein, 166 aa, Glycine max
  Coding DNA Sequence Number=SeqID_76174
  Homolog annotation: Hit_ID=Q6L477; Match level="QueryCoverage=42%, HitCoverage=11%, E-value=1e-09, Identity=33%"; Hit description =Putative uncharacterized protein OSJNBa0009L15.8
  Subcellular localization annotation: CTP_CleavageSite=15; ConfidenceScore=5.38e-01
MATPPALPPPLPPTVALASPSTLKRTCKATWLRSLTTRPPGAKRLVVHVDPATGKADGPHKKKLRTYLGIVARDKVYMTYGTWKEVPTAQKDLIWEDIQAEFDIPEASDSRTKKKILQTVGERWRQFKSDLMRKWALAADKDSVDDTICENYDISKEKWALFCQTR

SEQ ID NO: 167860 - protein, 175 aa, Glycine max
  Coding DNA Sequence Number=SeqID_76175
  Homolog annotation: Hit_ID=A7Q2G2; Match level="QueryCoverage=68%, HitCoverage=44%, E-value=5e-07, Identity=22%"; Hit description =Chromosome chr1 scaffold_46, whole genome shotgun sequence
  Pfam annotation: Domain name=zf-CCHC; Domain location=85-102; Score =24.1; E_value=0.00034; Accession=PF00098.14; Description=Zinc knuckle
MTRKRKELHLKPHLLSKKKKNKGIALKASSSIQEESDKEDLNEIKEDDGFNFFVNRFNKFLRNKGNQRRINFNSKKRGEDSSSVPKCYECNQPEHLRVNCPSFKKRMEKTDRKTFKDKKAKKAYITWEDNDMDSFKESENEVVNLSLMTKNYKSEEENFKMHSMTYIKNQSNLPN

SEQ ID NO: 167861 - protein, 166 aa, Glycine max
  Coding DNA Sequence Number=SeqID_76176
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MAFNVRDPQSFHMHHLQNALCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRAVLLPLRTTPSVAEQEGQLIETEATGAPQKHHHTLNQ

SEQ ID NO: 167862 - protein, 125 aa, Glycine max
  Coding DNA Sequence Number=SeqID_76177
MYIMYGPKYIMKHSQQNTISKETKPPTTLIPKKIPKLQNSLRVRLYHGFSLKACSELQNKERETRLKRAIKGINSRTHQQESSQGYCASNQWGKTHQMIMMMDGSNSHKGKIITFKLSFQNYHDM

SEQ ID NO: 167863 - protein, 161 aa, Glycine max
  Coding DNA Sequence Number=SeqID_76178
MASRKRKKRKVEIYHSEIDEFKAELERHNFLKRLTNLVKGSIDLALVKEFYANLYSSEDHPPKQSRVRGHLVKIDADSLNTFLETPVVLAEGETLPAYSRYCKLPTDYREIEVALCIPGRGFILNSEGHPGKILRKDLTTLAQVWSVLSYSNLAPHHTLLT

SEQ ID NO: 167864 - protein, 138 aa, Glycine max
  Coding DNA Sequence Number=SeqID_76179
MTNFLHKLCNLKNVSAITLRSGKQIEVPPPVAAPSPEPFKLHSTPEKEDELAAQKRKLPDHIGGPSSSSSNLQQPPIPLPFPPRVIPNKKMEEVDKEILETFRKVEVNIPLLDTIKANSKICQVSKRAVHPQKEVQGQ

SEQ ID NO: 167865 - protein, 155 aa, Glycine max
  Coding DNA Sequence Number=SeqID_76180
  Homolog annotation: Hit_ID=A8GHE6; Match level="QueryCoverage=100%, HitCoverage=100%, E-value=1e-49, Identity=67%"; Hit description =Putative uncharacterized protein
MSTSITMIVPIKNTVPGVSNVFSAPGHQGELLMAKPVNNQPEGGKAKKSEGANGNDEPANLNESRASARIKALNRQIQALQQKLVELKDSSADPKEIEKQKQLIEAQIKMLQAEIARIQKEEMEKQQQEQMEKAAAQAGDGVNRPTPLNAVDVYI

SEQ ID NO: 167866 - protein, 194 aa, Glycine max
  Coding DNA Sequence Number=SeqID_76181
GGVEPLLRRIGLAFGQIEVDRQLRVAFRQRRQQRQHIGFAEGWQAADAQRALRRFVQRAQLGAKAGDVRHQRGGARQQQLAGVGQQQATGGAHEQRGAERAFQSVDVAHQRGGHHAQPARSGGKAAQAGDVEKNWQMFYIAGVIHFCIICKSVSYEYPLLCRRRGGYSGCGLMTGFGAVPSRPHREKTHKPRGA

SEQ ID NO: 167867 - protein, 129 aa, Glycine max
  Coding DNA Sequence Number=SeqID_76182
MSDGFCGTHLQIMVRTRGLGRALGQVTRRGVGRGDHDDSDDAPQRQRPTASARRQRVAMTADHVDEPFIADPDVQDDPMEAPAAVEDIPADAGAEAAEDQPQRFPGGPSDPYVLTTYADHVACSVWRGE

SEQ ID NO: 167868 - protein, 153 aa, Glycine max
  Coding DNA Sequence Number=SeqID_76183
NCYVQQSQCKKDNGGGCGSLAQILRTKLCQPVSLDRLRIVFDTAIDGEGSGGRCGNQRGRGRVIGVKQRIIFAGEDARHRHQQGKAVVRIEKRRADGLRLLLLLIFFPAGRQFTAVEGDDVGLRYRHGKHHKAALLQQRFPGVHHQFQRCQRF

SEQ ID NO: 167869 - protein, 346 aa, Glycine max
  Coding DNA Sequence Number=SeqID_76184
  Homolog annotation: Hit_ID=UPI00016621D1; Match level="QueryCoverage =57%, HitCoverage=41%, E-value=9e-13, Identity=28%"; Hit description =UPI00016621D1 related cluster
LHALAFRGLHVLPFRGLHLLAFTERHVLTFEGLHAVTFIGPHALTFRELQVHAFRGLDVFALRSKGAHLKRATRPHLQRTTRPHLGYSYPYLQRTTRPHLHRATRPRHQRATRPHLGYSYPHLQRTTRVHALAFRGLHVLAFRGLHALAFMGLHILAFVGIPVLAFRGPHVLPFIGLHALTFSGLCVLTFRGLHPLTFRGLHPLAFVRLHALTFRGLHIFGFIWLHALCFLGLHALAFRGLHVLPFRGLHVLGFGGLHVLTFRGQHVLGFRELHVLTIRGLHDLIFRGLHVLVLRGSHAFAFVGLHTITLRGLHVLEFIGLHALSFRGLLVLQLRRLHLLTFRGLQ

SEQ ID NO: 167870 - protein, 120 aa, Glycine max
  Coding DNA Sequence Number=SeqID_76185
MHETKYGPPRQNRGGACHPARPGEQGCFLQKQQPSGGRIWKAQVAFEEVTETNGLRKNTSFRFLTRLGTSFIVQQRTPSISKRLTKGCMSSSNNPRTKLGYDTKETRQHVVHASINVSYL

SEQ ID NO: 167871 - protein, 152 aa, Glycine max
  Coding DNA Sequence Number=SeqID_76186
  Homolog annotation: Hit_ID=A4DID9; Match level="QueryCoverage=41%, HitCoverage=88%, E-value=7e-19, Identity=53%"; Hit description =Putative uncharacterized protein
GKEGLLLGGPEPSVRYHSGRARILTLCQDLRAEGQSQAEGSLTARPTRRAGTKVGLSDPTVPSGRAVAQRIKGWAVRPLKRYVSWVQNVVRQFGPYPDREGRTSGVPVIVPTVNAGASGSTAETAMGSLPQRGWSERSFIKLIDTVDLEGGP

SEQ ID NO: 167872 - protein, 258 aa, Glycine max
  Coding DNA Sequence Number=SeqID_76187
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSQTHPAHSFFCPPTPSFPLLGMGMAEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 167873 - protein, 44 aa, Glycine max
  Coding DNA Sequence Number=SeqID_76188
MGVQIAPRPIWALQKVPPEGGISQKFQPFFDVLHSFFIVLRSST

SEQ ID NO: 167874 - protein, 110 aa, Glycine max
  Coding DNA Sequence Number=SeqID_76189
MSLMNALKNGFKVLRICLSWPHPHPPSPSDRNCQILGIPTVLPNVGQVNDRAQAFKSKAIRVRTGVVGSSEGSKVASRNLSLGAAILPGWPLAFKMNPRPGMPKAVSIFL

SEQ ID NO: 167875 - protein, 163 aa, Glycine max
  Coding DNA Sequence Number=SeqID_76190
MVIDQSLFYDLTQLSSDGVPFEGALDDDWKFDFSVHDARRLVCTNQADMTGRLLAGSLALESRILHYLIVCILLPRSSNLAQVYEEDLIVMWAFHTGRQIDWAMCKALRLNAPLPYPHLVTLFLQHFNIPLDYEPYVPIKRSFLIGAAVVASFGYCKERDGSW

SEQ ID NO: 167876 - protein, 317 aa, Glycine max
  Coding DNA Sequence Number=SeqID_76191
  Homolog annotation: Hit_ID=Q2HTA0; Match level="QueryCoverage=58%, HitCoverage=36%, E-value=4e-14, Identity=29%"; Hit description=IMP dehydrogenase/GMP reductase, related
  Pfam annotation: Domain name=DUF1723; Domain location=17-70; Score =38.4; E_value=2.6e-08; Accession=PF08330.1; Description=Protein of unknown function (DUF1723)
LVTATGLSPLIACLVDTGDWGVISAFVERWHKETSSFHLPVGELTITLDDEAYLKSSERKLELRQHNVMRHTYAYRGYEIFIKADVRLDIELLQLVPICCTYTFRDLSQSGSYAWGATALVHMYDHLNDACKSGGQQLADNTRPRPTPLSCLLTTKAYSKALPASIYRKRIDGLMIPDVCWMPYGEHRGVREFDLISCFSGQLRWGPVVTIPPQTTGSRLSFEDIEDRWMHYSDYLAAARHICLVPGQYIPKVPVAPEAAPFDVEQPRHVVDACQAIAKRLECLLNLRIVTVGTKIHEVMEDCIKIARGVTTDGNVY

SEQ ID NO: 167877 - protein, 190 aa, Glycine max
  Coding DNA Sequence Number=SeqID_76192
  Subcellular localization annotation: CTP_CleavageSite=60; ConfidenceScore=5.70e-01
MAEPSKKRKGSSSTATAAAHRRHGPSGAPTAPIPPSLSSPRSSTLFSSDDQRLRMVLLCPEVHGTSMVIDQSLFFSLTHLPSQGAPFEGTIVDVWKFDYSSHDARRMVCNDQAEMTGRLLAGSLTFDNRIMHYIIVRILLPRSSNLAQASEEDLILMWAFLTGRQIDWAHLVRYRMHKALRAMHLFLIHI

SEQ ID NO: 167878 - protein, 450 aa, Glycine max
  Coding DNA Sequence Number=SeqID_76193
  Homolog annotation: Hit_ID=A2Q4S5; Match level="QueryCoverage=56%, HitCoverage=60%, E-value=3e-15, Identity=35%"; Hit description=IMP dehydrogenase/GMP reductase, putative
  Pfam annotation: Domain name=DUF1723; Domain location=124-173; Score =57.0; E_value=6.5e-14; Accession=PF08330.1; Description=Protein of unknown function (DUF1723)
MVRTRGLRRVVGTGRGRDLSQDVAEDVPRRRSPTASARRQRVTQRVEDVPQLAEDVPHASDADDDEGFPGGPRDPSVLIGFADHVAHNIWSDRKVDKFGRPVAEIEGMIAATGLDPFIRCSVITTDPGLISAFVERWHRETSSFHLPVGEVTITLDDVSSLLHIPIIGALHSFEPLATSNAVALLTELLEVTPDEATAETRQYWIYEHFQSVHRSVVDDGYAEASPRACRWLMGKAHMTGIKEAPYRARIDALTVTNVCWMSYAEHRGVRGYNLISSYTGQVRWGPIIVYLRPERVVRQMGYIQTVPPPPIRDSLTGTDIDDRWVHFSDHVAPTGKLCVVPGQVAPDYMEWFFQISHPFVTSTEDTTEPRPAPPPPTDDDFVEPPVTEVSVASDPLRILWMGRIVKHLERVINLRMVTAGTDLYDIMDLCLRIARMTTQMTILGRDRDPA

SEQ ID NO: 167879 - protein, 95 aa, Glycine max
  Coding DNA Sequence Number=SeqID_76194
MEVGLYEAHGSWLIGISIILRFSPSPATLDHKKLRFTVLTSAVDALTSSTIIALRGSFLAAPPQATSATSSTKKKKRHKEDAQAMKKTQEEEAGR

SEQ ID NO: 167880 - protein, 53 aa, Glycine max
  Coding DNA Sequence Number=SeqID_76195
MHNLNSCTSSMVALPNETTRKCTTTATCRDMEKSSEQAAATECQRRRRRSDLA

SEQ ID NO: 167881 - protein, 187 aa, Glycine max
  Coding DNA Sequence Number=SeqID_76196
  Gene Ontology: Mol. function=metal ion binding; Biological process =response to stress
  Homolog annotation: Hit_ID=A7P2X6; Match level="QueryCoverage=72%, HitCoverage=56%, E-value=9e-22, Identity=39%"; Hit description =Chromosome chr1 scaffold_5, whole genome shotgun sequence
  Pfam annotation: Domain name=zf-A20; Domain location=3-27; Score =37.0; E_value=6.8e-08; Accession=PF01754.7; Description=A20-like zinc finger
  Pfam annotation: Domain name=zf-AN1; Domain location=95-135; Score =62.0; E_value=2e-15; Accession=PF01428.7; Description=AN1-like Zinc finger
  Pfam module annotation: Pfam domain module=zf-A20::zf-AN1; Domain location=3-27::95-135
MVPSLCANGCGFYGSSATKNLCSKCYIDYLKENVTKSKECETKNLSDQVFVLDQSSATSCKPCASEVSNTDDATMVDVSLTDPEGIINNKRKKRCKCCNKKVGLLGFECRCGDVFCGTHRYPEKHACHVDLKEIGRQVDRQDVDIVLGSALTGPPRKHNKQPRMNDLMLWKSTQNHVWLQLIEGKIR

SEQ ID NO: 167882 - protein, 144 aa, Glycine max
  Coding DNA Sequence Number=SeqID_76197
WLRRGNQHIGNDDVRVFRRKLDIMKRHEFVWEPYTTTIISLLPPICVVGSVAWRKTKMFVDPQNANTATLVEVAETLQYMVSPQGRNTWTVDDLVPYVEKITILFEEQERITEPVSHGPASERQFPAPEFHILQSSVETQGIGR

SEQ ID NO: 167883 - protein, 228 aa, Glycine max
  Coding DNA Sequence Number=SeqID_76198
MVGDRGWWVYGRFVDVENLLCTIARPPPSTTCDGVVPRDMSWGSGDLGDVRRAPGSQQIKGTKTTKQGGLWLKKGTGRWWRPLIVMVAQLIHDRVEMECLEGAWETLEGNTRCRFRGTIRFTATSLVHPDEPAQTLQRTVEWILPTPTPYRLVEPVQVIKVTPSEEDPEEDLEELPPEPAVDALDFLEGDEDPLLEVDSPEEVMSASEADSTEDSGPREMATSGGSSS

SEQ ID NO: 167884 - protein, 88 aa, Glycine max
  Coding DNA Sequence Number=SeqID_76199
  Gene Ontology: Mol. function=histone-lysine N-methyltransferase activity; Cellular component=chromosome, pericentric region; Biological process=chromatin modification
  Homolog annotation: Hit_ID=A7PAZ7; Match level="QueryCoverage=90%, HitCoverage=27%, E-value=8e-21, Identity=60%"; Hit description =Chromosome chr16 scaffold_10, whole genome shotgun sequence
MPHYKGNKSRYINHSCCPNTEMQKWLTTNCFIHMMFVAIFDQDCHCGAAECRRKLGVRPTKPKLSSDATLKLVAYQVASSSRKNSRKK

SEQ ID NO: 167885 - protein, 514 aa, Glycine max
  Coding DNA Sequence Number=SeqID_76200
  Gene Ontology: Mol. function=nucleic acid binding; Cellular component= nucleus; Biological process=transcription
  Homolog annotation: Hit_ID=A5AKM6; Match level="QueryCoverage=84%, HitCoverage=90%, E-value=8e-88, Identity=43%"; Hit description =Putative uncharacterized protein
MSGVPKRSHEDSVHQSSKHPHQDSGTYSKLMPSVSNDHHIPYDMSQDSRVAKTVRTEPRDADRRSHLHTVYRMPLSSNDSHADHPIGPESRTESRDFKESREPRFENRDTKTEKKELHGEARRDSQIAKSEKDVRVDGRGDDNKDIRYEWDGHNDSKGDIKTDKDGYGMVSSSSHLNWKESKEYRGKRFSDAPGGSLDSWHTSRGNTPTEVGKDSSMAEERDYLETHEAVGENKIDSKSEDRFKERKRKDVKHRDWGDREKERSDRRSTTPVNNNSGDNKESAKEDRDVEKWERERKDLPKEKESSKEKEKDHSKRESLNGMEKDGLNDGKELCEEKNTELENVLPEQKKQKDVDSWKNVDGEVRERRKERDADLEGDRPDKRSKIDKQSEDGSAHGEGTGEKEREVHNYNVQHRKRIHRSRGSPQVANREARFRSHTQAPDNEENMDRHGNKNSVREEVEGSDRMHAVVRKIVVDRLGSWHHARKRDYEGSRWGEEGYCVVDLAPRVISKISL

SEQ ID NO: 167886 - protein, 92 aa, Glycine max
  Coding DNA Sequence Number=SeqID_76201
  Gene Ontology: Mol. function=histone-lysine N-methyltransferase activity; Cellular component=chromosome, pericentric region; Biological process=chromatin modification
  Homolog annotation: Hit_ID=A7PAZ7; Match level="QueryCoverage=80%, HitCoverage=21%, E-value=3e-17, Identity=59%"; Hit description =Chromosome chr16 scaffold_10, whole genome shotgun sequence
MEGIHSSFEGMHIPILKVYQNGGLQIGSSRVVDQPKCLHNCIGEVIRIKQLGNERFGIIKRFDKYSRKHSIMFEDGCVEIYDMSKEDWELVR

SEQ ID NO: 167887 - protein, 149 aa, Glycine max
  Coding DNA Sequence Number=SeqID_76202
  Gene Ontology: Mol. function=oxidoreductase activity, acting on single donors with incorporation of molecular oxygen, incorporation of two atoms of oxygen; Cellular component=cytoplasm; Biological process=aromatic compound metabolic process
  Homolog annotation: Hit_ID=A9PEK6; Match level="QueryCoverage=95%, HitCoverage=53%, E-value=1e-49, Identity=67%"; Hit description =Putative uncharacterized protein
  Pfam annotation: Domain name=LigB; Domain location=1-148; Score=17.2; E_value=1.8e-07; Accession=PF02900.9; Description=Catalytic LigB subunit of aromatic ring-opening dioxygenase
MEERRVSSKPISILVISAHCDTAVPSINVVDSVNHTIYDFYNFPEQMYQHKYPAPGAPQLARRVKELLIKSGFSRVDEDTKPGLDHGARVPLFLMYPEADIPVCQLSVQSQQDGTYHYNFGKALAPLKDESVLIIGSGSAILHLELPGL

SEQ ID NO: 167888 - protein, 214 aa, Glycine max
  Coding DNA Sequence Number=SeqID_76203
  Homolog annotation: Hit_ID=A5BEV8; Match level="QueryCoverage=34%, HitCoverage=9%, E-value=2e-07, Identity=42%"; Hit description =Putative uncharacterized protein
METISKRFQQLDVYGKIHLKSKLREIVYPDMNSMYPPLEKVKTKGAPKKPLAKQQKSTKRDPSYWEIVIIGEEHLHKELTSWSDQYMNLVGGIEKFEELRHFLLVDNLSKVTMDKWMNIMDMGYVIASQYNVIVVSLSLQHSMTFFPLRSVVMRPLSFTTSGVAMEYTLSFSGKAVAHSVHSVVMRPLSFTTSGVAMEYTLSFSGKAVAHSVHS

SEQ ID NO: 167889 - protein, 133 aa, Glycine max
  Coding DNA Sequence Number=SeqID_76204
  Gene Ontology: Mol. function=structural constituent of ribosome; Cellular component=ribonucleoprotein complex; Biological process =translation
  Homolog annotation: Hit_ID=A7P6K3; Match level="QueryCoverage=88%, HitCoverage=50%, E-value=3e-56, Identity=93%"; Hit description =Chromosome chr9 scaffold_7, whole genome shotgun sequence
  Pfam annotation: Domain name=Ribosomal_S3_C; Domain location=1-85; Score=92.7; E_value=1.1e-24; Accession=PF00189.11; Description =Ribosomal protein S3, C-terminal domain
MVPWCLMVVCTLRWACYGVLRFVMESGAKGCEVIVSGKLRAQRAKSMKFKDGYMISSGQPVKDYIDSAVRHVLLRQGVLGIKVKIMLDWDPKGKQGPKTPLPDLVTIHTPKEEEEYNRPPAVLANDIEVVPVA

SEQ ID NO: 167890 - protein, 343 aa, Glycine max
  Coding DNA Sequence Number=SeqID_76205
  Gene Ontology: Mol. function=magnesium ion binding; Cellular component=chloroplast; Biological process=photosynthesis, light harvesting
  Homolog annotation: Hit_ID=A5B523; Match level="QueryCoverage=84%, HitCoverage=95%, E-value=1e-120, Identity=76%"; Hit description =Putative uncharacterized protein
  Pfam annotation: Domain name=Chloroa_b-bind; Domain location=143-307; Score=253.5; E_value=4.4e-73; Accession=PF00504.12; Description =Chlorophyll A-B binding protein
  Subcellular localization annotation: CTP_CleavageSite=75; ConfidenceScore=5.25e-01
MLMNLTWHVHIHQNHAYSNLHSLTPPSFVQLAPHSPEASKAMASLAASTAAASLGMSEMLGNPINFSGATRPAPSASSPASFKTVALFSKKKATPTPPKKAAAAAPANDELAKWYGRQLIGCLEISGPDRRIFLPEGLLDRSEIPEYLTGEVPGDYGYDPFGLSKKPEDFAKYQAFELIHARWAMLGAAGFIIPEAFNKYGANCGPEAVWFKTGALLLDGGTLNYFGKPIPINLIVAVIAEIVLVGGAEYYRIINGLNFEDKLHPGGPFDPLGLANDPDQAALLKVKEIKNGRLAMFAMLGFYFQAYVTGEGPVENLAKHLSDPFGNNLLTVIAGSAERAPTL

SEQ ID NO: 167891 - protein, 107 aa, Glycine max
  Coding DNA Sequence Number=SeqID_76206
MEDWGNFLHRILEEDSEDFALIKTFFLVWRFGGKQWWLVAATGGRGWWRRRFHFLRLARQFTLSTTPSTLSLAQRTNSHSAQFPLGIQKEFEADPTINESGIAIFLK

SEQ ID NO: 167892 - protein, 113 aa, Glycine max
  Coding DNA Sequence Number=SeqID_76207
MLVERQTFDERDMLGAPSNIAEQFVFYRKNLLPEEQFVFYQKNLLPEKPSSGRTICVTGRTFFRKAFRKKVLPVEQFVHLEEGSSGSFSGRRFFRKNKLFYRKNLLPERFPEE

SEQ ID NO: 167893 - protein, 70 aa, Glycine max
  Coding DNA Sequence Number=SeqID_76208
MDDLTRWKIAEERSRPPESEKCTDDGDTYSCVVVCVVHACDDHISNVREEHMVKRSSRVFEDFVDMHTKM

SEQ ID NO: 167894 - protein, 155 aa, Glycine max
  Coding DNA Sequence Number=SeqID_76209
  Subcellular localization annotation: CTP_CleavageSite=71; ConfidenceScore=5.35e-01
MTMQNMQFQQETRASIQSLTNQMGQLATLLNQQQSQNFDRLPSQSVQNFKNLSAITLRSGKQCQGPQPATSSSSANEPTQLHSTPEKDDDKNLKSKSKEKQHIPLPFPPRAISIKKMEEIEKEILETFRKAESTGVVIHLANRSVAYPAGFIEMS

SEQ ID NO: 167895 - protein, 96 aa, Glycine max
  Coding DNA Sequence Number=SeqID_76210
MGSKIYPKVHENARAFFSSSSPNLLESSIQYPWGVKKRLNHEVLKVTIELSSSVRLSAHPLLSTALARLALSARLAVSLNPLTRAKREGGAKCNIA

SEQ ID NO: 167896 - protein, 99 aa, Glycine max
  Coding DNA Sequence Number=SeqID_76211
  Gene Ontology: Mol. function=aspartic-type endopeptidase activity; Biological process=RNA-dependent DNA replication
  Homolog annotation: Hit_ID=A5BVW2; Match level="QueryCoverage=76%, HitCoverage=15%, E-value=1e-10, Identity=37%"; Hit description =Putative uncharacterized protein
MSPYQVVFGMASYENSKFYKEKTKKFHDSLIAKKDFMVGQKFLLYNSRLGLVSVEIKSESTDKGFKVNGHRLKPFLTNPSLVDVVVEETSVLHPTSLPP

SEQ ID NO: 167897 - protein, 47 aa, Glycine max
  Coding DNA Sequence Number=SeqID_76212
MDERPCGPGMPPTRHPLDPDKFNRALGFPALITGLCQSFGVLVTPRK

SEQ ID NO: 167898 - protein, 120 aa, Glycine max
  Coding DNA Sequence Number=SeqID_76213
MPSPSEDYTFLPSEGYTPSPSEDYTSSPSESCTPSPSYDSTSAPSENSRDHTHKTPSGPGEVQQGPGVSSFDYGPLDCTRKIPSGPGEVQQGPGVFGSDYGPLLVLRSARRPQQGHQAPY

SEQ ID NO: 167899 - protein, 202 aa, Glycine max
  Coding DNA Sequence Number=SeqID_76214
  Gene Ontology: Biological process=transposition, DNA-mediated
  Homolog annotation: Hit_ID=Q1J7G7; Match level="QueryCoverage=18%, HitCoverage=67%, E-value=2e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLNSIRLECSGAIWAHCNLHLLGSSNSVPQPPEVSPCCPGWSRTPELREIKLIDTVDLEGGPVGKPVVPAALMNRPTRGERRFAYWALAECILAYYVGTDEGVSEVLHVAGEKRLH

SEQ ID NO: 167900 - protein, 392 aa, Glycine max
  Coding DNA Sequence Number=SeqID_76215
  Homolog annotation: Hit_ID=Q2HW90; Match level="QueryCoverage=52%, HitCoverage=38%, E-value=8e-18, Identity=32%"; Hit description =Putative uncharacterized protein
MPSWGEKTVSFLRVSSFLEQDCSCGWRFGKRDGSHEANSERRSGPASEILGRQGKGYGEPREVGPVCGYISFVDFWGVFFPNVDGLVDLAAIDAFLAYHHSKESPVVAILADLFDTFDRRCEKNSARIVCCLPALYVWVGFTPIPTRHKTPVSASKLSLMRRKRKSRLGPTFGWIGGNAINWFPRWKEGKEGVLFSCGDYPNVPLIGTRGCINYNPALAIRQLGYPMRGAPTEESLSPFLMRDLGAKSLKVIQRVHKAWRSPLKKDKELRGIRNGVIGGYHGWLRVHTRGLDWLSKLKVINEENFEAPEEDEEVQALKLELGKARLAKEKFKSAATHIQKECTELQEENAATVRALEQETKRARKEEYGREKFRGALWGSNNELKLRREERD

SEQ ID NO: 167901 - protein, 42 aa, Glycine max
  Coding DNA Sequence Number=SeqID_76216
MSTIVLGGFKDNWEVYFTYQRPLGTRENEGNSHSVGKILSKS

SEQ ID NO: 167902 - protein, 236 aa, Glycine max
  Coding DNA Sequence Number=SeqID_76217
MTTLTQTWMTLLLSNVLPSDHNSNLPLPKCQLVYAILTRMSVHVAQVIADAIYLFAGMPPTRHLLDLDKSNRALGFLALITSLCQSFGVPIAPSKVIRPPITRAFIEKYCTPRQAQRDAHQAADTPPPPRQADPTGSLGMERYLQHLVHQQAANHRGQVQIHECLYRFSLNQQGQGSAPFACPTLEQFGAEVAWPGDWPEAQAGEEPAGSPGEAKEACMDEDMTDLLDFLGGSRAT

SEQ ID NO: 167903 - protein, 161 aa, Glycine max
  Coding DNA Sequence Number=SeqID_76218
  Pfam annotation: Domain name=zf-CCHC; Domain location=61-78; Score =23.6; E_value=0.00041; Accession=PF00098.14; Description=Zinc knuckle
MELMRLHQHEENDNKRKGISLKASSFSIQEEKIQYVFEKQKKSKEIKHQSKEERRRSSLAPKCYKCDQHGHLRFDCRVFKRRVEKFDKRNFKEKKAYITWEDNDMDSSSDSENEIINLGLMVKDYESEEEVMSSNYDLSISFDELQDTFNDLHKESVIQEL

SEQ ID NO: 167904 - protein, 122 aa, Glycine max
  Coding DNA Sequence Number=SeqID_76219
  Homolog annotation: Hit_ID=A0PAV3; Match level="QueryCoverage=37%, HitCoverage=21%, E-value=5e-07, Identity=67%"; Hit description =Restriction endonuclease
  Subcellular localization annotation: CTP_CleavageSite=84; ConfidenceScore=5.10e-01
MVKVGTSYVPINVSFSPKVGPGLPGINRDTRIYLFCEHRRTSALASVAVPLRVTTTPAALNAPLQGASHSPFRLRNCWEGRSVRASSLLRQLAKGGCAARRLSWVTPGFSQSRRCKTTASEL

SEQ ID NO: 167905 - protein, 68 aa, Glycine max
  Coding DNA Sequence Number=SeqID_76220
MDGYNRDGICHCIKVYLKDRCPLPPLALLWSMNCQPLSKQWPTPYISRMKQCNSLKVLKRDYVDLNED

SEQ ID NO: 167906 - protein, 118 aa, Glycine max
  Coding DNA Sequence Number=SeqID_76221
MLVRMIRTRLFAAARVKSCPGMHSRCVIASLSGCARTVGRPPISGGVDMEHTENETRSPLKARACNPLQTEDVQSSDGEDISPLKVIGTSTQGHLYEKAEIDSSRGSVIPNPHDWILD

SEQ ID NO: 167907 - protein, 168 aa, Glycine max
  Coding DNA Sequence Number=SeqID_76222
  Homolog annotation: Hit_ID=Q0KIL1; Match level="QueryCoverage=63%, HitCoverage=11%, E-value=4e-08, Identity=34%"; Hit description =Gag/pol polyprotein, 3'-partial, putative
  Pfam annotation: Domain name=G-patch; Domain location=38-82; Score =28.5; E_value=2.4e-05; Accession=PF01585.14; Description=G-patch domain
MPYVEAAEVSLETTFQSFEVVSIASVDSFSGQPCLSDTTVMVAQVMLGNGYEPGMGLGKDNGDRTSLISARGNRGKFGLGYKPTQVDIRKSVAGRKNRGQGSLSQPTLRREGDAGAHGGVFHGRKMRGVATNVYSRKTSEKPEKAWELYLRTGMVLAPHASVTRDDSL

SEQ ID NO: 167908 - protein, 59 aa, Glycine max
  Coding DNA Sequence Number=SeqID_76223
MAPHRAQDLVFVHSNDIAGDDFGPLDDCGILEIASLSLDEPELDGVFFNDDDHLEGERP

SEQ ID NO: 167909 - protein, 67 aa, Glycine max
  Coding DNA Sequence Number=SeqID_76224
MVENLHEIAHRNVSEALRKRLGGKRGRWLPASSPRRAGLLPPEGTAFCWNILEGPSGLDCYLYTPVY

SEQ ID NO: 167910 - protein, 50 aa, Glycine max
  Coding DNA Sequence Number=SeqID_76225
MSRNFTDYLMMGVKYLEAVKRRLHATKQWSPDEIRKRRLKIVFFTLRTYL

SEQ ID NO: 167911 - protein, 63 aa, Glycine max
  Coding DNA Sequence Number=SeqID_76226
MREEPARTLQRTVEWILPTPTPYRLVEPVQVIEVSSSEEDPEEDPEELPPEPAVDALDLPEDD

SEQ ID NO: 167912 - protein, 176 aa, Glycine max
  Coding DNA Sequence Number=SeqID_76227
MGPGVGKLAAAQFTFNVGEEIANDTLAGQRQLLHRHTAVGEQAPGHTHAVFTAVAMDQADKLRVAERRKGDPLVVRQRLWRIRHAVMRQVGRRGAQHFAAARQPRGNPQRETGMFVEKTLQRRHQIVSGEFGGGGDAQLTDQFAAQCGDPLLATFGGVDHQQAIFIKAQSGFGQTQ

SEQ ID NO: 167913 - protein, 213 aa, Glycine max
  Coding DNA Sequence Number=SeqID_76228
MVVHRERRVQLREDEYTDFQEEIARRPWAPLVTPMAKFDPEIVLEFYANAWPTEEGVRDMRSWVKGQWIPFDVDALSQFLGDPLVLEEGFCPDRCREAGADHAHQHDHYDPDVDDTAAQQCMAPTKHPLDPDKSNRALGFPALITGLCHSFGVPVTPSKVIRPPITRAFIEKYCMPRQAQGDVHQATNAPPPPRKADPTGSLGMECNIPFFVS

SEQ ID NO: 167914 - protein, 211 aa, Glycine max
  Coding DNA Sequence Number=SeqID_76229
MGRVHEGSTVVHNTPLLPGQVKVSVEEVTDADAPVPVPTDEVSLVGQTLHTFLAWPTHLVKSLSQQVVVSPAKPPPKPDPEVDDPLYLMTLTIPELFLRPYQVTWDATVFGVFNLDFSLYIKHEDLSEIAHDGQCLSISVLQLWILHFTDTSMRAGNSDIYGFLEPQSIQRSGQSQFKSESQTTTLRGLLTGLDDAPQAKSKAPARWIVVK

SEQ ID NO: 167915 - protein, 49 aa, Glycine max
  Coding DNA Sequence Number=SeqID_76230
RCLLEWTFVFIFAMNLDVSLPPSLLEKQHSTLVIWEQLHRLTTIVTELI

SEQ ID NO: 167916 - protein, 81 aa, Glycine max
  Coding DNA Sequence Number=SeqID_76231
MPFGEALQQMPLYSKFLKDMLTRKHNPFAKHKPRAKRIFGHALSRESLALSTKPLHLRLIWFAKLAKAELSPFQFDLNWAK

SEQ ID NO: 167917 - protein, 45 aa, Glycine max
  Coding DNA Sequence Number=SeqID_76232
MGEVRRREGKGLMCFREGKVFFLEEEEKGGGLVCFGGVGGWGEEG

SEQ ID NO: 167918 - protein, 62 aa, Glycine max
  Coding DNA Sequence Number=SeqID_76233
  Subcellular localization annotation: CTP_CleavageSite=43; ConfidenceScore=5.74e-01
MADQLNRSPRYCGLFGSSASVARGSPMLTSSTSRRRAIFRPASTSNEPSMCGSLINPFQPTV

SEQ ID NO: 167919 - protein, 634 aa, Glycine max
  Coding DNA Sequence Number=SeqID_76234
  Gene Ontology: Mol. function=nucleic acid binding; Cellular component= nucleus; Biological process=meiosis
  Homolog annotation: Hit_ID=Q69NK8; Match level="QueryCoverage=99%, HitCoverage=97%, E-value=1e-174, Identity=51%"; Hit description=CwfJ / zinc finger(CCCH-type)-like protein
  Pfam annotation: Domain name=CwfJ_C_1; Domain location=387-501; Score= 126.9; E_value=6e-35; Accession=PF04677.6; Description=Protein similar to CwfJ C-terminus 1
  Pfam annotation: Domain name=CwfJ_C_2; Domain location=530-633; Score= 69.2; E_value=1.4e-17; Accession=PF04676.5; Description=Protein similar to CwfJ C-terminus 2
  Pfam annotation: Domain name=zf-CCCH; Domain location=325-351; Score =18.2; E_value=0.0054; Accession=PF00642.15; Description=Zinc finger C-x8-C-x5-C-x3-H type (and similar)
  Pfam annotation: Domain name=zf-CCCH; Domain location=359-383; Score =13.4; E_value=0.023; Accession=PF00642.15; Description=Zinc finger C- x8-C-x5-C-x3-H type (and similar)
  Pfam module annotation: Pfam domain module=CwfJ_C_1::CwfJ_C_2::zf -CCCH::zf-CCCH; Domain location=387-501::530-633::325-351::359-383
MAPRILLCGDVLGRLNQLFKRVSSVLSFPRVNKSAGPFDALLCVGQFFPDSPEQLEDFTKYIEGGSHFPLPTYFVGDYGVAAPKLLLQASKDSANQGFKMDGFKVCHNLYWLKGSGKFSLFGLSVAYLSGRKSSSAQQFGTYTEDDVDALRAIAEEPGIVDLFLTYPSIHVHYSPDSDIPAGLSDAAGGDSTVSELVQEIKPRYHIAGTKGIYYAREPYSNVDAVHVTRFIGLASVGNKDKQCCNILFASTFQKFIHAISPTPASTMSSTEIAMKTTNTTLSPYTYEEKRTSPMDSTKRSSDSISDPQYWRYDVSQKRQKHEAGHGDKLCFKFVSSGSCPRGEKCNFRHDTDAREQCMRGVCFDFLNKGKCERGPDCNFKHSLQDEGGRLPSRRPGSGSPNVESHLIISIGENYYLALAKGPLVEDHVLIIPVEHMPSTLSMSSESEIELSRFQNSLKSYCKSQEKEVIFFEWVSVRGTHANIQAIPIPSSKAIMAEKIFNLAAQKLGFEFVTKKWGVFDFLLHSYVVLLCNSVDSISEGRKFLKAQIDGDSSLFYAQIPGGTILLHHVEEKEKFPAQFGREIELTLVNMNQVLAGLLNMADNADWRNRKHSKDEEMKIVEVFKSRFQEYDPNC

SEQ ID NO: 167920 - protein, 485 aa, Glycine max
  Coding DNA Sequence Number=SeqID_76235
  Gene Ontology: Mol. function=cytokinin dehydrogenase activity; Cellular component=endoplasmic reticulum; Biological process =cytokinin metabolic process
  Homolog annotation: Hit_ID=A2Q544; Match level="QueryCoverage=97%, HitCoverage=93%, E-value=0.0, Identity=66%"; Hit description=FAD linked oxidase, N-terminal
  Pfam annotation: Domain name=Cytokin-bind; Domain location=224-484; Score=439.8; E_value=3.9e-129; Accession=PF09265.1; Description =Cytokinin dehydrogenase 1, FAD and cyto
  Pfam annotation: Domain name=FAD_binding_4; Domain location=41-192; Score=78.2; E_value=2.7e-20; Accession=PF01565.14; Description=FAD binding domain
  Pfam module annotation: Pfam domain module=Cytokin-bind::FAD_binding _4; Domain location=224-484::41-192
AQSRTWSFLQAPKEITLKLIRDPVTLSLASTDYGHIVHDNPFAIFAPSSISDISLLINFSNSLAIPITIAPRGQAHSIHGQAMTNDGVVVNMTELNGFRNGDGIIVVSDDTTATTIGPYADVGGEQIWIDVLHATLERGLTPLSWTDYLYLSVGGTLSNAGISGQTFRFGPQISNVHELDVVTGKGDLVTCSAENNSELFYAVLGGLGQFGIITRARIALGPAPTRANQEYLISVNGRNETNAADYVEGFLLLNQPPQDLSFYPEPDHPRITSLVTQYGIIYVIELVKYYDNSTQEHVDEDVNFWVEELKFVPTFMFEKDVSYEEFLNRVHADELFLRSQGLWDIPHPWLNLFVPASRISDFDEGVFKGIILQQNITAGLVIIYPMNRTKWDDNMSAVTPHDDVFYVVSFLHSTGFDKLEEFQAQNQQILQFCANAGIGIKQYLPQNKTQEEWEKQFGPKWKTFKERKAQFDPNSILSPGQGIFN

SEQ ID NO: 167921 - protein, 127 aa, Glycine max
  Coding DNA Sequence Number=SeqID_76236
MHKALRANAHLPYPQLVTLYLQDFNIPLDDESFVKVKCSFAIGAAVVASFGYRKDIDGQRVRKQDLPPTPNERTPSPPPQRNSSSSLLQDVLSELQGSGFCWGRDIRKVLMMSKTKIASNFNSRSRN

SEQ ID NO: 167922 - protein, 502 aa, Glycine max
  Coding DNA Sequence Number=SeqID_76237
  Gene Ontology: Mol. function=transcription regulator activity; Cellular component=nucleus; Biological process=regulation of transcription
  Homolog annotation: Hit_ID=A2Q1C5; Match level="QueryCoverage=64%, HitCoverage=87%, E-value=1e-61, Identity=46%"; Hit description=Helix- loop-helix DNA-binding
  Pfam annotation: Domain name=HLH; Domain location=304-353; Score =33.7; E_value=6.9e-07; Accession=PF00010.17; Description=Helix-loop -helix DNA-binding domain
MASSPSLKPPELIFFALWCNLLAALTLFFFDGYCDVTNNQPSSYLGSVAERLFHQYRALTFDVNHECVPGVAFRNQLPYIELQLLDLLRLTSTEIQTQFFQEARIEIAVFMGCKNGEIELGFSNISQVIKKTILPSSSFCFMSLSTGSPDQCSSSLLLSSIPGTSQSHFPQTLPTQTHQQQSIQEIDLAPVIPSYFPTPDGEHEAIVRALMSVMSPLSSSSSTSQQHQPRQILPNYTSIVHPGATAFNTYRSDTMNPNITPYMGSNFRRQSPQNRSFAFFTNLNLMRMRELVSQPASRPISTQHQQHHMITERRRREKLNESFQALRALLPPGTKKAKGTILTTAKDTMRSLMDEIEKINLRNQQLMAVLSAKETTVSATSTEENKAKPSSSSSNERLNVLVSAVLESSSLSEERMVDVQVTLRGESSRVDVLIRLLEFLERVQNVNLVSMYANNHIIGGTTINQLTFRLRIIEGNEWDEHALEEAVRRVVADTIQWKPLDQ

SEQ ID NO: 167923 - protein, 183 aa, Glycine max
  Coding DNA Sequence Number=SeqID_76238
  Gene Ontology: Mol. function=protein binding
  Homolog annotation: Hit_ID=A7PE48; Match level="QueryCoverage=68%, HitCoverage=34%, E-value=2e-41, Identity=65%"; Hit description =Chromosome chr11 scaffold_13, whole genome shotgun sequence
MCRKFVPYYNLASGYQQFLCTSVFGSDCPLYVHSLLSFRGPWGALSPVPENNAIAVNTQGGSVFAASGDSCAYCWDVETGKVKMVFKGHMDYLHCIVARNSSNQAYLPYLLDCKSGKCTQVIDPARDLKLKGSASWVGCVALDASESWLHRGGVGPGRNRGLHNGTVQCRGCSGRDSAAILFY

SEQ ID NO: 167924 - protein, 388 aa, Glycine max
  Coding DNA Sequence Number=SeqID_76239
  Gene Ontology: Mol. function=nucleoside-triphosphatase activity; Cellular component=cytoplasm; Biological process=DNA metabolic process
  Homolog annotation: Hit_ID=A7PE62; Match level="QueryCoverage=86%, HitCoverage=99%, E-value=4e-74, Identity=45%"; Hit description =Chromosome chr11 scaffold_13, whole genome shotgun sequence
  Pfam annotation: Domain name=RecA; Domain location=54-354; Score =316.1; E_value=6.5e-92; Accession=PF00154.12; Description=recA bacterial DNA recombination prot
MEERSELGKSGRELGLKNGFELDNIFHFYIPKGRRRSKSDGSDSDEENMSKKELALQQALDQITSAFGNGSIMWLGRSVSPKSLPVVSTGSFALDVALGHVVEIYGPEASVKTILALHVIAEAQKQGGYCVFVDAEHALDKKLAESIGVNTTNLLLSQPDCGEQALSLVDTLIRSGSVDVIVVDSVKTSVLDYNITSREDENEIGNVGVEHCSGKGAFLSMDLGVAALVPKGELDGEMGHAHMAMQARLMSQALRKLSHCLVTFSIQVLVKVVKNKLVPPFKIAEFELQFGKGISKETEIIDLSVKNKLISKAGAMFYYNEQSFRGKDALKNFLAENQSALEELEMKLREKLLNAETEKMWDVINGDVREAIATVDSTDEEAAAIVEA

SEQ ID NO: 167925 - protein, 1295 aa, Glycine max
  Coding DNA Sequence Number=SeqID_76240
  Homolog annotation: Hit_ID=A7PE35; Match level="QueryCoverage=98%, HitCoverage=98%, E-value=0.0, Identity=53%"; Hit description =Chromosome chr11 scaffold_13, whole genome shotgun sequence
  Subcellular localization annotation: CTP_CleavageSite=28; ConfidenceScore=5.47e-01
MATSSKFDPSSSSPDKPLYPGQRGSHIAASLDRSGSFRESMENPILSSLPNMLRSSSLATNGDVESFFNYVRFDPKLLTLEHKSNRQMDFKRHVNAALGISPDESPSSSSKGKLLPSPVPEDMKRVKDALGANIVKARERVKMFSEALSVFHEVFPAITSKKRSRAEGFSNDRSNVMLSDRPVLGPSIGKVGVQGHPVTGGFELEQQKSDERTKNVVPNKRTRTSMVDVRMDVRTNSLVRPSGTVDRDKEKLRIANNGVVQSEERTLPIGGDGWEKSKMKKKRSCIKLDVSPSTTLTKPVNTFQETKQGMQQRLATDSRSKLTNDSHSFRPVVSNGTVGAGKSDGISQQTGLGIRASTPRNNQDNNSLVNDRRGRPVSSDKERVNFRAVNKATARDEFNSASPTSSAKINTAIRAPRSGSGVAPKLSPVVHRAGVSNDWELSHSTTKPPAAGGTNNRKRVASARSSSPPVVPWQRPQKSSRTARRTNFMPIVPNSDEASALDTASDVAGNDLGLGFARRLAGSSPQQIKQKGDPSSSAALSESEESGVADVKPKEKGRKAEEIDQKSGQNVQKVSNMVLPTRKNKLVSGEEHGDGVRRQGRTGRSLAATRSMIPMTSEKLGNIGTAKQLRSARLGSDKNESKAGRPPSRKLSDRKAYARQKPAINAAADFFVGSEDGHEELLAAVKGVINSAHAFSSPFWRQMEPFFSLITEEDITYWKQKVNLESSTLTPTPVPSNIDGCETIVNGYGLMGCERDAGFDAQWNAGIVAEQSQLSKGDHNVIPLCQRLIAALISEEECSGGSEHFKFDAYDNEFEPDREPELNGLDHHSGTDFQFACHSAYNGFRILDKPEQDETERDIVGIPPTGLNSSFDKSVNGFLHDKAMSSFTCSELQYDSLDINDKLLLELKSIGISPAPVPDMLQTDDEGISEDIIRLEELYLGQISKKKNLLYGLFESASVDKELQEKDFEQRALDKLVVMAYEKYMACWGPSPSGGKNTSNKMAKQAALGFVKRTLGRCHQFEDTGKSCFSDPLFKDMFLAESSKPYASSLSVEARTASMGSQQSPSQFSQNMDNHDLNSSDVLPGLNYSSEQTSGKEDLWSNRVKKRELSLDDVGGTPGISSAPGIGSSVTSSAKGKRSERDRDGKGHSREVLSRNGTTKVGRPASSSAKGDRKSKTKPKQKATQNSVSVNGLLGKLTEQPKPALPSVPKSNEMPTNSNAKEKDEFGLGGLDDHEPIDLSNLQLPGMDVLGVGDDQGQDLGSWLNIDDDGLQDHDDFMGGLEIPMDDLSDLNMMV

SEQ ID NO: 167926 - protein, 536 aa, Glycine max
  Coding DNA Sequence Number=SeqID_76241
  Gene Ontology: Mol. function=protein serine/threonine phosphatase activity; Cellular component=protein serine/threonine phosphatase complex; Biological process=protein amino acid dephosphorylation
  Homolog annotation: Hit_ID=A4Q9A0; Match level="QueryCoverage=99%, HitCoverage=99%, E-value=1e-118, Identity=46%"; Hit description =Abscisic insensitive 1B
  Pfam annotation: Domain name=PP2C; Domain location=212-519; Score =265.5; E_value=1.1e-76; Accession=PF00481.12; Description=Protein phosphatase 2C
MEEISSSVAVPFTLGVGNLIQKESAVTTHMEITGLKLMANTAAAALMLNPAVECLKENQVGAALVSEMVIECESNWVLNEGLNQARKEDELMLAVDFQCLHSSSSQSVANGKSDPCREEAALWKSSFSEIDSPIIIKVDDDVDGKSGISKLCPSTKLVEDTVCFAMDITNEDQSGSDESDPRPSAVLLDQLPGENKTWRTSNPNALKLNSGPLWGCSSICGMRQEMEDAISVRPQLFQVSSQMLINDHVNENGKQSLAHFFAVYDGHGGLQVANYCQERLHSTLIEEIETAQSSSAETNGRDDWQDQWKKAFINCFQKMDDEVGGIGASNKGNNSGGSESNIETVAPETAGSTAAVAILSQTHIIVANCGDSRTVLYRGKEAMPLSSDHKPNREDERARIEAAGGRVIHWKGYRVLGVLAMSRSIGDRYLKPWIIPEPEVNIVRREKNDQCLILASDGLWDVMTNEEACEVAKKRILLWHKKYGDNGTTGRSEGADPAAQSAAEYLTKLAIHRGSQDNISVIVIDLKAQRKIKRKP

SEQ ID NO: 167927 - protein, 239 aa, Glycine max
  Coding DNA Sequence Number=SeqID_76242
  Gene Ontology: Cellular component=endoplasmic reticulum
  Homolog annotation: Hit_ID=Q9FJB4; Match level="QueryCoverage=78%, HitCoverage=48%, E-value=7e-70, Identity=72%"; Hit description =Arabidopsis thaliana genomic DNA, chromosome 5, P1 clone:MOK9
MSDTEDHAASEYSNGDESPPKPRQRFRDRSKEMLSKQAVQTKQMLSKQAVKIAKQAEEHERFINKVTHLVGVLGFGGFCFLLGARPQDIPYVYCLFYVIFVPLRWIYYRFKKWHYYLLDFCYYANTIFLVDLLFYSSNEKLFMVCFSFAELLQGPLAWALIVWRCSLVFSSVDKIVSVLIHLLPAKVAVNDHYNEASSSLIMQHSNLLFGLMIIPAVLLSYISNSANLSDFYSILELPF

SEQ ID NO: 167928 - protein, 177 aa, Glycine max
  Coding DNA Sequence Number=SeqID_76243
  Homolog annotation: Hit_ID=A7PE22; Match level="QueryCoverage=100%, HitCoverage=26%, E-value=5e-15, Identity=36%"; Hit description =Chromosome chr11 scaffold_13, whole genome shotgun sequence
MLNEDEPSNIIAQSLGGICALQGNKGGLRIQSGMLNEDEPSNIIAQSLGGICALQGNKWGEKDSSSDGVDGIIGLSLTLDEWMRLDCGEIDDDIDNIGEHTSKLLAAHHIMQKIDWLVSEAGNNNDECEIVAKVELKANKEDKSSEEEEEAIPQFRITEVHVAGLKTEPHKKKVWGT

SEQ ID NO: 167929 - protein, 365 aa, Glycine max
  Coding DNA Sequence Number=SeqID_76244
  Gene Ontology: Mol. function=metal ion binding
  Homolog annotation: Hit_ID=A7PE06; Match level="QueryCoverage=69%, HitCoverage=54%, E-value=6e-97, Identity=68%"; Hit description =Chromosome chr11 scaffold_13, whole genome shotgun sequence
  Pfam annotation: Domain name=DZC; Domain location=136-171; Score =81.6; E_value=2.5e-21; Accession=PF08381.2; Description=Disease resistancezinc fingerchromo
MLTCIARPKKPDESDPNNATSAAKSQAVKSLTSQGYGAEGFGSVQALRTVHGASDAGAISEQHHRVGRGFGPVPVVVPENGEFELDDDKDVGEGDGGAAEGDFERGGDAELRQREAGGAGGAVEPGVLITFVSLPRGGNDLKRIRFSREMFNKWQAQRWWAENYDKVMELYNVQRFNRQAFPLPTPPRSEDESSKLESAEESPVTPPLNRERLPRNMYRPTGMGMGYSSSDSFDHQSMQSRHFYDSNGMNSTPKVSTISAAKTEISSMDASIRSSSSREADRSGDFSISNASDLETEWVEQDEPGVYITIRALPGGARELKRVSQWNLFLGVLMCYTAEKNLGRCMLDYGGKRTVPEYMNNTCEL

SEQ ID NO: 167930 - protein, 103 aa, Glycine max
  Coding DNA Sequence Number=SeqID_76245
MKVEGIGSVRMKFHDGAIRTFSNVREMTSQGYKYVGSKWGCKVYKGRHLILQRHKNKGNLCYLDEQVLKRNHNRKMKKKMKFSNVVEVLGDTLVGRRVSSLSN

SEQ ID NO: 167931 - protein, 27 aa, Glycine max
  Coding DNA Sequence Number=SeqID_76246
MVMQGSVGEKRLGFMELSNLFPYCSDR

SEQ ID NO: 167932 - protein, 190 aa, Glycine max
  Coding DNA Sequence Number=SeqID_76247
  Homolog annotation: Hit_ID=Q9M0S0; Match level="QueryCoverage=82%, HitCoverage=72%, E-value=8e-48, Identity=55%"; Hit description =Putative uncharacterized protein AT4g09070
  Pfam annotation: Domain name=TATA_RF; Domain location=1-189; Score =119.4; E_value=1.1e-32; Accession=PF08612.2; Description=TATA -binding related factor (TRF)
MPIRCILHWQPNQGSVVNSQVLNEISQCVESLNGVKEGRCKASLTFYRPNLRDQSVTIDFPRDFLGISMLEQPNKYYLIIRGQKIVLEADSSILLIMEKLQSYKSKVALHFEGVLYKLGDFQIRVIKVVPSQAESLRGIMIEIKINCMKTLKRMGEWGIVTFLASQSRNCDVCCSCDNSFCGSLTAMESQ

SEQ ID NO: 167933 - protein, 382 aa, Glycine max
  Coding DNA Sequence Number=SeqID_76248
  Gene Ontology: Mol. function=protein binding
  Homolog annotation: Hit_ID=A7PB60; Match level="QueryCoverage=95%, HitCoverage=78%, E-value=8e-53, Identity=36%"; Hit description =Chromosome chr16 scaffold_10, whole genome shotgun sequence
  Pfam annotation: Domain name=QLQ; Domain location=11-47; Score=66.6; E_value=8.4e-17; Accession=PF08880.2; Description=QLQ
  Pfam annotation: Domain name=WRC; Domain location=78-123; Score=97.9; E_value=3.2e-26; Accession=PF08879.1; Description=WRC
  Pfam module annotation: Pfam domain module=QLQ::WRC; Domain location =11-47::78-123
MNGRNVNTNRFPFTPSQWQELEHQALIYKYMASGISIPPDLLFTIKRTTHLDSSRLLPHHPQHFGWNYLPMGLGRKIDPEPGRCRRTDGKKWRCSKEAYPDSKYCERHMHRGKNRSRKPVEVLKTTPTTAAVATNTDASTPTTILSITKNSPAHALSPTTHSLSHDTYHHHHHHPHPQQHSSHSFLYHHSSRPSSGAALSFQDNSAPLFLDTASCSQNNNNTDCRYVYGLKEEVDEHAFFTEPSGTMRSFSASSMEDSWQLTPLTISSSSSSKQRNCSGLSNDNNEYSYLQLQSLNGNNSKQPQQDQGCYISGSDVKCETFMKLGKEEPQKTVHRFFDEWPPKSRGSWLDLDDKSSTTQLSISIPTSTHDFATFNSTTQRDG

SEQ ID NO: 167934 - protein, 345 aa, Glycine max
  Coding DNA Sequence Number=SeqID_76249
  Gene Ontology: Mol. function=N-acetyltransferase activity; Biological process=metabolic process
  Homolog annotation: Hit_ID=A7PDX5; Match level="QueryCoverage=59%, HitCoverage=84%, E-value=8e-56, Identity=53%"; Hit description =Chromosome chr11 scaffold_13, whole genome shotgun sequence
MSLLKSPRDPKEAKVLVRLECGALMAMCMLQCVVLMLSCAVHSCWVKDYEELEAEKAASARKRSRRIAEVQEESMANATKMAEIKAKELDEKMKSNADICIIVFFICSPFVGVGCLGSLWVWPLNLNVVSHSRTIDTDFLTKKKKQVSVQLPSLTSPVSTVRFCDLNFGRLQPSDDELDPHNRFEFGNFVARQALLHEEYWTAAWLRAEEWASRTHKLYDTEFDAIKKRCKEQQDGQSSTCIITVRKQDKNVKRSIISSVVGTLDLNIRYLRLGETFPGEPVDAPRFCKIERTPSSRYGYIANLCVAKSVRRKGIASNMLYFAVESAKSSGNMNINVRVTFTTNV

SEQ ID NO: 167935 - protein, 39 aa, Glycine max
  Coding DNA Sequence Number=SeqID_76250
MKPQRRDPKRPRSNVGGGGSGKKGTYDGVLIDLDPLVSM

SEQ ID NO: 167936 - protein, 361 aa, Glycine max
  Coding DNA Sequence Number=SeqID_76251
  Gene Ontology: Mol. function=hydrolase activity, acting on glycosyl bonds; Cellular component=cellulose and pectin-containing cell wall; Biological process=cell wall organization and biogenesis
  Homolog annotation: Hit_ID=A7PDT4; Match level="QueryCoverage=99%, HitCoverage=69%, E-value=1e-176, Identity=81%"; Hit description =Chromosome chr11 scaffold_13, whole genome shotgun sequence
  Pfam annotation: Domain name=Glyco_hydro_28; Domain location=5-333; Score=13.6; E_value=7.9e-10; Accession=PF00295.8; Description =Glycosyl hydrolases family 28
MPPLPSYGYGREHPGPRYGSLIHGQHLKDVVITGHNGTINGQGQTWWKKYRQKRLNHTRGPLVQIMFSSDIVITNITLRDSPFWTLHPYDCKNITIKGVTILAPVFGAPNTDGIDPGDLCEVSDFWEVLQACGLRDSCEDMLIEDCYISVGDDAIAIKSGWDQYGIAYGRPSMNIMIRNLVVRSMVSAGISIGSEMSGGVSNVMVENILIWDSRRGVRIKTARGRGAYVRQITYRNITFENVRVGIVMKTDYNEHPDDGYDPMALPILRDISFTTVHGQGVRVPVRIHGSEEIPVRNVTFQDMSVGLTYKKKHIFQCAFVQGRVIGTIYPAPCENLDRYNEQGQLVKHSASQNVTDIDYDI

SEQ ID NO: 167937 - protein, 373 aa, Glycine max
  Coding DNA Sequence Number=SeqID_76252
MGTPSQIQEQSRCWPLPTITRRGEILRHGRPNWVTKVGCTKLWVLPSSTSNTTRWLAIIPTIRKALSARWPENELRLLWAWNGSGSFDGSGGGSVGSILGSEVKHNPRSRREVISSGVRCFIIGGGVAEGLGARGVEVDEVQRLQGEHERGWVARGVREAVGDCGCRQSSPPEAWPDRRLGRGLEMKQLSRKGDGGPIIRFARSSNSERNPGHEVNWALLDIHWNQASALPSMRGFWLRRGKRGRAVKKFIKFKVHGLHGVGEASEDGFQVARRCLVGTRHSIKGNESTNVMNLADLEEYYVTNSVMAASPQIRSISRRIVEDRLLLCLYCPPLKLLCSYHNAPADWLAKHGASNADTFSLLADSSGPSIARP

SEQ ID NO: 167938 - protein, 690 aa, Glycine max
  Coding DNA Sequence Number=SeqID_76253
  Gene Ontology: Biological process=intracellular signaling cascade
  Homolog annotation: Hit_ID=A8MQ97; Match level="QueryCoverage=84%, HitCoverage=100%, E-value=1e-169, Identity=52%"; Hit description =Uncharacterized protein At5g20680.2
  Pfam annotation: Domain name=DUF231; Domain location=533-690; Score =146.6; E_value=6.8e-41; Accession=PF03005.6; Description=Arabidopsis proteins of unknown function
MQTPIACWDNWVGEALETLYSLRPICLRNSQPREFGADDGAFQVFDEMQQRDRSSVEVEIAETTFSRWMHDTPVLSRSEFECTGGGGGGSGNYLLGNRDDQTNKNTGLRMKVGFNGLRGKEISLISIVLMSVTIILWSWEKMPGLSAFLPPQTPPLQLPSDHLASRRSDQVLEPDPHLGEDGSPLAKAKTANEAEELRLKGASWTVPAQSSSGKNMGEEGSSLATEKIFNETEELNLEGASRTVPAQSSFGKNMSESNTKTTSYTEQILSSVPDDEAKHKRILEGEKNHDVQTFSSPTSSGAKRNEAEGEKSLRQEENKHRNDFVTKSPQIISLTGGKDNNWNNATENKVCNYAKGKWVPDNNRPLYSGFGCKQWLSGMWACRLMQRTDFEYEKLRWQPKDCQMEEFEGSKFLRRMQNKTLAFVGDSLGRQQFQSLMCMITGGKDKLEVEDVGREYGLVIAEGSARPSGWAFRFSSTNTTILYYWSASLCDVEPIDVNNPNTDYAMHLDRPPAFLRQYIHKFNVLVLNTGHHWNRGKLTANRWVMHVGGVPNTDKKIAVIWGAKNLTIHSVVSWANSQLPKYPGLKVFYRSISPRHFVGGDWNTGGSCDNTKPMSVGKEILGEESIDEGAASAVKGTGVKLLDITALSQLRDEGHISRFSLTAKPGVQDCLHWCLPGVPDTWNEILFAQI

SEQ ID NO: 167939 - protein, 107 aa, Glycine max
  Coding DNA Sequence Number=SeqID_76254
MIRQVVERRDNHEHRVRGEEPLEDESANNLSLRSEKGHDEGIRDHRQRTMVEEGCRFGEDIEAAMESDGGDSGTDGCERRLMKSDVGDGSETGYNTQVNVLSAAEAS

SEQ ID NO: 167940 - protein, 1428 aa, Glycine max
  Coding DNA Sequence Number=SeqID_76255
  Gene Ontology: Mol. function=binding; Cellular component=integral to membrane; Biological process=regulation of transcription, DNA -dependent
  Homolog annotation: Hit_ID=A7R0A8; Match level="QueryCoverage=73%, HitCoverage=98%, E-value=0.0, Identity=56%"; Hit description =Chromosome undetermined scaffold_301, whole genome shotgun sequence
  Pfam annotation: Domain name=NUC173; Domain location=373-571; Score =261.5; E_value=1.8e-75; Accession=PF08161.3; Description=NUC173 domain
MEGIEMEEAAFGIDESNDDLCSSILSRFANSTDETHHHLCAVVGAMSQELKDNNQPSTPFAYFCAARVSLDKFTSEPNPPSHVIDALLTILSLALPRVPLVLLKKQNLQGEPFSELLSRVLLSPSASESAIVSGLKCLSRLLITRESVDWSDVSPLFYVLLGFLTDSRPKGVTSLLERFILLVGGANANAGEGAKEAQQILYILDALKECLPFLSRKSKTSILNYFKYLLDLHQPLVTRRITDGLSFLCHYPTSEVHPEALLELLNSLARSIESNKMSGDRLTFTARLLDAGMNKVYSLNRQICVVKLPIVFNALKDILASEHEEAIYAATDAFKNMINSCIDESLIKQGVDQISLSENKESRKSAPTIIEKICATIESLLDYHYTALWDRVFQIVSAMFHKLGNHSPYFMRGILKNMEDVQKLPDEDFPFRKQLHECFGSALVAMGPETLLSLIPLNLEAEDSSDANVWLFPILKHYIVGAPLNYFTEEILTMIKHAKEKAQKLEKQGLMVSSRNADALAYSLWSLLPSFCNYPSDTTKSFMNLEKHLRRKLKEEPDIRGIICTSLQLLIQQNNIVDSKDKGYIGEDMAKEQVPVHYSQQVARDNLYVLKSSAKHWLEDLSEVFLKSTKDDGGCLQRTIGDVASIADKADVRKLFQEKMLKLYKCTRKASKAGSSKSSHFMQIDDASNNLSLTILRAQLLDLAVSLLPGLDAEDIALLFEAIKPALQDAEGVMQKKAYKVLSIILRSSSNGFVSSKFEELRQTMVEILPCHFSAKRHRLDCLYFLIVHVSKSKDNMEHWRDIFLTEIILALKEANKKTRNRAYDILVEIARAFADEESGGNRESLNNFFQMVAGHFTGETPHMISAAAKGLARLAYEFSDLVLTSFKLLPGTLTLLRSDNKEIIKANLGFLKVLVAKSQAEGLQMHLKSMVEGLLKWQDNSRNHFKAKVKLLLGMLVTKCGLEAVKAVMPEEHMKLLSNIRKIKERKERNRSAKSEEARSHFSKATTSRQSMWNHTKIFSDFDGDSGNSDAEYMISRGSKASLHPKSAASSFRSNIRLKKNLPEHLSDQSDDEPLDLLDRQKTRSALKMSEHLKRKSRLDDEVELDSEGRLIIHEEVEWRKEKHADEDFDSRSERDSHISAKSGTKAQKKRKTSDSGWAYTGKEYASKKAGGDVKRKDKLEPYAYWPLDRKMMSRRPQQRAAARKGMASVVKMTKKLEGKSASGIGPLEGKALVRLDDIDALATASDYVTVSGGWDMPRLVRELPSHICDVPPAVSRDDDVPVWKHSTDGVFKVASDYKQNNRDPLFLAIWKSAMIFVRNLLFEIVSFAHKVWDTCGGVLRDHLGNVVLACAYNLGVCSISHAELWAILIGLKINWARGFTNLREWVLSTAASKEFTSNDAVYSGEHIFREANQVADTLARYGIVYS

SEQ ID NO: 167941 - protein, 225 aa, Glycine max
  Coding DNA Sequence Number=SeqID_76256
  Homolog annotation: Hit_ID=Q9M250; Match level="QueryCoverage=63%, HitCoverage=87%, E-value=3e-22, Identity=38%"; Hit description =Putative uncharacterized protein F7M19_120
MNGVSPLEAQAFNYLSFGFLTLLNNFWTWLAFTFWRTRAPTSELLPPPDDPVRDESDPVAVTGPSPTVVDVDGARKGKFTLYYEDESERECESHQETTALTERDGRGLKWWESWEELLKIRRGEDQNGWYTCQDLTVLNGSVVRLWDGGFGFGTSPQNPGTLQDVFLYGLVETHRFGCRKREGTLVTGGGRAVEPIGGAVRGKELGHDRAGSARTLQQVVPAPVV

SEQ ID NO: 167942 - protein, 259 aa, Glycine max
  Coding DNA Sequence Number=SeqID_76257
  Gene Ontology: Mol. function=protein binding; Cellular component =nucleus; Biological process=auxin mediated signaling pathway
  Homolog annotation: Hit_ID=Q8H6T6; Match level="QueryCoverage=57%, HitCoverage=94%, E-value=5e-70, Identity=85%"; Hit description=Auxin- regulated protein
  Pfam annotation: Domain name=Auxin_inducible; Domain location=44-142; Score=112.6; E_value=1.2e-30; Accession=PF02519.5; Description=Auxin responsive protein
  Pfam annotation: Domain name=Nep1; Domain location=135-241; Score= -28.2; E_value=3.4e-05; Accession=PF03587.5; Description=Nep1 ribosome biogenesis protein
  Pfam module annotation: Pfam domain module=Auxin_inducible::Nep1; Domain location=44-142::135-241
MEDAGGSKLHGIKQIVRLKEMFQKWQTVTLGSKDSNNHSDVTHHHGVLSPMINKRLTDIVYCDSDEDGCYSPQPPHDVPKGYLAVYVGPQLRRFIIPTSYLSHSLFKALLEKAAEEFGFDQSGGLTIPCEIETFKYLLNCIENHDDSSTELLQKFSIKSKGGHGKLLRLIQNPVTDHSPINSCKVGLSFSSQKTVQLRDYVSDANCNENLVFVVGAMAHGKIDADYIDDLISEYEGRVYNSTLVGKSQDFGPVMQNMIT

SEQ ID NO: 167943 - protein, 700 aa, Glycine max
  Coding DNA Sequence Number=SeqID_76258
  Gene Ontology: Mol. function=carboxylesterase activity; Cellular component=integral to membrane
  Homolog annotation: Hit_ID=A7PDR1; Match level="QueryCoverage=51%, HitCoverage=67%, E-value=1e-110, Identity=59%"; Hit description =Chromosome chr11 scaffold_13, whole genome shotgun sequence
VRLRTNGCNGWPSPPSMSLNLQRVPKFRKGNCKKAVEGNVVDGDGIGSGGGDGEGRRVGMLVPKGREGVVVVVVVLEGRVEGGNDGLGVVAFQGFESQFEVQGFAFVARHGEEKERERENGGSHFLLKINNSLPLPSPAPFENLFHSLITHFPSVNSLNLITPALGFASGVALSSSSSSSSRSNNYSSVSDIGEWLLFASPTPFNRFVLLRCPSISLEGGEDPSARLVREERHYVRGGRIQVRRGRERERELEELGYQRVCVSAADGGVVSLDWPDNLHLEEERGLDTTLLLVPGTPQGSMNANVRLFVVEALNRGFFPVVMNPRGCAASPLTTPRGTATLPFHLPFSTNQPKDYLLLCLLPFSSFSNPAADSDDICTAITYINNARPWTTLMGVGWGYGANMLTKYLAEVGERTPLTAVTCIDNPFDLDEATRSSPYHIVTDQKLTDGLIDILQTNKALFQGKTKGFDVEKALMAKSVRDFEEAISMTILLGSPLPHSLSDSSPQDILSAYSPTIDIRSIPYEWILVTKELVLGHLKRQNNKQKQAKGSKPGFRKDSLRITMNIQYGDLGKASLMLEGFIALLTSSPDLFCARLDAISDVHSRIGFSPGSRCEERGCPKRTGPLPQHSAKTFDSPAAGFVFTFKLEQNIGYNLTLPASDLVGFQSTVYGCLLWVQLSRLGWLEAFLVDEAGIALSAANL

SEQ ID NO: 167944 - protein, 1033 aa, Glycine max
  Coding DNA Sequence Number=SeqID_76259
  Gene Ontology: Mol. function=microtubule motor activity; Cellular component=microtubule associated complex; Biological process =microtubule-based movement
  Homolog annotation: Hit_ID=A7PDQ7; Match level="QueryCoverage=98%, HitCoverage=98%, E-value=0.0, Identity=61%"; Hit description =Chromosome chr11 scaffold_13, whole genome shotgun sequence
  Pfam annotation: Domain name=Kinesin; Domain location=40-394; Score =443.6; E_value=2.6e-130; Accession=PF00225.14; Description=Kinesin motor domain
  Subcellular localization annotation: CTP_CleavageSite=31; ConfidenceScore=5.13e-01
MTGTPVAVAAATPRSKIQRNASGTPGGPKVREEKIRVTVRMRPLNTKEQAMYDLIAWDCLDEHTIVFKNPNQERPTTPYTFDKVFAPTCSTHKVYEEGAKDVALSALSGINATIFAYGQTSSGKTFTMRGVTESAIKDIYDYIKNTPERDFILRISALEIYNETVIDLLKRESGPLRLLDDPEKGTIVEKLNEEVAEDRQHLRRLIGICEAQRQVGETALNDKSSRSHQIIRLTVESSLRESSGHVKSYIASLNFVDLAGSERISQTNTCGARMKEGSHINRSLLTLASVIRKLRFKSLKQSLYLQGDKTAYIYPFNISLGRSLMHQATLFVQTENGGKCGHIPYRDSKLTRILQSSLGGNARTAIICTISPSLSHVEQTRNTLAFATSAKEVINTARVNMVVSNKTLVRQLQKEVARLEGELRSPDLSVNSCLRSLLAEKELKIQQMERDMEDLRRQRDLAQTQLDLERRVNKVPKGSNDCGPSSQIVRCLSFPEENKSANGKRTPERREAVGRQAMLKNLLASPDPSILVGEIRKLEDRQLQLCEDANRALEVLHQDFATHKLGNQETAETMSKVLSEIKDLVAASSTPEEIVAADKADLMEKITQLKNQGNTIASLERKLENVQKSIDKLVSAFNAEETPENKTTPLRRKKILPFTLSNSPNMQHIIRAPCSPLSSSRKAMEHDIENRAPENNIGISGSDSFAKFHKDTPRKDDKSCDSILSRAGSPATRKSKSVNVMKIQKMFKNAAEENIRSFRVYVTELKELVAKLHYQKQLLVCQVLELEANKSLNEEKDTPDRSPLPWHILFDQQRKQIIMLWHLCHISLVHRTQFFLLLGGDPSDQIYMEVELRRLTRLEQHLAELGNASPALLGDEPAGSVSARYARVFERHVSFLTIPASPALLGVFDNSLNQVSLIKLVYLKNSIRALKQEREHLARKVNTKLTAEERELLYAKWEVPPVGKQRRLQFVNKLWTDPYNMQHVQESAEIVAKLIDFSVSDENSKDMIELNFSSPFNKKTWAGWNFISNLLNL

SEQ ID NO: 167945 - protein, 70 aa, Glycine max
  Coding DNA Sequence Number=SeqID_76260
MKMVNHEALRKSVSPHWTSMHAAKGDVKLVVANIQELELVLCNIGGVKLNGIVFLETSHYVQSLVLPYPI

SEQ ID NO: 167946 - protein, 2377 aa, Glycine max
  Coding DNA Sequence Number=SeqID_76261
  Gene Ontology: Mol. function=phosphatidylinositol phosphate kinase activity; Cellular component=mitochondrion; Biological process =phosphatidylinositol metabolic process
  Homolog annotation: Hit_ID=A7PDP8; Match level="QueryCoverage=92%, HitCoverage=99%, E-value=0.0, Identity=58%"; Hit description =Chromosome chr11 scaffold_13, whole genome shotgun sequence
  Pfam annotation: Domain name=Cpn60_TCP1; Domain location=915-1300; Score=-279.2; E_value=0.095; Accession=PF00118.15; Description=TCP -1cpn60 chaperonin family
  Pfam annotation: Domain name=DUF500; Domain location=350-539; Score =164.3; E_value=3.3e-46; Accession=PF04366.3; Description=Family of unknown function (DUF500)
  Pfam annotation: Domain name=FYVE; Domain location=169-237; Score =87.2; E_value=5.2e-23; Accession=PF01363.12; Description=FYVE zinc finger
  Pfam annotation: Domain name=FYVE; Domain location=566-638; Score =67.4; E_value=4.7e-17; Accession=PF01363.12; Description=FYVE zinc finger
  Pfam annotation: Domain name=PIP5K; Domain location=2108-2343; Score =183.5; E_value=5.5e-52; Accession=PF01504.9; Description =Phosphatidylinositol-4-phosphate 5-Kinase
  Pfam module annotation: Pfam domain module=Cpn60_TCP1::DUF500::FYVE::F YVE::PIP5K; Domain location=915-1300::350-539::169-237::566-638::2108- 2343
MASSDGRVTYSSLSKLEKENTHFGYDDINHHVESVWSELMPGTPCGQLVPTLSNKETLYQFPSEDDDLFDGGYESGDDARGIVPSNRPPEVNLKNVLSGIFAILSGRTKAPSVTANQQLPSSNVSFFDSGKNGDVFLDSSVYTPSAPPLCLPNGIDYSSYKEVLEAEPPEWLPDSSTTVCMQCSAPFTAITRGRHHCRFCGGIFCRTCTKGRCLMPVGFRERNPQRVCDACYDRLDPLQGVLINTISNAVQGAKHDVTDWTCARGWINLPIGLSMEHEIYKASNTLRNYCQVAKSNPEKSIPLTVLKSAKGLAILTVAKAGALVSYKLGTGLVVARRSDGSWSAPSAIFSLGLGWGAQIGGELMDFIVVLRDMKAVKTFCSRMHFSLGAGCSAAAGPVGRVLEADIRAGDRGSGMCYTYSCSKGDDQKLGRLSKVLEYCCLDFSSQGWCYDRYLGIMECLSLTSSSMGCIANDMECCQTVGAFVGVSLEGNIVATRMDANLCFYGDPYLTTSDILLGMVDRPKAAQPLAWVESQSMGTPDKKISDFVDVVRSWIPRRAEPLNVSRDFWMPDQSCRVCYECDSQFTIFNRRHHCRICGRVFCAKCTANSVPVPSDEANTGREDWERIRVCNYCFKQWEQVTTVDNNGSADPSATPCLSPSPSTTSLVSTKSSCTCHSSSSTAGSVPYTTGPYQRVPYSPHQSSQMNQITDDQENLNSGRSTNPSEAVGNVPSNQFGHCFSSHLCPHISDADESIPIKSDDEDDDYGVYHSDTESRHYSHAHDYDDPVNIHGVDHVYGPHQMHPDEDNIQEKNLSCLTQAQNLDPEGVGGIQVPGKEDDEHDHADGCETSPYHEESNYAEPVDFESNGLLWIPPEPEDEEDDREAVLYDDDEDEGTTGGGEWGYLRSSTSFGSGECRSRDKTSEDHRKAMKTVVERHFRALVAQLLQVENLNTCDEDGKESWLDIITALSWEAATLLKPDTSRGGGMDPGGYVKAGEWQSALSAPYDCRSGRSLYNMVVKGVVCKKNVAHRRMTAKIDKPRFLILGGALEYQRVSNQLSSVDTLLQQEMDHLKMAVARIDAHHPNVLLVEKSVSRYAQEYLLAKDISLVLNIKKPLLERIARCTGAQIVPSIDHLTSQKLGYCETFHVDKFFEEHGSAGQGGKKSTKTLMFFEGCPKPLGCTGANGDELKKVKHVIQYGIFAAYHLALETSFLADEGASPLEFPLKSPITVALPDKPSSIVRSISTIPGFSVLTARESQGAKAFKEEPQSNDIYKTERSPSSCCESTERSLVGDSIHMHEVSGGITQSAQDMPSSNCNSFLSNTSSKEDDKKCPMEFFQYRLDERRETMLNNDLISDSFGTFESSQQDGNSHLRAAALSAYQGANPEPPYIKHDTNNYNNNNNHDDMIHSKEDFPPSTSDHQSILVFLSTRVWKGTVCERSHLVRIKYYGSSDKPLGRFLRDQLLDPSYTCCSCELPSEAHVHCYTHQQGSLTISVKKSEFALPGEREGKIWMWHRCLKCPRIHGFPRATRRVVMSDAAWGLSFGKFLELSFSNHAAASRVASCGHSLHRDCLRFYGFGKMVACFRYASIHLHSVYLPPPKLEFNYDSQDWLQKEANELHNKAEILFSEVCNVLHQISEKVSGPVLQEGGNRVSDFRNLVAELKGMLLYEKEEFEDSLQRLLHKEGKVGQPVIDILELNKLCRHIHIHSYVWDQRLIYASNLSKIILQENLKSLNHREKLLGSREKVIEADVATRPARGHSSCDSFLLGTKPDGNLNLENTSHLSHPVVKSEDKGKDTNHDKVDLSLSGGANINDKSDSVEFGGAVRRALSEGESPFVANLSDTLDAAWTGEGHPTNLSLKENGCLPPDAAAVAVHSPVANIVTSKSNSDIYSANIGGIEAGCTNYSKLLSKGLDTKWKGIPFANVFGSFNKTSSFNTEKLVEYNPVHILSFRELERQTGARLLLPASTNDTIVPVYDDEPTSVIAYVLVSMDYHMQMLEYDRPKESGDSSISLPLFDSTSLLSLNSFDETITNTYRSLGSFDENVLPTSGSRSLPAGDPFSYTKDLHARVSFTDDGSLGKVKYTVTCYYAKRFEALRRTCCPSELDFVRSLSRCKKWGAQGGKSNVFFAKTLDDRFIIKQVTKTELESFTKFAPAYFKYLSESISTGSPTCLAKILGIYQVTSKHLKGGKETKMDVLVMENLLYRRNIRRLYDLKGSSRSRYNPDTSGSNKVLLDQNLIEAMPTSPIFVGNKAKRLLERAVWNDTAFLASIYVMDYSLLVGVDEEKHELVLGIIDFMRQYTWDKHLETWVKTSGILGGPKNTSPTVISPQQYKKRFRKAMSLYFLMVPDQWSPPELHPTAVDLCPLSNGGAPPVTRDC

SEQ ID NO: 167947 - protein, 610 aa, Glycine max
  Coding DNA Sequence Number=SeqID_76262
  Gene Ontology: Mol. function=protein transporter activity; Cellular component=cis-Golgi network; Biological process=intracellular protein transport
  Homolog annotation: Hit_ID=Q9FX37; Match level="QueryCoverage=61%, HitCoverage=54%, E-value=1e-154, Identity=69%"; Hit description =Putative uncharacterized protein T9L24.37
  Pfam annotation: Domain name=Sec34; Domain location=108-216; Score= -0.7; E_value=4.3e-05; Accession=PF04136.6; Description=Sec34-like family
  Subcellular localization annotation: CTP_CleavageSite=12; ConfidenceScore=5.07e-01
MGSRGPPQSHPNSAAISKGYNFASTWEQNAPLTEQQQSAIVSLSHAVSERPLPRKLAQENASVQDNALSVKTKDSSFDDSGAIETVMVNTNQFYKWFTDLESAMKSETEEKYQHYVNTLTDRIQTCDEILQQVDDTLDLFNELQLQHQAVATKTKTLHDACDRLLQEKQRLIDFAEALRSKLNYFDELENSRALGMMRSHVLAVLKGASSQVQEAIRGSGGGKASISEGVEASVIYVRFKAAASELKPLLEEIESRSSRKEYGQILAECHRLYCEQRLTLIRGIVQRRISEFAKKESLPSLTRSGCAYLIQKKHSYIQIVFDKHSRRSESLAGLRPTFERILADVHERLTFRARTHIRDEIANYIPTNEDLDYPEKLKKSAESTSEINPFQVGTRAGSDRRPPPPYAVVSGGFFRRDQGSDRLEKRDPPLELAPPSEAPRAASSSRVFRCVQLTRRRAGVGSCPFRSRQLRRRLLGAFQASPPSSGKLFGQLLCVFLSCVLGFALWFLGQGHHDHLEKTSDSVSDDKRSEWEKLDYQLCAVLRQSVEPDILEILRSFKSCRSFWKKAQEIFANDIQSLFDATMKVTGLKQTSHDMIAHVGKARAAVEELR

SEQ ID NO: 167948 - protein, 816 aa, Glycine max
  Coding DNA Sequence Number=SeqID_76263
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A7PDN5; Match level="QueryCoverage=59%, HitCoverage=97%, E-value=0.0, Identity=67%"; Hit description =Chromosome chr11 scaffold_13, whole genome shotgun sequence
  Pfam annotation: Domain name=Glyco_hydro_17; Domain location=28-347; Score=274.8; E_value=1.8e-79; Accession=PF00332.9; Description =Glycosyl hydrolases family 17
  Pfam annotation: Domain name=X8; Domain location=365-451; Score =124.8; E_value=2.6e-34; Accession=PF07983.4; Description=X8 domain
  Pfam module annotation: Pfam domain module=Glyco_hydro_17::X8; Domain location=28-347::365-451
MGLQHFTTCVLLALCILSQGLAKGAHGFACNWGTRLTHPLPPQITVKLMKDNGFKQVKLFEADPAALKALGNSGIQVMVGIPNDLLATLASNVDAAIAWVNQNVSSYISKNGVDIRYVAVGNEAFLKTYNGRFVNSTFPAIQNIQAALIKAGLGRQVKVTTPLNADVYQSDSSLPSGGNFRPDIHDQMISIIKFLSQNGGPLTFNIYPFLSLDADPHFPKEFAFFDGSAAPVVDGSITYTNVFDANYDTLISALEKNGFGQMPVIIGEVGWPTDGTANANIKNARRFNQGLIDRIVKRQGSPKRPSPPDIYLFGFIDEDAKSIEPGPFERHWGVFNFDGSIKYPLNLGGGKQLVGAKGVRYLPKQWCVMSTQANVDPNALAESMSKACTYADCTSLSPGSSCSGLDTRGNASYAFNMYYQAMNQQKGACNFNGLSVITNINPSPPQSSCQFKIMIDLGKHEKKSTSSSVAPERKLHSMVMLVSSFIFTVIKAFSQYPSLSFSDRGSYLSFPFLRNLVYANVFGVSRSIGFGTRGCSFDTSGSCSGNSDRIFVRAKTRSRGFASNRRQPMLADLEQRNSVRSDESDATLVKVDNGSINGSPAKPPCFSDHRLSQKLVVAVDVDEALNKFIADRYSSNYSVSEYHVYEFCKVLFVCFGNSLSSASADIRVHEFFKTPYFKSGIHPLPGAQMALQKLSRFCSLSVVTSRQNAIKDRTIEWIEKNYPGLFREIHFGNHFALDGVSRPKSEICRSLKAKVLIDDNPRYAIECADVGIRVLLFDYENSYPWCKNESVDQHPLVTKVKNWEEVEQQLVSLIAS

SEQ ID NO: 167949 - protein, 813 aa, Glycine max
  Coding DNA Sequence Number=SeqID_76264
  Gene Ontology: Mol. function=solute:hydrogen antiporter activity; Cellular component=integral to membrane; Biological process =regulation of pH
  Homolog annotation: Hit_ID=A7NW19; Match level="QueryCoverage=96%, HitCoverage=98%, E-value=0.0, Identity=67%"; Hit description =Chromosome chr5 scaffold_2, whole genome shotgun sequence
  Pfam annotation: Domain name=C4dic_mal_tran; Domain location=204-426; Score=-85.9; E_value=0.049; Accession=PF03595.8; Description=C4 -dicarboxylate transportermalic acid transport protein
  Pfam annotation: Domain name=Na_H_Exchanger; Domain location=38-426; Score=281.9; E_value=1.2e-81; Accession=PF00999.12; Description =Sodiumhydrogen exchanger family
  Pfam annotation: Domain name=TspO_MBR; Domain location=200-346; Score= -56.8; E_value=0.066; Accession=PF03073.6; Description=TspOMBR family
  Pfam module annotation: Pfam domain module=C4dic_mal_tran::Na_H _Exchanger::TspO_MBR; Domain location=204-426::38-426::200-346
MATANNASCPAFMKATSNGAFQHENPLDYALPLLILQICLVVVFTRVIAFLCRPLRQPRVIAEIIGGILLGPSAIGRNEKFLSTVFPKKSITVLDTLGNVGLLFFLFLVGLELDMRAIRRTGHKALAIALCGITVPFVLGIGTSFALRATVSKGAEPVSFLVFMGVALSITAFPVLARILAELKLLTTDVGRIAMSAAAVNDVAAWILLALAIAISGSNGSPFVPLWVLLSGVAFVIFAVFAIRPLLVAMANRSPEGEPVKEVYICITLTLVLACSFVTDTIGIHALFGAFVIGTIMPKEGSFSVVMIEKIEDLVSGLFLPLFFVSSGLKTNVATISGGLSWAMLVLVIFNACFGKIVGTIVVSLTCKVPSQEAVALGFLMNTKGLVELIVLNIGKDRKVLNDQAFAICVLMALFTTFITTPIVMAVYKPARRGAPYKHRTIQRRDPDTELRMLACFHTTRNIPTLINLIESSRGIRKRGKLCIYAMHLMELSERSSAITMVHKARKNGMPFWNKKPDDKDQMIIAFQAYEKLRSVNVRPMTAISALNSIHEDICTSAHQKRAAMIILPFHKHQRVDGSMESLGHSLHVMNQLVLSHAPCSVGILVDRGLGGTSQVQASDVSYKVVVPFFGGRDDREALCYGMRMAEHPGILLNVVKFVPPPGASLAFGAKLVGMSSNKDKKAMEVVGGSYYDDKQQDDQLWSEFLSACNNNQESMKYEQKLVASKGDIEAALKEMNRSNLILVGRMPSVGPLVSRSDCPELGPVGSYMASSDFSTVTSVMVIQQYNPSTDIHPLVMEEFDYPDKLEPNAPRS

SEQ ID NO: 167950 - protein, 188 aa, Glycine max
  Coding DNA Sequence Number=SeqID_76265
  Gene Ontology: Cellular component=cellulose and pectin-containing cell wall
  Homolog annotation: Hit_ID=A7NW14; Match level="QueryCoverage=99%, HitCoverage=56%, E-value=3e-50, Identity=51%"; Hit description =Chromosome chr5 scaffold_2, whole genome shotgun sequence
  Pfam annotation: Domain name=PAE; Domain location=26-188; Score=42.6; E_value=1.6e-18; Accession=PF03283.4; Description=Pectinacetylesterase
MKLLRMFLFVGLVIVKWVEGFEDANVTDLDMQYVSGRGFYRPLMVGFTLINGAAAKGAVCLDGSLPGYHFHRGYGSGSNSWLIQLECLSKTLVYLALFIWVDGECGRTNTEVIVAPQGAGLYFRGQRIWQAAMEDLMSKGMRYAKQALLSGCSAGGLATIIHCDEFRELFTRTTRVKCLSDAGLFLDS

SEQ ID NO: 167951 - protein, 138 aa, Glycine max
  Coding DNA Sequence Number=SeqID_76266
  Homolog annotation: Hit_ID=A5B7G4; Match level="QueryCoverage=76%, HitCoverage=43%, E-value=1e-39, Identity=67%"; Hit description =Putative uncharacterized protein
  Pfam annotation: Domain name=Self-incomp_S1; Domain location=30-137; Score=105.7; E_value=1.4e-28; Accession=PF05938.2; Description=Plant self-incompatibility protein S1
MGGLAKKITHHLVTLVLVIVLCTTIVEGTKHVSIKNRLGSGRNMTLHCQSKDNDLGKQNIAYGDEFGWDFSDNVAGTTLFFCDLGWENVEEFHFDAYSFARDRVRCGDAGCSWLVSIEGIYGLNGQTGYWEFMYQWPN

SEQ ID NO: 167952 - protein, 203 aa, Glycine max
  Coding DNA Sequence Number=SeqID_76267
  Gene Ontology: Mol. function=protein binding; Cellular component =nuclear chromosome; Biological process=regulation of transcription, DNA-dependent
  Homolog annotation: Hit_ID=A5X538; Match level="QueryCoverage=94%, HitCoverage=86%, E-value=3e-94, Identity=84%"; Hit description=SNF5
  Pfam annotation: Domain name=SNF5; Domain location=1-192; Score=8.8; E_value=5.3e-10; Accession=PF04855.3; Description=SNF5  SMARCB1  INI1
MKTPISGFYRNPVKFRMPTAENLVPIRLDIEIEGQRYKDAFTWNPSDPDSEVVVFAKRTVKDLKLPPAFVTQIAQSIQSQLSEFRSYEGQDMYAGEKIVPIKDLNNFESDPEEFARIFCKDTGIEDPEVGPAIAFAIREQLYEIAIQSVVSARESRMSKKGRRGAEYTPVSKGGAAAVDLVKLFGPKSSVVRLWNSLIHKPQD

SEQ ID NO: 167953 - protein, 193 aa, Glycine max
  Coding DNA Sequence Number=SeqID_76268
  Gene Ontology: Mol. function=hydrolase activity; Cellular component =cytoplasm; Biological process=purine base metabolic process
  Homolog annotation: Hit_ID=O65755; Match level="QueryCoverage=93%, HitCoverage=97%, E-value=5e-84, Identity=85%"; Hit description =Putative deoxycytidylate deaminase
  Pfam annotation: Domain name=dCMP_cyt_deam_1; Domain location=35-137; Score=141.0; E_value=3.4e-39; Accession=PF00383.13; Description =Cytidine and deoxycytidylate deaminas
MECPILFRSKREVVETKDGTVSVAAAFAGHQEAVQDRDHKFLSKAVEEAYKGVDCKDGGPFGAVIVHNDEIVASCHNMVLCNTDPTAHAEVTAIREACKKLKQIELADCEIYASCEPCPMCFGAIHLSRIKRLVYGAKAEAAIAIGFDDFIADALRGTGFYQKATLEIKRADGNEAIIAEEVFEKTKEKFQMY

SEQ ID NO: 167954 - protein, 95 aa, Glycine max
  Coding DNA Sequence Number=SeqID_76269
MDKIWFRGEVLSFMCDEGHHDTDNCDLTRQHPVFTVAAGVMRSGVVSENPDFVIGFEGWSDLGLRFGFLICVVNAHDGCGLKKRMNKNNIKILAF

SEQ ID NO: 167955 - protein, 327 aa, Glycine max
  Coding DNA Sequence Number=SeqID_76270
  Gene Ontology: Mol. function=diacylglycerol O-acyltransferase activity
  Homolog annotation: Hit_ID=Q2KP14; Match level="QueryCoverage=96%, HitCoverage=98%, E-value=3e-32, Identity=34%"; Hit description =Soluble diacylglycerol acyltransferase
MEISGSVLRQLSYVSGYGTPTRSRGVASRVGLRMGTGSGFCDEGHLQYYQDTKKILTPKKLKLLKGFSKLGLASDPEKLAMFHDLQQNLTSDAGEVLLRELEAARAKEKEMKKKRKQEIKAKLKASKMNCESSSSSSSESSDSDGDCDQVVDMNCFRAGAGVVVPAPVEESPLPKTPIVEDTNAKAHRDAMALCSKNDISVSSVRDCIKSESAVVTAAPQKRIEVCMGTKCKRSGAAALMQEFERVVGVEGGAVVSCKCMGKCKTAPNVKVQNSVDHSLARGLDDSVNIPANPLCIGVGLGDVDAIVARFLGESHTDIGMIGAATAT

SEQ ID NO: 167956 - protein, 51 aa, Glycine max
  Coding DNA Sequence Number=SeqID_76271
MIGRLVRVMLFCENAPIMWDRHKFKEAFKPSVFTPKAYTPKSPSGPLPPDS

SEQ ID NO: 167957 - protein, 751 aa, Glycine max
  Coding DNA Sequence Number=SeqID_76272
  Gene Ontology: Mol. function=ATPase activity, coupled to transmembrane movement of substances; Cellular component=integral to membrane; Biological process=transport
  Homolog annotation: Hit_ID=A7Q0Z8; Match level="QueryCoverage=93%, HitCoverage=94%, E-value=0.0, Identity=53%"; Hit description =Chromosome chr7 scaffold_42, whole genome shotgun sequence
  Pfam annotation: Domain name=ABC_membrane; Domain location=206-456; Score=144.3; E_value=3.4e-40; Accession=PF00664.14; Description=ABC transporter transmembrane region
  Pfam annotation: Domain name=ABC_tran; Domain location=1-86; Score =11.2; E_value=9e-08; Accession=PF00005.18; Description=ABC transporter
  Pfam annotation: Domain name=ABC_tran; Domain location=531-689; Score= 151.8; E_value=1.8e-42; Accession=PF00005.18; Description=ABC transporter
  Pfam annotation: Domain name=SMC_N; Domain location=416-692; Score= -119.3; E_value=0.0073; Accession=PF02463.10; Description=RecFRecNSMC N terminal domain
  Pfam module annotation: Pfam domain module=ABC_membrane::ABC _tran::ABC_tran::SMC_N; Domain location=206-456::1-86::531-689::416 -692
GLDTMVGEHGAQLSGGQKQRVAIARAILKDPRILLLDEATSALDAESEKIVQEALNRIMINRTTVIVAHRLSTIRNADSIAVMHQGKIVERGSHAELTRDPIGAYSQLIRLQEVKRSGQNVANETDKLEGTAHFGRQSSQRSFLQAISQRSSEVGSSGRNSFSESHAVGFLEPAGGVPQTSPTVSSPPEVPLYRLAYLNKPETPVLLAGSIAAIINGVLLPIVAIFMSKMISIFYEPADELRKDSKLWALLFVVLGVVSFIMPPCRFYLFGVAGAEHSSGAIGARLSSDVAAVRALVGDALGLLVQNIATAVGGLVIAFEASWQLALIMLALAPLLVLNGYVQFKFLKGFSANSKKLYEEASQVANDAVGSIRTVASFCSEKKVMKLYQEKCEGPIRTGIRRGIISGISYGVSFFMLYAVYACSFYAGARLIEDGKSTFSDVFRVFFALSMTAMGISQSGSLVPDSSNSKSAAASVFAILDQKSQIDPSDDSGLTLEEVKGEIEFNHVSFKYPTRPDVQIFRDLSLTIHSGKTVALVGESGSGKSTVISLLQRFYDLDSEPVLFNDTIRANIAYGKGGDATEAEIIAAAELANAHNFTCSLQKGYDTIVGERGIQLSGGQKQRVAIARAIVKNPKILLLDEATSALDAESEKVVQDALDRVMVDRTTIVVAHRLSTIKGADLIAVVKNGVIAEKGKHEALLNKGAPHLALSAFRSCAGRAMHAGPVLLLDRALGAGRLAGLSARNGFHLRA

SEQ ID NO: 167958 - protein, 264 aa, Glycine max
  Coding DNA Sequence Number=SeqID_76273
  Gene Ontology: Mol. function=tRNA-pseudouridine synthase activity; Cellular component=cytoplasm; Biological process=pseudouridine synthesis
  Homolog annotation: Hit_ID=A7NVZ5; Match level="QueryCoverage=99%, HitCoverage=86%, E-value=1e-117, Identity=77%"; Hit description =Pseudouridylate synthase
  Pfam annotation: Domain name=PseudoU_synth_1; Domain location=1-87; Score=51.4; E_value=3.1e-12; Accession=PF01416.11; Description=tRNA pseudouridine synthase
  Pfam annotation: Domain name=PseudoU_synth_1; Domain location=126 -233; Score=101.9; E_value=1.9e-27; Accession=PF01416.11; Description= tRNA pseudouridine synthase
  Pfam module annotation: Pfam domain module=PseudoU_synth_1::PseudoU _synth_1; Domain location=1-87::126-233
ESPPTVQCTVEKALTQATKLQRKDLCLVGASRTDAGVHAWGQVAHFFTPFNYDNLEQLHAALNGLLPTDIRIREISPASAEFHARFSAKSKIYHYKIYNDAIMDPFQRHFAYHSVYKLNSAVMREAATYFVGKHDFSAFANASHNDRVPDPVKHVFRFDLKEMGALLQLEVEGSGFLYRQVRNMVALLLQIGREAIPPDIVPHILASRDRKELAKYSLPAPPHGLCLVSINYNESHLLPPPESPPANSFGRHQTIRKCKVPFFL

SEQ ID NO: 167959 - protein, 56 aa, Glycine max
  Coding DNA Sequence Number=SeqID_76274
MVPHEDTLDSCPSHSVVPRTDPSSSSSSHDPDSGWPIVFRKGMFVRHLLTLDGDKP

SEQ ID NO: 167960 - protein, 111 aa, Glycine max
  Coding DNA Sequence Number=SeqID_76275
MEDINKHIGDNLRYSTFVEVNVQQKETANMEQKEVASEYFVTQVHLSFSGAILFFYYATGREQQVGKFRESSSSRKDKYPTEIIPKRIVLDIDKAKIQCITGTMIIFTFCW

SEQ ID NO: 167961 - protein, 52 aa, Glycine max
  Coding DNA Sequence Number=SeqID_76276
MGKTHEIPHHNLADFEPCLRYATEGQAFGGKIPPIMEGKGKVGSSRGKAQGH

SEQ ID NO: 167962 - protein, 110 aa, Glycine max
  Coding DNA Sequence Number=SeqID_76277
MSTQRLLRVATSTCFQLFGPTLEGSEEEGLGTAISRLLHPNARFRGKRVGQMGFCFGLEMEGKKEGPWRWWILALAGTERGIQPRFSADWRTTTKKLKILDMARNQNCLF

SEQ ID NO: 167963 - protein, 172 aa, Glycine max
  Coding DNA Sequence Number=SeqID_76278
  Gene Ontology: Mol. function=nucleic acid binding; Cellular component= intracellular; Biological process=regulation of transcription
  Homolog annotation: Hit_ID=A5ASK9; Match level="QueryCoverage=52%, HitCoverage=48%, E-value=2e-13, Identity=50%"; Hit description =Putative uncharacterized protein
  Pfam annotation: Domain name=zf-C2H2; Domain location=33-55; Score =21.3; E_value=0.0037; Accession=PF00096.17; Description=Zinc finger, C2H2 type
MEFGYQEDSSKSSSDEIDRSSEQNDETGIGRSYECVFCKRGFTTAQALGGHMNIHRKDRANNKAKPNFPPSSSSKVVDESNNYANPSYLTRGNYYSSTLPDHREVDVNYSYYHQLYFPSHACGAKSPSHRDELQVGSRKKQDFYSMEASSRKGCKIVFLVREGTQDIYTFSI

SEQ ID NO: 167964 - protein, 117 aa, Glycine max
  Coding DNA Sequence Number=SeqID_76279
MGTKLPIENEEDETHPRNWVLFKHNISNSKQRITNPVVENEEPDVLNLLTKFQVDPNDKEGKGNGMLTTRIDAGIESSVLEAREGNDKVKRGGGKSVYEIDTYEEGMVPKFERERGL

SEQ ID NO: 167965 - protein, 151 aa, Glycine max
  Coding DNA Sequence Number=SeqID_76280
MALPKEATPPPSFGVCCLLEACISSLPSICTEQLKVLVVSIGINVWQMLVTFCEVPFVGEGEGTIAFRHNSLHCLLVTRPFPLKALQKTHSKDDMVSMFECHNNVRGGSKWLVDGMVEGLVWCGGGVRWLRWWYRVDVGCGGHGGLGERGN

SEQ ID NO: 167966 - protein, 347 aa, Glycine max
  Coding DNA Sequence Number=SeqID_76281
  Gene Ontology: Mol. function=oxidoreductase activity; Cellular component=proton-transporting two-sector ATPase complex; Biological process=ethylene biosynthetic process
  Homolog annotation: Hit_ID=A7QVS7; Match level="QueryCoverage=93%, HitCoverage=86%, E-value=1e-105, Identity=57%"; Hit description =Chromosome chr7 scaffold_192, whole genome shotgun sequence
  Pfam annotation: Domain name=2OG-FeII_Oxy; Domain location=223-322; Score=130.5; E_value=5e-36; Accession=PF03171.11; Description=2OG -Fe(II) oxygenase superfamily
MEVVGFDKEGAGYDRAKEVKEFEDTKAGVKGLVDFGILKLPRFLIHPPESLPSSPTSSNNTTSTLQVPVIDFAGYDDDDDESCCRRLKIVREIREASEKWGFFQMVNHGVPVSVMDEMLRVIREFHEQSKEVKKEWYSRDPKVRVRYFCNGDLLVAKVANWRDTIMFHFQEGPLGPEAYPLVCREAVIQYMEHMFKLREILSQLLSEALGLKRDYLKNRECMKGETVVCHYYPPCPEPDLTLGATKHSDPSCLTILLQDTMGGLQVFHENQWVHIKPMPGALVANIGDFMQLISNDKLKSVEHRVLVGRVGPRVSAACHVHACCIVLINGNNPMWVVTILGTYQHDK

SEQ ID NO: 167967 - protein, 79 aa, Glycine max
  Coding DNA Sequence Number=SeqID_76282
MGSNPETASLHMQGHSLTLSCDKEEKNSSLPFNSKQAPIDHYRNYSSFLPRPYSLLCSSSLFEGQNFIEESISSNNICQ

SEQ ID NO: 167968 - protein, 134 aa, Glycine max
  Coding DNA Sequence Number=SeqID_76283
  Gene Ontology: Mol. function=ATPase activity, coupled to transmembrane movement of ions, phosphorylative mechanism; Cellular component=membrane; Biological process=metabolic process
  Homolog annotation: Hit_ID=A2Q410; Match level="QueryCoverage=85%, HitCoverage=13%, E-value=3e-32, Identity=62%"; Hit description =Cation transporting ATPase, C-terminal
MPDPLFFIAAKSFRCQKKVFNEFNARKPDKFNIFKGVTRNYLFMGIVGITVVLQIVIVEYLGKFTKTAKLNWKQWLISVIIAFIRVLVMCSHANCNSSPAPHSLSWPLAVVGKLIRVPKAELSNLFRKYLRRGN

SEQ ID NO: 167969 - protein, 323 aa, Glycine max
  Coding DNA Sequence Number=SeqID_76284
  Gene Ontology: Mol. function=hydrolase activity, acting on acid anhydrides, catalyzing transmembrane movement of substances; Cellular component=integral to membrane; Biological process=calcium ion transport
  Homolog annotation: Hit_ID=A2Q410; Match level="QueryCoverage=92%, HitCoverage=45%, E-value=1e-119, Identity=69%"; Hit description =Cation transporting ATPase, C-terminal
MATYKHRYFSGHTRNPDGSVQFIAGKTKVGDAIDGVIKIFTVAVTIVVIAVPEGLPLAVTLTLSACETMGSATTICSDKTGTLTMNQMTVVEAWIGGGKKIVPPYEESKFSHMLCSLLIEGVAQNTNGSVYIAEGGNDVEVSGSPTEKAILEWGIKLGMNFDTARSDSSIIHVFPFNSDKKRGGVATRVSDSEIHIHWKGAAEIVLACCTRYFDANDQLVEMDEAKMSTFKKAIEDMAADSLRCVAIAYRSYEMKNVPTSEEELSHWSLPEDNLVLLAIIGLKDPCRPGVKDAVKLCQKAGVEVLIHAFDVEIHFVPLCDLGH

SEQ ID NO: 167970 - protein, 213 aa, Glycine max
  Coding DNA Sequence Number=SeqID_76285
  Gene Ontology: Mol. function=transcription activator activity; Cellular component=nucleus; Biological process=regulation of transcription, DNA-dependent
  Homolog annotation: Hit_ID=A9NX56; Match level="QueryCoverage=93%, HitCoverage=61%, E-value=2e-39, Identity=49%"; Hit description =Putative uncharacterized protein
  Pfam annotation: Domain name=HALZ; Domain location=148-192; Score =49.4; E_value=1.2e-11; Accession=PF02183.9; Description=Homeobox associated leucine zipper
  Pfam annotation: Domain name=Homeobox; Domain location=93-147; Score =64.8; E_value=2.8e-16; Accession=PF00046.20; Description=Homeobox domain
  Pfam module annotation: Pfam domain module=HALZ::Homeobox; Domain location=148-192::93-147
MEDNNEECITGLCLGIGMGGHVPKKNKQKENKAVACLDLAFELCPKGEEAINVNLHHHHHEKVERISLERIHEYPNEKSTDSDNSNNNNRCRKKLRLSKEQSSMLENSFKQHSTLNPVQKQALADQLNLKTRQVEVWFQNRRARTKLKQTEVDHELLKKHCQNLSDENKRLKKELQELRALKVGPSPLCIQLSKTATLTTMCSSCDRELKLVN

SEQ ID NO: 167971 - protein, 159 aa, Glycine max
  Coding DNA Sequence Number=SeqID_76286
  Gene Ontology: Mol. function=protein serine/threonine kinase activity; Biological process=protein amino acid phosphorylation
  Homolog annotation: Hit_ID=Q8LEZ7; Match level="QueryCoverage=50%, HitCoverage=19%, E-value=3e-09, Identity=45%"; Hit description =Putative uncharacterized protein
MDANLEGKYPTNLALQLAQLALKCIQADPKVRPSMKEVLETLEQIEAANEKPADNIKWVTCSRVVQQHGWPEVASKELPRMLLLGWKVWREAERQKQDRVGLERRLENEKEKLSLWFWTLVVSLEVVDKPTTFEVLMMWVCGTLAAAPPSLPPRVGCSF

SEQ ID NO: 167972 - protein, 391 aa, Glycine max
  Coding DNA Sequence Number=SeqID_76287
  Gene Ontology: Mol. function=nuclease activity; Cellular component =extracellular region; Biological process=proteolysis
  Homolog annotation: Hit_ID=A7Q6B1; Match level="QueryCoverage=75%, HitCoverage=94%, E-value=1e-117, Identity=69%"; Hit description =Chromosome chr11 scaffold_56, whole genome shotgun sequence
  Pfam annotation: Domain name=Endonuclease_1; Domain location=126-361; Score=169.4; E_value=9.1e-48; Accession=PF04231.4; Description =Endonuclease I
MAYSFIANMRLGTSELNPPAFFSCRRHFPGIPTLQLHPPARPTSPRRCRDWVTYASRQKPPIPISSNIDERALCFDILWRWLSRLISFYLLSLNLAAAASDYPAPSTYPCEDISHYYSSVKHFRFRGEALKRQLNSIVAPHHSLSYREVWDALKVLDAADIDNPEASSEIVEIYSLRVVPKRLAGKPQGWNREHLWPRSYGLTKGPSLTDLHNIRPADVNVNSSRGNKYYGECITSSSKCLRPANKEAALDTETDKERWAPPMQFRDFFERQSLEKFLKVRGDVARALMYMAVCYGFQQPRGIPGLRLSDAPNVEKREMGLLSTLLKWNEVDPPSRDEKLRNERICKFYQHNRNPFVDHPEYANLIWKQPVFHNNSHTNNASHKEKELGMS

SEQ ID NO: 167973 - protein, 350 aa, Glycine max
  Coding DNA Sequence Number=SeqID_76288
  Gene Ontology: Mol. function=oxidoreductase activity; Cellular component=cytoplasm; Biological process=electron transport
  Homolog annotation: Hit_ID=A2Q567; Match level="QueryCoverage=91%, HitCoverage=55%, E-value=1e-105, Identity=64%"; Hit description =Amine oxidase
  Pfam annotation: Domain name=Amino_oxidase; Domain location=1-344; Score=-12.7; E_value=4e-05; Accession=PF01593.15; Description=Flavin containing amine oxidoreductase
MHETPRGLIHLLLTCSLWIMQQKVNAKCFQAEEITIAKGYLSIIESLASVLPPGLVQLGRKVTRIEWQPDRHEAMNLENGRTCSRPVMLHFCDGSIMSADHVIVTVSLGVLKASIRDDDSGMLMFNPPLPSFKAEAISRLGFGVVNKLFIQLSEPPHERKDEHEHSKGFPFLQMVFHSPQSELRHKKIPWWMRRTATLCPIYNNSSVLLSWFAGEEALALESLKEEEIIEGISDTISCFLSHSLEFCNGNVNSEKYSHEYKVKFSKVLKSQWGTDPLFLGSYSHVAVGSSGDDLDTMAEPLPKCHISASPPLQILFAGEATHRTHYSTTHGAYFSGLREANRLLQHYSLC

SEQ ID NO: 167974 - protein, 733 aa, Glycine max
  Coding DNA Sequence Number=SeqID_76289
  Gene Ontology: Mol. function=metal ion binding; Cellular component =nucleus; Biological process=regulation of flower development
  Homolog annotation: Hit_ID=A7PET2; Match level="QueryCoverage=87%, HitCoverage=99%, E-value=0.0, Identity=68%"; Hit description =Chromosome chr11 scaffold_13, whole genome shotgun sequence
  Pfam annotation: Domain name=fn3; Domain location=341-430; Score =27.1; E_value=6.3e-05; Accession=PF00041.12; Description=Fibronectin type III domain
MDEDVLAVPHLYEDHLANMVDEGDVSGVQSLSSSAQSTPEKNGHSDDASRSSELLQEFLKSGPKKEILRTCFDKDKKNISSKSRMAETKSTSKIAKKQDSKKVSGISNQPSRKQHRKGENPVRFVPTPDPPSDFGHSNSWICKNSACRAVLSKDDTFCRRCSCCICHLFDDNKDPSLWLVCTCESSQGDSCGLSCHIECALQHEKVGVVDHGQLMQLDGGYCCASCGKVTGILGCWKKQLNIAKDARRVDVLCYRIYLSYRLLDGTSRFKELHEMVKEAKAKLETEVGPVNGVSAKMARGIVSRLPIASDVQKLCSLAIEKADEWLATVPNVHPESREGSLPAACKVVFEEVTASSVKIILIEMSNASSGDIKGYKLWYYKSREESHTKDPVSVFPKAQRRILIPNLQPCTEYTFRVVSFTDMGDLGHSEAKCFTKSIEILEKNSSSSVAMNKKKENLQTECNSSGSKMEPNPTMEDSGFKVRDLGKILHLSWAQEQGCSEEFCCADKRKCCGQSETIKPTNPQELLPSVSRDLDLNVVSVPDLNEELTPPFESSRDEDNGCTLQQAVEADDDAASHDLEKNLARSHGSGGSQTWNHGPTGEVPAVDSRGDACRKRVASTNEETHDCDSTLINDSPLRASDGPFSLDENFEYCVKVIRWLECQGHIKQEFRLKLLTWFSLRSTEQERRVVNTFIQALIDDPSSLAGQLVDSFSDIISNKRPRNGFSNKAVSSS

SEQ ID NO: 167975 - protein, 109 aa, Glycine max
  Coding DNA Sequence Number=SeqID_76290
MDRRGEGDNEHRKKILLLEILRLMMYSLKSFESPGWFVWIGISTFALNVFLDFLVSLLRTKSELSRLVRVRAKPGLRAKRTIQFFQFFFKVFSSNFSPKHLKSSSFNFC

SEQ ID NO: 167976 - protein, 489 aa, Glycine max
  Coding DNA Sequence Number=SeqID_76291
  Gene Ontology: Mol. function=aspartic-type endopeptidase activity; Cellular component=cellulose and pectin-containing cell wall; Biological process=proteolysis
  Homolog annotation: Hit_ID=A7PGR6; Match level="QueryCoverage=76%, HitCoverage=78%, E-value=1e-112, Identity=55%"; Hit description =Chromosome chr17 scaffold_16, whole genome shotgun sequence
  Pfam annotation: Domain name=Asp; Domain location=171-465; Score= -113.5; E_value=6.9e-07; Accession=PF00026.14; Description=Eukaryotic aspartyl protease
MEDDQSTQIKGVVIISLPPPDNPSLGKTITAFAFSNNPSPPPQLFIQPHQHQSQQTHPNAQHNTDPPLQSYPSNPQLSFSFRRLFHSTPVKLFSFFGTLLFALFSMVLFLQPPLWTYVAARMMKDLKLQLGKLVQKEKFLTQRDVGDGSGVVAVDSSSVFPVSGNVYPDGLYFTILRVGNPPKSYFLDVDTGSDLTWMQCDAPCRSCGKGAHVQYKPTRSNVVSSVDSLCLDVQKNQKNGHHDESLLQCDYEIQYADHSSSLGVLVRDELHLVTTNGSKTKLNVVFGCGYDQEGLILNTLAKTDGIMGLSRAKVSLPYQLASKGLIKNVVGHCLSNDGAGGGYMFLGDDFVPYWGMNWVPMAYTLTTDLYQTEILGINYGNRQLKFDGQSKVGKVFFDSGSSYTYFPKEAYLDLVASLNEVSGLGLVQDDSDTTLPICWQANFQIRSIKDVKDYFKTLTLRFGSKWWILSTLFQIPPEGYLIISVILSF

SEQ ID NO: 167977 - protein, 670 aa, Glycine max
  Coding DNA Sequence Number=SeqID_76292
  Gene Ontology: Mol. function=binding; Cellular component=protein phosphatase type 2A complex; Biological process=ethylene mediated signaling pathway
  Homolog annotation: Hit_ID=Q38950; Match level="QueryCoverage=100%, HitCoverage=100%, E-value=0.0, Identity=78%"; Hit description =Serine/threonine-protein phosphatase 2A 65 kDa regulatory subunit A beta isoform
  Pfam annotation: Domain name=HEAT; Domain location=174-210; Score =23.5; E_value=0.00077; Accession=PF02985.13; Description=HEAT repeat
  Pfam annotation: Domain name=HEAT; Domain location=280-316; Score =31.6; E_value=2.9e-06; Accession=PF02985.13; Description=HEAT repeat
  Pfam annotation: Domain name=HEAT; Domain location=319-355; Score =27.8; E_value=4e-05; Accession=PF02985.13; Description=HEAT repeat
  Pfam annotation: Domain name=HEAT; Domain location=358-394; Score =25.9; E_value=0.00014; Accession=PF02985.13; Description=HEAT repeat
  Pfam annotation: Domain name=HEAT; Domain location=397-433; Score =28.1; E_value=3.2e-05; Accession=PF02985.13; Description=HEAT repeat
  Pfam annotation: Domain name=HEAT; Domain location=43-78; Score=1.2; E_value=18; Accession=PF02985.13; Description=HEAT repeat
  Pfam annotation: Domain name=HEAT; Domain location=436-472; Score =26.1; E_value=0.00013; Accession=PF02985.13; Description=HEAT repeat
  Pfam annotation: Domain name=HEAT; Domain location=475-511; Score =22.3; E_value=0.0017; Accession=PF02985.13; Description=HEAT repeat
  Pfam annotation: Domain name=HEAT; Domain location=559-589; Score =7.4; E_value=2.1; Accession=PF02985.13; Description=HEAT repeat
  Pfam annotation: Domain name=HEAT; Domain location=592-628; Score =21.3; E_value=0.0036; Accession=PF02985.13; Description=HEAT repeat
  Pfam annotation: Domain name=HEAT; Domain location=631-667; Score =18.9; E_value=0.02; Accession=PF02985.13; Description=HEAT repeat
  Pfam annotation: Domain name=HEAT; Domain location=81-117; Score =16.3; E_value=0.099; Accession=PF02985.13; Description=HEAT repeat
  Pfam module annotation: Pfam domain module=HEAT::HEAT::HEAT::HEAT::HEA T::HEAT::HEAT::HEAT::HEAT::HEAT::HEAT::HEAT; Domain location=174 -210::280-316::319-355::358-394::397-433::43-78::436-472::475 -511::559-589::592-628::631-667::81-117
MAMVDQPLYPIAVLIDELKNEDIQLRLNSIRRLSTIARALGEDRTRKELIPFLSENNDDDDEVLLAMAEELGVFIPYVGGVDHANVLLPPLETLCTVEETCVRDKSVESLCRIGAQMREQDLVEHFIPLVKVVHVPSCIAFSFVVLRRLAAGEWFTARVSSCGLFHIAYPSAPESVKTELRAIYGQLCQDDMPMVRRSAATNLGKFAATVEAPHLKSDIMSVFEDLTQDAVNDIPQVVALSVYWTDYVRNEYSLSLSYQDSVRLLAVEGCAALGKLLEPQDCVAHILPVIVNFSQDKSWRVRYMVANQLYELCEAVGPDPTRSELVPAYVRLLRDNEAEVRIAAAGKVTKFSRILNPDLAIQHILPCVKELSTDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVGFFDDKLGALCMQWLKDKVYSIRDAAANNIKRLAEEFGPDWAMQHIIPQPWVIGIWDDEFECFLDCGLWLLAYYRLVARILFLSDEVKVLDMVTDPHYLYRMTILQAISLLAPVLGSEITSSKLLPLVINASKDRVPNIKFNVAKVLQSLIPIVDQSVVESTIRPCLVELSEDPDVDVRFFASQALQSSDQVKMSS

SEQ ID NO: 167978 - protein, 30 aa, Glycine max
  Coding DNA Sequence Number=SeqID_76293
MKKSRMLMTKEHHPKSFIFEELFVQPFCQM

SEQ ID NO: 167979 - protein, 160 aa, Glycine max
  Coding DNA Sequence Number=SeqID_76294
  Subcellular localization annotation: CTP_CleavageSite=64; ConfidenceScore=5.16e-01
MFAHSIKGCRPLGRACGVLIPSPCVNTTPEPFNLKVRRSRLFRFFRRFPQINVGGDSARIPFVEHASRESRVALPPKDLSNDIYPNPQPKSHLFLTMTPLFAKHSSPSTTTGSSPSTSSTRSKSSSLLSSLHQHLQPHARHHRQVLRVQPLVGPHSLREC

SEQ ID NO: 167980 - protein, 170 aa, Glycine max
  Coding DNA Sequence Number=SeqID_76295
MGDQEEIQEQMKADMSALKEQMASMMDAMLEMRQLMENNVAIVATVSLAVEADPTLPATAHHPLPNVSNDVHEDRREHAQGDIDSYSSVPVEGLAPNTLPQPNLTGEPRNLPAQPIFLSTEGPPPAVEEKRKLDLIEERLRAVEGFGDYPFVDMADLCLVSDVLIPPKFK

SEQ ID NO: 167981 - protein, 101 aa, Glycine max
  Coding DNA Sequence Number=SeqID_76296
MDHFKCLKESMTMLTKLSYPVNGESNLRTNPSQEGENDEDMTKSKGKDPLEGLGGPMTRARARKAKEALQQVLFILFEYKPKFQGEKSKVVSCIMAQMEED

SEQ ID NO: 167982 - protein, 59 aa, Glycine max
  Coding DNA Sequence Number=SeqID_76297
MAITQATRLQMRPKWRRTKAQVEKDKAPEWRRMKAQVEKDEGPEAETLSRLLIVAEGPN

SEQ ID NO: 167983 - protein, 172 aa, Glycine max
  Coding DNA Sequence Number=SeqID_76298
  Homolog annotation: Hit_ID=A7PZL1; Match level="QueryCoverage=55%, HitCoverage=27%, E-value=6e-26, Identity=63%"; Hit description =Chromosome chr15 scaffold_40, whole genome shotgun sequence
MVLFMSLMHISRASASFNELKQLHKELGSSHSHKKHKRHRTENDLPEVKNSAKGKVLMQAMYGVKVETVFICRVFTAAFFGSSKKLSDLNVADIHSWALDFRRLQNLVNEEIRVRFSGGKFTVLNELEAVDASMKILYPTCRNLPFGGRATRDSRDACSTKGIRAESPPTFI

SEQ ID NO: 167984 - protein, 142 aa, Glycine max
  Coding DNA Sequence Number=SeqID_76299
MIAYIPNPRVDPSQYRDLVHYWCSEKGQEISNTNKRNRSKYEDLHCMGTKNLPRRIHEMDELKKKMIEAESSQNLQSTQDSTNWTNDIYSKVKEPEKRGHACCLGKLSHQASSSQISYANNRIQKLENLLENLVVVLKVQFA

SEQ ID NO: 167985 - protein, 87 aa, Glycine max
  Coding DNA Sequence Number=SeqID_76300
METFLQSRPEDDDLSRKGCLRLPPDPQVMIAKGGVVDKSEVFAPTVATHPSAGGRREGSGVRLPRVENVRSRHQHLFERCIYARGRY

SEQ ID NO: 167986 - protein, 131 aa, Glycine max
  Coding DNA Sequence Number=SeqID_76301
MELQRLNKNEETDKRKKIISLKASSSMQEEEEEEEESDDEEDFSLFVKKFQKFIKNRIIKNTSRFKRKVEEHFKTQEEKLKNSSRFKRKVEFKHQDSWIKLQEPRLRFKTQDSRIKRRLKQHKYEMVFFKN

SEQ ID NO: 167987 - protein, 65 aa, Glycine max
  Coding DNA Sequence Number=SeqID_76302
GKEGGGCRPARPGELGCFHQKTPPSVGTPWKIARQYSLSTPGMSRNFTDYLTMGVKYLEAVKQRL

SEQ ID NO: 167988 - protein, 122 aa, Glycine max
  Coding DNA Sequence Number=SeqID_76303
  Homolog annotation: Hit_ID=Q6WAY4; Match level="QueryCoverage=72%, HitCoverage=16%, E-value=3e-08, Identity=33%"; Hit description =Putative uncharacterized protein
MGSSQTHLLKKRFYQVKVKSLGMVEVSTEVIASLAQYYDQPLRCFTYGDFQLSPMVEEFEEILGCPLGGRRPYLFSGFYPSLARISKIVQISVQELDHRKQVENRVVGIPRKYLEAKARILA

SEQ ID NO: 167989 - protein, 80 aa, Glycine max
  Coding DNA Sequence Number=SeqID_76304
  Subcellular localization annotation: CTP_CleavageSite=48; ConfidenceScore=5.50e-01
MARSAGHFSLSAIPSRFAIALGAPFALSDTSKVVIFKITRVRLWRNVLGSFRKHFKTIQRLTNPGSRFCRNRFRNLIIST

SEQ ID NO: 167990 - protein, 51 aa, Glycine max
  Coding DNA Sequence Number=SeqID_76305
MVIPKFKVPDFGKYKGTTRSKNHLKMTTVTWSTNLGTFLSPFLEGPNGCLH

SEQ ID NO: 167991 - protein, 270 aa, Glycine max
  Coding DNA Sequence Number=SeqID_76306
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRRVKASQASLNTFVDCRGLGVYTKKYRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 167992 - protein, 338 aa, Glycine max
  Coding DNA Sequence Number=SeqID_76307
  Gene Ontology: Cellular component=integral to membrane
  Homolog annotation: Hit_ID=P76272; Match level="QueryCoverage=71%, HitCoverage=93%, E-value=2e-99, Identity=47%"; Hit description =Uncharacterized protein yebT
  Pfam annotation: Domain name=MCE; Domain location=187-276; Score =33.8; E_value=6.4e-07; Accession=PF02470.11; Description=mce related protein
  Pfam annotation: Domain name=MCE; Domain location=73-165; Score =108.6; E_value=1.9e-29; Accession=PF02470.11; Description=mce related protein
  Pfam module annotation: Pfam domain module=MCE::MCE; Domain location =187-276::73-165
MSLVNRDQLLAFTMGPAAFYFGAAVILTIMAETPTTPTSANLRNKRKISPFWLLPIIALLIAGWLLWTNYQERGTTITINFQTADGIVPGRTPIRYQGVEVGTVQGIVLSDDYRSIQIKASIKSDMRDALRENTQFWLVTPKASLAGVSGLDALVGGNYIGMMPGDGKERDHFTALDTQPKYRVNTGELLIHLHAPDLGSLNTGSLVYYRKIPVGRVYDYSINGNTDGVTIDVLIERRFTNLVKKQSRFWNVSGVDADVSLSGAKVKLESLAALPARRADFARSAQRRQPESRQHAADVSGAGSGHPDQTDAAAGRQSVRRADDRSLRHRPDAQRHAD

SEQ ID NO: 167993 - protein, 61 aa, Glycine max
  Coding DNA Sequence Number=SeqID_76308
CEKGRYNKQKGAKIKKKRRKSEAAQVQQGAKRRTRAERDVTLSARLCAQGDYEGPSPSLHL

SEQ ID NO: 167994 - protein, 82 aa, Glycine max
  Coding DNA Sequence Number=SeqID_76309
MWVCHNLPFGGRAMRGSRVCLPRKENAQSHHQRLFEENVEKTGKVWFMNFKRERFGSCFYARGRVFPSLLRILNCNEEIRPT

SEQ ID NO: 167995 - protein, 269 aa, Glycine max
  Coding DNA Sequence Number=SeqID_76310
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
LELLRADQRLISPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARANWSSTAVAAALELVDPPGCRNSIPSRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 167996 - protein, 78 aa, Glycine max
  Coding DNA Sequence Number=SeqID_76311
MKWGDIQGYLMVTHTVHQPWANEPNDAQRLTSSSPPFVVLTCEVSSHAGLPYGENEPVDARRLTSSTAPFVVLTREVR

SEQ ID NO: 167997 - protein, 350 aa, Glycine max
  Coding DNA Sequence Number=SeqID_76312
  Gene Ontology: Mol. function=CTP synthase activity; Cellular component=cellular_component; Biological process=pyrimidine nucleotide biosynthetic process
  Homolog annotation: Hit_ID=Q6D181; Match level="QueryCoverage=65%, HitCoverage=42%, E-value=1e-110, Identity=88%"; Hit description=CTP synthase
  Pfam annotation: Domain name=CTP_synth_N; Domain location=124-350; Score=556.8; E_value=2.3e-164; Accession=PF06418.5; Description=CTP synthase N-terminus
  Pfam annotation: Domain name=CbiA; Domain location=128-338; Score= -37.7; E_value=0.083; Accession=PF01656.14; Description=Cobyrinic acid a,c-diamide synthase
  Pfam annotation: Domain name=MazG; Domain location=3-51; Score=-5.3; E_value=0.013; Accession=PF03819.8; Description=MazG nucleotide pyrophosphohydrolase domain
  Pfam module annotation: Pfam domain module=CTP_synth_N::CbiA::MazG; Domain location=124-350::128-338::3-51
MHEARQAVVDESKLEEEIGDLLFATVNLSRHLGHKAENALQAANRKFERRFRQVEAIVKQRGLSLEDATLEQMEEAWQQGLCGAGGVNPDEHGRAAEMMDSKTIVCRSGEVRVYCFPSWFSMTTNYIFVTGGVVSSLGKGIAAASLAAILEARGLNVTIMKLDPYINVDPGTMSPTQHGEVFVTDDGAETDLDLGHYERFIRTKMSRRNNFTTGRIYSEVLRKERRGDYLGATIQVIPHITNAIKERIIEGGEGHDVVLVEIGGTVGDIESLPFLEAIRQMAVDVGREHTMYMHLTLVPYMAAAGEVKTKPTQHSVKELLSIGIQPDVLICRSDRAVPANERAKIALFCN

SEQ ID NO: 167998 - protein, 76 aa, Glycine max
  Coding DNA Sequence Number=SeqID_76313
MPTLLGKSTVLIRYTNMLNFAGCDGKAVATYPSAGGRRETRGMRVPRKEYARSRHQRLFEENVGKTGKDAIYELLS

SEQ ID NO: 167999 - protein, 220 aa, Glycine max
  Coding DNA Sequence Number=SeqID_76314
  Gene Ontology: Mol. function=phosphoribulokinase activity; Biological process=carbohydrate metabolic process
  Homolog annotation: Hit_ID=P0AEX5; Match level="QueryCoverage=100%, HitCoverage=76%, E-value=1e-112, Identity=88%"; Hit description =Probable phosphoribulokinase
  Pfam annotation: Domain name=PRK; Domain location=7-214; Score=405.3; E_value=9e-119; Accession=PF00485.9; Description=Phosphoribulokinase Uridine kinase family
  Subcellular localization annotation: CTP_CleavageSite=11; ConfidenceScore=5.02e-01
MSAKHPVIAVTGSSGAGTTTTSLAFRKIFSQLNLHAAEVEGDSFHRYTRPEMDMAIRKARDQGKHISYFGPEANDFSLLERTFLEYGEFGKGQSRKYLHTYDEAVPWNQVPGTFTPWQPLPEPTDVLFYEGLHGGVVTPQHDVAKHVDLLVGVVPIVNLEWIQKLIRDTSERGHSREAVMDSVVRSMEDYINFITPQFSRTHINFQRVPTVDTSNPFAAK

SEQ ID NO: 168000 - protein, 114 aa, Glycine max
  Coding DNA Sequence Number=SeqID_76315
MASRKRVRTDDIPSSSIPPPHLRELAQNRTIVPLEYFLEKVVWSEAQLPLVRPNEVAPPEPAPAQVELMSAEPQTPVLKKQLTPLLPQLEELLIFLIRHLEKLLLSLISQFRHC

SEQ ID NO: 168001 - protein, 155 aa, Glycine max
  Coding DNA Sequence Number=SeqID_76316
MLNKEPGLWCNTSIESQQNEKDLEAVHVRDYTTKDDLKELIGTTNTNKMHLPFSNPSLKNFIVKRAWLGVVSLILEAGRADCRDLRKSYLWRGSKSSDNEEHDDIEIEFDDSDIDLTSSIFNSFIELIEEHIMGMEFASEDDGSLLVGLLWRLNL

SEQ ID NO: 168002 - protein, 196 aa, Glycine max
  Coding DNA Sequence Number=SeqID_76317
  Homolog annotation: Hit_ID=A5BNA8; Match level="QueryCoverage=35%, HitCoverage=5%, E-value=4e-07, Identity=48%"; Hit description =Putative uncharacterized protein
MTLLVLPVLGVLVASCNRLCEIVGKLLDNFNFVMNEILKLTKVLQQQRHMHSSDSHAEDDVGDPDVVKTKFDDSQRADNGITDNKRADKGRCDNGATDKGRPDNERFDKGKLDNKRAELRCLGDVEKGYTQPQNEATLSPNEKETLLKLKKKDQQALAFIHQGVDKVKKVCLQTLRREFESLHMKKSKSISDFGNK

SEQ ID NO: 168003 - protein, 118 aa, Glycine max
  Coding DNA Sequence Number=SeqID_76318
MTRGNPGDLQPFDLEIDRTFHRLVRHSVHPGHSMHFEHFEHSEYSIVGDSEYSDFEHSITNFYTENMAQSPPRERTLREMAAPDFTYESLCIQYPDEGVPYVLRTGLIHLLPKFHYLA

SEQ ID NO: 168004 - protein, 302 aa, Glycine max
  Coding DNA Sequence Number=SeqID_76319
  Gene Ontology: Mol. function=DNA binding; Biological process =regulation of transcription
  Homolog annotation: Hit_ID=A7QBW0; Match level="QueryCoverage=88%, HitCoverage=99%, E-value=1e-126, Identity=78%"; Hit description =Chromosome chr1 scaffold_75, whole genome shotgun sequence
MVTNEYSLENILSEAAMQDRTVILTTLNEAWAAPNSIIDLFLESFRIGDHTRRLLNHLVIIALDQKAFIRCQAIHTYCYLLVSEATDFHEEAYFMTPSYLKMMWRRIDFLRSVLEMGYNFVFTDADIMWFRDPFPRFHRDADFQIACDHFTGSFDDVQNRPNGGFNFVKSNNRSIEFYKFWYSSRETYPGYHDQDVLNFIKVDPFITDLGLRMKFLDTANFGGLCEPSRDLNKVCTMHANCCYGMDSKLHDLRIMLQDWKYYLTLSPSLKRLSIISWRVPQNCSLDSLKHDHGSPEKSVQEG

SEQ ID NO: 168005 - protein, 521 aa, Glycine max
  Coding DNA Sequence Number=SeqID_76320
  Gene Ontology: Mol. function=protein binding; Biological process =protein metabolic process
  Homolog annotation: Hit_ID=A5C486; Match level="QueryCoverage=99%, HitCoverage=61%, E-value=1e-121, Identity=48%"; Hit description =Putative uncharacterized protein
  Pfam annotation: Domain name=Clp_N; Domain location=24-79; Score =12.0; E_value=0.053; Accession=PF02861.11; Description=Clp amino terminal domain
MRGGICSIQLQPLTLEATTVVKQAVNLATRRGHAQVTPLHVASAMLATSTGLLRKACLQCHSHPLQFKALELCFNVELDPLPASTSSPLLAPQYSTPSLSNALVAAFKRAQAHQRRGSIENQQQHILALKIKVEQLVISILDDPSVSKVMREAGFSSTLVKTRVEQAVSMEVYSKKASSDRSHAKENITKPHHVVLGGSNNVSPSSGPFGQVTAGSFTKPNLDHVNNDDVTSVLSELVRRKNTVIVGEGVANAEGVAKEVMERFEVGNVHRDLRYVQFVSLPLMCFRNISKEEVEHKLMEIRNLVKSCVGKGVVLYLGDLKCGESSRLWLMGIATFKAYMKCKMCHPSLEAIWELHPFTIPVGSLSLSLNFHSDFQAQERSKLFFKDVAFEDRTGVRNHLTCCRDCLINFEKEAQSITNCIRKKFCPASSLPTWLQNCKEERSDIMEDQPRDCALGSDIKINMVTSKKSCPKYVSLPESVSVAVTDKLYASSFANTIGEDKIFLTVAEAVAYCSPKLVEDP

SEQ ID NO: 168006 - protein, 56 aa, Glycine max
  Coding DNA Sequence Number=SeqID_76321
MSTKEYGYIWCHQLLELRLVLGPIISSGINEPLGLIRILVVDLKRANKAALTLVNF

SEQ ID NO: 168007 - protein, 251 aa, Glycine max
  Coding DNA Sequence Number=SeqID_76322
MSLHSSSSVNGEGSTPKDPLYKILDELRSLKLWKEKQERKEKGKKRVEEISQDEREKIREEERRKIMKEMKREKHASYSSHDSCKSLSEELSDYYRGRHSSHTKHHSQRREKDRRPHEVNISLPYFHEKDNVEAYLDWEMKVEKHFACHHISEERKVPLATLSFQGGDFKAHLEHKISCSSLPLPSFISFFLQALIHGLLWCGVSSLSSFSIPLPFIFQEAKESIDEEDPRPTSSNGACIRNSVNQDRGGG

SEQ ID NO: 168008 - protein, 214 aa, Glycine max
  Coding DNA Sequence Number=SeqID_76323
MAYADDVIRDSHISQKKPVEPVKRSNNVTADDPLGDLIKNMFMDEWSSSSGHGSVYGFLEPQSIHNAKDRCVECQHYIETWVKESQQEVYLGAYLNRLIGSWLFCVLGMMLLSGFVHYINTFIVIYTLMFFFLTSAMKTLKTIVDGKNHGTSKGIEVKSHVQSIGYECGYYVMHWMWNIWFGDDTLLDIETITIIHKKWTTYFAKVKNIRCRNV

SEQ ID NO: 168009 - protein, 140 aa, Glycine max
  Coding DNA Sequence Number=SeqID_76324
  Subcellular localization annotation: CTP_CleavageSite=42; ConfidenceScore=5.16e-01
MKDCKNTSAEDVSFISRISQSLTNSSQALKLAPASSFGGLVRARVLSAPMDHLAHLIFFWILPRAKPRSVALSGCSLSQQIGLARSALAFVTDGEVFMAQEALLKVFDRILDVVVETTGTAPFDEIIEVSSDGGDERGEQ

SEQ ID NO: 168010 - protein, 247 aa, Glycine max
  Coding DNA Sequence Number=SeqID_76325
  Homolog annotation: Hit_ID=A2Q2F8; Match level="QueryCoverage=14%, HitCoverage=5%, E-value=5e-07, Identity=72%"; Hit description =Kinesin, motor region
MKKDYDIALVGAFRREKDKDMELQALRDEIQASMKLITLDAGDIMRDQGALEEEPLVNRPDEFPMVNKVSNLLGMDDRDVVSHSQCEKKDVDIRKMGLVKTSPVKKESNSTSALKVYSRRKTCHIAKSMAHLNLGPILNEIGTEGDTRVMVAGNSFEYNKEGVDLCDSQSGPLTPKQDHQPHSPIPPSSFNNDFNGVEGDQHWEIARQLGISFDENFKNRGKEFLDEASTSHSAAATTEMGNNTIAP

SEQ ID NO: 168011 - protein, 24 aa, Glycine max
  Coding DNA Sequence Number=SeqID_76326
MALGDKSRVRRYAEVVAEQADKAP

SEQ ID NO: 168012 - protein, 63 aa, Glycine max
  Coding DNA Sequence Number=SeqID_76327
MEACLKNFYGAEDKREEMRGSLENKPWKEKFHHQEIVLDKKLREEALMEEENERESDVEIEGE

SEQ ID NO: 168013 - protein, 123 aa, Glycine max
  Coding DNA Sequence Number=SeqID_76328
MVKVGTSLRADQRLIFAKKLAQGFPGINRDTRIYLFCEHRRTSALASVAVTLRVTTTPAALNAPLQGASHSPFRLRNCWEGRSVRASSLLRQLAKGGCAARRLSWVTPGFSQSRRCKTTASEL

SEQ ID NO: 168014 - protein, 144 aa, Glycine max
  Coding DNA Sequence Number=SeqID_76329
  Gene Ontology: Biological process=transposition, DNA-mediated
  Homolog annotation: Hit_ID=Q1J7G7; Match level="QueryCoverage=25%, HitCoverage=65%, E-value=3e-10, Identity=71%"; Hit description =Transposase
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSIQAQDPGRSSLLTHNALVMEACLWGFYGGWIFELQ

SEQ ID NO: 168015 - protein, 265 aa, Glycine max
  Coding DNA Sequence Number=SeqID_76330
  Homolog annotation: Hit_ID=A5B5V0; Match level="QueryCoverage=86%, HitCoverage=52%, E-value=6e-10, Identity=24%"; Hit description =Putative uncharacterized protein
MDFFSNVNFECIQAFQNSNLIPFMSLKLPVYSELVKAFYSNLEIQESTLISEVFGIKMVIDQSLFYDLTQLSSEGVPFEGALNDDWKFDFSVHDARRLVCTNQADMTERLLAGSLAFESRILQYLIVCILLPRSLNLAQVSEEDLIVMWAFHIGRQIDWAHLVRYHMHKALQLNDSLPYPHLVTLFLQHFNIPLDSEPYVPIKRSFLIGAAVVASFGYCKERDGSWVKKGAQPIDDEGHLPVGEDSSLLQRILDRFDGLQTYVGE

SEQ ID NO: 168016 - protein, 116 aa, Glycine max
  Coding DNA Sequence Number=SeqID_76331
MRSWVRGQWIPFDADALIQFLGDPLVLEEGQECEFSQRRNRANGFDEEVIAQLLCIPGQDFARTAAGRRVRIMRTSMTTLTQMWMTLLLSNILPSDHNSDLPLPKCQLVCHLPGTL

SEQ ID NO: 168017 - protein, 35 aa, Glycine max
  Coding DNA Sequence Number=SeqID_76332
MDYSGKRLHMGTVNRREDQAKDTGGGNGTHRKHGG

SEQ ID NO: 168018 - protein, 68 aa, Glycine max
  Coding DNA Sequence Number=SeqID_76333
  Subcellular localization annotation: CTP_CleavageSite=25; ConfidenceScore=5.50e-01
MAMSAPTKRGLASSPGSTMGCDRARSTMTKAAAMMMARPSPLSAGADDHPFASPSTRKNTMPKMATLK

SEQ ID NO: 168019 - protein, 70 aa, Glycine max
  Coding DNA Sequence Number=SeqID_76334
MTQDYSLNIPVAAASGALHVFPGGLKTIVPDKRSVGLNGGFVHTVQLGANCLPGTECQAWNETNAAITAE

SEQ ID NO: 168020 - protein, 264 aa, Glycine max
  Coding DNA Sequence Number=SeqID_76335
HVRILVKERRDYFSLAPLSSRDSKSNDMQRYHMVIRTFCQLEASEPVDTQRLTSSSAPLSSRDGKSDDMRRYLMVIRTFCQLEASEPVDMQRLTSSSAPLLSRDGKSDDMRRYLMVIYTFCQLEASEPVDMRRLTSSFAPFLEMSASFGQDCEKVSFAIRHTQGSASSGRDSEKVSFAIRQTQGSASSGRDYEKVSFAIRQTQGSGSGSMQRYLRVIHTFRQLEASEPVDTQRPMWSSAPFPEMSVSSGRDYEKVSFLPSDSSV

SEQ ID NO: 168021 - protein, 77 aa, Glycine max
  Coding DNA Sequence Number=SeqID_76336
MHAKRCTVKRVQKLEAELNKLESEAEHRQLTSQENMKRKKLQQDLWSVAQAHESLMRQKARSRWIKEGARYLDIFTW

SEQ ID NO: 168022 - protein, 450 aa, Glycine max
  Coding DNA Sequence Number=SeqID_76337
  Gene Ontology: Mol. function=catalytic activity; Cellular component =integral to membrane; Biological process=metabolic process
  Homolog annotation: Hit_ID=P75770; Match level="QueryCoverage=68%, HitCoverage=96%, E-value=1e-137, Identity=82%"; Hit description =Inner membrane protein ybhN
  Pfam annotation: Domain name=UPF0104; Domain location=224-441; Score=- 72.1; E_value=0.028; Accession=PF03706.4; Description=Uncharacterised protein family (UPF0104)
MPIVRVGARLLYNYLVKGGVQVFEYRRRPLHGKVALMDDHWATVGSSNLDPLSLSLNLEANVIIHDRHFNQTLRDNLNGIIAADCQQVDETMLPKRTWWNLTKSVLAFHFLRHFPALVGWLPAHTPRLAQVDPPAQPTMETQDRKILTWLFFIAVIVLLVVYAKKVDWEEVWKVIRDYNRVALLSAVGLVVVSYLIYGCYDLLARFYCGHKLAKRQVMLVSFICYAFNLTLSTWVGGIGMRYRLYSRLGLPGSTITRIFSLSITTNWLGYILLAGIIFTAGVVELPDHWYVDQTTLRILGIGLLMIIAVYLWFCAFAKHRHMTIKGQKLVLPSWKFALAQMLISSVNWMVMGAIIWLLLGQSVNYFFVLGVLLVSSIAGVIVHIPAGIGVLEAVFIALLAGEHTSKGTIIAALLAYRVLYYFIPLLLALICYLLLESQAKKLRAKNEAAM

SEQ ID NO: 168023 - protein, 71 aa, Glycine max
  Coding DNA Sequence Number=SeqID_76338
MVKHKQRYWRNSEEARTDRPSQQLRSLNGEWDAPCSGALSAAGVVVTRSVTATLASADVRRCFCRYAPPRQ

SEQ ID NO: 168024 - protein, 69 aa, Glycine max
  Coding DNA Sequence Number=SeqID_76339
MVGAFSQNIVTLTGLPLILLKGVTLMEACLWGFYGGWIFELQWGPLMVIFHHGDAAEDKGKEVRGGAIH

SEQ ID NO: 168025 - protein, 64 aa, Glycine max
  Coding DNA Sequence Number=SeqID_76340
MYPLLFSVTTTQVDVPSTCTTKDGKGRIKRILRQYPFEFFEKGEGRHKRIQARGEEKHKKNSGD

SEQ ID NO: 168026 - protein, 69 aa, Glycine max
  Coding DNA Sequence Number=SeqID_76341
MSVDEYYKEMEISLIRDQIEKSQEATMARVAPLCLFGGSHSSSYQGGTQVKRKQTYKKERGSLTKSHEK

SEQ ID NO: 168027 - protein, 236 aa, Glycine max
  Coding DNA Sequence Number=SeqID_76342
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLNGHHRNVNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168028 - protein, 76 aa, Glycine max
  Coding DNA Sequence Number=SeqID_76343
MKPLRNCTRWINVSAYQCYSCGNSSIQRSGNHSLSMKVNNELDVKFNNNDVYLGAYLNGSIQHGPGRLKASCPRNT

SEQ ID NO: 168029 - protein, 131 aa, Glycine max
  Coding DNA Sequence Number=SeqID_76344
VAPTKVIQPPITRAFIEKYCTQRQAQGDAPQAAGAPPPPHQAGPAGSFDMEQYLRHVVRQEAANHRAHSQGFASFSCPTPDQFRAEVAWPGDWPKAQTGEAPPEAPDDGEEAHEDEEMADLLDFLGGSGAT

SEQ ID NO: 168030 - protein, 173 aa, Glycine max
  Coding DNA Sequence Number=SeqID_76345
  Homolog annotation: Hit_ID=Q6L477; Match level="QueryCoverage=58%, HitCoverage=16%, E-value=7e-07, Identity=26%"; Hit description =Putative uncharacterized protein OSJNBa0009L15.8
  Subcellular localization annotation: CTP_CleavageSite=49; ConfidenceScore=5.60e-01
MATPPASPHPPPPPAGASMSQYTLKRTRKATRLRSLATRPPGAERLVVNVDPANGKANGPHKKKLRIYLGIVARDKVDVTYETWKEVPVAQKDLIREDIQAEFEILEASDSRKKKKIFETVSEWWRQFKSDLTKKWALAADKDGVDDTICEKYDISKEKWAQFCQTRRDPSWE

SEQ ID NO: 168031 - protein, 111 aa, Glycine max
  Coding DNA Sequence Number=SeqID_76346
  Homolog annotation: Hit_ID=A8P366; Match level="QueryCoverage=62%, HitCoverage=39%, E-value=6e-07, Identity=42%"; Hit description =Putative uncharacterized protein
MKYECPRLSLLIITPIPKANTIGSESCAPEARPGQFKDRSASPAEGTSRPVHTGGGPIDPTQAGITAAAGTRLALQWILVKGFRLYSFQLPDSMSPGIVIYCHYLPVSGFG

SEQ ID NO: 168032 - protein, 56 aa, Glycine max
  Coding DNA Sequence Number=SeqID_76347
MWAIIDQYKEKLSLAATHEQRLEDEYAKVRFHLERESIASEIASQSKGDGGCILGP

SEQ ID NO: 168033 - protein, 108 aa, Glycine max
  Coding DNA Sequence Number=SeqID_76348
MSFIQMQSQMQSQGLALPPKTEVGPSVAHVSIKESCVDPSSPPRLVALGRVYEGSTTIHNIPLGNDQVKVDVEEGVEGLGKPADMPDPDMDPLYLMTLTILYLFLMPL

SEQ ID NO: 168034 - protein, 129 aa, Glycine max
  Coding DNA Sequence Number=SeqID_76349
MEEKKNKRLDEAAQSESTDTVVNPPSPIRQHVKWKMARMKRLGQITSEATKEITDRIRSFVTHGRQDVLIAAIGRPEHPSRVRAARASVTIKYYFGPTSRALRTSSSMGPKDLEHLTQKIKDQLKKSIT

SEQ ID NO: 168035 - protein, 101 aa, Glycine max
  Coding DNA Sequence Number=SeqID_76350
  Pfam annotation: Domain name=Chromo; Domain location=1-35; Score=8.5; E_value=0.052; Accession=PF00385.15; Description='chromo' (CHRromatin Organisation MOdi
MDPPRLKVLVQWKGLHPDDATWESWDELKAEYHLEDKVLFEAQGNVMNEAPQSPLTETQTEQLLTEKNQRQRRRVEALFELIKGLIKDSDGIPNDEVILVP

SEQ ID NO: 168036 - protein, 44 aa, Glycine max
  Coding DNA Sequence Number=SeqID_76351
MCSYSQSGALSGISPCSANMHNSSFFQILPRAQPKECCAQRMAH

SEQ ID NO: 168037 - protein, 220 aa, Glycine max
  Coding DNA Sequence Number=SeqID_76352
  Homolog annotation: Hit_ID=A7QUI1; Match level="QueryCoverage=100%, HitCoverage=51%, E-value=1e-45, Identity=48%"; Hit description =Chromosome chr10 scaffold_179, whole genome shotgun sequence
  Subcellular localization annotation: CTP_CleavageSite=25; ConfidenceScore=5.01e-01
MAGVAGSYDGAPVLALKLSSALLFSAATGMLLATNKIQPSQLAEEQRNTARLFKQLQTQIQTEIAIGNPSEGDVRDAIEKVLALDKAYPLPLLGGAMLEKFPAKFEAARWWPESRLSSNDEDKIMEIKNNNNNGWNVELEEEMREVIEVLKRKDMEDYERLGNIALKKNKGFAVSAPLLTGIVALGSVFSGDGLVPALAGALATVVNAFEHGGQVGMVFE

SEQ ID NO: 168038 - protein, 71 aa, Glycine max
  Coding DNA Sequence Number=SeqID_76353
MAVLYYDTMQSKEPFGVLIRKAKDSKKGEQKGLFLGFLDPSSPRLASCLPEPPNDFKVKKPALWASLLLHD

SEQ ID NO: 168039 - protein, 252 aa, Glycine max
  Coding DNA Sequence Number=SeqID_76354
  Homolog annotation: Hit_ID=A5AJA0; Match level="QueryCoverage=75%, HitCoverage=43%, E-value=8e-30, Identity=38%"; Hit description =Putative uncharacterized protein
  Subcellular localization annotation: CTP_CleavageSite=66; ConfidenceScore=5.17e-01
MSACGKITMSHIGHGPIGGYGASINMPNPSTQFPPMPQFVLNQSFYETSYNTITALDNLGTSDFPKAGVSSTASGWPSFNDIKAPPLTYSLSAEEKAIVAVLQLQHKVLEACQKFLVGDAGSDGDEDDEDEDKLVDDYDSKECEEYKFFEKVFAEDGDLRRYYESNQKEGDFHCLVCGGIRKKVWKRFKNCKTLIHHSTAILRTKRKRAHRACAQVICKVVGWDIDQLPAIVLKDLDSSLTGSRKLLVSNPN

SEQ ID NO: 168040 - protein, 143 aa, Glycine max
  Coding DNA Sequence Number=SeqID_76355
MAAQLIHDRVVMECLEGVWETLEGNERCRFHGTIRLTTTSLVHPEEPARTLQQPVEWILPTPTPYRLVEPVQVIEVSSSEEDPEEDPEELPPEPVVDALDFPEDDEDPLPDVDSPEDIMSVFEEDSTEESGPRGTTNSEDSSS

SEQ ID NO: 168041 - protein, 89 aa, Glycine max
  Coding DNA Sequence Number=SeqID_76356
  Homolog annotation: Hit_ID=Q53M83; Match level="QueryCoverage=59%, HitCoverage=5%, E-value=4e-07, Identity=49%"; Hit description =Transposon protein, putative, CACTA, En/Spm sub-class
MPYFGVIEEILEVNYVKFRVCVFNYKWVHSNIGVQTDDFGFTLILVMKDGQCLLVPTSVPDRTSSIKRCINYLCKKKENHAREMMCKNK

SEQ ID NO: 168042 - protein, 170 aa, Glycine max
  Coding DNA Sequence Number=SeqID_76357
  Subcellular localization annotation: CTP_CleavageSite=59; ConfidenceScore=5.55e-01
AHGYTTQLPPAHRPPESAVPSPSTSKKTRKATRLRSLATRPAGVERPLVHVDPVTGKVNSPHKKKLRMYLAIVAHDKVMIIGKKSIAQNDLIWEGERWRKFKSDLTSKWALAHGKEGEDDKDVQKKAQAIQKQNIAPHVLSRGGYDFLEKKVDGGEAKETIGGSSPIREH

SEQ ID NO: 168043 - protein, 43 aa, Glycine max
  Coding DNA Sequence Number=SeqID_76358
MAGVLFLLKQQNSLDITSDGIGYVCGGDGGGDHFHAAAAGVVE

SEQ ID NO: 168044 - protein, 189 aa, Glycine max
  Coding DNA Sequence Number=SeqID_76359
  Gene Ontology: Mol. function=zinc ion binding
  Homolog annotation: Hit_ID=A7QSS7; Match level="QueryCoverage=53%, HitCoverage=23%, E-value=1e-32, Identity=54%"; Hit description =Chromosome chr4 scaffold_162, whole genome shotgun sequence
MVFLRQSFYEAHRPLTSAHKVPLNLPHTLLTKLLLEKRVQANIAQMSLLEKDDVVGGDEEGKDVGDEVACIVAEGGVGQMASVILRRGTGAMRLGRDVLVLTQRTNSRSLAFLSESLNEGKDSEALAKYNLKAIKEFSPFNKYLIGEKAALDEWGSKYCLEWHDGLKGGSSFHQGDILISNKRIRSRPG

SEQ ID NO: 168045 - protein, 67 aa, Glycine max
  Coding DNA Sequence Number=SeqID_76360
MRKGEPENRVTRGIARYSRLRHIEIEWPLLALSVFCFVYNSVSGFWSLPSTLRLWIPYTSPRNFDRG

SEQ ID NO: 168046 - protein, 106 aa, Glycine max
  Coding DNA Sequence Number=SeqID_76361
MWTLQLTQEMLDHPEPLKLPHCTEVPLRACGNHMTVLRRHGPPLQWKVETLNPAIGGKGVVQPWYNFLEKMDFDDGDEISIYYRYYEKIWDIIIRRQEDWEDDDND

SEQ ID NO: 168047 - protein, 28 aa, Glycine max
  Coding DNA Sequence Number=SeqID_76362
MTVITLSSTLAANGGVNVLRGDERASTK

SEQ ID NO: 168048 - protein, 131 aa, Glycine max
  Coding DNA Sequence Number=SeqID_76363
  Gene Ontology: Mol. function=nucleoside-triphosphatase activity; Cellular component=signal recognition particle, endoplasmic reticulum targeting; Biological process=SRP-dependent cotranslational protein targeting to membrane
  Homolog annotation: Hit_ID=A2Q2E1; Match level="QueryCoverage=58%, HitCoverage=29%, E-value=3e-21, Identity=60%"; Hit description=GTP -binding signal recognition particle SRP54, G-domain
  Pfam annotation: Domain name=SRP54; Domain location=30-126; Score= -33.0; E_value=8.5e-09; Accession=PF00448.13; Description=SRP54-type protein, GTPase domain
MSSLGLTILQVPKAIYRCSLFHMRHFKRIRQSLALLTHGKSCMLVAGDVYKPAAIDQLAILGKHVDVPVYTAGTDVKPSEIAKQGLEEAKKKKIDVVIVDTTEVLLVVDAMTRQEVVGSSGLRIIKKGGLN

SEQ ID NO: 168049 - protein, 176 aa, Glycine max
  Coding DNA Sequence Number=SeqID_76364
  Gene Ontology: Mol. function=transporter activity; Cellular component= integral to membrane; Biological process=auxin mediated signaling pathway
  Homolog annotation: Hit_ID=Q673E8; Match level="QueryCoverage=100%, HitCoverage=33%, E-value=2e-79, Identity=83%"; Hit description =Putative auxin efflux carrier protein 6
  Pfam annotation: Domain name=Mem_trans; Domain location=2-176; Score=- 18.0; E_value=5.9e-07; Accession=PF03547.9; Description=Membrane transport protein
  Subcellular localization annotation: CTP_CleavageSite=44; ConfidenceScore=5.18e-01
MTDKEISFRDSTKVSKPADPKDTVASSQKMPHAFVMMRLILVVVGRKLSRNPNTYSSVLGLLWSLISFKWNMEMPSLIKASVKIISDAGLGMAMFSLGLFMALQPRIIACGTKRAVMGMVIRFMCGPLVMSASSISIGLRQERLHTAIVQAALPQGIVPFVFAREYGLHPDILSTG

SEQ ID NO: 168050 - protein, 336 aa, Glycine max
  Coding DNA Sequence Number=SeqID_76365
MFNGKNILSKPRIKGGFVQGDVRDGATILRNAGGLRLSQVVQDVHPGPMLRHQPLRGGVRSSGALLPLHLHEQPLSDGRQVHRGGHALEARCASISVPLGNFLPRRLFGLAHHSLLARHLAQHTCHGYPAAPSHVRRLHAIAYGATRRAPVHHMVHSTPLLVRVQSGDGSDPTAVPGANGGVHSEVRGRRRCDIARRPRHAAADGVGDRRPGPDPSADPPLGLIGAGDELLYRRQHCRCHAAAVQPLERGHILDQHAASPARRRRGLCRRRQSPPLRLRLVRRVLAAAHAEGVELQRDGGQHAGVGEVAGLRRERVPTVIAGGQSGVGVAGEMPGS

SEQ ID NO: 168051 - protein, 85 aa, Glycine max
  Coding DNA Sequence Number=SeqID_76366
EVVAAQLAQASSARPGEPGCFLQKQQPSGGIFWRAQATHKGWDLGSVDVGCTDKSSHSSVPDPYGWPLTEVDSRGGGDVSVAAYY

SEQ ID NO: 168052 - protein, 91 aa, Glycine max
  Coding DNA Sequence Number=SeqID_76367
  Subcellular localization annotation: CTP_CleavageSite=51; ConfidenceScore=5.02e-01
MVQPTNPRSIPRFSTKCDYMMWQWGVIIGPNLGPWAQKSTLRFMRTLGPSSAALAKSSWSLLLMDLVTGSFLGRIASIPASYGGVIPRHDA

SEQ ID NO: 168053 - protein, 213 aa, Glycine max
  Coding DNA Sequence Number=SeqID_76368
  Homolog annotation: Hit_ID=Q5BXX7; Match level="QueryCoverage=13%, HitCoverage=67%, E-value=2e-09, Identity=96%"; Hit description =Putative uncharacterized protein
RGGRCKTQGASPGGAVVGADLGGTGEARLIALCARTPKGNRPAHPGNGSAGGRVQRLEEHRTSRGVRQGKSAKWIRNLGKRIGSEGWARGSQSRTRRLSVDCSSCFRGESGSSRAGRGTDWERALRASSPGVEQSTQNCALNVKVKKFNQARIPTVPVYYPAKPQPRERAWRNQRGKKTLLPFVGSLSFCLPGANYVCARADGRPSPLLPLVP

SEQ ID NO: 168054 - protein, 218 aa, Glycine max
  Coding DNA Sequence Number=SeqID_76369
  Homolog annotation: Hit_ID=Q6WAY6; Match level="QueryCoverage=77%, HitCoverage=27%, E-value=5e-14, Identity=34%"; Hit description =Putative uncharacterized protein
MSCQHLRQTLRRRAALEGQRLVETLHHSRRLLRLEFIDRKESPVVAILADLYDTFDRRCEKRSTRIVFCTLTFYVWLVSYLFRQEVRHACPLESHRSCTEKRGANWDQLLASKEGASVNWFPCWKEGRTGVLISCVGFPNVPLMGTRGCISYNPDLAIRQLGYPMRGAPLEEELEPIIARGFNKTNVEALQKVHKAWEMVQKKDKELKGSNNGPIGGY

SEQ ID NO: 168055 - protein, 117 aa, Glycine max
  Coding DNA Sequence Number=SeqID_76370
MVHACHRAHHLWMTKGAEDDVSLCVPLDTTVSEWRKGVPNDHNLSLHARHLWMTKGVEDDVSLCAPSDMTVSEWRKGVWNDHNLSPHVIGSSRLWMTKGAEDDFSLCVPWTLNVSEW

SEQ ID NO: 168056 - protein, 74 aa, Glycine max
  Coding DNA Sequence Number=SeqID_76371
MSSNRTSSSKRLYFGTTSWIWLSCSLSNLLVEFIEEEDEDEFDLKEMREKERKRSMNSVNICPYGHYSYFPIEL

SEQ ID NO: 168057 - protein, 87 aa, Glycine max
  Coding DNA Sequence Number=SeqID_76372
MTATQQSDSPRHPPVTHDASFVEPHIPQVLEPAAAPTHARFDVDQPRHAVDACHAIVERLERLLNLRIVTAGTETHEVMEECIRIAR

SEQ ID NO: 168058 - protein, 74 aa, Glycine max
  Coding DNA Sequence Number=SeqID_76373
  Homolog annotation: Hit_ID=A5BEV8; Match level="QueryCoverage=78%, HitCoverage=7%, E-value=7e-09, Identity=48%"; Hit description =Putative uncharacterized protein
PFIHDFSHNIVDVKADGNCGYRLVADLLGMGEDSWSLVRTHLLKELGKFSDEYMKLFGGKERFEELRMSLLVDG

SEQ ID NO: 168059 - protein, 213 aa, Glycine max
  Coding DNA Sequence Number=SeqID_76374
  Gene Ontology: Biological process=transposition, DNA-mediated
  Homolog annotation: Hit_ID=Q1J7G7; Match level="QueryCoverage=21%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGNARVFPVTTLNSISTSGFHSWTPKYHLGFGYLGGMHGYSVYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 168060 - protein, 165 aa, Glycine max
  Coding DNA Sequence Number=SeqID_76375
LDWLAKLKVVSEESFEAPEEHEEVQALKSELGKAKFAKEKFKLAATHIRKECAGLREENAITARALEQETKRARKEEYGRNKFRGALWGSNSELKLRREERDQSRAHSMATMWMDRFALTLNGSQELPRLLAKAKAMADTYSSPRRDSWASRLLSAYDRLNGPHN

SEQ ID NO: 168061 - protein, 93 aa, Glycine max
  Coding DNA Sequence Number=SeqID_76376
MHALLGSFNSGNWSDSKVLDSAGLSCCAFTRNWDSLYTCSYSHLPLHTRHLFAEIAYQITQDPRMFDTRFLPFYITCAIRCTCRNPNTLACIR

SEQ ID NO: 168062 - protein, 122 aa, Glycine max
  Coding DNA Sequence Number=SeqID_76377
MTTLTWMTLLFSNILPSDHYANLPLQMYQLGSRPQDTQWTRRSPTGSWSCQALITGLCQFYGVPVTFSKGIRPPTNRAFIKKYCVPRQAQGETPQQPGDGRQRATDAPSSPLEFTSVHPQKG

SEQ ID NO: 168063 - protein, 114 aa, Glycine max
  Coding DNA Sequence Number=SeqID_76378
MLHIDPTTGKVDGPHKKKLRTYLGIVTHDKVDVTYKNWKQVPTAQKDLIWEDIQVESDIPEASDVRTKKKILQAVGRVDKDSVDDTVCEKYDISKEKWAQFCHSRRDPSWEGIL

SEQ ID NO: 168064 - protein, 124 aa, Glycine max
  Coding DNA Sequence Number=SeqID_76379
  Subcellular localization annotation: CTP_CleavageSite=30; ConfidenceScore=5.58e-01
MSRASSSSVFVLPGNTRDLEQRCLGSPFSRAVNSSRMGVVIPVPIFTSFFHCQFLSPLVPSFLMRPHLLVLMGDYPLQLWGKSHILVLFILRLIRFLLEIDGRVPGISTFEGLIVGSGVSNVKK

SEQ ID NO: 168065 - protein, 83 aa, Glycine max
  Coding DNA Sequence Number=SeqID_76380
MWYWSSGIWCWPNLITSSDMNGSGMEKEERERIRHFKEKISLEEDHHHRRPWIRAQRKKEMNEGRGREEHKILCSKRALKSEV

SEQ ID NO: 168066 - protein, 200 aa, Glycine max
  Coding DNA Sequence Number=SeqID_76381
  Homolog annotation: Hit_ID=Q0ZCD0; Match level="QueryCoverage=78%, HitCoverage=13%, E-value=6e-07, Identity=24%"; Hit description =Integrase
MEISMIDVASGGALGDMTPAEARNLIEKMASNSQQFSARNDAIVIRGVHEVATNSSSLAETKKLEGKLDALVNLVTQLALNQKSVLVARLCGLCSSADHHTDLCPSVQQSGAIEQPEAYATNIYNRPPQPQQQNQPQQNNYDLSCNRYNPEWRNHPNLRWSSPQPQQQQPAPSFQNAAGRNRPYVPPPVQQQQQQQHQQR

SEQ ID NO: 168067 - protein, 38 aa, Glycine max
  Coding DNA Sequence Number=SeqID_76382
MVNAVEECEPQRPKQMKDMGCFPRSYVFLNCGKEIRPT

SEQ ID NO: 168068 - protein, 179 aa, Glycine max
  Coding DNA Sequence Number=SeqID_76383
MAPTRHPLDPDKSNRALGFPALITGLCQSFRVPVAPSKVIRPLITRAFIDKYCTQRQAQGDAPQAAGAPPPPHQADPAGSFDTERYLRHSMRQHAANHRGLGQVHECLYQLSLNMQSQGFTPFPCPTPDQFKAEVAWPGDWPEAQAREAPVEAPDDGEEAGMDEEMSDLLGFLGGSGAT

SEQ ID NO: 168069 - protein, 99 aa, Glycine max
  Coding DNA Sequence Number=SeqID_76384
MRPDEVIPPKPIVPIIHETFEAGESQLRQEAATPERTPQTPEVHERQADPPTPIMEMPKDPTMPVLRLSSTPLATLVLHLTDEEDMQDTQGIQDQSQEF

SEQ ID NO: 168070 - protein, 241 aa, Glycine max
  Coding DNA Sequence Number=SeqID_76385
LECVGAFNACIKCMSLLGYKCEVKSHIGSPYVVARGPQVYPSNLPNNWYQSRWFDQVLTQTSMQVPQVARMVAMAILVNDKRPPLEGEATMWKRLTLEGEMCWVTSVRLPYMVAHGLQARQVPQVAMTILVDDKDFQSRGRLPCGRDSHLRGRYVGLQCGVRSPYVVARGSQLVAHVDDVTEQWGGCQIVVENVTLFITNIACSKRKRTRDTWGHMSTPMEAQYMALDRSVMGDPNHGFPS

SEQ ID NO: 168071 - protein, 354 aa, Glycine max
  Coding DNA Sequence Number=SeqID_76386
  Gene Ontology: Mol. function=transcription factor activity; Cellular component=nucleus; Biological process=regulation of transcription, DNA-dependent
  Homolog annotation: Hit_ID=A7QXY1; Match level="QueryCoverage=83%, HitCoverage=87%, E-value=6e-12, Identity=39%"; Hit description =Chromosome undetermined scaffold_235, whole genome shotgun sequence
  Pfam annotation: Domain name=AP2; Domain location=46-97; Score=69.7; E_value=9.5e-18; Accession=PF00847.11; Description=AP2 domain
MEEALRRLNGMGPTQDPDTTLSDHHPKKSATTKRGLRDTASSGGTMRYRGVRRRPWGRYAAEIRDPQSKERRWLGTFDTAEEAAFAYDCAARAMRGAKARTNFVYPDAADPHHHHLFQPYNINPKHCHVTRFVPNQNLNADFSANSHNNNNNNVSSSLNMVLFRDFLNSSSHHFHNNNNKSSSCYVNSSSSSAAANNCLQGCCFTNPNLGMEVAEAIDEESDFFPIESSDSGLLEEIVHKFLPKSKPKKETLSVPESLPPQQKFELKNVSAARGCADTRTRVPKVEAFGAPYDSSTMQHQFEAIHHGFNTMQGVSVERNNQFLMNHVAAGCSNLEDFLQYPEIFNSLVARMQNA

SEQ ID NO: 168072 - protein, 944 aa, Glycine max
  Coding DNA Sequence Number=SeqID_76387
  Gene Ontology: Cellular component=endoplasmic reticulum
  Homolog annotation: Hit_ID=A7QXY4; Match level="QueryCoverage=69%, HitCoverage=98%, E-value=0.0, Identity=60%"; Hit description =Chromosome undetermined scaffold_235, whole genome shotgun sequence
MKTLEEANVLVTSDYSTCLNSGLVGLLELHFFLSGISGGAMRLSSLKDHTRTFKNAILDSTSLSNITIFTAPKPFKGSIRTRQTLAIRSWLALSPYVTVVLFSQDPSVSSFADAFDSRVLVDTNIDFTFLGTPFFHSMVAKSRSYTSEISVIIDSETVILSGFISTLNHVYQLDHDWLLVASAQNVSSFPFHLDESGKHWQTDNRKRMNVQELQKILQHNWQGKHCCYSRMLMVWNNKDAPLHSGVLPPFLYGKGTHNNWLIHEAMSSEFRFVFDASLTITSFHLNEEDDFSPTHGNSSAVDIENRSWEYIGNSHIGANYGSFFYSEANFTSLVKLLKCNKQYIMVDTKKNIVYPIGHQGAMNLMKEKVIPSWLKENTVYCIDRLNSHTKSLDCSVKDQTKIPSILELPFSLESLLSITSDKTKTVILTVAGYSYKDMLMSWVCRLRKLSIENFVVCALDKETSQFSILQGIPVFTDPIAPSNISFDDCHFGTKCFQRVTKVKSRIVLKILKLGYNVLLSDVDVYWFKNPVPLLHSLGPAVLAAQSDEYQNQGPINLPRRLNSGFYYARSDSQTIAAIEKVVRHAETSGLSEQPSFYDTLCGNGGSNRVGDDKCVEPETNLTVHFLDRDLFANGAYQDLWREKNVKEACLKKGSYIIHNNWISGRLKKLERQVLSGLWEYDPSTRMCLRCSQSSKRDGETETFRVHNNFEVQAMLKRVVHSLDLVEQKEKDSRRKNRLRGREAPPTKDFVRGPDVFKFPHQSVFWHEDVPVPGHKYILISFRDVDKLKSKLLEEERSKEANGVVLETKTRSPSGHKDKVKVSNGVAGHEALETMITSGNGKMKEPNGVAGQEISVSLSPKDKVKSVEMVDTDMEGSLGEGGVEESFFSAKDFYAPKEKSTSTRPSRRKGLKGKKPFVAPLPKAKKLYRSLGWQPSLPTVKEPSP

SEQ ID NO: 168073 - protein, 280 aa, Glycine max
  Coding DNA Sequence Number=SeqID_76388
MPKQIQLYAVNVRENKKGGEGGGFTGEGSGAREGEDAGVAAKVTELAVGKTGEDFAAVAAEEFEVVAMGGRGAHHWVFVGFSGNEWDWGIMIFMYPSLIPEATGATGDIGCWRESCLRGHAVIAVGETTDVACIPPFSLASLVTWRESRPSHWQDMHSGLQSRRPGFSEHISSLLMAKAGLSKENESKACKFLIEHAAVCFLLSKLLQIFKAKAVYLKESPTPVSSFPVARTTASLQPISPEALATLSTLLDSPAAMAGKPRQSVSPTTMATCPHKQLPR

SEQ ID NO: 168074 - protein, 957 aa, Glycine max
  Coding DNA Sequence Number=SeqID_76389
  Homolog annotation: Hit_ID=A5BSI2; Match level="QueryCoverage=60%, HitCoverage=96%, E-value=4e-98, Identity=38%"; Hit description =Putative uncharacterized protein
MASWNFCISIFNAVDWAAKARAWADANAARESQHPQSHFSPAGRMQEQSHYHDQYQLSVDSHYTDVQNQTHPSASYQQFSYLDASVQRISGHSQEPASASLEASYNQDGHSCSARNGTGIGDSTVSFEQGNLPTNPSVHQQEVPSSYSSVAGYLAEQLMWDEKLSQCWVGVTAILWAKGSVKMASEKCSLSHATQMGGHYRLQASDEGGWGKIEFLLKSSSKEAAEQIQQSYSAFPLSSSSSQEHHVQPSMHAPPFASGCHSVDSAISLADQPLDFAPRFNRDSDLQMQSTYSHHDSSSSMNNWVSPVAPGVGYPPIPPILSSGQQHDPSITTPGHVAPPFGRFPGPGLPSTIQPTGAPFTLSTGTTIHPTVAFSADVYGVSGIPDRPKKASVPNWLKDEIKKKVIPAPAGNLKEETFVNDGIDKSYARGDEADSKSIDSSRSAEDEEDEEDQVEAARTAAINLEIKRVLTEVLLKVTDELFDEIATKVLAEDDFTAEGYNNVFSVVGHKVATSNHKASASPPSATVPKASAKVFVPIKEKVENVDASEKSNSSSPGDVLGLGNYGSDADDGDNEIESSSVPTPAKDAAYKSGIKKPLSDTHDLSVNGISQLDEHAISETNLVNNQVKTISLPSRSSNGAATDQLHDDKVTKESNHSHSSKVVSEDLRDNGLNFIERNHDRFNGFSSKDTSGIPRSELPGKNISVEKAMDDHSGRESRKKSEKNDRPDRSTSEKDFVKEVHSSKTKIDEKGNENQRRKDERNQKRDKTDYGSEAKERVKQHSLRHGEKAKESDSRKRSSHVDVKDDKKEAEKSHRGSATDDTSRKREHAKDKGEHKSRQKDASNNDRHRRRRSSSVSSRGRTKKDCINHAGDSSGSCIQESVTYHRLQSDLKEDNFCGLLIASVLSAGILPILLLILPGEGGQDPDHLFGGRDEWMGTEMVDFASTVFIQENINLEA

SEQ ID NO: 168075 - protein, 41 aa, Glycine max
  Coding DNA Sequence Number=SeqID_76390
  Gene Ontology: Biological process=regulation of epidermal cell division
  Homolog annotation: Hit_ID=Q8S8F8; Match level="QueryCoverage=80%, HitCoverage=11%, E-value=1e-09, Identity=84%"; Hit description =GLABRA2 expression modulator
MMRVISVDNHEFWFMGFLNYDGAVESLQDALQSGRQIQSEA

SEQ ID NO: 168076 - protein, 268 aa, Glycine max
  Coding DNA Sequence Number=SeqID_76391
  Homolog annotation: Hit_ID=A7P917; Match level="QueryCoverage=71%, HitCoverage=39%, E-value=6e-65, Identity=63%"; Hit description =Chromosome chr3 scaffold_8, whole genome shotgun sequence
MVGLSFTTLGQRNLKFQQGSLPPQPRRGSRRWLDPVAFHRPGAFLHERLHHRGGQGVDGAGSVTGGAGTLRGVCALEEKKVVKLIPFLSEKESKELVARVWPSREDSCDAMLQGLISSAMNSYDNITFVKAFIGKILWDLSLRETAKRVLEKVFRMSLKTVKELLEDYLSPVFRGDLNETGAVQRLNLHKASTNGKHLLWLVERMIELRVVDVAVREWSEQVVFTADLQRAFRDDAWRNIVPGLPAVILRCTFRLTNVVSASTILASR

SEQ ID NO: 168077 - protein, 199 aa, Glycine max
  Coding DNA Sequence Number=SeqID_76392
MALNLLRIQIPDELQEQAKQGAFVPHGRQDILNTAIGRPEHPGRVPVGGHGVTITSYFGHASCGSHSSSPAITAERLVEIIQTIKQEVKKEVEDENKDRMDKMKMELDAIKSELSQIHTQQSAPPRPSNPDVFVARVSTKESCAEAANNVVGNERSTFDTCSMGFYIVCGDSTQLVAGGKVFGVGGIIHTVAYGDDVVR

SEQ ID NO: 168078 - protein, 213 aa, Glycine max
  Coding DNA Sequence Number=SeqID_76393
  Homolog annotation: Hit_ID=O49696; Match level="QueryCoverage=27%, HitCoverage=9%, E-value=2e-16, Identity=69%"; Hit description =Putative uncharacterized protein AT4g17970
  Pfam annotation: Domain name=UPF0005; Domain location=36-196; Score= -67.3; E_value=0.027; Accession=PF01027.11; Description =Uncharacterised protein family UPF0005
MAETNTSIKSSRQLRYVYSFADKVKSFPGLARRATWKVGKEDPRRVVHALKVGMALTLVSLLYLMEPLFKGIGKNAMWAVMTVVVVMEFTVEVVRRKNNSPVTTTLGYTPAKGGDGAEATVPRRRRGRFFEPLKEFRKEEVTLQVDGSNDHIIVKGERQTNEQKHVHFELAFPFPPDSDVDNISGNFNREILHMHVPKQASNTLVNRNEPYNK

SEQ ID NO: 168079 - protein, 168 aa, Glycine max
  Coding DNA Sequence Number=SeqID_76394
KRKSAQYANRLSPRVGRFINAAGTTGFPTGKRAVSATQLIYDHDYEFELVPARCTLSACIVFVVWEAPAERALPSFVPCLAVRAKPLRRLSVMLPANHYMNNPDPKSYLLVWKLREKVTRKLGAPWRQLRGWAVSKTAQEFMTCVLSAHVAAKRTKGSVPWLPLRFKI

SEQ ID NO: 168080 - protein, 60 aa, Glycine max
  Coding DNA Sequence Number=SeqID_76395
MRRGGGGERKADPLIYRCKIGLWAFVVSLSVKPRAQCHCALSVCPALSASPSCALGMPCA

SEQ ID NO: 168081 - protein, 99 aa, Glycine max
  Coding DNA Sequence Number=SeqID_76396
  Homolog annotation: Hit_ID=Q6WAY3; Match level="QueryCoverage=40%, HitCoverage=1%, E-value=2e-07, Identity=62%"; Hit description =Gag/pol polyprotein
MVAITPARFPQSPFFRGYDSNATCACHGEAPGHSIEHCRALKHKVQGLIDAGWLNFEENHVIFKCKPLVCLLKQPVLLSLDFQDRSIRDYSSCTLVGVP

SEQ ID NO: 168082 - protein, 135 aa, Glycine max
  Coding DNA Sequence Number=SeqID_76397
MSVEQFIKKVPWPGARPSFVGDNESFTAQAPQPHELELENDHSSKAIIPRAVDFLKRRFETRSNEAAHPEPMPVSADALFPGVDPSLAQHATDFSTPVLEIPEGQTIPVLTLDTSPPAILVLHLTDEEDVQTQDT

SEQ ID NO: 168083 - protein, 102 aa, Glycine max
  Coding DNA Sequence Number=SeqID_76398
MVITFHTEVLSYPNFVRGPLLDDVRPFFGPRETYQGNPCGVYPDLSSFTGSGVYPDLSSLTGSGVYPDLSSFTGSGVYHDLSSFTGSGVIQTFVACIKRSAP

SEQ ID NO: 168084 - protein, 196 aa, Glycine max
  Coding DNA Sequence Number=SeqID_76399
  Gene Ontology: Biological process=transposition, DNA-mediated
  Homolog annotation: Hit_ID=Q1J7G7; Match level="QueryCoverage=19%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPEFDVCIQLTELNIPVHRAEFNHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 168085 - protein, 127 aa, Glycine max
  Coding DNA Sequence Number=SeqID_76400
MLVHMIHTRLFAVARVKPCPGMHSSCVIASLSGCARTVGALQYHGVAQELIKGNYWPLNRECKSRMWNPLKVRTRSPLKVRACNPLKVRTCSPLKVRTCSPLKARTCSPLKVRACSPTKARTCSPLK

SEQ ID NO: 168086 - protein, 110 aa, Glycine max
  Coding DNA Sequence Number=SeqID_76401
  Homolog annotation: Hit_ID=UPI0000ECBAF8; Match level="QueryCoverage =60%, HitCoverage=75%, E-value=5e-18, Identity=74%"; Hit description =UPI0000ECBAF8 related cluster
GRHRGGAPIRPIVSRITIHWPSFYNVVTGKTLALPNLIALQHIPLSPAGVIAKRPAPIALPNTVTATLASADVRRCFCRYAPPPSVAEQEGQLIETEATGAPQKHHHTLN

SEQ ID NO: 168087 - protein, 180 aa, Glycine max
  Coding DNA Sequence Number=SeqID_76402
MTTLAQTWSVLSFSNLIPTSYTSDVTLDRAKLIYGIIMKMDKNVGYLISHQISLTAQHDTSRLRFSTLITALCKARGVQSDSRSLESLSPTINLDYIKKNYWNLDDPIVTFSGPRKARGKRSEALSTLSTSSPSSSTLPPSSSTQIPVIPPTPSQIPLPAPLSTGPTDFIFTPQMLHSML

SEQ ID NO: 168088 - protein, 236 aa, Glycine max
  Coding DNA Sequence Number=SeqID_76403
  Gene Ontology: Mol. function=chloramphenicol O-acetyltransferase activity; Biological process=response to antibiotic
  Homolog annotation: Hit_ID=P62577; Match level="QueryCoverage=80%, HitCoverage=86%, E-value=1e-111, Identity=100%"; Hit description =Chloramphenicol acetyltransferase
  Pfam annotation: Domain name=CAT; Domain location=6-190; Score=429.6; E_value=4.6e-126; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQWLLPVVLLHVFPGWTQDDSYRIRRSGRTERGVRAYSPAWSELPTRN

SEQ ID NO: 168089 - protein, 88 aa, Glycine max
  Coding DNA Sequence Number=SeqID_76404
MRSFNGDFPPWRCSGRQRRIGKNPILLEWPKYKAQKKEKPILIFTKKSGFNLDPWAQKSTLRFMRTLGPSLVAVAQASWSLLSNTLGG

SEQ ID NO: 168090 - protein, 210 aa, Glycine max
  Coding DNA Sequence Number=SeqID_76405
  Homolog annotation: Hit_ID=Q6WAY4; Match level="QueryCoverage=88%, HitCoverage=33%, E-value=5e-20, Identity=34%"; Hit description =Putative uncharacterized protein
MGTNQTRKRFYQVKIKGLDVTSLKELGRLMGPLQMQAFRKAYRKILDLTIAEIFTEAVVSLTQYYDQPLRCFMFGDFQLVPTVEEFEENLGCPLGGRKPYLFSGFLPSLSKIAVVVRGSARELDHVKQTRNGIVGLPRKYLEGKARDMANQEEWVSFVDVLALLIFGVVLFPNVDGLVDLAAIDAFLAYHHSKESSVVAILADLFDTFDR

SEQ ID NO: 168091 - protein, 256 aa, Glycine max
  Coding DNA Sequence Number=SeqID_76406
  Homolog annotation: Hit_ID=UPI00006A2D9E; Match level="QueryCoverage =49%, HitCoverage=86%, E-value=2e-10, Identity=16%"; Hit description =UPI00006A2D9E related cluster
ATRRRFQGLHAFAFRGLHALAIRGLHVLAFRGLHALAFGGLHVLSFRGLYVFAIRGLHTLTFRGLHVLAFRKLHALAFRGLHALTLKGLHVLTFRGLHALAFKGLHVLAFTRLHVLAIRRQHILAFIGLHVLVFRGLRALAFRGLRVLALSGLHALALRGLGLHVHDFRGLHALAFEALHALAFRGLLILTFRGLQVLANRGLHTLAFRGLHVLAFRGLARPRLQKTTRPRLQRTARPHLHRTTCPCLQRIARPHL

SEQ ID NO: 168092 - protein, 423 aa, Glycine max
  Coding DNA Sequence Number=SeqID_76407
  Gene Ontology: Mol. function=hydrolase activity; Biological process =queuosine biosynthetic process
  Homolog annotation: Hit_ID=A6T5I7; Match level="QueryCoverage=37%, HitCoverage=73%, E-value=5e-63, Identity=72%"; Hit description =Queuosine biosynthesis protein queC
  Pfam annotation: Domain name=ExsB; Domain location=153-293; Score =163.8; E_value=4.7e-46; Accession=PF06508.4; Description=ExsB
MAQALVPLLAAQGCTLTCVFHDVKSWRDDIDLSDADIIMGDRLIGDAPQFTLVNWLENDAAWQPLRPAVLQAPLHAIARQASPALRSAAIHQLFQQLMRDGHLLPLFNYRYQVFAPPGVEGIQLNSMGWFDFTRAWIPPPAAGGAVQPAPEPALQQYDEVHCVTFDYGQRHREEISVAAELAHQLGARAHKVLDVTLLNELAVSSLTRDNIPVPAYNPQASGLPSTFVPGRGSRSGDYRRMRNRFSGYPDCRDEFVKALNNAVTLGMARDVRFETPLMWLNKAETWALADYWQQLPLVRSETLTCYNGVKGDGCGQCGQRDGGDETEKRPALIAAALRAGVLSGHASSGSRDLALNVQHVAQHRRTTIVNVDIHHHKRQLLLQQPVKGIGIFQPLPARLFQKFQAENDNWLDLLSIAQPDGPL

SEQ ID NO: 168093 - protein, 29 aa, Glycine max
  Coding DNA Sequence Number=SeqID_76408
MAFVDNWVVGKEKGNTWAARSLQLWKRIL

SEQ ID NO: 168094 - protein, 60 aa, Glycine max
  Coding DNA Sequence Number=SeqID_76409
MMGDVSKFTTISPKSGHVTYDDNNISKISKETKDQAECFDDAKGSHKKLKIFKMDDQDSL

SEQ ID NO: 168095 - protein, 25 aa, Glycine max
  Coding DNA Sequence Number=SeqID_76410
MGAKYLKAVKKRLHAIKQWSSDEIR

SEQ ID NO: 168096 - protein, 200 aa, Glycine max
  Coding DNA Sequence Number=SeqID_76411
MDGKAFSWQRHYIQQPSCKDKSWEQILHDVAYRFDDSVFDDPVAELSKLKQEGDLGEYLEAFDSPLARVGSIMSLQQNYHTESTSSPTIADSKGNTSTSISRKEVSDRIAKGLCRLCGDKWDKNHTTKCKVWGKLNAIFFAQEEIDVEMMQKNDREDEQAIIDTSIDMIQDVDVHISLNALQGIAGGSMFKLGKCTRLRK

SEQ ID NO: 168097 - protein, 47 aa, Glycine max
  Coding DNA Sequence Number=SeqID_76412
MTKNERRTMKNGEKREVVAAQLAQASWVASTRRHRLLLEPPRRLKWA

SEQ ID NO: 168098 - protein, 199 aa, Glycine max
  Coding DNA Sequence Number=SeqID_76413
LVYAILTRMSIHVAQLIANAIYPFAGMAPTRHPLDPNKSNRALGFPALNTGLCQSFGVPVAPSKVIRLPLTRAFIEKYCTQRQVQGDAPQAADVPPPHQAGPDGPFDSEQYLRHVVRQQAANHRLHVQTHDCLYQLSLSLQSQGFTSFPCPTLDQFRAEVAWPGDWPEAPTEAPDEADEAREDEEMTDFLDFLGGSRAT

SEQ ID NO: 168099 - protein, 112 aa, Glycine max
  Coding DNA Sequence Number=SeqID_76414
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=54%, HitCoverage=48%, E-value=1e-25, Identity=93%"; Hit description =Putative uncharacterized protein
MPPPPPPQIQFALCESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 168100 - protein, 206 aa, Glycine max
  Coding DNA Sequence Number=SeqID_76415
MGASEHPLNMHIQGAQVVVSAPRKMAEWWKAEEVMVARVMLGNGYEPKMGLGKDNGGRTILKSTRGNRGKFGGGQGSRLGQEVEGGPPCHISRSFISAGLGHKDQVIEICEEDSPSGLDLVRPCPPSFRLGNWQVEERPDIYATSIISDDESLEGTITWDPTIDFEQEMDQMEDEENEDVGLPPELEKIVAHEDQEMGPHQEETEL

SEQ ID NO: 168101 - protein, 278 aa, Glycine max
  Coding DNA Sequence Number=SeqID_76416
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIRTQEATHHMHVNAIVHQYTAQYWYAPFQTDSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168102 - protein, 399 aa, Glycine max
  Coding DNA Sequence Number=SeqID_76417
  Gene Ontology: Mol. function=transporter activity; Cellular component= membrane; Biological process=transport
  Homolog annotation: Hit_ID=A8GBY6; Match level="QueryCoverage=57%, HitCoverage=65%, E-value=1e-106, Identity=83%"; Hit description =Putative uncharacterized protein precursor
MGTINAGYSYSKDYQQSSLGVAGGIVAHSGGVTLTQPLQNTFVLVEAKDAKGVRIENQPGVAIDRFGYAVMTSASPYRHNRVALRTEDIGNGLDIPMAARDVVPTYGAITRVKFETHTGQSLGSPAGEMGQRRGRKLLTGGAGIESGDRTADGLSGTFADLRKTVKGKDMSSLLKHKNLGLAAGLLVTLGTFSQSSYALSCKQNGSIRQDIVLDKAIKVSTANTAPGALLWRSQTFTSTFQCTDDWNNPKGENAYLYWDPQSRMSQIHNSIEVGVTYQGIDVKPTKGARQDVGPGTECRRSGSRCLSPARSLTVTVSYAIYIKATGKAPPAGGKINDNNSYSVFQVDGVGGLNGTPNSNFNAYISGLGNIQFISCNPKITVVANNGSTVNFGTIPRQNA

SEQ ID NO: 168103 - protein, 174 aa, Glycine max
  Coding DNA Sequence Number=SeqID_76418
  Gene Ontology: Mol. function=aspartic-type endopeptidase activity; Biological process=RNA-dependent DNA replication
  Homolog annotation: Hit_ID=Q6WAY3; Match level="QueryCoverage=26%, HitCoverage=2%, E-value=4e-09, Identity=56%"; Hit description =Gag/pol polyprotein
MVVRAFDSSRREVMEEIDIPIQIGPHTCNVVFQVMDINPAYSCLLGEAMDSRARSGPFNALPEIEIPGWWTLGDSVRRRGYVGKLPLLRTICRGSGRIIGNSFPILRGGKLCLCGNKSIAIVATCPSRARLTGALSKGGKMCGVATNVYLWETSEKPKETGQNENSKFGSCIYA

SEQ ID NO: 168104 - protein, 194 aa, Glycine max
  Coding DNA Sequence Number=SeqID_76419
  Homolog annotation: Hit_ID=Q6WAY6; Match level="QueryCoverage=75%, HitCoverage=23%, E-value=7e-15, Identity=35%"; Hit description =Putative uncharacterized protein
MGWLGYQGSAWKRKQKLWRIKKNGLVDLAAINTFLAYHHNKESPVVVVLADAYDKFDWRCKKSNTRIICCTPALYVWMVSHIFHHESRLVCPLQGRHMCAEKGKTNWEELLEGMVEVSINWFPRWKEGGAGVLCSCEGFPNVPLMGTRGCINYNPMLAIRQLGYPVRRAPSEEIIVLLIARGFSESNAKMLQRV

SEQ ID NO: 168105 - protein, 65 aa, Glycine max
  Coding DNA Sequence Number=SeqID_76420
MEGGQEVLKRKLCTKRIFGHALSQESQAFSAQPLHLRLIWSAKLAKAELSQLQFDLNLAKQQLDR

SEQ ID NO: 168106 - protein, 263 aa, Glycine max
  Coding DNA Sequence Number=SeqID_76421
  Homolog annotation: Hit_ID=Q5W7C9; Match level="QueryCoverage=60%, HitCoverage=63%, E-value=4e-38, Identity=56%"; Hit description =Unknow protein
APLSFKRIRGMSSPGGILNALATALHGSIRTAPSIHRLRLGLLGYLIPFAPLAFVSQCQCRPSRVLSPLVFFPISTHFTAPPEIPSAPTVLQLDALRPIIPDNACILCLTAAAGTELADAYSPDTVIASSPGKRIPVWLIILSDPATDHRLGKLLPHQLANQTRAPPRADSSFCSSAYGVLAAVSSCCSPPKGRIELSMRFLVALLIASLFVDKADSEFSSIPRHNLYPGASYSTGVRSQKYSPPTPRARTDNFHHVKVTLYR

SEQ ID NO: 168107 - protein, 148 aa, Glycine max
  Coding DNA Sequence Number=SeqID_76422
MGGYVGARASLLSTIPPFVAMTQELVARGDTLRLSAPRHSVTPSVIDEQRPIWSSAPFPEMSAFSDGDFSSLTNYLEQRRGGGPDDTRRYLTVIRTLLSSRGGGPDDTRRYLTVIRTLLSSRGGGPDDKQRQNLVILHPCIIQRRRAR

SEQ ID NO: 168108 - protein, 371 aa, Glycine max
  Coding DNA Sequence Number=SeqID_76423
  Homolog annotation: Hit_ID=Q6WAY6; Match level="QueryCoverage=73%, HitCoverage=44%, E-value=9e-14, Identity=26%"; Hit description =Putative uncharacterized protein
MKVDPSVPYKVTACVSRKGRQTGSNSWLEGRAGVLSSCEGFSNVPLMGTRGCINYNPILAIRQLGYPMRGASSEESITPFIARGFSDPNARIFQGVRKAWCAVQRKDKEIKGSSNGIIDGYHKWLNARTQGLDWLLKLKVLREEEAETPEESEEVQALKAELERAQAVKEKFKTMTIKVRKECDELRDINVATAEALERETKRAQKEECGRNKFRGALLGSYSELKLRRAERDQSRVEGMILEDKLKACQRSKRSLSDQLRKMEENMWVIVDQYKEKLSLAGTHEPKLEDEYAKVSVLQAEREAKERAIDSLHREAMMWMDKFAFTLNGSQDLPRLLAKAKAMADVYSAPEEVHGLLDYCQHMIDLMAVSR

SEQ ID NO: 168109 - protein, 21 aa, Glycine max
  Coding DNA Sequence Number=SeqID_76424
MRPPPSSAEPPRKEMERRKSS

SEQ ID NO: 168110 - protein, 77 aa, Glycine max
  Coding DNA Sequence Number=SeqID_76425
  Homolog annotation: Hit_ID=Q2QVS8; Match level="QueryCoverage=62%, HitCoverage=4%, E-value=5e-09, Identity=56%"; Hit description =Transposon protein, putative, CACTA, En/Spm sub-class
MGFTLLDLQKLAYKDEPFIMAKQVRQVFYIEDPCNSRRSVVLLGRPTVMATPPRSLLHSDAPSEVKCQKLGSAKANN

SEQ ID NO: 168111 - protein, 311 aa, Glycine max
  Coding DNA Sequence Number=SeqID_76426
  Gene Ontology: Mol. function=oxidoreductase activity; Cellular component=mitochondrion
  Homolog annotation: Hit_ID=Q0ZHB8; Match level="QueryCoverage=99%, HitCoverage=50%, E-value=1e-138, Identity=78%"; Hit description =Mitochondrial L-galactono-1,4-lactone dehydrogenase
  Pfam annotation: Domain name=ALO; Domain location=2-304; Score=-72.7; E_value=3.3e-05; Accession=PF04030.5; Description=D-arabinono-1,4 -lactone oxidase
MNSEISGGNWKLLSENKHVKYLYIPYTDSVVVVRCNPVSKWKGPPKFKPQYTKDEAIQHVRDLYQESLKKYGAEGSKGKSAEDGEQNIDELSFTELRDKLIALDPLDKKHIININKAEAEFWRKSEGYRVGWSDEILGFDCGGQQWVSETCFPAGKLANPSMKDLEYIEELKQLIEKEEIPAPAPIEQRWTASSRSSLSPASSPSEDDIFSWVGIIMYLPTMDARQRKDITEEFFHYRHLTQAKLWDCYSAYEHWAKIEVPKDKKELAALQERLRKRFPVDAYNKARKELDPNRILSNNMLEKLFPQSDTI

SEQ ID NO: 168112 - protein, 140 aa, Glycine max
  Coding DNA Sequence Number=SeqID_76427
MEMDTQNVILAPNKLLTQQIEALTDKSTSSTISTRMKPYLNRTSKETTKATEVAQDNGEKKNKDGVEKEKEKNDGLVTSETVEEKVVSEEEKQKSNKQATNKGKVVVNRPPIEYFPYLHAPSKKDKERQYKRFLEIFKRL

SEQ ID NO: 168113 - protein, 490 aa, Glycine max
  Coding DNA Sequence Number=SeqID_76428
  Gene Ontology: Mol. function=protein binding
  Homolog annotation: Hit_ID=A7Q041; Match level="QueryCoverage=86%, HitCoverage=84%, E-value=1e-112, Identity=52%"; Hit description =Chromosome chr8 scaffold_41, whole genome shotgun sequence
  Pfam annotation: Domain name=DUF593; Domain location=63-156; Score =182.5; E_value=1.1e-51; Accession=PF04576.6; Description=Protein of unknown function, DUF593
MASEVAPSSGDLLKCCNCGCGCSLVAHSSGTWMRSVKRKLDEFKMDGQLPIPAIARIEVENECVALREMVSMQQRTIQDLNAELEEERNSSSTAANEAMSMILRLQREKAEVQMEARQFKRFAEEKMTHDQEELLSLEDLLYKREQIIQSLTCEVQAYKHRLMSFGLTEDEAEGDQYELPTYEYPPLKCNVMHDGMDAGNDDTDIEKYAFGETPSDRLRNLENRISQMEKTPTYSRMDGDFTGKNILEKVIVGQSPRRIKHSRRFSSDSASLSGIGKEIGPESMMDSPKLNSNYRRDYFSESEDPSNFKKVHNASDGDDMSDRIYTIDSVHCGAPYNGFTDSKAGGFEDYATTPRESGNHATDFEDPYIKKLYMRLQALEADRESMRQAIISMRTDKAQVVLLKEIAQHLCKEMSPKRKMARKLYFSGNSNSSFVSIFKWISSIVFWRKRAHQSKYMFGLPPESVGLLMLLDKGMHARPWRCVSSTQVGD

SEQ ID NO: 168114 - protein, 127 aa, Glycine max
  Coding DNA Sequence Number=SeqID_76429
  Gene Ontology: Cellular component=ribosome
  Homolog annotation: Hit_ID=Q67V33; Match level="QueryCoverage=48%, HitCoverage=21%, E-value=8e-10, Identity=54%"; Hit description =Ribosomal protein-like
  Pfam annotation: Domain name=Plant_tran; Domain location=1-84; Score =23.7; E_value=6.3e-10; Accession=PF04827.5; Description=Plant transposon protein
MAHQQSFLKSWSHKTYGVGKHIFELQATLMKTIPRPQGHKTKLFAQHQEAIRKDVDHTFGVLQSWFMIVHGLAYGWSILLIASAKCNTHGLSTRKTLEEDELYKPGLEVGADLRAWDEFVSDCEILE

SEQ ID NO: 168115 - protein, 114 aa, Glycine max
  Coding DNA Sequence Number=SeqID_76430
MVVSFKDEDYPWFANMENFKATEQPPEGIKFHKRKRFFGEATKENKLAYFHIATTHHMEATSTEKEQLQRSFKPDSISLNSSKMLITMHDHATTVNELTTYLDDMKCHYRTCTR

SEQ ID NO: 168116 - protein, 136 aa, Glycine max
  Coding DNA Sequence Number=SeqID_76431
MDERLLAYTIAWIFLARGGNHATLMIGDLIAIQTMKDKVMEHYGMDFMDEKFKILTAPELEIMAQVPKVEEKPLSPFEITLLRKIDQIYNWQLQQNETQNEHLNNISKMLNIIKASLRKHHIGDDILYLLCLFMML

SEQ ID NO: 168117 - protein, 83 aa, Glycine max
  Coding DNA Sequence Number=SeqID_76432
MNLEERSRIFAKIGEKLAAQLAQASKVASSRSNNLLEESSGGPKWACFRRSYGNSRIAQKHLFSTSATLRNFTDRASLLPFDF

SEQ ID NO: 168118 - protein, 170 aa, Glycine max
  Coding DNA Sequence Number=SeqID_76433
  Subcellular localization annotation: CTP_CleavageSite=30; ConfidenceScore=5.34e-01
MASFSGHRHGLMRVFSTRQTDMLRRALSARVVSVQAAFFTPTTPPPSDPIPGVWGQSELQCLHPLCNLDFRLIVLCCCRLCVLVQGTQFLYKFNMPSQRPFVDAYLQLSMPVFDDPDAATAPPSAATRAPMHMHLTLSMRALFTGEPYPSKLWASIDWCRAIIYSARPHG

SEQ ID NO: 168119 - protein, 92 aa, Glycine max
  Coding DNA Sequence Number=SeqID_76434
MSVLELYIEKDVAGGSMFPSANSLTSCGNYLSNDETQPPTNMSNLHVDEDDDDNDYLVSNTYVEESNSTAFIFRLKFKTILQDYKLQHQDDH

SEQ ID NO: 168120 - protein, 54 aa, Glycine max
  Coding DNA Sequence Number=SeqID_76435
MEMQRKIKEKRRKSDAILPRKGPVTKAMSKRLQEDWVRTVEEGPRVLMNLRVDF

SEQ ID NO: 168121 - protein, 97 aa, Glycine max
  Coding DNA Sequence Number=SeqID_76436
MAASKTVQNRNRKSLITNVECAFCTNCLNAFILYDLVKACKKYSNMGDCFWLIDKDLVMQSYPARALARRLQVDWARDPRKGPRVLMSLRVDFEPMG

SEQ ID NO: 168122 - protein, 37 aa, Glycine max
  Coding DNA Sequence Number=SeqID_76437
MKVFMMPKYYLKMVVIIKKGENVNEYHASFDDAKKVT

SEQ ID NO: 168123 - protein, 166 aa, Glycine max
  Coding DNA Sequence Number=SeqID_76438
  Subcellular localization annotation: CTP_CleavageSite=54; ConfidenceScore=5.17e-01
MWDRHRLKGTLKSSVFTPKAYTPKSLSRPLPPDLGFSSVREKEKGLKPSLHCLCAMSISPVAKSSLKIPMMEKCRNEFQTRCSNFTMIQWCELMTLQRPTNPSPWSDSQEYMITYNKFKVLYSPIMVALLPTLGCSHSLLVQLDLFSGLLNHLRSKGNALTGIYPT

SEQ ID NO: 168124 - protein, 75 aa, Glycine max
  Coding DNA Sequence Number=SeqID_76439
MIRFSGLLTTSRAANRSRRRNPNTSPDHSIGRSDGRLPGPVGQGYRLVEYISVARVRPRTSKGITDLLLPQTSVA

SEQ ID NO: 168125 - protein, 349 aa, Glycine max
  Coding DNA Sequence Number=SeqID_76440
  Homolog annotation: Hit_ID=Q6FDK6; Match level="QueryCoverage=72%, HitCoverage=97%, E-value=5e-26, Identity=31%"; Hit description =Putative uncharacterized protein
MEVAKEWVAAKKISWGSVIGGVITVLAVSLLLSTLGTSLGFSIVDPTSDDPINGAGTTVVIWSAVSIIISLAAGAFIAGRLAANDGLIHGFLVWATSLIVAAVLGGMLVGSAVKATGNALGAIASTSGSLLSGAGSAIGKGATGLADVGGKVFDKLGIDTTLEPEQLHGDVVTALKKSGIPSLQPEFMQQQLNAAKTDLADAVKALALQPDNSDAIIKQLVDKLKKHGEAISQDVDQDTLKKALVENTNMTPQEVDQTVKNLVDAKNKTAQLVNQRLDEAEAKINQAKQEYAELKQKAREQAAAAADELSRAALWSFFALLIGAVVSALAGLWGVNTNARRVTVSSPQA

SEQ ID NO: 168126 - protein, 133 aa, Glycine max
  Coding DNA Sequence Number=SeqID_76441
MPPTRHPLDPDKSNRALGFPALITGLFQSFGVPVTPSKRYLQHLVRQQAANHRGQVQTYKCLYQLSLSLQSQGFAPFVCPTPDQFRAEVAWPGDWPEAQTREAPAEAPGDTEEACMDEKMTDLLDFLGGSGAT

SEQ ID NO: 168127 - protein, 154 aa, Glycine max
  Coding DNA Sequence Number=SeqID_76442
  Homolog annotation: Hit_ID=A5B326; Match level="QueryCoverage=76%, HitCoverage=9%, E-value=1e-11, Identity=33%"; Hit description =Putative uncharacterized protein
  Pfam annotation: Domain name=Retrotrans_gag; Domain location=54-131; Score=4.1; E_value=0.022; Accession=PF03732.8; Description =Retrotransposon gag protein
MGSMNSMMEKLFKQVQLFRSQIKFRRRRRGGQRGRAKAEQLFELENTPQAQWGKLWLLSMEGKAFVWQRHYTTHNNNKMKSWQQILQDVALRFDMGNYDDPVSELSKLRQEARVDVTKEMAISFFLGGLHASLEKSVCIHNPSSLQDAMRLARL

SEQ ID NO: 168128 - protein, 225 aa, Glycine max
  Coding DNA Sequence Number=SeqID_76443
  Subcellular localization annotation: CTP_CleavageSite=15; ConfidenceScore=5.07e-01
MTSRDQVGHSATLVSSKKTAGPMIRGDTLRLSASFCHPEAAGPMTSRDQSLVILHPCIIQRRRAPMIRGRSLTVIRIPFCHPEAAGPMTSRDQVWSFCTLVSSRGGGPDDTRRYLTVIRTLLSSRGGGPDDKQRPKAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 168129 - protein, 84 aa, Glycine max
  Coding DNA Sequence Number=SeqID_76444
  Homolog annotation: Hit_ID=A7QL08; Match level="QueryCoverage=47%, HitCoverage=54%, E-value=9e-12, Identity=90%"; Hit description =Chromosome undetermined scaffold_116, whole genome shotgun sequence
MAYFSCLNPGFETQTYPQEDRWGDSGLKKDLRVSRVVPGGSLNAFLFLLIGVISQRLAMVKKKGEQAHLESAVQRIVVCCVREG

SEQ ID NO: 168130 - protein, 59 aa, Glycine max
  Coding DNA Sequence Number=SeqID_76445
GGLRIGALAECILAYYVGTDEGVSEVLHVAGEKRLHRGNVLLNGAEDFLEDARKIFNRE

SEQ ID NO: 168131 - protein, 43 aa, Glycine max
  Coding DNA Sequence Number=SeqID_76446
MKSGDMRGYLMVTHTFCQPGANEPVDARRETSCSAPFVVLTHA

SEQ ID NO: 168132 - protein, 65 aa, Glycine max
  Coding DNA Sequence Number=SeqID_76447
MQLLLFLQRVFPHIARPPPQTPPGITGVEQHHQSGDGEDRAKTVAGGDRGAEQRAADVADVAERL

SEQ ID NO: 168133 - protein, 454 aa, Glycine max
  Coding DNA Sequence Number=SeqID_76448
  Gene Ontology: Mol. function=transferase activity, transferring acyl groups, acyl groups converted into alkyl on transfer; Cellular component=mitochondrion; Biological process=carboxylic acid metabolic process
  Homolog annotation: Hit_ID=A8GCY8; Match level="QueryCoverage=87%, HitCoverage=71%, E-value=0.0, Identity=92%"; Hit description=2 -isopropylmalate synthase
  Pfam annotation: Domain name=HMGL-like; Domain location=39-317; Score= 305.7; E_value=8.8e-89; Accession=PF00682.10; Description=HMGL-like
MLIDPSSKYRPFPPVALPDRQWPARTLRQAPRWCSSDLRDGNQALAEPMDNARKREFYQLLLQCGFKEIEVAFPSASQTDFDFVRTLIDEQLIPDDVTIQVLTQSRDDLIDRTFEALQGAPRAIVHLYNATAPMFRDIVFRQDKAATVALAVNGARRIRRQCEAQPDTAWCFEYSPETFCFTELEFALEICEAVAAVWQPGPQRPMIINLPATVEVSTPNVYADQIEWFCRHFSRRADVTISVHPHNDRGTGVACAELALLAGADRVEGCLFGNGERTGNVDLVTLALNLYTQGVAPGLDFSRLKQVVEVVELCNQLPVHPRHPYAGELVFTAFSGSHQDAIKKGFAAQRQDGWWQVPYLPLDPADVGCSYEAVIRVNSQSGKSGAAWLLEQNHGLALPRARDRRQRQGNERRAAVALIPRHLWAGGATALAAAELPDGKPRRRGLQLQCAGCL

SEQ ID NO: 168134 - protein, 59 aa, Glycine max
  Coding DNA Sequence Number=SeqID_76449
MGLRLQSSLCALNREQNRLRQWSNVGPDPKAETNQGSRSIDRRPMPSSGQAESTAGKQP

SEQ ID NO: 168135 - protein, 118 aa, Glycine max
  Coding DNA Sequence Number=SeqID_76450
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=75%, HitCoverage=81%, E-value=5e-39, Identity=88%"; Hit description =Chromosome undetermined scaffold_79, whole genome shotgun sequence
  Pfam annotation: Domain name=Complex1_49kDa; Domain location=1-86; Score=-132.4; E_value=0.0011; Accession=PF00346.10; Description =Respiratory-chain NADH dehydrogenase,
MTTGSSVYSTSIHHFELYTEGFSVPAPSTYTAVEAPKGEFGVFLVSNGSNRPYRRKIRAPGSAHSQGLDSMSKHHMPADVVTIIDRSSVSVGDGIARVYGLNEIQAGEMVEFASGVKG

SEQ ID NO: 168136 - protein, 81 aa, Glycine max
  Coding DNA Sequence Number=SeqID_76451
  Subcellular localization annotation: CTP_CleavageSite=34; ConfidenceScore=5.54e-01
MILSSWQNKRNSQMAILLSSPSPPPPIGAASHSSSMLKQTRKASRLRSLATRPIGEKRPLVHMDLATDKADSPHIKKLRTY

SEQ ID NO: 168137 - protein, 80 aa, Glycine max
  Coding DNA Sequence Number=SeqID_76452
MSHHSSCVNGEGTSHKDPLPRILDELSSLKLCVTTFPLRASEGEAHGCAFQRRKDARSRHQRLFVENVRKTEGNRSKWKF

SEQ ID NO: 168138 - protein, 154 aa, Glycine max
  Coding DNA Sequence Number=SeqID_76453
  Homolog annotation: Hit_ID=A7Q8B9; Match level="QueryCoverage=26%, HitCoverage=13%, E-value=2e-12, Identity=73%"; Hit description =Chromosome chr14 scaffold_63, whole genome shotgun sequence
KTDLTPSCMLHSARGDIAQLVELRSCNWVVAITEDRNMPLKDSTETKTGCQERRGEDQAGPCEQLDALSPFNPLSEMWQKEKRIPWTDPIVSTPVGTTRSPQGPLRHPGGRGPTIEPCSKKRNALAIPLSGGRGKLSVPGSPVAGSSGTTRILS

SEQ ID NO: 168139 - protein, 60 aa, Glycine max
  Coding DNA Sequence Number=SeqID_76454
MASDPYDLLSAGQSNDTCMCASRARSYASGLRWTPRMVADVEVWWCICRWLNVAGSCFGV

SEQ ID NO: 168140 - protein, 39 aa, Glycine max
  Coding DNA Sequence Number=SeqID_76455
MPPWKTCSYSNCKNKEEPRKEVPDMVVADIVIVVLLKNL

SEQ ID NO: 168141 - protein, 196 aa, Glycine max
  Coding DNA Sequence Number=SeqID_76456
  Homolog annotation: Hit_ID=Q6WAY6; Match level="QueryCoverage=41%, HitCoverage=17%, E-value=4e-10, Identity=39%"; Hit description =Putative uncharacterized protein
MVGSSINWFPRWKEGGAGVLCSCEGFPNIPLMGMRGCINYNLMLVIRQLGYPMRGVPSEKILQRIRRAWNTVERKDKELRGSSNGAIGGYHKWLKSRTQGITWLPKLKGLSGKEAEVLEESEEVQALKVELEKMRVVKEALNMVVTRVWKKCDVLRDVNMTMVEALERKNQKGSKGRMEQEQALRGFMGQQQRAQA

SEQ ID NO: 168142 - protein, 33 aa, Glycine max
  Coding DNA Sequence Number=SeqID_76457
MDYFNDPIPLELERLKALRIQWAQFYLRVRDQA

SEQ ID NO: 168143 - protein, 111 aa, Glycine max
  Coding DNA Sequence Number=SeqID_76458
MKLKFGKLLKHIPWKKVIATNWRDISVKIILQNTDDGQIQTEIYVLELEFQKVEDLVDDHSALEQDWEDYNAQLMEELLHKKKYRYHHPVYESLTRSEAQHYNLSLSTRSD

SEQ ID NO: 168144 - protein, 55 aa, Glycine max
  Coding DNA Sequence Number=SeqID_76459
CVSSSIVSDSSFLGDPTVPFSEGKDGNSHPRSRFMLRDKGNVPHYFHDMHVTMMI

SEQ ID NO: 168145 - protein, 70 aa, Glycine max
  Coding DNA Sequence Number=SeqID_76460
MAVVGTTGSYGGHDGGQGTAIDITCHGLDLNQEGEAQTDSSESRPWGKDTRFECSFKPMLIPCGWGILTK

SEQ ID NO: 168146 - protein, 46 aa, Glycine max
  Coding DNA Sequence Number=SeqID_76461
MEVVSAQRLLEVVLVPKVQVYCLNEDLHSGFPVVVTLSIKNMRPIY

SEQ ID NO: 168147 - protein, 297 aa, Glycine max
  Coding DNA Sequence Number=SeqID_76462
  Gene Ontology: Mol. function=nucleotide binding; Cellular component =intrinsic to membrane; Biological process=defense response
  Homolog annotation: Hit_ID=Q2YE87; Match level="QueryCoverage=86%, HitCoverage=31%, E-value=1e-122, Identity=54%"; Hit description=NBS -LRR type disease resistance protein Rps1-k-2
  Pfam annotation: Domain name=LRR_1; Domain location=100-123; Score =10.3; E_value=3.8; Accession=PF00560.24; Description=Leucine Rich Repeat
  Pfam annotation: Domain name=LRR_1; Domain location=196-223; Score =9.6; E_value=5.1; Accession=PF00560.24; Description=Leucine Rich Repeat
  Pfam annotation: Domain name=LRR_1; Domain location=22-46; Score=3.9; E_value=57; Accession=PF00560.24; Description=Leucine Rich Repeat
  Pfam annotation: Domain name=LRR_1; Domain location=70-97; Score=5.4; E_value=31; Accession=PF00560.24; Description=Leucine Rich Repeat
  Pfam module annotation: Pfam domain module=LRR_1::LRR_1::LRR_1::LRR _1; Domain location=100-123::196-223::22-46::70-97
MKSLYIEDLKKLEFPTQHKHELLETLSIESSCDSLTSLPLVTFPNLRDVTIGKCENMEYLLVSGAESFKSLCSLSIYQCPNFVSFGREGLPEEMSTLLPKLEDLYISNCPEIESFPKRGMPPNLRTVWIVNCEKLLSGLAWPSMGMLTHLNVGGRCDGIKSFPKEGLLPPSLTSLYLFKFSNLEMLDCTGLLHLTSLQELTMRGCPLLENMAGERLPDSLIKLTIWECPLLEKRCRMKHPQIWPKISHIPGIKRINKSSKATWKLTLYICLEEVTIQIWLIGPEKLYLSMNLSSNLN

SEQ ID NO: 168148 - protein, 198 aa, Glycine max
  Coding DNA Sequence Number=SeqID_76463
  Pfam annotation: Domain name=zf-CCHC; Domain location=167-184; Score =7.8; E_value=0.1; Accession=PF00098.14; Description=Zinc knuckle
MTSRNLDEALIRLDNTMHSMTLNMDKLLNRLALVPSSTTPNPTPVPHHSTFVPVQIRYAPSPYEDPNYRLVGPLPVALLHLGFDAGDPLRSPGPSAYDCGPGRRPREDPGAEVVRPSSSSTAVATPPPAPLVPPRITPLPPLLPSPPQAPTIKRLTPEELASRHEHGLCFTCDEKFHRGHQCASRVHLLIAEDEEPAD

SEQ ID NO: 168149 - protein, 185 aa, Glycine max
  Coding DNA Sequence Number=SeqID_76464
  Gene Ontology: Mol. function=nucleotide binding; Cellular component =intrinsic to membrane; Biological process=defense response
  Homolog annotation: Hit_ID=Q2YE87; Match level="QueryCoverage=89%, HitCoverage=13%, E-value=9e-80, Identity=89%"; Hit description=NBS -LRR type disease resistance protein Rps1-k-2
  Pfam annotation: Domain name=LRR_1; Domain location=14-42; Score=5.0; E_value=36; Accession=PF00560.24; Description=Leucine Rich Repeat
  Pfam annotation: Domain name=LRR_1; Domain location=145-168; Score =4.8; E_value=40; Accession=PF00560.24; Description=Leucine Rich Repeat
  Pfam annotation: Domain name=LRR_1; Domain location=63-86; Score=7.4; E_value=13; Accession=PF00560.24; Description=Leucine Rich Repeat
  Pfam module annotation: Pfam domain module=LRR_1::LRR_1::LRR_1; Domain location=14-42::145-168::63-86
MEYLLVSGAESFKSLCSLRIYQCPNFVSFWREGLPAPNLINFSVWGSDKLKSLPDEMSSLLPKLECLGISNCPEIESFPKRDMPPNLRTVWIENCEKLLSGLAWPSMGMLTHLNDWGRCDGIKSFPKEGLLPPSLTTLYLFDLSNLEMLDCTGLLHLTSLQQLEIKKLRDVQSWRIWLEKVFLSL

SEQ ID NO: 168150 - protein, 306 aa, Glycine max
  Coding DNA Sequence Number=SeqID_76465
  Homolog annotation: Hit_ID=A7QZ10; Match level="QueryCoverage=26%, HitCoverage=25%, E-value=1e-08, Identity=43%"; Hit description =Chromosome undetermined scaffold_261, whole genome shotgun sequence
MALLIEATVGATVGAVFSRVAENYRTAKQRVAASDGGTPIVYQKDGGGDTTCFRVFKNPVATLCDLGLLQGQTGPVFRRARETICHRHASSDGKRSEETLLKVRRILRVVEKTCFDPWEAIENTLLMFLTWISVFAVKLISAISALRWIFPTLIRVAFTFSSTKREQFPTLLALCQESHSFLGRVTEIVSVSWLKILGRIKTGMLSPDTLYEAYLVFKESSDGAYGFKNMPFEVTIGVIGEVTDSRIMNLVVGSSESNIRRRVTMVDQPSWPMDFGILRIMWTGLCTNLKAVNSLPSFMVSVMSAI

SEQ ID NO: 168151 - protein, 507 aa, Glycine max
  Coding DNA Sequence Number=SeqID_76466
MDRQRTALKDLIWRTTREVDDRHALKRSFKEALCLAKDIKLSAGWEATQHIYLRCKQQTGGTKSKGPTGEDSKRRGTNSKLKWATRSHALSARLRAKHPGLIALSLAQGLANADGLEAIRTSPWPPVNAEQCPHLGKRPTMTLPTSLQRSLGTGTKTTFSFGTSFRKGMLSLDPGCSMSSSRNLGDADGNRVRGQVVRFNADTINEFLDTPVIQEDGEEYPAYTRYPSTHPDPDTIAATICTPGGHFILNVDGLPWKLLRKDMTTLAQTWSVLSYYDLAPTSHTSDVNLDRARLIYDLVRWMDMDVGNFISQQISQIAQSSTSRLGFPALFTTLCDIQGVVSDTLIFESLSPTINLAYVKKNFWNSADPSITFPGARRTRTRAPASTSEAPPTSQPSSLRPQPPLPSTAAPSDMQGQMLRYLYQGQQIIIQDLHRLFLHLQMDSSLTTPEAYRQQVAWPGDQPSTDRGEGPSRAAATEDPAVDEDLMVDLAGTDWGPWADLGGGAGH

SEQ ID NO: 168152 - protein, 247 aa, Glycine max
  Coding DNA Sequence Number=SeqID_76467
  Gene Ontology: Mol. function=nucleotide binding; Cellular component =intrinsic to membrane; Biological process=defense response
  Homolog annotation: Hit_ID=Q2YE87; Match level="QueryCoverage=99%, HitCoverage=20%, E-value=1e-103, Identity=76%"; Hit description=NBS -LRR type disease resistance protein Rps1-k-2
  Pfam annotation: Domain name=LRR_1; Domain location=184-211; Score =4.3; E_value=48; Accession=PF00560.24; Description=Leucine Rich Repeat
  Pfam annotation: Domain name=LRR_1; Domain location=41-64; Score=0.1; E_value=2.9e+02; Accession=PF00560.24; Description=Leucine Rich Repeat
  Pfam annotation: Domain name=LRR_1; Domain location=65-87; Score=4.3; E_value=50; Accession=PF00560.24; Description=Leucine Rich Repeat
  Pfam annotation: Domain name=LRR_1; Domain location=90-113; Score =10.0; E_value=4.4; Accession=PF00560.24; Description=Leucine Rich Repeat
  Pfam module annotation: Pfam domain module=LRR_1::LRR_1::LRR_1::LRR _1; Domain location=184-211::41-64::65-87::90-113
MLESMIEAITNIQPTCLRDVTIGKCENMEYLLVSGAESFKSLCSFRIYQCPNFVSFWREGLPAPNLINFSVSGSDKLKSLPEEMSTLLPKLECLYISNCPEIESFPKRGMPPNLTTVSIVNCEKLLSGLAWPSMGMLTNLTVWGRCDGIKSFPKEGLLPPSLTSLYIDDLSNLEMLDCTGLPVSLLKLTIERCPLLENMVGERLPDSLIRLTIRGCPMLEKQCRMKHPQIWPKVSHIPGIKVDDRWI

SEQ ID NO: 168153 - protein, 168 aa, Glycine max
  Coding DNA Sequence Number=SeqID_76468
  Homolog annotation: Hit_ID=A5BEK1; Match level="QueryCoverage=67%, HitCoverage=11%, E-value=8e-13, Identity=30%"; Hit description =Putative uncharacterized protein
MASRNLDEALVRLDNTMHSMTLNMDKLLNRLAPVPSSTTPNPTLVPRHSTSVPAQIRYAPSPYEDPVGALFKLTHTGSVLTYLKEFEDLANRIIGLPTPFLLPCFISGLTSEMRRTVQAPTVRHLTPEELASRHEHGLCFTCDEKFHRGHRCASRVHLLIAEDEEPID

SEQ ID NO: 168154 - protein, 91 aa, Glycine max
  Coding DNA Sequence Number=SeqID_76469
  Gene Ontology: Mol. function=binding; Cellular component=cytoplasm; Biological process=regulation of translation
  Homolog annotation: Hit_ID=A7PZ14; Match level="QueryCoverage=82%, HitCoverage=2%, E-value=8e-24, Identity=77%"; Hit description =Chromosome chr4 scaffold_39, whole genome shotgun sequence
MNYRIANLFVRGLEVKAWRTKQSSVQVLGAMAYRAPQHLSRCLPKIVPKLAEYLKVLTDTHPKVQSAGQMALQHVGNVIESRNIWSYPYST

SEQ ID NO: 168155 - protein, 20 aa, Glycine max
  Coding DNA Sequence Number=SeqID_76470
MIRVERQRQGIGCYELDWFF

SEQ ID NO: 168156 - protein, 157 aa, Glycine max
  Coding DNA Sequence Number=SeqID_76471
  Homolog annotation: Hit_ID=A2Y1D2; Match level="QueryCoverage=58%, HitCoverage=16%, E-value=8e-10, Identity=40%"; Hit description =Putative uncharacterized protein
  Pfam annotation: Domain name=Transposase_24; Domain location=11-147; Score=-15.4; E_value=0.012; Accession=PF03004.5; Description=Plant transposase (PttaEnSpm family)
MIAHIPDPRVDPSQYRDLVHYWCSEKGQKISNINKRSCSKYEDLHCMGTNNLPRRIHEMTTKAKGVQPSRAEIYIDTRTRKDGSIVTEKAAIVIDELKKKMVEAERVRKIYKAPKILLIGQMIYIQKSKDLKKEDVCVVLASFHIKQVHLKALIQTI

SEQ ID NO: 168157 - protein, 149 aa, Glycine max
  Coding DNA Sequence Number=SeqID_76472
MGKRRKLNIIQNDGQSQAKEQSIESSTEVNQNNNSILEENAQFEGEQHIQEDSHVQSHTSLESASESSTKDKKRTRGYTHMLDVWDLPDGEFILVEVDHWGNPMGWEGKTLLNAIGSLVRRHQCAPINFVSWKDIPKDYITDMVELIQV

SEQ ID NO: 168158 - protein, 98 aa, Glycine max
  Coding DNA Sequence Number=SeqID_76473
  Homolog annotation: Hit_ID=Q6UUU1; Match level="QueryCoverage=81%, HitCoverage=54%, E-value=1e-17, Identity=61%"; Hit description =Putative uncharacterized protein
MAYERGGDFLEDARKILNREVRGPRQSRFSIGSAPLTSITKSDAQISGGETRQDYKDTRRFPLAAPSSALLFLPFGLPDVIPLYGRVCLIPRLNTQFR

SEQ ID NO: 168159 - protein, 302 aa, Glycine max
  Coding DNA Sequence Number=SeqID_76474
  Homolog annotation: Hit_ID=A7R7K5; Match level="QueryCoverage=41%, HitCoverage=15%, E-value=2e-16, Identity=34%"; Hit description =Chromosome undetermined scaffold_1841, whole genome shotgun sequence
  Pfam annotation: Domain name=RPW8; Domain location=3-144; Score= -30.0; E_value=0.017; Accession=PF05659.2; Description=Arabidopsis broad-spectrum mildew resistance protein RPW8
MALLIEATVGAVFNESLRTVLEFKNKTVCFKSSLVHLQSTLVAISPVIKEIEQQNNELKLPKEELQSFIRKMEEGTQLVFECSKIRWLHFVTRACYKDKLDQFSDELVKLFAIDMQAQMARDRKETLLKVRRILRVVEKTCFDPGEAIDNTVLRFLTWISVFAVKLIRVLGGFKNMPVGVSIGVIGEVTDSRIVNLVVGTWRKLGVQYPKESDDGGWREEGKYAKLILGMSFSALFMSGLVLLYMSSRCLGRETSLRGHAIGTQPSWPMDFGMLRIMWTGLGTNLKAVNSLPSFMVSVMSAI

SEQ ID NO: 168160 - protein, 65 aa, Glycine max
  Coding DNA Sequence Number=SeqID_76475
  Subcellular localization annotation: CTP_CleavageSite=56; ConfidenceScore=5.02e-01
VIVNSPTGRWKVLVSLCHLSTNVDISPGSPVTTKHPINGLNPVVGTNPSISGTGVPINAVEDILL

SEQ ID NO: 168161 - protein, 419 aa, Glycine max
  Coding DNA Sequence Number=SeqID_76476
  Gene Ontology: Mol. function=nucleotide binding; Cellular component =intrinsic to membrane; Biological process=defense response
  Homolog annotation: Hit_ID=Q2YE87; Match level="QueryCoverage=99%, HitCoverage=44%, E-value=0.0, Identity=64%"; Hit description=NBS-LRR type disease resistance protein Rps1-k-2
  Pfam annotation: Domain name=LRR_1; Domain location=122-143; Score =5.6; E_value=28; Accession=PF00560.24; Description=Leucine Rich Repeat
  Pfam annotation: Domain name=LRR_1; Domain location=145-167; Score =3.4; E_value=73; Accession=PF00560.24; Description=Leucine Rich Repeat
  Pfam annotation: Domain name=LRR_1; Domain location=203-226; Score =13.2; E_value=0.98; Accession=PF00560.24; Description=Leucine Rich Repeat
  Pfam annotation: Domain name=LRR_1; Domain location=292-319; Score =2.9; E_value=89; Accession=PF00560.24; Description=Leucine Rich Repeat
  Pfam annotation: Domain name=LRR_1; Domain location=337-361; Score =3.9; E_value=58; Accession=PF00560.24; Description=Leucine Rich Repeat
  Pfam annotation: Domain name=LRR_1; Domain location=385-413; Score =4.7; E_value=41; Accession=PF00560.24; Description=Leucine Rich Repeat
  Pfam module annotation: Pfam domain module=LRR_1::LRR_1::LRR_1::LRR _1::LRR_1::LRR_1; Domain location=122-143::145-167::203-226::292 -319::337-361::385-413
MPRGMSKLNHLQHLDFFAVGKHEENGIKELGGLSNLCGELEIRKLENVSQSEEALEARMMDKKHINSLQLEWSRFNNNRTNFQLEIDVLCKLQPHFNIESLQIIGYEGTRFPDWMGNSSYCNMISLKLRDCDNCSMLPSLGQLPSLKVLEISVLNRLKTIDAGFYKNEECHSGTSFPSLESLAFYGMPCWEVWSSFDSEAFPVLKSLYIRDCPKLEGNLPNHLPVLKKLAIKYCELLVSSLPTAPAIQSLEISESNKVALHALPLLVETIEVEGSPMVESMMEAITNIQPTCLRSLTLRDCSSAVSFPGGRLPESLKSLHIKDLKKLEFPTQHKHELLETLSIHSSCDSLTSLPLVTFPNLRHLIIEKCENMESLLVSGAESFKSLCSLSIYECPNFVSFWREGLPAPNLINFSVSGSV

SEQ ID NO: 168162 - protein, 100 aa, Glycine max
  Coding DNA Sequence Number=SeqID_76477
  Gene Ontology: Mol. function=protein serine/threonine kinase activity; Cellular component=cytoplasm; Biological process=protein amino acid phosphorylation
  Homolog annotation: Hit_ID=A7Q3T7; Match level="QueryCoverage=69%, HitCoverage=14%, E-value=8e-21, Identity=69%"; Hit description =Chromosome chr13 scaffold_48, whole genome shotgun sequence
MKLVDRLPKLANDCNEKWNHMHLIKHQDGLLHSTCGTPAYVAPEVINRRGYDGAKADIWSCGVILYVLLAGESSNFLTGLHQMYADCCRKSWKALGSKGG

SEQ ID NO: 168163 - protein, 31 aa, Glycine max
  Coding DNA Sequence Number=SeqID_76478
MLAKAVATEAGANFINISMSSITSKRSGNAR

SEQ ID NO: 168164 - protein, 104 aa, Glycine max
  Coding DNA Sequence Number=SeqID_76479
MGEGCCTQPYPCICKEAVSGFEPMTNRSPRHNFTAAPGLALNLHHGGKSGTFVSDFVMQERSDRFILAFNHQWKTGKKKRLALTTSYLSIGKEAWAQLKDVVEN

SEQ ID NO: 168165 - protein, 104 aa, Glycine max
  Coding DNA Sequence Number=SeqID_76480
MGQGVIRKRDNIADKGMYSKEIDANQDIATIGVSTAKKGVNQAEKEVQAAVNTKRKISKPAYLKDYNCWNLNQWELAASKQQKQGMQLENKIKRAITRPTYLKD

SEQ ID NO: 168166 - protein, 556 aa, Glycine max
  Coding DNA Sequence Number=SeqID_76481
  Gene Ontology: Mol. function=nucleotide binding; Cellular component =intrinsic to membrane; Biological process=defense response
  Homolog annotation: Hit_ID=Q2YE87; Match level="QueryCoverage=98%, HitCoverage=43%, E-value=0.0, Identity=81%"; Hit description=NBS-LRR type disease resistance protein Rps1-k-2
  Pfam annotation: Domain name=LRR_1; Domain location=108-130; Score =4.8; E_value=39; Accession=PF00560.24; Description=Leucine Rich Repeat
  Pfam annotation: Domain name=LRR_1; Domain location=166-186; Score =5.3; E_value=32; Accession=PF00560.24; Description=Leucine Rich Repeat
  Pfam annotation: Domain name=LRR_1; Domain location=188-213; Score =4.6; E_value=44; Accession=PF00560.24; Description=Leucine Rich Repeat
  Pfam annotation: Domain name=LRR_1; Domain location=255-282; Score =2.9; E_value=91; Accession=PF00560.24; Description=Leucine Rich Repeat
  Pfam annotation: Domain name=LRR_1; Domain location=300-324; Score =3.1; E_value=83; Accession=PF00560.24; Description=Leucine Rich Repeat
  Pfam annotation: Domain name=LRR_1; Domain location=348-371; Score =3.3; E_value=74; Accession=PF00560.24; Description=Leucine Rich Repeat
  Pfam annotation: Domain name=LRR_1; Domain location=372-394; Score =1.0; E_value=2e+02; Accession=PF00560.24; Description=Leucine Rich Repeat
  Pfam annotation: Domain name=LRR_1; Domain location=397-420; Score =13.6; E_value=0.73; Accession=PF00560.24; Description=Leucine Rich Repeat
  Pfam annotation: Domain name=LRR_1; Domain location=468-491; Score =3.6; E_value=65; Accession=PF00560.24; Description=Leucine Rich Repeat
  Pfam annotation: Domain name=LRR_1; Domain location=493-520; Score =9.3; E_value=5.7; Accession=PF00560.24; Description=Leucine Rich Repeat
  Pfam annotation: Domain name=LRR_1; Domain location=85-106; Score =7.5; E_value=13; Accession=PF00560.24; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1; Domain location =108-130::166-186::188-213::255-282::300-324::348-371::372-394::397 -420::468-491::493-520::85-106
VDSRGSPMENVSQSDEALEARMMDKKHINSLLLEWSGCNNNSTNFQLEIDVLCKLQPHFNIESLQIKGYKGTKFPDWMGNSSYCNMTRLTLSDCDNCSMLPSLEQLPSLKFLVISRLNRLKTIDAGFYKNEDCRSWRPFPSLESLFIYDMPCWELWSSFDSEAFPLLKSLRILGCPKLEGSLPNHLPALETLYISDCELLVSSLPTAPAIQSLEISKSNKVALHALPLLVETIEVEGSPMVESMIEAITNIQPTCLRSLTLRDCSSAVSFPGGRLPESLKTLRIWDLKKLEFPTQHKHELLETLTIESSCDSLTSLPLITFPNLRDLAIRNCENMEYLLVSGAESFKSLCSLRIYQCPNFVSFWREGLPAPNLITFKVWGSDKLKSLPDEMSTLLPKLEHLYISNCPEIESFPEGGMPPNLRTVWIVNCEKLLSGLAWPSMGMLTHLSVGGRCDGIKSFPKEGLLPPSLTSLYLYDLSNLELLDCTGLLDLTSLQILHIDNCPLLENMAGERLPVSLIKLTIMGCPLLEKRCRMKHPQIWPKICHIPGIKVDDRWI

SEQ ID NO: 168167 - protein, 189 aa, Glycine max
  Coding DNA Sequence Number=SeqID_76482
  Gene Ontology: Mol. function=protein serine/threonine kinase activity; Cellular component=cytoplasm; Biological process=protein amino acid phosphorylation
  Homolog annotation: Hit_ID=A0MNK8; Match level="QueryCoverage=74%, HitCoverage=43%, E-value=7e-52, Identity=56%"; Hit description=CBL -interacting protein kinase 22
  Pfam annotation: Domain name=Pkinase; Domain location=3-172; Score =17.5; E_value=1.1e-09; Accession=PF00069.16; Description=Protein kinase domain
  Pfam annotation: Domain name=Pkinase_Tyr; Domain location=1-151; Score=-140.4; E_value=0.00081; Accession=PF07714.8; Description =Protein tyrosine kinase
  Pfam module annotation: Pfam domain module=Pkinase::Pkinase_Tyr; Domain location=3-172::1-151
MSVAIKITDKEKILKVGMIDQIKREISAMRLTRHPHVVELYEVMASKTKIYFVMEYVKGGELFNKQLISAVDYCHSRGVCHRDLKPENLLLDENGNINGLLHTTCGAPAYAAPEVINRRSYDLVCSIGRGEFKFPNWIAPDNFWNLNQWELGKTGKAKNGPTSDSVAKEPVAETEDENAASKQQKQGCN

SEQ ID NO: 168168 - protein, 134 aa, Glycine max
  Coding DNA Sequence Number=SeqID_76483
  Gene Ontology: Mol. function=CTP synthase activity; Biological process=pyrimidine nucleotide biosynthetic process
  Homolog annotation: Hit_ID=A7Q0J8; Match level="QueryCoverage=31%, HitCoverage=8%, E-value=7e-11, Identity=79%"; Hit description =Chromosome chr7 scaffold_42, whole genome shotgun sequence
MARDQKEILLKVRRILSAVNKFPFHTVDASNPEENTILCPRRCRGCKQRWGAQRGGAYVIGRPVALCVQKKVGFGGKAAVVPVVEFDIVFERETESVVSHITAAIKDWIEGVVIPVDGKEGPADVCVIELGGTV

SEQ ID NO: 168169 - protein, 463 aa, Glycine max
  Coding DNA Sequence Number=SeqID_76484
  Gene Ontology: Mol. function=nucleotide binding; Cellular component =intrinsic to membrane; Biological process=defense response
  Homolog annotation: Hit_ID=Q2YE88; Match level="QueryCoverage=98%, HitCoverage=44%, E-value=0.0, Identity=70%"; Hit description=NBS-LRR type disease resistance protein Rps1-k-1
  Pfam annotation: Domain name=LRR_1; Domain location=104-128; Score =7.1; E_value=15; Accession=PF00560.24; Description=Leucine Rich Repeat
  Pfam annotation: Domain name=LRR_1; Domain location=146-169; Score =12.0; E_value=1.8; Accession=PF00560.24; Description=Leucine Rich Repeat
  Pfam annotation: Domain name=LRR_1; Domain location=258-286; Score =6.6; E_value=18; Accession=PF00560.24; Description=Leucine Rich Repeat
  Pfam annotation: Domain name=LRR_1; Domain location=304-331; Score =6.2; E_value=22; Accession=PF00560.24; Description=Leucine Rich Repeat
  Pfam annotation: Domain name=LRR_1; Domain location=375-398; Score =4.3; E_value=49; Accession=PF00560.24; Description=Leucine Rich Repeat
  Pfam annotation: Domain name=LRR_1; Domain location=400-427; Score =6.7; E_value=18; Accession=PF00560.24; Description=Leucine Rich Repeat
  Pfam module annotation: Pfam domain module=LRR_1::LRR_1::LRR_1::LRR _1::LRR_1::LRR_1; Domain location=104-128::146-169::258-286::304 -331::375-398::400-427
HEENGIKELGGLSNLRGDLELRNMENVSQSDEALEARMMDKKHINSLQLVWSGCNNNSTNFQLEIDVLCKLQPHFNIESLYIKGYKGTRFPDWMGNSSYCNMTSLTLLDCDNCSMLPSLGQLPSLKNLRIARLNRLKTIDAEAFPVLNSLEIRDCPKLEGSLPNHLPALKRLTIRNCELLVSSLPTAPAIQSLEILKSNKVALHALPLLVETIEVEGSPMVESVMEAITNIQPTCLRSLTLKDCLSAVSFPGAESFESLCSLHIHRCPNFVSFWREGLPAPNFINLTISELKSLPEEMSSLLPKLECLEIFNCPEIESFPKRGMPPDLRTVSIYNCEKLLSGLAWPSMGMLTHLSVWGRCDGIKSFPKEGLLPPSLTTLYLFDMSNLEMLDCTGLLHLTSLQQLQIFGCPKLENMAGESLPFSLIKLTMVECPLLEKRCRMKHPQIWPKISHIPSIWFYGRLI

SEQ ID NO: 168170 - protein, 211 aa, Glycine max
  Coding DNA Sequence Number=SeqID_76485
  Gene Ontology: Mol. function=aspartic-type endopeptidase activity; Cellular component=viral capsid; Biological process=proteolysis
  Homolog annotation: Hit_ID=A7QLG3; Match level="QueryCoverage=99%, HitCoverage=31%, E-value=4e-29, Identity=36%"; Hit description =Chromosome undetermined scaffold_119, whole genome shotgun sequence
MGIGVIILMCLRDIRHNKFEYSLIGTVETSLEQGPVYFNCYPNKIVSLMDRNILNSLFLNIYFHGIDMKEGSILATVIYRIQYKVMNTCASRVLLKPQKGETTLFITDMTKTNVSLPRIIKWDEVTLPEKWVMDKATPSVPRPAPTIEQIKQDNCGLSRSESHNQFSSINLKELDTISSIPRTMYNQEPEDDQKSIQSLTYSSIHEPYDVI

SEQ ID NO: 168171 - protein, 63 aa, Glycine max
  Coding DNA Sequence Number=SeqID_76486
MAMQDSRVRLPRKEKLWSLHQRLFEENVRKTKSGSTNFKNKGSGVVYMRGRFDKSGALAPTYP

SEQ ID NO: 168172 - protein, 214 aa, Glycine max
  Coding DNA Sequence Number=SeqID_76487
  Subcellular localization annotation: CTP_CleavageSite=11; ConfidenceScore=5.01e-01
MVKSMKKRKVSSTTTAAASHQRHRPSKAPTTPVPPSLIILDPKYLDIAFFDDETFDCYQLPHYPELVRVFYNNLRIQDNTLYSEVHGIPLVIDQSLFFSLTKLPSQGVPFEGTVVDDWKFDYSSHDARRMVCNDQADMTGRFLVGSLTFDFRIMHYIIVRILLPRSSNLAQASEEDLILMCAFLIDRQIDWARAHLVKYRMHKALWTNAPLLYP

SEQ ID NO: 168173 - protein, 253 aa, Glycine max
  Coding DNA Sequence Number=SeqID_76488
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFLLSGLFLHARPTFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168174 - protein, 294 aa, Glycine max
  Coding DNA Sequence Number=SeqID_76489
  Subcellular localization annotation: CTP_CleavageSite=15; ConfidenceScore=5.04e-01
MAEPSKKRKGSSSTAAAAHRHHRPSEASTAPIHPSLSSTLFSSDDQRLRQGAPFEGTIVDDWKFDYSSHDARRMVCNDQAEMTGRLLTGSLTFDNRIMHYIIVRILLPRSSNLAQASEEDLILMWAFLTGRQIDWAHLVRYRMHKALRTNAPLPYPQLITLFLRHFQIPLDDEPFVQVKRSFAIGAGVVTSFGYRKDQNGQWLKKDALPPQDERTPSPPPQREDSALLNEVLTELRGLRSYVGERFDSLDTRFAVMDIRLTQVEDVSFIRTCFDPPPPPPSSSRLIVIIMTKSY

SEQ ID NO: 168175 - protein, 108 aa, Glycine max
  Coding DNA Sequence Number=SeqID_76490
MFETHRRGIHKVLGCFREKSAKNMKTRVYLAKWVCVNRLLHPNFIWAPLLITSEGLTPIAMESVKLREVSERKHPKNKKTGGSNLARLGELGDNHLPHFVEKWHPGLP

SEQ ID NO: 168176 - protein, 187 aa, Glycine max
  Coding DNA Sequence Number=SeqID_76491
NKPVDTRRFTSSSAQTISVILTLESRDMRRYPSEAADPMTCGNHLVQHLFAIYKTQSMIASRDKRRLLRLLSSRGGGPNDMREPFGGGPDDMQLSARSMSDKRAETDSAPFIIQEQRVDWNSKLGGKHAETDSAPFIIQEQQTEWINAHRRILRPLSFRNIKNNKLGGKRAETNSVPFYSFRNSKLG

SEQ ID NO: 168177 - protein, 26 aa, Glycine max
  Coding DNA Sequence Number=SeqID_76492
MEKNEETTMEREGEDKGEEVRGGVIH

SEQ ID NO: 168178 - protein, 174 aa, Glycine max
  Coding DNA Sequence Number=SeqID_76493
  Gene Ontology: Biological process=transposition, DNA-mediated
  Homolog annotation: Hit_ID=Q1J7G7; Match level="QueryCoverage=18%, HitCoverage=47%, E-value=2e-11, Identity=96%"; Hit description =Transposase
MCRNCRKSSWYSLQSDENVSVCSWKRCNKGEHYPISPAHRLSLPYEIPDEHSSGGQESERSGYRYIEQLTEMPQNVLYDAIGIYQRCWNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 168179 - protein, 153 aa, Glycine max
  Coding DNA Sequence Number=SeqID_76494
MHEQCLAINSWGFGLDSGGCMNGNQFMGLRIRFDGGGCTNSAWQSIRGAPDSMAINSWGSKLDGGGCMNNDQFMGLRIRLDGGGCTNTTWQSIRGAPNWMRLAINSWGSGHDGGGCMNDNQFMGLRIRFDDGGSTNSARESIRGASDTMVEDT

SEQ ID NO: 168180 - protein, 113 aa, Glycine max
  Coding DNA Sequence Number=SeqID_76495
MSLSDSVYFVKMASRKRKSIGARPTAQYDTRRFHSLDSWNRYTDNVLGRSILPKKMVKIYHTEFHDFKTELESDAILPRKGPVTRAMSKRLQEDWARVNKEGLRVLMNLRVDF

SEQ ID NO: 168181 - protein, 142 aa, Glycine max
  Coding DNA Sequence Number=SeqID_76496
MHAKARVMSEIEEVQEQMKADMEAMKEKMTTMMEAMMSMRKMMEASTTTVTAASTTTEVDPAHPSSLNQVNSPVSDMVGQGGITLGCTGGPYFVQVQSKHLFPPYGLPPNSTPPNVVHAPDENVNNSAPIPIKGRQPQSGHA

SEQ ID NO: 168182 - protein, 69 aa, Glycine max
  Coding DNA Sequence Number=SeqID_76497
MTLPCKLTFQTFVFVGNGSEKAFHEEVVATYPSAGGRRVARGCVFQEWNTRGVATNVYLRKTLEKPEKT

SEQ ID NO: 168183 - protein, 75 aa, Glycine max
  Coding DNA Sequence Number=SeqID_76498
KNIEHFENLAKVQAKNDQENISDKLSGVDQGTSYNSNNLVNQEVIETVVVIEYIQTKYVSMKIIRNWEQKLMNRG

SEQ ID NO: 168184 - protein, 145 aa, Glycine max
  Coding DNA Sequence Number=SeqID_76499
MVNKECKEVSVSSKRKTSPLRQPPHFLVCKKTLVSTATSLGLEVIPQVKKLLDEGLVRKSLNPCALLVPKIGVVERSPEYEEPRDLRSNPFQGRGDDAILPPKGQTVVVVEDLPILDLDDFSNLDCICCLKDHNYSTVVDFAAEG

SEQ ID NO: 168185 - protein, 80 aa, Glycine max
  Coding DNA Sequence Number=SeqID_76500
MGQLSDQGVPKDPKRIKIIPDWPTPPSVKVRSPEYEEPQDLRSNPFQGGGDDAIPTPQGYWIEDSNSAWARATKEALGFS

SEQ ID NO: 168186 - protein, 55 aa, Glycine max
  Coding DNA Sequence Number=SeqID_76501
MLEAEESEMLKIKGCGDLKNAERLRIYSGEVGKVALVFGDNYKLVTATVSASCSK

SEQ ID NO: 168187 - protein, 520 aa, Glycine max
  Coding DNA Sequence Number=SeqID_76502
  Gene Ontology: Mol. function=exonuclease activity; Cellular component= intracellular; Biological process=regulation of transcription, DNA -dependent
  Homolog annotation: Hit_ID=A7NSX5; Match level="QueryCoverage=99%, HitCoverage=43%, E-value=1e-120, Identity=45%"; Hit description =Chromosome chr18 scaffold_1, whole genome shotgun sequence
IKLGEPGWKERYYEGKFSAKTPEELEAIRKDVVLKYTEGLCWVMHYYYEGPLRLILDIITATGSDEVQKLSLLEILPSDPAPGFYPYHYAPFASDLKGLGELDISFKLGTPFKPFDQLLGVFPAASSHALPEPYRRLMTDPNSPIIDFYPIDFEVDMNGKRFAWQGIAKLPFIDEVRLLAEVQKIENLLTDGDFRVAKKQLFEKLIMTFFSKRRTIAAAAAIELHYSFQMHEIVNGGMNGYISLCGGEPCPPIFRSPIASMEDIMDNHIVEIGDLKPEPVLWHEDSGRRHHSENGRKNPPGSISGRELGDAAHRLIVNSLQAKVDTNGYRHPHNGPPISYPAPMGHYRQPVPSYGYESSPGYVAMPPPISAPSLQGRPQFAPYNAAPTAQQYGCNQPYPPPPVVYNHPRQQSNSYERNDYQHARSNHYERNHHQGSGGSSRHGYQSSGNNHNARFNNSHGSYGSHHHEVSHHNQNFQPSRAHQNWTPPNNPSGHRDYGHHSSNQYSLLDRRGNRNPMPPP

SEQ ID NO: 168188 - protein, 213 aa, Glycine max
  Coding DNA Sequence Number=SeqID_76503
  Gene Ontology: Mol. function=lysine decarboxylase activity; Cellular component=cytoplasm; Biological process=response to chemical stimulus
  Homolog annotation: Hit_ID=A7NSX4; Match level="QueryCoverage=96%, HitCoverage=95%, E-value=5e-87, Identity=79%"; Hit description =Chromosome chr18 scaffold_1, whole genome shotgun sequence
  Pfam annotation: Domain name=Lysine_decarbox; Domain location=61-194; Score=235.5; E_value=1.2e-67; Accession=PF03641.5; Description=Lysine decarboxylase family
MEIEQQAMKMMKSSRFRRICVFCDTSHGKNPSYQHAAIQLAKQLVERNIDLVYGGGSIGLMGLISQVVFDGGRHVLGVIPTTLMPIEITGESVGEVRAVSGMHQRKAEMAREADAFIALPGGYGTLEELLEVITWAQLGIHDKPVGLLNVDGYYNSLLSFMDNAVDQGFITPAARHIIVSAQTAQDLISKLEEYVPKHCGVAPKQSWEMNQQL

SEQ ID NO: 168189 - protein, 64 aa, Glycine max
  Coding DNA Sequence Number=SeqID_76504
MGATMPSKGWQILVFKKLPNGYVEEVKNLIWDTINIYSLFKTGQGFYGCQCAEEITYLIEARQL

SEQ ID NO: 168190 - protein, 81 aa, Glycine max
  Coding DNA Sequence Number=SeqID_76505
MKVANVKATCQDDNLSNEKYAKEILNLVSHLHGYIHACVSISPQCPSVWGKMCDWTMKEKFMRLLPVDERFGEEIISGCHT

SEQ ID NO: 168191 - protein, 626 aa, Glycine max
  Coding DNA Sequence Number=SeqID_76506
  Gene Ontology: Mol. function=heat shock protein binding; Cellular component=outer membrane-bounded periplasmic space; Biological process=response to stress
  Homolog annotation: Hit_ID=A7QHC5; Match level="QueryCoverage=91%, HitCoverage=73%, E-value=0.0, Identity=66%"; Hit description =Chromosome chr2 scaffold_97, whole genome shotgun sequence
  Pfam annotation: Domain name=DnaJ; Domain location=91-152; Score= -8.8; E_value=0.03; Accession=PF00226.22; Description=DnaJ domain
  Subcellular localization annotation: CTP_CleavageSite=42; ConfidenceScore=5.55e-01
METVVSRAVLVLCTPHPTTTHPFTKPNKLLRSSLSRGAASLSATSKWAERLIADFQFLGDAAASTSTSTLSPSSVPPRLDPPERYVSIPLDLYRILGAEPHFLGDGIRRAYEAKFSKPPQYAFSNDALISRRQILQAACETLADPTSRREYNQSLVDDEEAAILTQIPFDKVPGALCVLQEAGETELVLEIGQGLLRERLPKTFKQDVVLAMALAFVDVSRDAMALSPPDFIAACEMLERALKLLQEEGATSLAPDLQAQIDETLEEITPRCVLELLALPLDDEHRARREEGLLGVRNILWAVGGGGAAAIAGGFTREDFMNEAFLHMTAAEQVELFVATPSTIPAESFEAYGVALALVAQAFVGKKPHLIQDADNLFQQLQQTKITTVRNAPSVYIPKEKREIDFALERGLCALLVGELDQCRSWLGLDTDSSPYRNPSIIEFIMENAKGDEDSDLPGLCKLLETWLMEVVFPRFRDTKETRFKLGDYYDDPTVLRYLERLEGGSNSPLAAAAAIAKIGAEATAVISQVQASVINALKKAFPVGSEDQIVKHQVNGVNEDFGFSESENPLILSDQDSPVNAEVSGIKNTMETRKGEFITEEIKHASVQIMCAGVVIGLEWLTHSS

SEQ ID NO: 168192 - protein, 336 aa, Glycine max
  Coding DNA Sequence Number=SeqID_76507
  Gene Ontology: Mol. function=zinc ion binding; Cellular component =intracellular; Biological process=regulation of transcription
  Homolog annotation: Hit_ID=A7NT20; Match level="QueryCoverage=82%, HitCoverage=98%, E-value=8e-83, Identity=57%"; Hit description =Chromosome chr18 scaffold_1, whole genome shotgun sequence
  Pfam annotation: Domain name=zf-B_box; Domain location=113-160; Score= 51.0; E_value=4e-12; Accession=PF00643.15; Description=B-box zinc finger
  Pfam annotation: Domain name=zf-B_box; Domain location=60-107; Score =43.5; E_value=7.3e-10; Accession=PF00643.15; Description=B-box zinc finger
  Pfam module annotation: Pfam domain module=zf-B_box::zf-B_box; Domain location=113-160::60-107
MDGSLIIVVPPLPFDHIYPSQSLPTFYEALATPSFILSSQTFHFKLQVFKLPTHCSYSHPMKIQCDVCNKHEASVFCTADEAALCDGCDHRVHHANKLASKHQRFSLLRPSHKQHPLCDICQERRAFTFCQQDRAILCKECDVSIHSANEHTLKHDRFLLTGVKLAASAMLRSSQTTSDSNSTPSLLNVSHQTTPLPSSTTTTTTNNNNNKVAVEGTGSTSASSISEYLIETLPGWQVEDFLDSYFVPFGFCKNDEVLPRLDADVEGHMGSFSTENMGIWVPQAPPPLVCSSQMDRVIVQSETNIKGSSISRLKDDTFTVPQISPPSNSKRARFLW

SEQ ID NO: 168193 - protein, 107 aa, Glycine max
  Coding DNA Sequence Number=SeqID_76508
MGFLSASSRIIPYIYIGLDYGFMSKFRMFSDFDVLCSWSCPFKNKGREKQKEAYVHVTFSSSSVENVEGKIFPKKNPSAECVCLNWEKGADPLKMECSSKGELALAH

SEQ ID NO: 168194 - protein, 502 aa, Glycine max
  Coding DNA Sequence Number=SeqID_76509
  Gene Ontology: Mol. function=4 iron, 4 sulfur cluster binding; Cellular component=chloroplast; Biological process=amino acid biosynthetic process
  Homolog annotation: Hit_ID=Q6Z702; Match level="QueryCoverage=79%, HitCoverage=77%, E-value=0.0, Identity=90%"; Hit description =Putative 3-isopropylmalate dehydratase large subunit
  Pfam annotation: Domain name=Aconitase; Domain location=41-462; Score= 79.4; E_value=1.2e-20; Accession=PF00330.11; Description=Aconitase family (aconitate hydratase
  Subcellular localization annotation: CTP_CleavageSite=49; ConfidenceScore=5.19e-01
MLQSGAKENNPLCYCGASAPTFHHWISSVFFFFRGVRTAMTMTEKILARASEKAQLTPGDNVWVNVDILMTHDVCGPGSIGIFKREFGEDAKVWDREKLVIIPDHYIFTSDERANRNVDILRDFCHEQNIKYFYDIKDLSNFKVNPDYKGVCHVALAQEGHCRPGEVLLGTDSHTCTAGAFGQFATGIGNTDAGFVLGTGKLLLKVPPTLRFVMDGEMPDYLLSKDLILQIIGEITVAGATYKSMEFVGTTVESLTMEERMTLCNMVVEAGGKNGVVPADSTTFKYLEGKTSLPYEPVYSDDQARFLAEYRFDVSKLEPVVAKPHSPDNRALARECKDVKIDRVYIGSCTGGKTEDFMAAAKVFLASGKQVKVPTFLVPATQKVWMDLYSLPVPGSGGKTCSQIFEEVGCDTPASPSCGACLGGPKDTYARMNEPKASSLLLPQHLGGGDGGLVTVHIGADGEGSTHTPPSNSNQQPPTTVKTLAEQNWGFLVSETIILFLG

SEQ ID NO: 168195 - protein, 354 aa, Glycine max
  Coding DNA Sequence Number=SeqID_76510
  Gene Ontology: Mol. function=motor activity; Cellular component=cell projection; Biological process=axonogenesis
  Homolog annotation: Hit_ID=UPI00016621D1; Match level="QueryCoverage =58%, HitCoverage=40%, E-value=4e-19, Identity=33%"; Hit description =UPI00016621D1 related cluster
RNTHPRLHTFRGLHVLTFRGLHTLAFVGLHALTFRGLHVLTFRGLHALTFRELQALTFRGLHVLPFRGLHVLAFRGLHTLAFRGLHTLAFRGLHVLAFRGLHALTFRGLHALSFRGLHALTFRGLYALAFRGLHVLAFIGLHALAFSGLPVLTFKGLHALAFRGLHVLAIRGLHALVFRGLHALAFIGLLVFAFKGLHVLAFRGLHICAFRELKGSRPPDTQWTQRRPTRPWGFQLWLWASASPIGCPSPQARSCHRDIGIAPARHPVDPEKSNRVLGFPAPITSLRQFYGVPIAPSRVIRPLLIGLSSRSTAPLGRRRARHHSSGQQTQRHHLQSTPQLIHEKARAFKILSLW

SEQ ID NO: 168196 - protein, 216 aa, Glycine max
  Coding DNA Sequence Number=SeqID_76511
MEFFSNENFECFQAFENSNLIPFMSLKLPVYSELVKAFYSNLEIHEGVLMSEIYGMKMVIDQSLFYDLTKLSSEGVPFEGALIDEWKFDFSVYDARRSSNLAQVSEEDLIVMWAFHKGLQIDWAHLVRYRMHKALRLNAPLPYPHLVTLFLQHFNIPLDSEPYVPIKRSFLIGASVIASFGYIKEHDGSWVKKGARNIGEEGHEGEDSSLLSKIME

SEQ ID NO: 168197 - protein, 98 aa, Glycine max
  Coding DNA Sequence Number=SeqID_76512
FVTSHDMFQMQGEQTRCPYKKCKCKVFKFVDDVMRDLYEEGFMPNYYWWTNHGEELPQFPPILLQGSYYESGGQRKKLNPYEQMIMDHAGPSIGQYIE

SEQ ID NO: 168198 - protein, 612 aa, Glycine max
  Coding DNA Sequence Number=SeqID_76513
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q143B6; Match level="QueryCoverage=100%, HitCoverage=62%, E-value=0.0, Identity=54%"; Hit description =Phosphoenolpyruvate carboxylase
ATTLFKFYLQELAALKRELAVSTRVVGVSEAVLHMTKTSRDQSQHRLDEPYRLALNGVYDRLLATANQLLPEGGWVLEQGIVADAYENAEALLVPLETIAASLRQHQGEALIYPRLGKLIKAVHSFGFHLATVDIRQSSDVHEAVITELLHKAGHDFDYASFNEDEKIGVLLEELKQPRLLFSPFQQYSELVHKEIGVLVAVRETRERFGEHAVRQYIISHTETLSDLLEVALLQREAGLLRGVWGSANIQVDLNIVPLFETIADLRDAPMIMGKWLSLLGIRHIIRHQGNEQEIMLGYSDSNKDGGFLTSNWELYKAEISLVELFNQANVRLRLFHGRGGTVGRGGGPTYQAIMAQPKGTVDGQIRLTEQGEIISTRYADPVVGRQHLETLIAATLDATLFPADQLESSKRRAFESVMEALSTTAMTSYRSLVYETPGFAEYFFNTTPIDEIAGLNLGSRPAARKSTRRIEDLRAIPWGFSWGQCRLLLPGWYGLGSAIQHFLQQDPALKESRLAMLLEMQAHWPLFNTLINNVDMVLAKTDLIVARHYAHLLEDRELREEIFSRIAHEHKLTTDAVNLLLGTTQRLASQPVIAKSIRDRLPYLDPLNHLQ

SEQ ID NO: 168199 - protein, 70 aa, Glycine max
  Coding DNA Sequence Number=SeqID_76514
MDKSLKVGEDEWRDKERRSTEFCASNETQVKNQDSGKFEESKSHSIKNQDSSEDSREDSRLERISRKTSR

SEQ ID NO: 168200 - protein, 229 aa, Glycine max
  Coding DNA Sequence Number=SeqID_76515
IPNFEALEEVEEVQALKLELRKARLGKEKFKSAATHIRKECTELQEENAATARALEQETKRARKEEYGQEKFRGALWGSNSELKLRREERDRSRVHGMILKEELAACARSKRSLAQHLEATEQSMLAIIGQYKEELNQSVAHEQKLVEDFAQVYAEKEARGRVIDALHQEATMWMDRFALTLNGSQDLPHLLAKAKAMADVCTAPEEIHGLINYCQHMIDLMAHIIRNR

SEQ ID NO: 168201 - protein, 95 aa, Glycine max
  Coding DNA Sequence Number=SeqID_76516
LPIVNADSPTVLHPSRNQLLLLISDHCEASLLRRLPKAHGITHLASHIRDKCPVGCLDDGGGSQRSFEAYIKNQSLSGCIWSLAPSSFDAYMWMG

SEQ ID NO: 168202 - protein, 204 aa, Glycine max
  Coding DNA Sequence Number=SeqID_76517
MDISEDTNIPVILGRLFMLTASCIVDMGKRKLELGFQDQKIDFDLFVEDKPAPEHNVCLQVMEGGQEVLKMALRKRARTEDIPSSSTLAPPPIITMEHFLEQVAWPEAQLPLVRVNEAALPEPTHVQVDPEPADPQSPVVNPPSSPEREVVPPSPLLIVIFDASSDEAAAPPDSPAGETADPSTSPVGGIVDLSYSSSGEASSH

SEQ ID NO: 168203 - protein, 71 aa, Glycine max
  Coding DNA Sequence Number=SeqID_76518
MAEINQGKTMTSHDCPRIFVSYLQVHRDGSSGARVTIDRSLPLPGAKQAENVAARQPSILCGCSFFYYCLF

SEQ ID NO: 168204 - protein, 62 aa, Glycine max
  Coding DNA Sequence Number=SeqID_76519
APYQDDELVELQEVLEVNPDVINESLADVDGGGEEIDASLLKQLDLVELDEDECILSENDIE

SEQ ID NO: 168205 - protein, 371 aa, Glycine max
  Coding DNA Sequence Number=SeqID_76520
MAPRKLASKRSRKDKAAEGTSSAPEYDSHHFRSAEHQQRFEAIKGWSFLQERRVQLRDDEYTDFQEEIVHRRWASLVTPMAKFNPDIVLEFYANAWPTKEGWIPFDADALSQFLGYPLVLEEGQECEYGQRWNQADGFDEEAIAHLLCIPVQDFTRTAAGRRVRIMRTNMTTLTQIWMTLLLSNIQPSDHNSDLPLPKCQLVYAVLTRMSIHVAQLIPNAIYLFAGMAPTRHPLDPDKSNRALGFPALITGLCQSFGVPVTPSKVIQPPITRAFIEKYCTQRLAQGDAPQATDAPPPHQAGPAGSFDSEYLQSQGFTSFPCPTSDQYRAEVAWPGDWREAQAGEAPGEADEAREDEEMTDLLNFLGGSGAT

SEQ ID NO: 168206 - protein, 286 aa, Glycine max
  Coding DNA Sequence Number=SeqID_76521
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRFTPEDMLKEKLIDGVIEEPLGGAHYDPEAAYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168207 - protein, 271 aa, Glycine max
  Coding DNA Sequence Number=SeqID_76522
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
  Pfam annotation: Domain name=Ribosomal_L3; Domain location=43-212; Score=-114.5; E_value=0.1; Accession=PF00297.13; Description =Ribosomal protein L3
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRLFNEGEFVDVTGTSKGKGFQGVVKRHNFGGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168208 - protein, 150 aa, Glycine max
  Coding DNA Sequence Number=SeqID_76523
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MSLNNPLETFTFRSTCNVYKFTFVEQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 168209 - protein, 117 aa, Glycine max
  Coding DNA Sequence Number=SeqID_76524
KAGVAAHDVQRYVKESDWAAQCTRQDKMSNEELKLQDPRCRIQCPGHPARKYWTHKSVNRLCWIHDVGYNENDRSHPAQVVAAQIRTLLFKHEGCTGLSTKSGIEELFSEFWDLSVL

SEQ ID NO: 168210 - protein, 125 aa, Glycine max
  Coding DNA Sequence Number=SeqID_76525
MGDQEEIQEQMKADMLALKEKMASMMDAMLGRRQLMKNNVATNATVSSAAEADPTLPATAHHPLPNMVGRERSTLGHISNPHLGYNRVAYPYGLPPNYTPPVMRDDVGHVLSPILEGEPPRQSDE

SEQ ID NO: 168211 - protein, 57 aa, Glycine max
  Coding DNA Sequence Number=SeqID_76526
MATMIEVMMSIKEIIEVNAAAIAATSTIAEVDLPPIWPQPNKSSNPRYGRSGRQRVG

SEQ ID NO: 168212 - protein, 255 aa, Glycine max
  Coding DNA Sequence Number=SeqID_76527
  Homolog annotation: Hit_ID=Q2HW90; Match level="QueryCoverage=29%, HitCoverage=14%, E-value=8e-09, Identity=42%"; Hit description =Putative uncharacterized protein
MGSSQKPSFKKRFYQVKIKSLKVTSLRELGQLMGQLQRQAFRKAYGKIWDLARVEVSIESIASLAQYYDHPLRCFTFGDFQLPPMAEEFEEILGCRNEWASFIDVLALLIFGGVLFSNVDGLVDLAAIDAFLAYHNHKESPVVAMLADLYDTFDRGCEKSSARIVCCALALYVWLVSHLFLQEGRPVYPLQGHRSCVEKGKANWDQLLASMEGRLLIGSLARRKEESGLYLHAKDVQMFPGWEHGVVLIIIPSSP

SEQ ID NO: 168213 - protein, 158 aa, Glycine max
  Coding DNA Sequence Number=SeqID_76528
MVTRTFRQLGANEPVDVKRLASSSTLFAIQGHRVRWQAEIPYGHPRLSSTKGKDFDGIRMMLAGRSGAMEKGSNMVVQPSWDPRLTASRYLTPIVRQSVEFRDMSEVEGKHCCAIRKVPQHSRSQRRGCCVVRKVSGMQIAIRPTWAFKDVPTEGGAF

SEQ ID NO: 168214 - protein, 29 aa, Glycine max
  Coding DNA Sequence Number=SeqID_76529
MRHIRSIEGDEYGSAAVAAVAAAASETCR

SEQ ID NO: 168215 - protein, 150 aa, Glycine max
  Coding DNA Sequence Number=SeqID_76530
  Homolog annotation: Hit_ID=Q2HUJ1; Match level="QueryCoverage=63%, HitCoverage=37%, E-value=5e-07, Identity=31%"; Hit description=H+ -transporting two-sector ATPase, alpha/beta subunit, central region, related
  Subcellular localization annotation: CTP_CleavageSite=47; ConfidenceScore=5.45e-01
MELRGGNSRLWVSSQFSWASASTGKVFAFKCNLMVPSKVTVFSWKVVLDRVQTRLQFRKRKLLRHFDDISCPFCKQHVETANHLLFLCQVSHYVWMRGCNWLELDIVLPNEVIAHFWQHAGLIAGTKSKKGHGVRCGWRLRGLYGPTEMI

SEQ ID NO: 168216 - protein, 142 aa, Glycine max
  Coding DNA Sequence Number=SeqID_76531
  Homolog annotation: Hit_ID=A3BRV8; Match level="QueryCoverage=45%, HitCoverage=11%, E-value=1e-15, Identity=48%"; Hit description =Putative uncharacterized protein
MVLDAEWKSFSKTNFESKADKVKECDTDTPCLHLIYDMWDSMIEEVREKVFEHEGVLEARRNKSNTSLHCLAHLLVPKYYSESWLQGESGMEEYKVGSSSYWDVGGYVLLVDDDYVDTFANLFVDDPEIEGVLFNDEEEQVN

SEQ ID NO: 168217 - protein, 95 aa, Glycine max
  Coding DNA Sequence Number=SeqID_76532
  Homolog annotation: Hit_ID=Q0WQ56; Match level="QueryCoverage=35%, HitCoverage=7%, E-value=2e-09, Identity=88%"; Hit description =Putative uncharacterized protein At3g49310
VDAFPITVMFGMCSIFLLVACILQRRLMVISDKPISVYICARCDLSEGKPDAHKEKGLKEQAERTSGTIFLKCFCYLPSAINYGGACVASRVERC

SEQ ID NO: 168218 - protein, 1007 aa, Glycine max
  Coding DNA Sequence Number=SeqID_76533
  Gene Ontology: Mol. function=binding; Cellular component=ubiquitin ligase complex; Biological process=protein ubiquitination
  Homolog annotation: Hit_ID=A7QEZ3; Match level="QueryCoverage=100%, HitCoverage=100%, E-value=0.0, Identity=55%"; Hit description =Chromosome chr16 scaffold_86, whole genome shotgun sequence
  Pfam annotation: Domain name=Arm; Domain location=365-405; Score=4.7; E_value=2.8; Accession=PF00514.14; Description=Armadillobeta-catenin -like repeat
  Pfam annotation: Domain name=Arm; Domain location=490-530; Score=2.4; E_value=5.4; Accession=PF00514.14; Description=Armadillobeta-catenin -like repeat
  Pfam annotation: Domain name=Arm; Domain location=531-571; Score =34.0; E_value=5.6e-07; Accession=PF00514.14; Description =Armadillobeta-catenin-like repeat
  Pfam annotation: Domain name=Arm; Domain location=572-615; Score=9.5; E_value=0.69; Accession=PF00514.14; Description=Armadillobeta-catenin- like repeat
  Pfam annotation: Domain name=Arm; Domain location=752-798; Score =12.2; E_value=0.31; Accession=PF00514.14; Description=Armadillobeta -catenin-like repeat
  Pfam annotation: Domain name=Arm; Domain location=875-915; Score =23.9; E_value=0.00061; Accession=PF00514.14; Description =Armadillobeta-catenin-like repeat
  Pfam annotation: Domain name=Arm; Domain location=919-959; Score=5.2; E_value=2.4; Accession=PF00514.14; Description=Armadillobeta-catenin -like repeat
  Pfam annotation: Domain name=HEAT; Domain location=375-407; Score =5.6; E_value=4; Accession=PF02985.13; Description=HEAT repeat
  Pfam annotation: Domain name=HEAT; Domain location=537-573; Score =12.4; E_value=0.37; Accession=PF02985.13; Description=HEAT repeat
  Pfam annotation: Domain name=HEAT; Domain location=807-843; Score =18.8; E_value=0.021; Accession=PF02985.13; Description=HEAT repeat
  Pfam annotation: Domain name=HEAT; Domain location=880-917; Score =12.3; E_value=0.39; Accession=PF02985.13; Description=HEAT repeat
  Pfam annotation: Domain name=HEAT; Domain location=970-1001; Score =1.1; E_value=18; Accession=PF02985.13; Description=HEAT repeat
  Pfam annotation: Domain name=U-box; Domain location=265-334; Score =65.0; E_value=2.5e-16; Accession=PF04564.6; Description=U-box domain
  Pfam module annotation: Pfam domain module=Arm::Arm::Arm::Arm::Arm::Ar m::Arm::HEAT::HEAT::HEAT::HEAT::HEAT::U-box; Domain location=365 -405::490-530::531-571::572-615::752-798::875-915::919-959::375 -407::537-573::807-843:...
  Pfam module annotation: Domain location=:880-917::970-1001::265-334
MANELVARASHAPTSELLSRTIFAVFDTIKAANEVVIHKENLKRFSVHLKNVSLILKSLSKQDIHNSASLENAMNGLYREVGVAKQLFVECNNRSKVYLLINSRKIVTHLNCCTKDIGRAVSLIPLASLDINSDLNQQISELCKKMLDAEYQTAAADEEILKKIETAIQEGNVDRSYANQLLTCIADAIGVPLEHGALKREFEELKNEMENAKSRVDVAEALHMKQIIAVLGKADFITSAQEKETRYFEKRNSLGERPLMPLQSFYCPISLAIMADPVETSSGKTFERREIEKWFAEGNTLCPLTRLPLDTKILRPNKTLKQSIQEWKDRNTMITISAIKSELETNDEEGVVQSLEKLQKLCLEREVHREWLKMENYITVLIGLLSSKNREIRKHVLLILCMLAMDNADNKEDIAKVDNALGLIVRSLSRQAEERKLALVLLLELSKCKMVCSLIGSIQGSILLLVSMINSDDVEAAKHAHELLVKLSVLDQNVIEMAKANYLKPLLLKLSTGSENMKIVMTETLSKITLTDQNKLSLVKDGALQPLVQLLLNDDLEIKKVAVKALLQFSSLPENGLQMIKEGVAPPLLELLYCHSLQSPTLLEQVVATIMHLAMSTTYQHAEPEQVSLLDSEEDIYKFFSLISLTEPEIQNKILRAFQALCQSFYGLRIRKRLRQISAAKVLVHLLELNTQPVQVNSLKLFYCLTEDGDDGNISSHITERFIKVLLTIIEASDDAEAMVTAMGIISKLPQESHMTQWLLDSGALKTILTCLTDQHKHVSHKKQVIENSVQALCRFTVSTNLEWQKRVALEGIIPVLVQLLHSGTPFTKQNAAISIKQFSESSYRLSEPIKKPSIFKCCLVAKETGCPAHLGTCSVESSFCILQANALEPLVRMLADQDDGTREASLNALLTLVDSEAPQSGSKVLANSNAIAPMIQLSSVPIPRLQERILIALERIFQLDDVRNKYKVVATMHLVEITQGKDSRMRSLAAKCLAQLGELNKQSSYF

SEQ ID NO: 168219 - protein, 100 aa, Glycine max
  Coding DNA Sequence Number=SeqID_76534
GLFPEEPWCLPTWMAKSYLHPDFPSAVSLVTIFQRNERGFEALVLTLGQDHLELPSGVRTKCGQQKPIKERMQVGMGSRPTDRCPFAALDKQRTSLQGSP

SEQ ID NO: 168220 - protein, 57 aa, Glycine max
  Coding DNA Sequence Number=SeqID_76535
MTVATTNIHQFPFGQASYADLELKIKLIDTVDLEGGPAEGILAYYVGTDEGVSEVLH

SEQ ID NO: 168221 - protein, 154 aa, Glycine max
  Coding DNA Sequence Number=SeqID_76536
MTSKIILMMPKNQELSKFQRIRSQQASRIKFQRIKIQEQSCFKIQDSRTIKFQESRFKNNQDQDSRLKIQESREDSIKIRYILCGTSRGYIYLGCYTENKRGYISCGSVQVEGTSTWLFKENKGGYIPCGSLACKGFYKVERNLKNPWLLGDWM

SEQ ID NO: 168222 - protein, 442 aa, Glycine max
  Coding DNA Sequence Number=SeqID_76537
  Gene Ontology: Mol. function=alkaline phosphatase activity; Cellular component=contractile vacuole; Biological process=metabolic process
  Homolog annotation: Hit_ID=A5FF14; Match level="QueryCoverage=98%, HitCoverage=98%, E-value=0.0, Identity=68%"; Hit description =Alkaline phosphatase precursor
  Pfam annotation: Domain name=Alk_phosphatase; Domain location=39-438; Score=166.0; E_value=1e-46; Accession=PF00245.11; Description =Alkaline phosphatase
MNRRKFLKGSALLSGLFAINPVNVLATEPAVKPKSYKKAKNIIFMVSDGMSSGTLALANLYSQNILGKSGNWINLYKENKVSRALMDTASASSIVTDSAAASSSFGGGFRVKNGVLNIGVNGEKYVPIWQKFKKAGKKTGCVTTVTITHATPAGFCINSASRNAEPEIAEMYAEIGFDVMMGGGDEFFNPAKREDKKDVYGLYKQKGYQILKNRSDLQNIDKSKPVLGVFNTGALPYSIDRANIAALQSTPTIAEMAKTAIDQMKDHKEGFVLQIEGGKVDWSAHANDVAALIHDQIAFEEAVKVAVDFAEKDKNTLVIITTDHGNANPGTIYGADATRNFNTIAHYKFTNEYVLNAIHPDFNLQQTKDWIYETNAISLADDEAKSLLSFYTSLDKEGGMDHSGDYVELAMFGPGSELLKPFVKNTDLHYIMLEATELSAHT

SEQ ID NO: 168223 - protein, 33 aa, Glycine max
  Coding DNA Sequence Number=SeqID_76538
MNALSTLAALSLFIATVKILDFQMNALNGPCRA

SEQ ID NO: 168224 - protein, 58 aa, Glycine max
  Coding DNA Sequence Number=SeqID_76539
MKKKKIALYGSRFDEEMSEIGRFGGLGMEVRRKEEGAAQEILKNVIFIEQDAWPSVLV

SEQ ID NO: 168225 - protein, 228 aa, Glycine max
  Coding DNA Sequence Number=SeqID_76540
MWFPGSFPFTSYPKFVNINQCTLCVRLIASEPNLRSCLMDEGLTEDYTSSPSKDYTSSPSEDCTSLPLEDCTSSPIEYFTSLLSGGYTPSPSGGYTPSSSKAYTPSPSKGYTPSSSKGYMPSPSEDYTSSPSKDYTPSSSKGYTPSPSEDYTSSPSEGCTPSSSEDYMSSPLRGLHALALRGLHIPLFRSLHALGFRGRHILAFGGLRSPSPFEGYASSLSVGSISTP

SEQ ID NO: 168226 - protein, 156 aa, Glycine max
  Coding DNA Sequence Number=SeqID_76541
  Homolog annotation: Hit_ID=Q6UUU1; Match level="QueryCoverage=38%, HitCoverage=40%, E-value=9e-19, Identity=78%"; Hit description =Putative uncharacterized protein
  Subcellular localization annotation: CTP_CleavageSite=24; ConfidenceScore=5.31e-01
MEPDGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPGPGLSVY

SEQ ID NO: 168227 - protein, 213 aa, Glycine max
  Coding DNA Sequence Number=SeqID_76542
  Gene Ontology: Mol. function=chlorophyll binding; Cellular component =integral to membrane; Biological process=photosynthetic electron transport
  Homolog annotation: Hit_ID=Q2MI75; Match level="QueryCoverage=98%, HitCoverage=66%, E-value=2e-67, Identity=47%"; Hit description =Photosystem II P680 chlorophyll A apoprotein
  Pfam annotation: Domain name=PSII; Domain location=4-213; Score=78.0; E_value=3e-20; Accession=PF00421.10; Description=Photosystem II protein
GIFMGLPWYRVHTVVLNDPGRLLSVHIMHTALVAGWAGSMALYELAVFDPSDPVLDPMWRQGMFVIPFMTRLGITNSWGGWNITGGTITNPGIWSYEGVACFGFGAFHVTGLYGPGIWVSDPLWTNWKDTIRKSRVGRGRNVGHISSIAAVFFAAFVVAGTMWYGSATTPIELFGPTRYQWDQGYFQQEIYRRVGAGLAENQSSMDNGDGIAV

SEQ ID NO: 168228 - protein, 68 aa, Glycine max
  Coding DNA Sequence Number=SeqID_76543
MSRNFMDYATISSSASGMLRNFTDCAIMFPFDSRHVAELHGLLNDGCQVPRSGQAKVACHQTMVPRKN

SEQ ID NO: 168229 - protein, 102 aa, Glycine max
  Coding DNA Sequence Number=SeqID_76544
  Gene Ontology: Mol. function=helicase activity; Biological process =viral genome replication
  Homolog annotation: Hit_ID=Q2A9E0; Match level="QueryCoverage=76%, HitCoverage=5%, E-value=1e-22, Identity=62%"; Hit description =Putative uncharacterized protein
MMAHVVATFLFFVYANTNEQRHIFDSIINAVNGHAGGMFFLYGYEGTRKTFMWKTLASALHSKGDIVLTVASSGIASLLLPNGRTAHSKFVIPVRTLKELKE

SEQ ID NO: 168230 - protein, 174 aa, Glycine max
  Coding DNA Sequence Number=SeqID_76545
MSVHVAQLIADAIYIFAGMPPTRHPLDPDKSNRALGFPALIAGLCQSFGVPVTPSKVIRPSITRAFIEKYCTPRQAQGDAPQDAGAPPPPHQADPPGSFGTERYLLYFVRRQAANHRGLSQQSQGFAPFACPTPDQFRAEVAWHGDWPEAQAGEARMDEEMTNLLGFLEGSGAT

SEQ ID NO: 168231 - protein, 128 aa, Glycine max
  Coding DNA Sequence Number=SeqID_76546
LCQSFGVPVAPTKVIRPPITWAFIEKYCTYRQAQGDAPQAAGAPPPPHQASPAGSFDMEQYLWHLSQGFASFSCPTPDQFRAEVAWPGDWPEAQAGEAPPEAPGDGEEAHEDEKMADLLDFLGGSGAT

SEQ ID NO: 168232 - protein, 215 aa, Glycine max
  Coding DNA Sequence Number=SeqID_76547
HKRIQFLTLEGSHALTVERASRPRHQRIACPHPQRTARAHLQRTARPHPQRTARPHLQSTARPHPQRAARPHLQKTTCPRLESATRPRLGGLHALTSRGLHVLALGTSYPHLQRTTRPRLERTTRPHHQRAARPHHQRTARPRLRRATCPHIRGLHRTACPHPQRTARPHPQRTARPHLQRTARPHPQRTARPHLQRTARPHPQRAAHPHLQRTT

SEQ ID NO: 168233 - protein, 61 aa, Glycine max
  Coding DNA Sequence Number=SeqID_76548
MVESERLSFIRNNQNKLRVDKHFNLQESLATGSTTGLHKDLTKNHLLGKVVANMYTIEFQN

SEQ ID NO: 168234 - protein, 198 aa, Glycine max
  Coding DNA Sequence Number=SeqID_76549
  Homolog annotation: Hit_ID=A2Q6B4; Match level="QueryCoverage=33%, HitCoverage=27%, E-value=4e-09, Identity=40%"; Hit description =Ribosomal protein L33; Nucleic acid-binding, OB-fold
GDAIHVVCKQDQLKSWKADLMENYTYVMHNFKVMKNDGQFRICDHQYKLVFTGVTVVRQSDLEDLPFKKYKFADFTNVIVGLFQPELLVGSYAPSISNSLRASKLLINEAVFEIQEFRERLSDLGIQVRSVLTPGGHGSSQEGDVDLNVSPQALDKLLGYVLAFKVKVQPKFNNVVVLRYSNDSDLINVVPLSSYLLP

SEQ ID NO: 168235 - protein, 95 aa, Glycine max
  Coding DNA Sequence Number=SeqID_76550
MVGSLRRQTTSCILSPIEKRIEIELRHFFFLLKISPFAKRKPRAKCIFCHALRGESLALSTQPLHLRLIWSTKQAKAELSPFQFDLNWAKRWPAH

SEQ ID NO: 168236 - protein, 91 aa, Glycine max
  Coding DNA Sequence Number=SeqID_76551
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
  Subcellular localization annotation: CTP_CleavageSite=22; ConfidenceScore=5.14e-01
MVKVGTSYVPINVSFSPKSWPRASRYQQGHQDLFFLRSDLPSQVLQWLLFLSAVPPVQLLTGWCVTAKAPPDISAGKCSGHAARNHHTRRA

SEQ ID NO: 168237 - protein, 242 aa, Glycine max
  Coding DNA Sequence Number=SeqID_76552
  Gene Ontology: Mol. function=transcription factor activity; Cellular component=intracellular; Biological process=regulation of transcription, DNA-dependent
  Homolog annotation: Hit_ID=A8GIR1; Match level="QueryCoverage=87%, HitCoverage=86%, E-value=1e-86, Identity=79%"; Hit description =Transcriptional regulator, GntR family
  Pfam annotation: Domain name=FCD; Domain location=80-204; Score=91.6; E_value=2.5e-24; Accession=PF07729.3; Description=FCD domain
  Pfam annotation: Domain name=GntR; Domain location=8-70; Score=44.0; E_value=5.4e-10; Accession=PF00392.12; Description=Bacterial regulatory proteins, gntR fam
  Pfam module annotation: Pfam domain module=FCD::GntR; Domain location= 80-204::8-70
MEEAGVSLNELAYRRFKQALVTLSYKPGEYLNTAQVMNDLDMGRTPINQAIHRLANEGLLQVIPRKGVMVSPLSMDDALELIEVRLANEMLCMQLASQRITERQIATLTELNRQIEAASQERDRVRMMTLDHEFHQELAQIAGNNMLADILSVLHARAQRFWASTLSREGHMREVIDEHRAIIAALAAQDSAAAAEAAQAHILSFRSALLHDGSVERWPTLVGVALKNSKKSGENLTGPLAT

SEQ ID NO: 168238 - protein, 154 aa, Glycine max
  Coding DNA Sequence Number=SeqID_76553
  Homolog annotation: Hit_ID=A8GIQ8; Match level="QueryCoverage=26%, HitCoverage=18%, E-value=2e-07, Identity=63%"; Hit description =Putative uncharacterized protein
MTRRISMNDSPNGMLFVATDVATQDDADFNRWYDREHVEERVRVPGFYPAHAIGHCRAGVNIWGCIKPNRWPVLPPKPIAPRFNTKRLGRWPAWRKCAIQCAGCVRWRRSPAKGAAVISVSSCCRRRHRKRCMPASCNWAHGWLNSLALCAAAC

SEQ ID NO: 168239 - protein, 181 aa, Glycine max
  Coding DNA Sequence Number=SeqID_76554
  Gene Ontology: Mol. function=protein kinase activity; Biological process=protein amino acid phosphorylation
  Homolog annotation: Hit_ID=A9R0Y3; Match level="QueryCoverage=98%, HitCoverage=48%, E-value=3e-67, Identity=69%"; Hit description =Carbohydrate uptake ABC transporter 2 (CUT2) family, periplasmic carbohydrate-binding protein
CAPIEDLIAQKVDIIGVVPNDARVLEPVLKRAQEAGIKVIVHESPGQKYADWDFELVDASQHGVNHMKALAACMKEQGKYAVYVGSLTVPLHITWSDSAINYQKQHYPNMQLVGDKFGVGESLDDSVRTTNDLMAKYPDLKGVLAFGSQGPIGAGRAVLNRGKSNDICVIGPFSPGQGASL

SEQ ID NO: 168240 - protein, 109 aa, Glycine max
  Coding DNA Sequence Number=SeqID_76555
MKNDEERWKTFTKLPTETSRKCYGSASAWIFFTETNFLTNFKGKEGGGCRPARPGELDCFHQKAPPSVETPWMVQVGLNLTDCLTMGVKYLEAVKRRLHPTKQMVPGRN

SEQ ID NO: 168241 - protein, 58 aa, Glycine max
  Coding DNA Sequence Number=SeqID_76556
MSQHAGIQPHIVSSLSHMLDEHNAHAKSFRMTRDRLADSQVDNIRLKLIVAREKDGRV

SEQ ID NO: 168242 - protein, 90 aa, Glycine max
  Coding DNA Sequence Number=SeqID_76557
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTLTCRSTSHFAKSWPRASRYQQGHQDLFILRSDLPSQVLQWLLFLSAVPPVQLLTGWCVTAKAPPDISAGKCSGHAARNHHTRRA

SEQ ID NO: 168243 - protein, 113 aa, Glycine max
  Coding DNA Sequence Number=SeqID_76558
MVISPERRVQLRDNEYTDFQEEIGHRRWASLVTPMAKFDPNIVLEFYANAWPTEEGVCDMRSWVRGQWILFDAYAIGQLLGYPLVLEEGQECEYGQRRNRSDGFDEEAIAQLL

SEQ ID NO: 168244 - protein, 137 aa, Glycine max
  Coding DNA Sequence Number=SeqID_76559
  Gene Ontology: Mol. function=transporter activity; Cellular component= membrane; Biological process=oligopeptide transport
  Homolog annotation: Hit_ID=A7PTC3; Match level="QueryCoverage=70%, HitCoverage=15%, E-value=1e-35, Identity=76%"; Hit description =Chromosome chr8 scaffold_29, whole genome shotgun sequence
MSDMDTVENSIRGNGEIAEKEEHQHHTSKTEHRRGGIRTLPFILANELCDRFASSGFHANMISYLTQQLNMPLVSASVTLTNFNGTSSFTPLFGALIADSFAGRFWTIVVASFIYELVSHPLLFTLYNLSHIHLSHS

SEQ ID NO: 168245 - protein, 626 aa, Glycine max
  Coding DNA Sequence Number=SeqID_76560
  Gene Ontology: Mol. function=transporter activity; Cellular component= membrane; Biological process=oligopeptide transport
  Homolog annotation: Hit_ID=A7PTC3; Match level="QueryCoverage=86%, HitCoverage=90%, E-value=0.0, Identity=62%"; Hit description =Chromosome chr8 scaffold_29, whole genome shotgun sequence
  Pfam annotation: Domain name=MFS_1; Domain location=4-535; Score =29.0; E_value=1.7e-05; Accession=PF07690.7; Description=Major Facilitator Superfamily
  Pfam annotation: Domain name=PTR2; Domain location=119-527; Score =458.5; E_value=9.1e-135; Accession=PF00854.12; Description=POT family
  Pfam annotation: Domain name=Sugar_tr; Domain location=1-600; Score= -185.6; E_value=0.099; Accession=PF00083.15; Description=Sugar (and other) transporter
  Pfam module annotation: Pfam domain module=MFS_1::PTR2::Sugar_tr; Domain location=4-535::119-527::1-600
MTVTISIGITIIFTITIIIVLIAIIIGVEGGDGSNDNDNDDDDDDDCNSSHDSDGNDEKSHDNKGRDVAGFNGNLISYLTQVLNMPLVSASNILTIFVGTGSFTPLLGALIAESFAGRFWTITIASLIYQLGLISLTVSAILPHFRPPPCPTQENCQEATSSQLSMLYISLLLTSLGSGGIRPCVVPFLGDQFDMTKNGVASRKWNLFNWYFFSLGLASLSALTIVVYIQDNTGWGWGFGIPTIVMLVSIIAFVLGSPLYKTEKPEGSPLVRLAQVIVAAIKKRNETLPSDPKFLYQDRDLDAAICLEGRLLHTDQFKWLDKAAIVTGEDARDPNAPPNLWKLATVHRVEELKSIIRILPISSSGILLIAASSHLPSFVIQQARTMDRHLSHSFQISPASMSIFSVLTMMTGVIVYERLFVPFIRRFTKNPSAITCIQRMAIGFVINTIATLVSAPVEIKRKAVAEKYHLLDSPSATIPISVFWLVPQYCLHGLADVFMSVGLFEFLYDQSPESMRSSATALYCIVIALGSYAGTFVVTLVHKYSGSKERNWLPDRNLNRGRLEYYYLLVSGIQVLNLVYFGICIWCYTYKPLEEIAEVSMEKDLELEQANSKVSCVNSKDGGDAE

SEQ ID NO: 168246 - protein, 88 aa, Glycine max
  Coding DNA Sequence Number=SeqID_76561
MKVIQANKRKRKTTSELENTQCGVACGRERKGEESTVRKRDHQKLLLKTRGRNVLGFDESMSILLTSDGELVEAEGEGERRGEESDSG

SEQ ID NO: 168247 - protein, 86 aa, Glycine max
  Coding DNA Sequence Number=SeqID_76562
  Gene Ontology: Mol. function=catalytic activity; Cellular component =cellular_component; Biological process=metabolic process
  Homolog annotation: Hit_ID=Q8H2B0; Match level="QueryCoverage=77%, HitCoverage=9%, E-value=1e-30, Identity=89%"; Hit description=Beta -amyrin synthase
MWRLKIADGGKDPYIFSTNNFVGRQTWEFDPEAGTPEERAQVEAARQNFYNNRFKFKACGDLLWRFQDCDILASNHIYTYPKQQEA

SEQ ID NO: 168248 - protein, 52 aa, Glycine max
  Coding DNA Sequence Number=SeqID_76563
MTLTNNLDVLCIQETKIEAIDRRIYQYLWVDCNLTSSQATSITPAGFPLLEV

SEQ ID NO: 168249 - protein, 116 aa, Glycine max
  Coding DNA Sequence Number=SeqID_76564
MTRGNPGDLQPVDPEIDRTFHRLVRHSVHPGHSVHFEHFEHPDHFEHSVVGDSEYSDFEHSTVNFHTKNMAQPPPREMAAHDFTYESLCIQYLDEGVPYVLKTGLIHLLPKFHGLA

SEQ ID NO: 168250 - protein, 515 aa, Glycine max
  Coding DNA Sequence Number=SeqID_76565
  Gene Ontology: Mol. function=transferase activity, transferring glycosyl groups; Cellular component=cytoplasm; Biological process =carbohydrate metabolic process
  Homolog annotation: Hit_ID=A7PTD8; Match level="QueryCoverage=91%, HitCoverage=58%, E-value=1e-164, Identity=66%"; Hit description =Chromosome chr8 scaffold_29, whole genome shotgun sequence
  Pfam annotation: Domain name=CBM_20; Domain location=15-111; Score =19.0; E_value=1.7e-06; Accession=PF00686.10; Description=Starch binding domain
  Pfam annotation: Domain name=Glyco_hydro_77; Domain location=172-515; Score=158.8; E_value=1.5e-44; Accession=PF02446.8; Description=4 -alpha-glucanotransferase
  Pfam module annotation: Pfam domain module=CBM_20::Glyco_hydro_77; Domain location=15-111::172-515
  Subcellular localization annotation: CTP_CleavageSite=34; ConfidenceScore=5.24e-01
MVNPGLFSANKSVNSVKVSFRIPYFTQWGQTLLVCGSVPVLGSWNVKKGVLLRPIHQGAELIWGGSITVPKGFRCQYSYYVVDDNKNVLRWEMGKKHELVLPEGIRSGHEIEFRDLWQTGSDALPFRSAFKDVIFRQCWDLSDTTVGVNHINIEPEDGMMREIPWRGAGVAIPMFSIRSESDLGVGEFLDLKLLVDWAVATGFHLVQLLPINDTSVHGMWWDSYPYSSLSVFALHPLYLRVQALSKNIPEAIKKEIEKAKQQLDGKDVDYEATMATKLSIAKKVFAQEKDLILNSSSFKEFFSENEGWLKPYAAFCFLRDFFETSDRTQWGHFAHYSEDKLEKLVSKDSLHYEIICFHYYVQYHLHLQLSEAAEYARKKGVILKGDLPIGVDRNSVDTWVYPNLFRMNTSTGAPPDYFDKNGQNWGFPTYNWEEMSKDNYGWWRARLTQMAKYFTAYRIDHILGFFRIWELPDHAATGLVGKFRPSIPLSLSIYISCLICCRKNLKEKEYGTLIA

SEQ ID NO: 168251 - protein, 769 aa, Glycine max
  Coding DNA Sequence Number=SeqID_76566
  Gene Ontology: Mol. function=cysteine-type peptidase activity; Cellular component=cytoplasm; Biological process=ubiquitin-dependent protein catabolic process
  Homolog annotation: Hit_ID=O22207; Match level="QueryCoverage=100%, HitCoverage=85%, E-value=0.0, Identity=58%"; Hit description =Ubiquitin carboxyl-terminal hydrolase 5
  Pfam annotation: Domain name=DUF1055; Domain location=106-244; Score =234.0; E_value=3.4e-67; Accession=PF06337.3; Description=Domain of Unknown Function (DUF1055)
  Pfam annotation: Domain name=UCH; Domain location=317-712; Score =142.2; E_value=1.5e-39; Accession=PF00443.20; Description=Ubiquitin carboxyl-terminal hydrolase
  Pfam module annotation: Pfam domain module=DUF1055::UCH; Domain location=106-244::317-712
MTEVLMCIASVSELSPDEERILIRDIALASQANSKEGDTFFLITQRWWQHWIEYVNQDQTNTSYDASSLSEQFDLANSSALKRPAGIDNSDLIDDAVLEDSGTGIEIHDTLLEGRDYVLLPQEVWNQLFRWYGGGPTLARKVISSGLSQTELAVEVYPLRLQLLMLPKNDRFPIRISKKETIGQLHRKACEIFDLQPDQVCIWDYYARRRHALMNDMDKTLDDANLQMDQDILVEVINNTNNTSFAQENGSAQREANSALVEPSKSSLSIAGGLSASRGASKGYNTDLSSSQNLNSPVRDVENPYGTSGVTTRSSFLGLTGLLNLGNTCYMNSAIQCLVHTPEFARYFREDYHREINWQNPLGMVGELALAFGELLRKLWAPGRTPIAPRPFKAKLVRFAPQFSGHNQHDSQELLAFLLDGLHEDLNRVKHKPYIKSRDADGRPDEEVADEYWANHIARNDSIIVDVCQPTTNRTMTVTVFACDGASLPFSCTVTVPKQGRCRDLIQALSNACSLKHNERLVLVEIRNHLIHRYFEDPLQLLSNIKDDDRLAAYKVPKIDKNTKYLQLIHRQREQSSDSHIISGWKPYGTPIVSLISCDDTVTRGDIQVIVNCMLSPLLRKGINVEQATTSETSIPKATSDHCSFNSDDDACAPNMMSNSVNKDTTNSKAPPMPLPTLPLLLVDDNNACIDLSMGEEKVVKLSPLSPKILVYIDWSQKLLEKYDTHTLETLPEVLKYGPVTKKARTEPLSLYTCLEAFLREEPLVPEDM

SEQ ID NO: 168252 - protein, 19 aa, Glycine max
  Coding DNA Sequence Number=SeqID_76567
MTQEEYALLTAIVILSPVY

SEQ ID NO: 168253 - protein, 15 aa, Glycine max
  Coding DNA Sequence Number=SeqID_76568
MTYLELSGWCKKVDE

SEQ ID NO: 168254 - protein, 110 aa, Glycine max
  Coding DNA Sequence Number=SeqID_76569
MMTKSSKINQRTTQVNQEQSKTQEESLETRIKIQGSRSQESRSRLKTQDSRMKRRLNQDKGYIYLGLTKNKRGYISCGSVLVEGTSTRFKENKGGYIPCGSLLVNGFLQG

SEQ ID NO: 168255 - protein, 87 aa, Glycine max
  Coding DNA Sequence Number=SeqID_76570
MLIDVGNALACACCVCSWGAKCTDLPGSLALALGHVHTLDIMYVHGGRSALTFQGLWHLLWAMFIRRMECMSWGVKCTNLIGWPRRG

SEQ ID NO: 168256 - protein, 121 aa, Glycine max
  Coding DNA Sequence Number=SeqID_76571
MEIFIQSIDPGAWNAIVKGPCIPTKKVNSELVSKEWDEMKDDEKRKVQDDQKAKNILTSSYILMNSFVLQGEKVQRKYGKCLKSLMKAQRIFSNEEWRNHFRTSNKIHPYCASSSWSWKNV

SEQ ID NO: 168257 - protein, 72 aa, Glycine max
  Coding DNA Sequence Number=SeqID_76572
MVVSQRALLRASEGEAHGCAFQRRKDARSRHQRLFVENVGKIEGNRSTKAGLLLLRTLHRRGNQTYVVLPYA

SEQ ID NO: 168258 - protein, 122 aa, Glycine max
  Coding DNA Sequence Number=SeqID_76573
  Gene Ontology: Mol. function=carboxylesterase activity; Biological process=metabolic process
  Homolog annotation: Hit_ID=Q0ZPW4; Match level="QueryCoverage=42%, HitCoverage=16%, E-value=6e-13, Identity=61%"; Hit description=CXE carboxylesterase
  Pfam annotation: Domain name=DUF1936; Domain location=83-118; Score =13.8; E_value=0.081; Accession=PF09151.1; Description=Domain of unknown function (DUF1936)
MLEFEFEFVFVTVRVAVPIRVCVRHCRDLVTLDLSCTVPLWVCVYSDPGAHLSMKFPSKVRYVGSLKLVSENDLLKDMGWYYNELLKKCGWNGVVKVIEAKGEGGVFHLLNPDCDNVVSLLD

SEQ ID NO: 168259 - protein, 43 aa, Glycine max
  Coding DNA Sequence Number=SeqID_76574
IMVRTRGLGHALGQVIGRGVGRGDRDDSDDAPQRRRPTASVWR

SEQ ID NO: 168260 - protein, 181 aa, Glycine max
  Coding DNA Sequence Number=SeqID_76575
  Homolog annotation: Hit_ID=Q6WAY4; Match level="QueryCoverage=87%, HitCoverage=29%, E-value=1e-17, Identity=33%"; Hit description =Putative uncharacterized protein
LMGQLQRQAFCKAYGKIWDLTMEEVSTEAIASLAQYYDQPLRCFTFGDFQLTPMVEEFEEILGCPLGGRKPYLLSGFYPSLARISKTVKISTQELDRGKQVENGVVGVPRKCLEAKARVLASQGEWAPFMDILALLIFGVVLFSNVDGLVDWASIDAFLAFYDRKESLIVAILANLYDIFD

SEQ ID NO: 168261 - protein, 77 aa, Glycine max
  Coding DNA Sequence Number=SeqID_76576
MRPLRVTPLSPVILVTLADNELMSVASSSLSLGGVYLHGTAWLFWYGKGTGLVAGGYWGPLMVIFHHGDAAEDKGEE

SEQ ID NO: 168262 - protein, 74 aa, Glycine max
  Coding DNA Sequence Number=SeqID_76577
MAEEESGLPTVNLHASHCAVMNVIHLNKREVKEMRKRQKTTILLKGHQNEESNFITCECCPECPLGTAESVDLF

SEQ ID NO: 168263 - protein, 218 aa, Glycine max
  Coding DNA Sequence Number=SeqID_76578
  Gene Ontology: Cellular component=ribosome
  Homolog annotation: Hit_ID=Q2HSY3; Match level="QueryCoverage=65%, HitCoverage=64%, E-value=1e-15, Identity=31%"; Hit description =Nucleic acid-binding, OB-fold, subgroup
  Pfam annotation: Domain name=DUF223; Domain location=39-135; Score= -1.5; E_value=0.0041; Accession=PF02721.5; Description=Domain of unknown function DUF223
MSRKENLISKLHTRKGTWKIVVRITDLWQARKQNSKQTIEMVLMDQTGSKIGATLWQELFTELRDKLQCGSSYLIQNLRIVDNQSEYRVSPAPYLVYFLKTTSVKEIHCPEIPSNIYLITPFTDIIFGLAQRHTLVDIVGVVADLIDVKTVNPPHRMTVRLRDNSMSVYMSMGVRTTNRDYAIHLREAIDKNPLLQEPLVVMLTLGKIKDATCVSGVG

SEQ ID NO: 168264 - protein, 123 aa, Glycine max
  Coding DNA Sequence Number=SeqID_76579
  Homolog annotation: Hit_ID=Q84VH5; Match level="QueryCoverage=61%, HitCoverage=11%, E-value=3e-32, Identity=96%"; Hit description =Envelope-like protein
MKRESPLSLHYKLFEGTHVPDIVSTSGKAASGAVSKDALIAELKDTCKVLEATIKATTEKKMELERLITRLSESGIDDEEAAEEEEEAAEEDKEAAEEEEEAAEEEEDAAEETESDGDSEATP

SEQ ID NO: 168265 - protein, 164 aa, Glycine max
  Coding DNA Sequence Number=SeqID_76580
MLSHQLGGSKKKLPSKTPTAAHLLPRRRVRDHHKHQPHGTKITRNYVCTWLNSKMQCGTIHHEIVHVTLSFRKTRQQVSRSPFHAQATPHPHGDQHESQGSSKPSDMPPSHYTLHPLCTYTAYIHRDDIININIISSQCHHQRQQSSHLNIINIIGNHIPHTHT

SEQ ID NO: 168266 - protein, 100 aa, Glycine max
  Coding DNA Sequence Number=SeqID_76581
MSLPSAVHVSPLSKEKRRSGDESRHHRKGRTDEINVLSVATYPSAGGRSVTRGMRVPQKEYARSRHQRLFEENVGKTGKDAIYELLSERFGSCIYARGRY

SEQ ID NO: 168267 - protein, 180 aa, Glycine max
  Coding DNA Sequence Number=SeqID_76582
  Gene Ontology: Mol. function=D-alanine-D-alanine ligase activity; Cellular component=cytoplasm; Biological process=cell wall organization and biogenesis
  Homolog annotation: Hit_ID=A6T5A4; Match level="QueryCoverage=86%, HitCoverage=41%, E-value=3e-77, Identity=94%"; Hit description=D -alanylalanine synthetase
  Pfam annotation: Domain name=Dala_Dala_lig_N; Domain location=33-168; Score=232.3; E_value=1.1e-66; Accession=PF01820.12; Description=D-ala D-ala ligase N-terminus
MASPVKKQPKPDRNEINLPGFHNYAMEVEMAKMRVGIVFGGKSAEHEVSLQSAKNIVEAIDKTRFDVVLLGIDKQGLWHINDASNYLLNPQDPAHIALRPSDVTLAQIPGRDAHQLINADSGQPLAAIDVIFPIVHGTLGEDGSLQGMLRMANLPFVGSDVLGSAACMDKDVTKRLLRDA

SEQ ID NO: 168268 - protein, 120 aa, Glycine max
  Coding DNA Sequence Number=SeqID_76583
MKFVFCVFFGKHDELAKRVCCAKRVHPKCLNMTSRKRKSTASRPQAQYDTRRFQSLEAWNGYTDNILDRRILPKRNVKIYHTEFDEFKANLERCNLHKSLANLQEGSIDVAVEAKLQELF

SEQ ID NO: 168269 - protein, 36 aa, Glycine max
  Coding DNA Sequence Number=SeqID_76584
MGVQIAPRPTWALQKVVASGGSNHARLGELGGEEVK

SEQ ID NO: 168270 - protein, 43 aa, Glycine max
  Coding DNA Sequence Number=SeqID_76585
MRGIPYGYPHLSSTKANESMVLLPSSKDIQVRRRARFFSARQG

SEQ ID NO: 168271 - protein, 47 aa, Glycine max
  Coding DNA Sequence Number=SeqID_76586
MSTETQRRLSSHEIPQATSMEMFGWLHPVIFLDSLDRSNVTESTTVG

SEQ ID NO: 168272 - protein, 385 aa, Glycine max
  Coding DNA Sequence Number=SeqID_76587
  Gene Ontology: Mol. function=nitrite reductase [NAD(P)H] activity; Cellular component=membrane; Biological process=nitrate assimilation
  Homolog annotation: Hit_ID=A8GKP8; Match level="QueryCoverage=100%, HitCoverage=45%, E-value=0.0, Identity=93%"; Hit description=Nitrite reductase (NAD(P)H), large subunit
  Pfam annotation: Domain name=Fer2_BFD; Domain location=241-293; Score= 93.1; E_value=8.7e-25; Accession=PF04324.6; Description=BFD-like [2Fe- 2S] binding domain
  Pfam annotation: Domain name=Pyr_redox; Domain location=1-62; Score= -9.4; E_value=0.034; Accession=PF00070.18; Description=Pyridine nucleotide-disulphide oxidor
  Pfam module annotation: Pfam domain module=Fer2_BFD::Pyr_redox; Domain location=241-293::1-62
MAEQLDPMGGDQLRRKIERMGVKVHTGKNTQEIVNGGGTARKTMHFADGSLLEVDFIVFSTGIRAQDKLARQCGLEIGRRGGIAINDSCQTSDPDVYAIGECAAWRDRTFGLVAPGYKMAQVAVDHLLGRENGFQGADMSAKLKLLGVDVGGIGDAHGRTEGARSYVYLDESKEVYKRIVVSADNKTLLGAVLVGDTSDYGNLLQLALNGIELPENPDGLILPAHAGSKPAIGVDSLPESAQICSCFDVSKGDIIQAVNKGCHTVAALKAETKAGTGCGGCIPLLTQVLNAELSKQGIEVNHHLCEHFAYSRQELFHLIRVEGIKSFEALLAKYGKGYGCEVCKPTVGSLLASCWNEYILKPQHTPLQDTNDNFLGNIQKDGTYS

SEQ ID NO: 168273 - protein, 131 aa, Glycine max
  Coding DNA Sequence Number=SeqID_76588
FHRNTPHLANICVETAGNRRGIHSRAMKTFQFAHGKRCNKVGTSYVPINVSFSPKVGPGLPAVPPVQLLTGWCVTAKAPPDISAGKCSGHAARRVPFAIQAAQLLGRAIGAGLFAITPDQAYRYRRPRGGA

SEQ ID NO: 168274 - protein, 55 aa, Glycine max
  Coding DNA Sequence Number=SeqID_76589
MAHGRQALTFNKIGTIVGNDLPRESVPINQLPLDESDHYTPRDIGVGNRFDPFGE

SEQ ID NO: 168275 - protein, 171 aa, Glycine max
  Coding DNA Sequence Number=SeqID_76590
MSCPVIITLTFLCRSVSWCMPPTRHRLDPDKYNRALGFPALITGLCQSFGVPVTPSKVIRPPITRAFIEKYCTPRQAQGDAPQATDALPPPHQADPTGFIRHGAVSTTLGSPTGSQPPGADQFRAEVAWPRDWPEAQTEEAPAGAPDDAEEARIDEEMTDLLGFLGGSGAT

SEQ ID NO: 168276 - protein, 128 aa, Glycine max
  Coding DNA Sequence Number=SeqID_76591
GKQKNSQAVSPLKSFVYGKGEESKEFSDCVILNSLTREKGDTKELRAVSPSFFWKREKRDTKTIQALVLGDSFWQGRRGMKKMNSTLLFSRFRKPEKFRKLLTKEEEEENQEDVQRDTKGVKDCNNCS

SEQ ID NO: 168277 - protein, 158 aa, Glycine max
  Coding DNA Sequence Number=SeqID_76592
MPPTRHPLDPDKSNRALGFPAMITGLCQSFGVLVTPSKGDAPQAADALPPPHQADPTGSLGMERYLQHLVRQQAANHRGQMQIHECLYQLSLSQQGQGFVPFACPTPDQFRAEVAWPRDWPEAQVGEALAEAPGDAEEARMDEEMTDLLGFLGGSGAT

SEQ ID NO: 168278 - protein, 348 aa, Glycine max
  Coding DNA Sequence Number=SeqID_76593
MAPKKLPAKRSRKDATGEGSSAAPLVDMEFDRHKEYTEFQEEISQRQWTQLVSPMAKYDPEIVREFYANAWPIEEGVREKCSWVRGQWIPFDEDAINQFMGHPLVLEEGQHWQDFAQSVAGREVQIMRTSMTTLTQIWMMLLLGNILPNDHNSDLLLLKCQLVYTILTQVSVHISQLISDAMYQFAGIAPPRHPVDLERSNRALGFPALITGLCQFYEVPVNPNKLIRPPIRSGATAARGGPAAASCRCTIATSIGDTIPRVYLCHLWRIELQMNTYMQHVTSQQAANHRRQDPNPFPWPTLEQFGATVAWPRDEANFETQARPTGTPGDDEGVEEDDDMADVLDFFT

SEQ ID NO: 168279 - protein, 311 aa, Glycine max
  Coding DNA Sequence Number=SeqID_76594
MASMKRKSIGSRPTAQYDTRRFHSLDAWNRYTDNVLGRDILPERKVELYHTEFDDFKTELERHNLQKRLTNLVDGSIDLALVKEFYANLYSSEGPSPKQARVRGHLVKIDTDSLNTFLKTPVVLAEGETLPTNSRYYRLPSDFREIEVALCIPSRGFILNAEGHLGRILRKDLMTLAQVWSVLSYTNLAPTSHTSDLIVDRTRARAKPTELPSTSVAPTPASTSAAPSVLAQSPTAQVPQHVKDASSEATIPEPFMVEEEEDPSTPIVEIPEDPTTPVLTLNTSPPATPLLHLTDEEGDQTQDTQDQSQEF

SEQ ID NO: 168280 - protein, 178 aa, Glycine max
  Coding DNA Sequence Number=SeqID_76595
MGDIEEVQEQMKADMEALKDQMTSMMEAMLSMKRLIESNVAAAVATNATAEADLTHPFAINQVNQPILDMLGQGGEVLGSTGGPHIGHNRNAYPYRLPPNYTLPTMHIPNENSNHVVPVTFEGQQPQLIGGTREEPREHAQGDFDPYPTLMLCLDPIPRELLNPALCNHCISQYGGHL

SEQ ID NO: 168281 - protein, 88 aa, Glycine max
  Coding DNA Sequence Number=SeqID_76596
MARIAKVVKILVQELDRVKQNRNGVVRILRKHLEEKAKTLEDQGEWASFFDVLELLVFGVFLFPNVDGLVDLVAIDAFLAYHHSKESM

SEQ ID NO: 168282 - protein, 91 aa, Glycine max
  Coding DNA Sequence Number=SeqID_76597
MVDSVIVLHRSSSVLNRSSFVDRLPSLVTDVWGANTFPVMRILKLTKYRLKAQVEKDEGPSGEGQSPRVEKDEGPEAETLSRLLIVAEGPN

SEQ ID NO: 168283 - protein, 92 aa, Glycine max
  Coding DNA Sequence Number=SeqID_76598
MNRSINYLCKKKENHPDMLRSLGDRPLLRYNIRAAWRPMYAFKKVVISLLMVSNGIIPFEKHIAAVGTTSNNMLSKRKTLDEGSLLSSKSET

SEQ ID NO: 168284 - protein, 106 aa, Glycine max
  Coding DNA Sequence Number=SeqID_76599
MTADGTGLVVLLMRHYRTGCAADKGASVRAPDMGASVRALGAGALGRAPAIGATSRARDLGASSCLKTQPAIPPPPASHYLLPPPPQPTCSPTNKNYCTPTNTKNG

SEQ ID NO: 168285 - protein, 46 aa, Glycine max
  Coding DNA Sequence Number=SeqID_76600
MPLQGEDESRRSSPPQEAMDKSLKPTNPRSSPRFSTVEAKTLPLMF

SEQ ID NO: 168286 - protein, 77 aa, Glycine max
  Coding DNA Sequence Number=SeqID_76601
MESGGRRRYLVVIRTFRQPRRTNPTAFKLDDARDSSLLSAGDRVRWRGEVPLGQLSYPNFVRGPLFGGMQLSLDRLE

SEQ ID NO: 168287 - protein, 162 aa, Glycine max
  Coding DNA Sequence Number=SeqID_76602
MAPKKLSTKRSRRDATREGSCVASEFDSHRFRSAEHQQRFEAIRGWSFHRERRVQLREDEYSKFQEEIAHRHWTPLVTPMPKFDPEIVLEFYANAWPTEEGVWDMRSWVRGQWIPFDADALSQFLGDPLILEEVQQCEFSQRRSQADGFDEEAIAQLLCIPG

SEQ ID NO: 168288 - protein, 231 aa, Glycine max
  Coding DNA Sequence Number=SeqID_76603
MTEDIFVFEMCVDYCIGRLHMLSNLIISDDKRDFDSLWIGRVCATICCLRVSSDRKSADNHEVSPHAIRPSSHDSRIETFWRSRPKDVDISGDADISGNDADDHIGLSVSTGLLSSDVVFLRITTWGISSCHLTHGSGSTNVVFVRITTWGISTCHLTHGSGLTDVVFVRITTWDIVFVRITTRVSMPATGLHGSGLTNAIFVRITTRVSPPATGLHGSGLIDVVFIRMTI

SEQ ID NO: 168289 - protein, 48 aa, Glycine max
  Coding DNA Sequence Number=SeqID_76604
MGRRLPPSSHRRAGGFLRRNFTEALRKPRKPFFNKTREELAAQLAQAS

SEQ ID NO: 168290 - protein, 158 aa, Glycine max
  Coding DNA Sequence Number=SeqID_76605
ASAPSSSSKPESETEAAPSSVEFIPGSSVLAEPASCSGSEGLRLGSEGQKVQHNGVERTRRMGGKERENGEWFGERNGNGNGREGLERREGFGGEGGGGGCKKSYLIQGLLKLAPALEMLCVSTDFIAIFANIVLFGRIITLGLKNVRFLPLHIVDIS

SEQ ID NO: 168291 - protein, 273 aa, Glycine max
  Coding DNA Sequence Number=SeqID_76606
  Gene Ontology: Mol. function=nucleoside-triphosphatase activity; Cellular component=membrane; Biological process=protein catabolic process
  Homolog annotation: Hit_ID=A7QTW2; Match level="QueryCoverage=61%, HitCoverage=22%, E-value=1e-60, Identity=71%"; Hit description =Chromosome undetermined scaffold_171, whole genome shotgun sequence
  Pfam annotation: Domain name=AAA; Domain location=166-270; Score= -34.4; E_value=0.021; Accession=PF00004.20; Description=ATPase family associated with various cellular activities (AAA)
MALFDHIIDPPSREETLVVIITCFISWGTDGKHIFQLQDLKQRALGNSDETFLSPGISDKLPLHVVMLFSESHEAVSSFRLIQKFMGAAALQKYIGSLGGIGPSGVGSSSSYAPKELNKEVMPEKNVKTFKDVKGCDDAKQELEEVVEYLKNPSKFTRLGGKLPKGILLTGAPGTGKTLLAKAIAGEAGVPFFYRAGSEFEEMNMMYNKLFSQNFFPNKNDIYLHMLRSGLENRIISNGHNQGYQTREFTQTRESFIDLISDSTRRLVRVYFI

SEQ ID NO: 168292 - protein, 177 aa, Glycine max
  Coding DNA Sequence Number=SeqID_76607
  Gene Ontology: Mol. function=nucleoside-triphosphatase activity; Cellular component=membrane; Biological process=protein catabolic process
  Homolog annotation: Hit_ID=Q6A167; Match level="QueryCoverage=50%, HitCoverage=11%, E-value=9e-45, Identity=98%"; Hit description=Ftsh -like protease
  Pfam annotation: Domain name=AAA; Domain location=37-175; Score=47.8; E_value=3.9e-11; Accession=PF00004.20; Description=ATPase family associated with various cellular activities (AAA)
MEKFGFRPCEIFGLLFVLIFYRCVIFWLGAKFYKYGKVLLGGPWVCGKLGAAGCWLDSGLGVVVLILTTRWWFVGVGARRVRSLFQAAKKKAPCIIFIDEIDAVGSTRKQWEGHTKKTLHQLLVEMDGFEQNEGIILMAATNLPDILDPALTRPGRFDRHVGKEEKGEMRFPIIMVY

SEQ ID NO: 168293 - protein, 57 aa, Glycine max
  Coding DNA Sequence Number=SeqID_76608
  Gene Ontology: Mol. function=pyridoxal phosphate binding; Cellular component=mitochondrion; Biological process=photorespiration
  Homolog annotation: Hit_ID=Q8W2G3; Match level="QueryCoverage=87%, HitCoverage=26%, E-value=2e-15, Identity=78%"; Hit description =Alanine:glyoxylate aminotransferase-like protein
MELVVLFTNYGTEANELAMLIARLYTGCHDIICLRKAYHGNATGTMGATNHSNHLEI

SEQ ID NO: 168294 - protein, 77 aa, Glycine max
  Coding DNA Sequence Number=SeqID_76609
MGKRGASPFLSHTHFFLCAYDCEGVSSCIMSSGGCDDKIIYTVPRVEINVLQPTKEGFLRFSSNYLASNTCSAQEMV

SEQ ID NO: 168295 - protein, 61 aa, Glycine max
  Coding DNA Sequence Number=SeqID_76610
MDGGTGGLKKCRIVERRGEFSCLFLSSNASDQRMSAARATWLESIGWRENLVEEQSKFALL

SEQ ID NO: 168296 - protein, 142 aa, Glycine max
  Coding DNA Sequence Number=SeqID_76611
MDKASRNGNLKDIKISFVGHSIGNLIIRIALTDDPDLENTLIYNLSKVTYWRSGYRNVLFKFICKPIVGKGKVMNRCQMPPSTKDEELVLGEIKGSARSGFESTRCSQKWHRECLVGRGKKIPKVMEEGYAVNKPPMFKGAN

SEQ ID NO: 168297 - protein, 177 aa, Glycine max
  Coding DNA Sequence Number=SeqID_76612
  Homolog annotation: Hit_ID=A7R5Q5; Match level="QueryCoverage=74%, HitCoverage=27%, E-value=6e-12, Identity=31%"; Hit description =Chromosome undetermined scaffold_1022, whole genome shotgun sequence
MTRGNTGDLQPFDPEIDRTFHRLVRHSVHPGHSVHFEHSEHSVEGDSKYSDFEHSTTNFYTENMAQPPPPPRERTLREMAAPDFTYESLCIQYPDEGVPYVLKTGLIHLLPKFHGLAGEDPHKHLKEFHIVCSTMKPPDVQEDHIFLKAFPHSLEGVAKDWLYYLAPGPFSTGMTLR

SEQ ID NO: 168298 - protein, 327 aa, Glycine max
  Coding DNA Sequence Number=SeqID_76613
  Homolog annotation: Hit_ID=A5AIE9; Match level="QueryCoverage=78%, HitCoverage=55%, E-value=9e-12, Identity=24%"; Hit description =Putative uncharacterized protein
  Subcellular localization annotation: CTP_CleavageSite=38; ConfidenceScore=5.67e-01
MEESSKKCKGSSASASASRAHRSGATSASTTPIPPSLSSSTLFSSEEQQKRYSNLFSSRSIIDPKFIDMEFFSAETFDCIQAFQNLGFIPFMSLQLPVYPELVKAFYCNLEIQDNTLISEVFGIKMVIDQSLFHDLTQLSSDGVPFEGTLNDDWKFDFSAHDVRQLVCTNNADMTERLLAGSLAFDSRILHYLIVRILLPRSSNLAQVSEEDLIIMWAFHTDCQLDWAHLVRYRMHKALQLNAPLPYPYLVTLFFRHFQIPLDSEPYVPIKRSFLIGAIVIASFGYRKDHDGSWVKKGAQPADEEGNLPVEENSTLLRRLMDKFDGL

SEQ ID NO: 168299 - protein, 213 aa, Glycine max
  Coding DNA Sequence Number=SeqID_76614
MDYYDIDIEFLRFGIGSGGVQPSKNFTWMSCDGSTIGMIVMDVQVGNCNRELHKDQHAIRGKDGKQGMEYSLPYYHFQDQKTSQTLFPSFYIDVIETKWEQDDMLHMDHFSGFLCSHRIPDVPGDRICIIDFYFSWTHPTPSNYHFPIPMPSVAKGLGTTQGRYGGSCVGDEREKEEEDTSYKEDPFMDEEDPTTEPEIMEEDSSQDSSEDSY

SEQ ID NO: 168300 - protein, 61 aa, Glycine max
  Coding DNA Sequence Number=SeqID_76615
MPGLLNTNELHDRRTQTPDAEEEDDAHCGNAARRTEDGRIPYFMYDDDIISTSFNIISTPL

SEQ ID NO: 168301 - protein, 85 aa, Glycine max
  Coding DNA Sequence Number=SeqID_76616
MKDMHKVSLYDVSMGCTKQMLTFPLGLHHGPTKDVTYPLAPSKKENEHYFARFLDIFKKLEITFPFGEALQHMPMYTKFLKDFLT

SEQ ID NO: 168302 - protein, 109 aa, Glycine max
  Coding DNA Sequence Number=SeqID_76617
  Gene Ontology: Mol. function=nucleic acid binding; Biological process= DNA integration
  Homolog annotation: Hit_ID=A5B612; Match level="QueryCoverage=91%, HitCoverage=35%, E-value=2e-17, Identity=47%"; Hit description =Putative uncharacterized protein
MGPFIPTKEVNGESVPKEWDGMIDDEKRKVQDDQNGKNILTSGLSSNEFFHTAKCKSAKEIWKMLEVTHEGTTEVKRARKHILVSEYEAFRMKNGESISKLCRSKLHDD

SEQ ID NO: 168303 - protein, 178 aa, Glycine max
  Coding DNA Sequence Number=SeqID_76618
MTSRLLAGSLTSEEDLILMWAFLTSRQIDWAHLVQYRMHKALRANVPLPYPQLVTLFLHHFQIPLDDEPFVQVKRSFAIGAGAVTSFGYRKDRNGQWLKKDALPPQDERTPSPPPQQDDSALMIEVLSELRGLHTYVGERFDSLDGRFAGMDIRLTQLEEDVGYIRQSFDLPPPPPPS

SEQ ID NO: 168304 - protein, 232 aa, Glycine max
  Coding DNA Sequence Number=SeqID_76619
  Gene Ontology: Mol. function=chloramphenicol O-acetyltransferase activity; Biological process=response to antibiotic
  Homolog annotation: Hit_ID=P62577; Match level="QueryCoverage=78%, HitCoverage=83%, E-value=1e-103, Identity=96%"; Hit description =Chloramphenicol acetyltransferase
  Pfam annotation: Domain name=CAT; Domain location=6-182; Score=359.7; E_value=4.8e-105; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFRPRFHHGQYYTQGDQGADAAGDSVVLLHVFPGWTQDDSYRIRRSGRTERGVRAYSPAWSELPTRN

SEQ ID NO: 168305 - protein, 37 aa, Glycine max
  Coding DNA Sequence Number=SeqID_76620
MAVINLGTPQLAAAEEDTTPAQTPQPSPPSAPAPEEI

SEQ ID NO: 168306 - protein, 69 aa, Glycine max
  Coding DNA Sequence Number=SeqID_76621
  Gene Ontology: Biological process=transposition, DNA-mediated
  Homolog annotation: Hit_ID=Q1J7G7; Match level="QueryCoverage=42%, HitCoverage=41%, E-value=8e-10, Identity=100%"; Hit description =Transposase
MVKVGTSYVPINVSFRQKLAQGFPWLLFLSAVPPVQLLTGWCVTAKAPPDISAGKCSGHAARNHHTRRA

SEQ ID NO: 168307 - protein, 109 aa, Glycine max
  Coding DNA Sequence Number=SeqID_76622
MHHQKRKTLDEASLLSSESETQHNHRSTSTPYGSHKPGYRAQHLKSNLSIAHVIYPRVQWHIISNYEGNRYKDAHQEITTWQRLYISMNKTKDKRNEVEAKSTKRTVAE

SEQ ID NO: 168308 - protein, 37 aa, Glycine max
  Coding DNA Sequence Number=SeqID_76623
MATIALLSRYRSKLAYDTGIGGGVWPQMRSRRVLCSI

SEQ ID NO: 168309 - protein, 208 aa, Glycine max
  Coding DNA Sequence Number=SeqID_76624
  Gene Ontology: Mol. function=helicase activity; Biological process =viral genome replication
  Homolog annotation: Hit_ID=Q2R1R7; Match level="QueryCoverage=95%, HitCoverage=12%, E-value=2e-46, Identity=48%"; Hit description=AT hook motif-containing protein, putative
MWYDEIISKNENCGSPRFSLCCGDGKVELPLLQNPSQYLQQLLFDDNTIDSKNYQHNLRAYNMMFAFTSAGIKLDKTINDSRGPPTIRIQGQPCHRIGSLLPMPGKKPKFAQLYILDTENEVQNRINVMSQYSGIQGHIVSSLSHMLDERNAHAKSFRMVRDRLANDEADNIKLQLIATREKDGCVYNMPNVLEITALIVTPFTPTYI

SEQ ID NO: 168310 - protein, 34 aa, Glycine max
  Coding DNA Sequence Number=SeqID_76625
MNLLASECELPDHRLRLLPEITASSSLWSALLRM

SEQ ID NO: 168311 - protein, 123 aa, Glycine max
  Coding DNA Sequence Number=SeqID_76626
  Subcellular localization annotation: CTP_CleavageSite=18; ConfidenceScore=5.43e-01
MRGKRVFSLSFLDPSSPRLASGSPGPTNYFMVKEPACLGKPVTSGVSISSPGQAVIAPSAHFPINRCVREAEERFQGLVLEGIERIKIEEEERRGNEVEALPNRDCDQSLHRSSFGVLRMTVG

SEQ ID NO: 168312 - protein, 115 aa, Glycine max
  Coding DNA Sequence Number=SeqID_76627
  Homolog annotation: Hit_ID=Q2HW90; Match level="QueryCoverage=75%, HitCoverage=17%, E-value=2e-07, Identity=31%"; Hit description =Putative uncharacterized protein
MGLNQTPSFKKRFYHVKTKSLKVASLQELGQQMDQVQRQAFRKTYGKIWDLAMIEVSVEAITSITHYYDQPLRCFTFGDFQLVPIVEEFEGILGCPLGGRKSYFFSAVIPRPWQE

SEQ ID NO: 168313 - protein, 153 aa, Glycine max
  Coding DNA Sequence Number=SeqID_76628
MAGMGKLDHLEERLRAIEGGEDYAFANLEELFLIPKHGHSQVQGAGLWQVQGDYSLQEPSKDDLMVAFIKQCQYNSDMAPDRMQLQKQKIEVDPKRGKFDHPTRTTEKTGANEEGEKEGETHAVTAIPIRPSFPPTQQCHYSANNKPPPYPPP

SEQ ID NO: 168314 - protein, 269 aa, Glycine max
  Coding DNA Sequence Number=SeqID_76629
  Homolog annotation: Hit_ID=Q6WAY6; Match level="QueryCoverage=91%, HitCoverage=49%, E-value=1e-22, Identity=28%"; Hit description =Putative uncharacterized protein
MDQVQRQAFHKAYGKIWDLAMIEVFVEAIASLAQYYDQSLRCFIFGDFQLVPTIEEFEAILGCLLGGRKPHLFFELYPSMERVAKVVKISVQELDRVKQNRNGVAGIPRNVDGLVDLAAIDAFLAYHHNKESPTIVVLADAYDTFDLRCKKSSARIVYCTPALYVCPLQGHHMCAEKGKANWEELLASMVGASVSWFPRWKEGGTGVLCSCEGFPNVPLMGTRGCINYNPVVAIRQLGYPMRGAPSEEIIVPFVVRGFSECNAKMFQRV

SEQ ID NO: 168315 - protein, 101 aa, Glycine max
  Coding DNA Sequence Number=SeqID_76630
GTSIVVQVEGTSTWVVVTENKRGYISCGSVLVKGTSTRLFKENKGGYIPCGSLLKQSFKNYFDDAKEFKNYFDDAKEFQRSFKMNFKDEESKMSSKANISR

SEQ ID NO: 168316 - protein, 241 aa, Glycine max
  Coding DNA Sequence Number=SeqID_76631
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGLAGLSCWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168317 - protein, 258 aa, Glycine max
  Coding DNA Sequence Number=SeqID_76632
  Homolog annotation: Hit_ID=Q6UUU1; Match level="QueryCoverage=23%, HitCoverage=40%, E-value=3e-18, Identity=78%"; Hit description =Putative uncharacterized protein
YIEQLTEMPQNVLYDAIGIYQRCWNLLRADQRLIFAKKLAQGFPWLLFLSAVPPVQLLTGVVRNGKKHRRTSALASVAVHAARRVPFAIQAAQLLGRAIGAGLFAITPAGERGMCCKAIKLGNARVFPVTTFMFNLFKNADIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168318 - protein, 95 aa, Glycine max
  Coding DNA Sequence Number=SeqID_76633
MAKRFADDNNLSLHVIGLAASALQKVQNDHNLSLRATGLDRLWMTKDSIVSGWQKGVRMTKICLCVSSGSPPLDDKRCADDHNLSPHVIGLAAFG

SEQ ID NO: 168319 - protein, 154 aa, Glycine max
  Coding DNA Sequence Number=SeqID_76634
MEMALVRANIEEDTKTVRDGFTNKISFQHHDHKIILKPLSPREVQITKKNESYVRKANKNRKEVVLEPGDDPGHLRANVFQEGGKDENPKITQIQGLMTRSRTKQSVDTLQQIVIGILSKALVEKDEGPSGVEKDEGPKAKALPRILIFTEDPN

SEQ ID NO: 168320 - protein, 172 aa, Glycine max
  Coding DNA Sequence Number=SeqID_76635
NLQDSGTLKRVAWGLDVGTRVSEEDLIVMWAFHKGLQIDWAHLVRYRMHKALQLNALLPYPHLVTLFLQHFNIPLDSEPYVPIKRSFLIGASVIASFGYIKEHDGSWIKKGARNVGEEGHEGEDSSLLSKTLEKFDGLQTFVGERFDTLELQVDMRFNEMESRMTKVEEDVS

SEQ ID NO: 168321 - protein, 247 aa, Glycine max
  Coding DNA Sequence Number=SeqID_76636
  Gene Ontology: Mol. function=oxidoreductase activity; Cellular component=cytoplasm; Biological process=metabolic process
  Homolog annotation: Hit_ID=A8GIM1; Match level="QueryCoverage=100%, HitCoverage=100%, E-value=1e-94, Identity=71%"; Hit description =Short-chain dehydrogenase/reductase SDR
  Pfam annotation: Domain name=Epimerase; Domain location=9-236; Score=- 67.8; E_value=0.04; Accession=PF01370.12; Description=NAD dependent epimerasedehydratase family
  Pfam annotation: Domain name=KR; Domain location=8-191; Score=-9.1; E_ value=8.3e-07; Accession=PF08659.1; Description=KR domain
  Pfam annotation: Domain name=NAD_binding_4; Domain location=11-223; Score=-104.4; E_value=0.053; Accession=PF07993.3; Description=Male sterility protein
  Pfam annotation: Domain name=Shikimate_DH; Domain location=6-128; Score=-26.9; E_value=0.049; Accession=PF01488.11; Description =Shikimate  quinate 5-dehydrogenase
  Pfam annotation: Domain name=adh_short; Domain location=7-175; Score =133.4; E_value=6.5e-37; Accession=PF00106.16; Description=short chain dehydrogenase
  Pfam module annotation: Pfam domain module=Epimerase::KR::NAD_binding_ 4::Shikimate_DH::adh_short; Domain location=9-236::8-191::11-223::6 -128::7-175
MNRISGKVVVITGASSGLGEATAIHLAAQGATMVVAARRKDRLDALVRKIVGDGGTALALQADVTKRQEVEAMIAQAVRQFGKIDVLVNNAGLMAIAPLSAVKVDEWERMIDINVKGVLYGIAATLPLFEKQQFGHYITISSIAGKKVFSPGGTVYSGTKFAVSAIAEGLRHEVGGKIRTTTIAPGLIDTELKQGSSHAESLQAVGELYQSQAISADAIARAIAYAIEQPSDVDVSEIVIRPTVQEF

SEQ ID NO: 168322 - protein, 131 aa, Glycine max
  Coding DNA Sequence Number=SeqID_76637
  Pfam annotation: Domain name=G-patch; Domain location=6-41; Score =13.8; E_value=0.004; Accession=PF01585.14; Description=G-patch domain
MARVTLGNVYEPGMGLGKDNGGITSLISAKGNRGKFGLGYKPTQADIKKGIIGRKSRGQGSRLGQEVKGGLPCHISRSFVSAGLGHEGQVVAICEDDAPSWSELVQPCPPGFRLGNWRVEELPDIYAASIM

SEQ ID NO: 168323 - protein, 263 aa, Glycine max
  Coding DNA Sequence Number=SeqID_76638
  Gene Ontology: Mol. function=ATP binding
  Homolog annotation: Hit_ID=A8GK11; Match level="QueryCoverage=79%, HitCoverage=100%, E-value=1e-100, Identity=86%"; Hit description =Toluene tolerance family protein precursor
  Pfam annotation: Domain name=Tol_Tol_Ttg2; Domain location=71-253; Score=330.7; E_value=2.6e-96; Accession=PF05494.3; Description =Toluene tolerance, Ttg2
MGFWEDLNRPSFLYKKRAVKDKRQKPGRTRPAEAGCPGAAPQPAVSKSLREDTCMFKRLLMVALLVVAPLASAADQTNPYSMMQEAAQKTFSRLKNEQPKIKQDPNYLRSIVHQELMPFVQVKYAGALVLGRYYKEATPAQREAYFTAFQAYLEQAYGQALAMYHGQTYQIAPEQPLGNADIVAIRVTIIDNGGRPPVRLDFQWRKNSKTGYWQAYDMIAEGVSMITTKQNEWASTLRTQGIDGLTKQLQAAAAQPITLDKKN

SEQ ID NO: 168324 - protein, 134 aa, Glycine max
  Coding DNA Sequence Number=SeqID_76639
  Subcellular localization annotation: CTP_CleavageSite=39; ConfidenceScore=5.07e-01
MTRQLMLSFSQMQSQFQSQMQSQGLALPPEPEVGPSAARVSTKKSCVDPSGNDPDTGDLDKCGLYIEENSPCLVALGRLYKGSTNIHNIPLLHDQVKVGVEEVTDVNDPIPVPTEEVMWDATVFGGIMKTSPCT

SEQ ID NO: 168325 - protein, 81 aa, Glycine max
  Coding DNA Sequence Number=SeqID_76640
MATHVDEGKAEKKVEEHKQHLAAEPALEPVSDLVELEEVVEDEDDQQERETPIKESASSKKEKCAESSPTFIQGKRWKNQK

SEQ ID NO: 168326 - protein, 40 aa, Glycine max
  Coding DNA Sequence Number=SeqID_76641
MLKLLASRASAKRNTHGLSARNTLEEDELYRFAKRTASSH

SEQ ID NO: 168327 - protein, 105 aa, Glycine max
  Coding DNA Sequence Number=SeqID_76642
  Gene Ontology: Mol. function=aspartic-type endopeptidase activity; Biological process=DNA integration
  Homolog annotation: Hit_ID=A5AIP8; Match level="QueryCoverage=98%, HitCoverage=12%, E-value=9e-17, Identity=42%"; Hit description =Putative uncharacterized protein
MVRFYDPLEKKLVKSCDVKFMEDQTIEDIDKVKYTPKEDNGVADFEPVEPPIHGDATEPPQVQLMRSNMERQLSRRYSTNEYVILTDNGEPKCFKEAMESEEKRK

SEQ ID NO: 168328 - protein, 51 aa, Glycine max
  Coding DNA Sequence Number=SeqID_76643
RQREQWRKFEPSTSSGSMEEQGRAMLEWLGFNGRTRKSLGFNWKNKEEARA

SEQ ID NO: 168329 - protein, 296 aa, Glycine max
  Coding DNA Sequence Number=SeqID_76644
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDCHVRKLMLKQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168330 - protein, 88 aa, Glycine max
  Coding DNA Sequence Number=SeqID_76645
MMQALLELVGLGSSSSMDSFASWKMNGSGMEKEERERRRHFKEKMSLEEARHHRRPWIRAWGKKEMNEGRGREEHEILCSKRALNFEV

SEQ ID NO: 168331 - protein, 141 aa, Glycine max
  Coding DNA Sequence Number=SeqID_76646
  Gene Ontology: Mol. function=binding
  Homolog annotation: Hit_ID=Q94C27; Match level="QueryCoverage=49%, HitCoverage=19%, E-value=3e-21, Identity=70%"; Hit description=F-box protein At1g70590
  Pfam annotation: Domain name=Sel1; Domain location=9-44; Score=22.8; E_value=0.0013; Accession=PF08238.3; Description=Sel1 repeat
MKAADGGYVRAMYNISLCFSFGEGLTRNHQLARKWMKWATDCGHSKAQFEHGLALFSTFVVLGNWVYVEIRGKLNMGPDLPGRDYDILQQRKMEGHSEIRLLGENFDAGLMGRMKDDEYESRFGSDNFEDTSGYDQDGGDD

SEQ ID NO: 168332 - protein, 267 aa, Glycine max
  Coding DNA Sequence Number=SeqID_76647
  Homolog annotation: Hit_ID=Q9LHC7; Match level="QueryCoverage=32%, HitCoverage=11%, E-value=2e-07, Identity=33%"; Hit description =Retroelement pol polyprotein-like
MKKIQGLLAPHRATSVKNVMDEDGGWTNATATMVSTPTHTIMECAKSIWSMKDDSDSMEYDYDDNVDNVVEDDGCAGNDDGLVGHDDAENDDSMEDEVNDAEIDNNFKDKGEVVMRRGSFVRACSIVSVFSMTCCSTSVEAMVGKFLVDKTPFDPEITKIERKNRKKKKQETAKPPGNRPPWRTLDDYAYQQGPKHYNIIVSPPFSNKVVELKPALLSLIASHPFARMDHEDPYTHVSTFTELCSTMGASNEDAKFVYLRAFPFSLA

SEQ ID NO: 168333 - protein, 103 aa, Glycine max
  Coding DNA Sequence Number=SeqID_76648
MIALLPRVHAAYVGSVVVGIGREPSMKATLFFIEELPSWRGSMWCNSCDQEARSLVCALREYIPLSEAPASSARHKNLEENLPCKHALSSLSLAKRVIRHLPG

SEQ ID NO: 168334 - protein, 64 aa, Glycine max
  Coding DNA Sequence Number=SeqID_76649
MKKKEEHAAPWAQLSDVTGFNSTTSKGLARTYRKELHESVMLLHYQEPLSMLLSHRCHRRSSKQ

SEQ ID NO: 168335 - protein, 582 aa, Glycine max
  Coding DNA Sequence Number=SeqID_76650
  Homolog annotation: Hit_ID=A7PAG8; Match level="QueryCoverage=93%, HitCoverage=79%, E-value=1e-137, Identity=52%"; Hit description =Chromosome chr14 scaffold_9, whole genome shotgun sequence
  Subcellular localization annotation: CTP_CleavageSite=50; ConfidenceScore=5.16e-01
MASAGLVGILAIAVCSCTVSFPWLQNPGTFVAARALLETNAKLMREVKMREAMLDKEASVQRARQEASLAEGISWGMGEDAIEEDEDDVEEVTWQSYKGQLTEKQEKTREKIIKRMEKIANMKKEINSIRVKDISQGGLTQGQQTQIARNEQRTMQILEELENLEETLNDSIRESMGARTGKLSHGKKKGAVEGEEEYLSDDDDEFYDRTKKKASHQKTGDNQSVETADTLLDKKDVITKEMNEKKELLMIEKNKILSNPESATQDEVDDSLDAYMSGLSSQLVHDKSEQLEKELSTLQSELDRICYLLKIADPTGEAAKKRELKVHEPKPKKSEVTITIKKKPPAEAQKSSGPCAKADNKNPPVETLKIRETPVKEDGSIEGEKPGAATLGLDKSEPDSDRLKAENVVFAIPKPQWLGAVEDRVTDNTQQSMPSLLLHEIDESNQFVDYKDRNQILGSSDNAKTSVGSTIESAAGLIIRKRKQVETTATNCNDASEQLTSSTSGEKMAEDAVALLLKHNKGLYTNDDEEKYEGQERRGPKRVLGPEKPSFLNDEMDYDDSWVPPEGQSGDGRTSLNDRYGY

SEQ ID NO: 168336 - protein, 385 aa, Glycine max
  Coding DNA Sequence Number=SeqID_76651
  Gene Ontology: Mol. function=DNA-directed RNA polymerase activity; Cellular component=mitochondrion; Biological process=transcription
  Homolog annotation: Hit_ID=A7PAG7; Match level="QueryCoverage=90%, HitCoverage=27%, E-value=1e-123, Identity=66%"; Hit description=DNA -directed RNA polymerase
  Pfam annotation: Domain name=RNA_pol; Domain location=3-385; Score =278.1; E_value=1.8e-80; Accession=PF00940.10; Description=DNA -dependent RNA polymerase
MALDTIFDKLSESERENEKDKADIIAQKEKLNELDTIELGAAAVNLVAGEKPADVYSGIAASPFLKMQILPCERDDLKINSSVIEKSFLCRVSNIMQRDAQKDPAIFPDALHARTLVNQVDRKLVKQTVMTSVYGVTYIGAREQIKRRLKERNAISDDTELFGASCYAAKVTLTALEEMFQGARGIMNWLGDCAKVIASENQPVRWTTPLGLPVVQPYRKLGKHIIKTSLQMLTLQRETDKNSCLKELVKKKLQGKITCNKKLVGRLYNMLGNLPQVMVTRQRTAFPPNFVHSLDGSHMMMTAVACKKEGLNFAGVHDSYWTHACDVDKMNRILREKFVELYETPVLENLLESFQSSFPSLSFPSLPERGDFDLREVLESPYFFN

SEQ ID NO: 168337 - protein, 67 aa, Glycine max
  Coding DNA Sequence Number=SeqID_76652
MSSEEDPEEDPEELPPEPTVDALDFLEGDEDPLPEVDYPEDVMSASEADSMEESGPKEMATSGGSSS

SEQ ID NO: 168338 - protein, 163 aa, Glycine max
  Coding DNA Sequence Number=SeqID_76653
MNVVKVGSRTSHVRLRVAFVRRPRGGTCKTNDFDAQEGDELVKSPSVDKSYLVSRVITWIGIRITGLSGLLSPRARTSVVRAASVKLSRVDMLLDKELYFSFYWRFDPTRLKSFDKDMLTLVERVDKAILEQLPTSLDTHAILSLPLASDPITALDGIMSDFP

SEQ ID NO: 168339 - protein, 74 aa, Glycine max
  Coding DNA Sequence Number=SeqID_76654
MRLVKRLLSLLRLLRPQGPTEQSRHTVDACQAIKKRLERLLNLRKVTVGTKIHEVIKDYIRIARGLTPDGNVYD

SEQ ID NO: 168340 - protein, 118 aa, Glycine max
  Coding DNA Sequence Number=SeqID_76655
MVGMFYTSMINRMLLGAPSSIVGAPSMIMVRTRGLGRVLGRVIGRAMGREDHHDSDDEAAPVVEDAPDMTEDVPAHGAKAIDGAKGFAIDDAEGFSGGPRDPSVLIEYADHVALSIWN

SEQ ID NO: 168341 - protein, 91 aa, Glycine max
  Coding DNA Sequence Number=SeqID_76656
MDMLADVETSSRMDIPVSNSNHSAQHESQSLSVTADHDPLLGLPLTPTKRQTFQDCDDEAGTSQISPAQLSSNKLKKTWHNLVHLVVSKLC

SEQ ID NO: 168342 - protein, 67 aa, Glycine max
  Coding DNA Sequence Number=SeqID_76657
MVVITTTTKVMMTNVVVIDDGDNYDNGRSRNHGGNNNNRNVHISGAWDLLKNNGSKLLTSDYKRKMQ

SEQ ID NO: 168343 - protein, 2862 aa, Glycine max
  Coding DNA Sequence Number=SeqID_76658
  Gene Ontology: Mol. function=ubiquitin-protein ligase activity; Biological process=ubiquitin cycle
  Homolog annotation: Hit_ID=A2Q2P2; Match level="QueryCoverage=100%, HitCoverage=99%, E-value=0.0, Identity=85%"; Hit description=Zinc finger, ZZ-type; Zinc finger, C2H2-type
  Pfam annotation: Domain name=ZZ; Domain location=368-411; Score=43.8; E_value=6e-10; Accession=PF00569.8; Description=Zinc finger, ZZ type
MVGFRVHVGNTSASHIPSSISIFQRVVKFDEGMRSWYDIPFTVAESLLADEEFTISVGPTFNGSTLPRIDSLEVYGRAKDEFGWKEKMDAVLDMEARVLGSNSSLSGSAKKRRSMQSAPIQEQVIADGLRLITKFYSSCKQQDCSRFEEARTELGKLKCKPLLEIIFECDREPILQASASRVLQAVFPKKEIYHQVKDTMRLRGVVKSSLLLSSRLGIGGAAGSWIIEEFTTQMRAVCSEVVDVLVQVLWGILDFEQPDTQTMNNIVMSAVELIYCYAECLALHGKDAGVHSVAPAVVLLKKLLFSSNEAVQTASSLAISSRLLQVPFPKQTMLATDDAVDSVVSVSGPADPSTGNNQIMIEDDTITSSVQYCCDGCSTVPILRRRWHCTVCPDFDLCEACYEVLDADRLPPPHSRDHPMTAIPIEVDSVGDGNEFHFTADDVSDQNLLPVPVDSNMQNSSPSIHVLEPNDSGDFAASLTDPVSISASKRAINSLLLSELLEHLKGWMDMTSGVQAIPVMQLFYRLSSAVGGPFIGSSKPDSLDLEKLIKWFLDEINLNRSFVAKTRSSFGEVAILVFMFFTLMLRNWHQPGSDGPMPRQSGTNDMHDKNVVQFPLPTSASAKTSLDDQEKIDFTSQLLRACDSLRQQSFVNYLMDILQQLVYVFKSPVNNEGVHSNAGPGCGALLTIRRDLPAGNFLPFFSDSYAKVHRTDIFMDYHRLLLENAFRLVYTLVRPEKHDKTGEKEKVYKLSHGKDLKLDGYQDVLCSYINNPHTNFVRRYARRLFLHLCGTKSHYYSVRDSWQFSSEAKRLYKHINKSGGFQNNPIPYERSVKIVKCLSTMAEVAAARPRNWQKYCLRHGDILSFLMNGIFYFGEESVIQTLKLLNFAFYTGKDVGHTPQKMESGDISSNKSGTVSQESKKKKKGEDGAESGSEKSYLDMEAAVDVFTDKSSNILKQFIDCFLLEWNSITMRAEAKLVLYGVWHHAKPTFKETILKELLQKVKFLPMYGQNIVEYTELVTWLLGRSSDTSSKHKISELVDQCLTPDVIRCIYETLHSQNELLANHPNSRIYNTLSGLVEFDGYYLESEPCVACSTPEVPYSRMKLDSLKSETKFTDNRIIVKCTGSYTIQTVTMNVHDARKSKSVKVLNLYYNNRPVTDLSELKNNWSLWKRAKSCHLAFNQTELKVEFPIPITACNFMIELDSFYENLQALSLEPLQCPRCSRPVTDKHGICSNCHENAYQCRQCRNINYENLDSFLCNECGYSKYGRFEFNFMAKPSFTFDNMENDEDMKKGLAAIESESENAHRRYQQLLGFKKPLLKIVSSIGDSEIDSQQNPSVQQMMVSLPGPSCKINRKIALLGVLYGEKCKAAFDSVSKSVQTLQGLRKVLMNYLHQKLSDTSVGSRFVVSRSPNNCYGCATTFVTQCLELLHVLARHPNSKKQLVSAGILSELFENNIHQGAKAARVQARIVLCSLSEGDVNAVNELNSLIQKKVLYCLEHHRSMDIAVTTREELLLLSEVCSLADEFWESRLRVVFQLLFSSIKLGAKHPAISEHVILPCLRIISQACTPPKPETLDKEQSLGKSSANTKDESNQNVSGSLTGAVTVSGTKTFPDSSERNWDATSKTRDIQLLSYSEWERGASYLDFVRRQYKVSQAVKGTGQRSRPQRHDYLALKYALRWKRRAGKAAKSDLSVFELGSWVKELVLSACSQSIRSEMCTLISMLCAQSSSRQFRLLNLVVSLLPATLSAGESAAEYFELLFKMVDSEEALLFLTVQGCLRTICTLITQEVSNVESLERSLHIDITQGFILHKLIELLGKFLEVPNIRSRFMRDDLLSEILEALIVIRGLIVQKTKLISDCNRLLKDLLDSLLLESSENKRQFIRACINGLEIHREERKGRACLFILEQLCNVICPSKPEPVYLLVLNKAHTQEEFIRGSMTKNPYSSVEIGPLMRDVKNKICHQLDLLGLLEDDYGMELLVAGNIISLDLSIAQVYEQVWKKSNQSSNVTNSNLLSPNAVNSSRDCPPMTVTYRLQGLDGEATEPMIKELEEDREESQDPEVEFAIAGAVRECGGLEILLGMIQRLRDDFKSNQEQLVTVLNLLMYCCKIRENRRALLKLGALGLLLEAARRAFSVDAMEPAEGILLIVESLTLEANESDNISITQSALTVTSEEAGTGEQAKKIVLMFLERLSHPLGLKKSNKQQRNTEMVARILPYLTYGEPAAMDALVQHFSPYLQDWGAFDHLQKQHLDNPKDDHIAQQAAKQRFTLENFVRVSESLKTSSCGERLKDIILEKGITKTAMTHLKDSFAYTGQAGFKNSAEWAQGLTLPSVPLILSMLRGLSMGHLLTKKCVDEEGILPLLHALEGVAGVNEIGARAEYLLDTLSNKEGKGDGFLEEKVCKLRHATKDEMRRRALQKREELLQGLGMHRELFSDGGERIVVSRPVPGIEDVQEEEDGLACMVCQEGYSLRPADLLGAYSYSKRVNLGVGSSGSARGGECVYTTCHQEAKRADAALKNPKKEWDGATLRNNESLCNSLFPVRGPSVPLAQYVRYVDQYWDNLNGLGRADGSRLRLLTYDIVLMLARFATGASFSADSRGGGRESNSRFLPFMIQMARHLLDQGNPSQRRTMARAVSAYISSSSSDLRPSSPSGTQPTPGTEEIVQFMMVNSFLSESYESWLQHRRAFLQRGIYHAYMQHTHSRSAIRAPSVTAPAHGVESGSMGQSATTETGQSDDLLSIIRPMLVYTGLIEQLQHFFKVKKSTGATPPTRTDGASSTTEGEDESGNLEGWEVVMKERLLNVKELLGFPKEMLSWLDEINSATDLQEAFDIVGVLAEVLSGGFTQCEDFVQGAINAGKS

SEQ ID NO: 168344 - protein, 1712 aa, Glycine max
  Coding DNA Sequence Number=SeqID_76659
  Gene Ontology: Mol. function=ubiquitin-protein ligase activity; Biological process=ubiquitin cycle
  Homolog annotation: Hit_ID=A2Q2P3; Match level="QueryCoverage=92%, HitCoverage=72%, E-value=0.0, Identity=76%"; Hit description=Zinc finger, N-recognin; WD40-like
  Pfam annotation: Domain name=zf-UBR; Domain location=1569-1639; Score= 20.0; E_value=2e-05; Accession=PF02207.11; Description=Putative zinc finger in N-recognin (U
MAADSLAVLAEALSPPVSPGDFLSKLRSDDAVLLGLNAFCSVLRRGLQSSDDGTSLFLSWTDAQIHAISSLAHAIASASRSLSVEQAEGVLVAIVQQSIEFALCYLENSGVTSDDLGIQNNMIHLLEMALVDGINMVADILQPTTASALIDMLPMVDDCCGSFVDDYKKCHLEGFKCSKEEKSMDWLLKTLASEHVPHDRQESGFIEQTYYQYFNNFVFLSQHWAVVHGKCTPRLILLCNKLAKVKDVFDERAVSQNFRRRLSFILRMLKILGSLLKDVPYVDYDASLMGAVATFSNTLSSLFRIKFEFVNTCATTEGSFESIILMVIEEFLHSVQVIFGNSNVAQNIQTCIIAAILESLDSSVWTYDKSAPNLKPPLAYFPRFVVYTLKLITDLKRQRHLVPFEWKDFDVELVGSSTDSQIGSPSCLVHLEPVPLLKGFTFEELLKLIFPVSSQWIANLMQLALFLHCEGLKLKPKLERSHSSLAKVAGTSEVENAVCHEDEALFGDLFSETGRSVGSTDGCEQPPVAALISSSSYQNMPTQAAIELLNFLKTCIFYTEWHPSLYVDACNKLSSRDIDILLSLLNCQGCCSEDNMSDSCTPLLEDGKIGQIHDLCFDILHNLLTNHALNDSLEDYLVDKILTVENGSFSYNDRTLTLLAHTLFCRVGSSGSQLRTKIFRVYVAFVVEKAKTVCIKCPSINDLVGTLPSLFHIEVVLMAFHLSSEGEKAVMAKLVFSTLKEVASLTLDLNSTLLTCWALVVSRLILILRHMIFYQQTCPTSLLIDVRSKLREAPLSGSSMQNKVNDHMSSWSSTAFKNIAGGLIGEEAVVSSLIGHLIDISGSSASLVREDLAIDSLTLNWGEIYFTFSLILGFWRGKMATAVEDLIVERYVFSLCWDIPYVGSEADHTIKSWDQDHPVDPSNMLHFFHFSHLLHGHPEGMGKFTISPDVILSLLQHLNAALPIPEGIEQLGWYFLRSGMWLSLVISFINVGIWRYYMDNGISGHGLTWTGNAMGDEKYVKVAGSMISSMIESGQFPLLVKLFSSLLNKYLQVCQNAFLDILNDKQKLTPGFSPFLLLKHTEMDQSLQDELLERSGSNAGELQFVLSLISRLDAVVDKKASGILSRASWECLLHGFPFNLSTPSSTMFSCVLSIRGIVFVLDGLLRIKEAGSIINLEDEILGQVLDAVMIIKYDRTFESVHGKCDTIYHSLSAELDLSCYEDLILMKQMEGFLMDVNAGGASDCSVHEWIICKIIEILNSLRKDPSKSVIFHFYLGVENVPEKMNRLLHLHLGDCLVLIDALDSCFSESVNVKVLGFFVDLLSGEQFPDLRMRIQRKFLDRDIHCVSKWLEKRLLGSIVKSDCGVDCAKGCSISLRESTMNFSLCLVSPPSEQQSKELQQHIFNSALGSLDSAFLLFDIHVAKSFFNFIVQISRGEFLMKQLLTRTVMLMEKLVGNENLLPGLKFLFAFIESVFSDCGSSKISLQKTTKKSSSGNSLAVGHSSARLVGSRKNSETFILSANQEGGSTSLECDATSMDEDEDDATSDGEVLSIDKDDEEDANSERALASKVCTFTSSGSNFMEQHWYFCYTCDLTVSKGCCSVCAKVCHRGHRVVYSRSSRFFCDCGAGGVRGSNCQCLKPRKFTGDSSAPVRGSNTFQSFLPFPEDGDQLPDSDSDFEEEISSDADNSLSYVFQKNFKKGFHCYWKNLILRV

SEQ ID NO: 168345 - protein, 268 aa, Glycine max
  Coding DNA Sequence Number=SeqID_76660
  Pfam annotation: Domain name=F-box; Domain location=63-108; Score =18.1; E_value=0.033; Accession=PF00646.24; Description=F-box domain
MTNLGWGQIPLLLVQCDKNPRNKVEFTIVEATLVKFAVGVEALSVRAATKDEEEWRKSMKTHTHTLPLPPELIREILLSLPVNSLLQCKRVSNDFYAESIDIDSPLLMCALRLILPPTSPPYRDQYDEVDHRGKLEILGSCRGLILLYYDRSCDLILWNPSIGVHRISPKFKCGLTLVYLYGFGRFSEIPLFDHSTMEKYELCSLRVMGGCLSVCCSVRGCATDEIWAMKEYKVDSSWTKSIVIPNNGFSPICITKDGGIIGSKEVED

SEQ ID NO: 168346 - protein, 87 aa, Glycine max
  Coding DNA Sequence Number=SeqID_76661
MVQGGIKLLSGIGFKLSPATSHPWTPDVDEEVHNERRRGTTTNDDRGRGTTNKHQERNRNNQQAPTKEAKEEETKMTEEEEEEDEAE

SEQ ID NO: 168347 - protein, 123 aa, Glycine max
  Coding DNA Sequence Number=SeqID_76662
MPLTRHSLDPDKSNRALGFPALITGLCQSFVVPVTPSKAANHRGQVQIHECLYQLSLSQQGQGFAPFACPTPEQFRAKVAWPGDWPEAQAGEAPAGSPGDEEEARMDEEMTDLLGFLGGSGAT

SEQ ID NO: 168348 - protein, 197 aa, Glycine max
  Coding DNA Sequence Number=SeqID_76663
  Gene Ontology: Mol. function=transcription regulator activity; Cellular component=intracellular; Biological process=regulation of transcription
  Homolog annotation: Hit_ID=A7R6M0; Match level="QueryCoverage=49%, HitCoverage=28%, E-value=9e-32, Identity=62%"; Hit description =Chromosome undetermined scaffold_1335, whole genome shotgun sequence
MSRNFTDCATMLSFDFRHVTELHELPNDGCQVPRSGQTRVASQQTDGPQTKLGAPGHRIGLLRSHASTKVTDKAKQILDSKFGPLKDDDDGGIEDFDDGSKIVELNAIEILTEHLHFYEKGFLCDSNLCMHMRAHGEQFETMEAMAKPSETITQWRATRFSCPFEGCKRNKLHQRFQSLKSVICVKNHFKRSHCPKM

SEQ ID NO: 168349 - protein, 347 aa, Glycine max
  Coding DNA Sequence Number=SeqID_76664
MVLPLGSLHSTDVLAFAPGELALTEGGHEVHVAFGLDSLACKAEEWIGDICEATLVNENPGHHEICYDDGDNHLVDGVATLEVPVRKGDKRETSLLPGLSSIGKVVIDGVDYTSDVSGRSSAFLLFASWFLFCFFGCPSGLDHVCLGSFIWGSRIGTSRLALVWLMALVWLVRVGLGVCFTLVALLSCLADFILKSGHFFHLDVALDLFAQFVHATGLAKAAKVMVRPASGVLHTESFDGGVKAAYGLGWKSTIPGVQMLVWIGCPIVPLKEGFRSSVVLFVRQGCDSPCVCSGKSLAGHGRPLALSTLSRGIISSPRCSFGVVGVSRLMPDRVLTMDGCERIDERP

SEQ ID NO: 168350 - protein, 200 aa, Glycine max
  Coding DNA Sequence Number=SeqID_76665
  Gene Ontology: Mol. function=sequence-specific DNA binding; Cellular component=nucleus; Biological process=regulation of transcription, DNA-dependent
  Homolog annotation: Hit_ID=Q3Y4G8; Match level="QueryCoverage=93%, HitCoverage=75%, E-value=9e-82, Identity=84%"; Hit description=MADS -box protein
  Pfam annotation: Domain name=K-box; Domain location=28-127; Score =155.0; E_value=2.1e-43; Accession=PF01486.8; Description=K-box region
MDLTVLPFFVYLEISMLKTLERYQKCSYGAVEVTKPAKELEQSSYREYLKLKARFESLQRTQRNLLGEDLGPLNTKELEHLERQLDSSLKQVRSTKTQFMLDQLSDLQTKEQMLVEANRSLTVKLEEINSRNHYRQSWEAGDQSMPYGGGPQNSHSHQGFFQPLECNPTLQIGYNDVASDQITATTQPQQVSGFIPGWML

SEQ ID NO: 168351 - protein, 67 aa, Glycine max
  Coding DNA Sequence Number=SeqID_76666
MGVDSDSDKFPTVKAGGTEEKRAESERRHGRVYNTRYSFHQYYHSLRPIIIFKFTNQINTSTIYLLF

SEQ ID NO: 168352 - protein, 292 aa, Glycine max
  Coding DNA Sequence Number=SeqID_76667
METRMEAMEIAMEENREAVESWLSSIEGMIQRLAAAWEKKSSRMNVHTIYASEGDEGMAVHDDNLWRNLELPIFDGEDSMGWLTRIERYFRLRAVREEDKLEVVVIAMEGEALVTQRFQASSLGYPVQALLALQQEETVKGFIGVISSGSVSKGLKEEISTEVRLHEPKNLKEAMVKARRVEDKNRVLWKLPLSNIQGYNLQKPNYSGQKSVKDWQPANSKAIDLTNAVKRGSSGWQGRRTFHNLSLTKVNEKMRKGEYFTCDEKYNPAHVSKNKQFRLMIMEEEDEGDPCL

SEQ ID NO: 168353 - protein, 157 aa, Glycine max
  Coding DNA Sequence Number=SeqID_76668
  Gene Ontology: Mol. function=protein kinase activity; Biological process=protein amino acid phosphorylation
  Homolog annotation: Hit_ID=Q69F86; Match level="QueryCoverage=77%, HitCoverage=39%, E-value=7e-20, Identity=41%"; Hit description =Serine-threonine kinase
MYEAIDNVESSGDFTDSRQVGSLGRLKKSSSECFWLKIRIGVARGLHYLHAGVKLTIIHLHINLSNILLDNNMKPKIKDFSLSLKGPHFMSKPKPIKVVSVVGTYAYMAMEYAMYVLLDVVCGRKYVQIKAQREFLEKPVEEEIDPNIKGKIVPDCW

SEQ ID NO: 168354 - protein, 120 aa, Glycine max
  Coding DNA Sequence Number=SeqID_76669
MGEVEVELESALLLQEQADITNISSNYTLYSTTNFPKYQWPVRWTESLNSGYSDTDTEQSIESVESQCPNKMTMVVLGNGDITSASSSSSSSESESECDVQPLKGDPLMVRRLMRKCVQG

SEQ ID NO: 168355 - protein, 150 aa, Glycine max
  Coding DNA Sequence Number=SeqID_76670
MEQREEEGEITSPRDSQQKLKGGKKSSLFAQHQSLRFLQWWVSWRKGEVFWVTYYDPTKTDFLPTKSLLNFSLFVIKQNNKAGIRVADQSCLLGDEFLEDEKDECIVVALGDGGGSCCIGSTSRIKACLALSKIHSSRLRNLSKNSFIVL

SEQ ID NO: 168356 - protein, 297 aa, Glycine max
  Coding DNA Sequence Number=SeqID_76671
  Gene Ontology: Mol. function=nucleic acid binding
  Homolog annotation: Hit_ID=A7UQU7; Match level="QueryCoverage=82%, HitCoverage=47%, E-value=2e-36, Identity=35%"; Hit description=IMP dehydrogenase/GMP reductase, putative
  Pfam annotation: Domain name=DUF1723; Domain location=3-52; Score =53.3; E_value=8.7e-13; Accession=PF08330.1; Description=Protein of unknown function (DUF1723)
MVTGDPRLISPFAEKWHRETSTFHLPVGELTITLDDVACFLHLPIIGALPRFEPLGVDEAILLLMELLEVYESRCQARHGIIEARAYLLHLVGCTLFANKSSTHVHVVHLEVFRDLGQSGGYAWGVAALVHMYDQLNEASQTPHTTDGWCWIYEYFPSVHQCVTDNAYAETTPRASRWLTTKAHMKGIKGAPYRARLDALTITDVSWFPYSEHRPVRGFELISCYQGQLRWGHVVVYIQPERVVRQFRYIQTIPPPPITSSLSYDEIDESWMHFGDHLAPVGEICVIPGQAAADYME

SEQ ID NO: 168357 - protein, 308 aa, Glycine max
  Coding DNA Sequence Number=SeqID_76672
  Homolog annotation: Hit_ID=Q2HTA0; Match level="QueryCoverage=68%, HitCoverage=39%, E-value=1e-25, Identity=33%"; Hit description=IMP dehydrogenase/GMP reductase, related
  Pfam annotation: Domain name=DUF1723; Domain location=162-211; Score =53.3; E_value=8.7e-13; Accession=PF08330.1; Description=Protein of unknown function (DUF1723)
MGKKDQLAIKVGTRGLARALGGGIGRGMGWDEHDVDVPQRRRPTASARRQRVQVDVAEEDVPHVDEDIPIADVDAADVAADGAEGSPVEHGDGCPSGLRDTSLLTLFADHVAYSIWHGEERPELKLVSHGRKVDKFGSPAPEIEGLVSGIGLSPLIGCSMVTGDPRLISPFAEKWHRETSTFHLPVGELTITLDDVACFLHLPIIGALPRFEPLGVDEAILLLMELLEVYESRCQARHGIIEARAYLLHLVGCTLFANKSSTHVHVVHLEVFRDLGQSGGYAWGVAALVHMYDQLNEASQTPHTTDGW

SEQ ID NO: 168358 - protein, 351 aa, Glycine max
  Coding DNA Sequence Number=SeqID_76673
  Homolog annotation: Hit_ID=A7UQU7; Match level="QueryCoverage=43%, HitCoverage=27%, E-value=1e-10, Identity=30%"; Hit description=IMP dehydrogenase/GMP reductase, putative
  Subcellular localization annotation: CTP_CleavageSite=28; ConfidenceScore=5.17e-01
MVVSNFMRLPCCFFFVVFFFLRSCSIVVASSLFLFFIASIRAPFIDAFSFYFEARVVEDPSTAVEELNEAQQQPPVEEGVTDVEGFSGGSHDTSVLGYFENHIALRERPELKLSSHGRKMAMFGRLAPEIEGLVAAIRLGEVTNTLDDVALLLHLSIVGAFIASSNFMQELKRFNVMALMFDCPGYETGTYAWGTAALVHMYDNLNGASKNTMRQLEYVCKISVVLDLRPFLVCWFRRSYRGLRQVKTACMPMEALPMSTYRRRLDRLTPDVMCWIPYGDPRSFREFEVISLFSGHLRWGPLTVIHRSERVVGQFGYIQTISLHPPVPSAFVEEMNARWMYDRQIKWSGST

SEQ ID NO: 168359 - protein, 177 aa, Glycine max
  Coding DNA Sequence Number=SeqID_76674
MSCFVVVKEKQRSRCIVKGSDVWNYNTSSSDSVLIKKIIQIRDFIISKELSTEEAKKMIQSWSTNEQLLVGKVYEYIRGVKPTVSWKSLQVWAHIRDLAHFRRRFTSLQRITDSLIKGRSTLGVQGKLRCLVIAITVYCIWLSKNKLIFEDYQFSVIEVISKIKFLMYRQAHLLHLF

SEQ ID NO: 168360 - protein, 57 aa, Glycine max
  Coding DNA Sequence Number=SeqID_76675
MVKMCGKEQQTTYQNFTTIQQEKERVLGEEEGKTKLRVRGGVGSIVSLKTDLRWLYL

SEQ ID NO: 168361 - protein, 231 aa, Glycine max
  Coding DNA Sequence Number=SeqID_76676
  Homolog annotation: Hit_ID=A5BC87; Match level="QueryCoverage=92%, HitCoverage=18%, E-value=6e-12, Identity=22%"; Hit description =Putative uncharacterized protein
MTSVNASLKSLWEELDNYRPLPPCSCSAKTYHQQDFIIRFLKGLDERFAMKSNTTPPKCSHCDKLGHTSDVCYFKFGYPHGHPKYPSHPRLSNNKYTSGGGTTSSGGGAVNSAEVVTPTHGGESKKESSTQDHGFHITMAQYQELMNLLSKSSGPGGASSETTLTRANLTHSSPNQIHNSGFGSHFVFSIPTTHTLNTLSLHTTPWIIDFGATDHITCSLDCFIHILQLHQ

SEQ ID NO: 168362 - protein, 49 aa, Glycine max
  Coding DNA Sequence Number=SeqID_76677
MAARSLEDSDTMLDFILKPIENHAIVGELLEAKASQHADINKSPIIPLL

SEQ ID NO: 168363 - protein, 49 aa, Glycine max
  Coding DNA Sequence Number=SeqID_76678
MGRGKAGLKGLDEGEPGGTGEMEGIGCEDGEDEMEGKRIKSSSNFWAMD

SEQ ID NO: 168364 - protein, 213 aa, Glycine max
  Coding DNA Sequence Number=SeqID_76679
  Gene Ontology: Cellular component=exocyst; Biological process=vesicle docking during exocytosis
  Homolog annotation: Hit_ID=A7PHZ9; Match level="QueryCoverage=22%, HitCoverage=6%, E-value=3e-11, Identity=77%"; Hit description =Chromosome chr13 scaffold_17, whole genome shotgun sequence
MAEDQPRRVTLEDYSSFVEPQFFTSIAWPESKQLLDASARGKIKLKTPEEAMELIENMASSCSICGGAHESRRCIPLDDTDQEHGSNYNQQQGQWRSHLENQFNKDQGGPSNRPHQQGPSLYDRTTKLEETLAQFMQPKIATNNSQDNHIQDQSSCRGFEFIKKRKNGISIDGTLLVVSPVSPLMALAGKAQVATKELLDSILDDVVRIFGEC

SEQ ID NO: 168365 - protein, 315 aa, Glycine max
  Coding DNA Sequence Number=SeqID_76680
  Gene Ontology: Mol. function=aspartic-type endopeptidase activity; Biological process=RNA-dependent DNA replication
  Homolog annotation: Hit_ID=Q69F85; Match level="QueryCoverage=31%, HitCoverage=7%, E-value=3e-17, Identity=39%"; Hit description=Gag -pol polyprotein
MEEASIIQSFQKQLKVLQKRNGKEKVVLRQKQEVNLKALREENDAIQAQFQAPKANIVPTQRGATKLEHSSHETNHHAITTGQSQQKSYGQPTEACHQHLFVILDIPLPLGWRPLNIYYYNGTTDPNEHIEAYVISQVDHNKKYKYHRNGHSTEECIILKDKIEELAEVVVTIFTKADTQTDMAITKNSQWGKLNSNNKKLLRNVNLIHTEQSPCYSMPAITLIDVDFVGNDSTQDDPMMVTIVILGWAICKTRIDQGRERVYARGKVDILTVPYVLVDVDTSYNILLGRPTLNRIRAIVSTPHLAMKFTSSIGN

SEQ ID NO: 168366 - protein, 360 aa, Glycine max
  Coding DNA Sequence Number=SeqID_76681
  Gene Ontology: Mol. function=protein serine/threonine kinase activity; Biological process=protein amino acid phosphorylation
  Homolog annotation: Hit_ID=A7PT10; Match level="QueryCoverage=48%, HitCoverage=25%, E-value=4e-42, Identity=49%"; Hit description =Chromosome chr8 scaffold_29, whole genome shotgun sequence
  Pfam annotation: Domain name=Lectin_legB; Domain location=55-273; Score=104.6; E_value=3.1e-28; Accession=PF00139.10; Description =Legume lectin domain
MIPIQILNKSKKTRLNDRPQHCNLFSRVDSHDQLLNHPRPDTATLSNLACQKEKENIFFYQIIVKGVNDTHLNNNTVSLTCDLVVPTSSASRALYSRPVRFRQPGNRFPASFTTFFSFFVTSLNPSSIGGGLTFVLSSDDDTIGEAGGFLGLSGGGGFVAVEFDTLMVMEFKDLNGNHVGVDLNNVVLSEVGDLANIEVNLKSCDLINMWIEFDGSSKGLSVWVSYSNLKPKDPILTMNLDQGREDDSVGGAGVEDAEEGEVEAKELEGEEFGGDSGAEEGGMVLGGGEAVGVVRVEVGEGLEEVRVKNEKGLKELSEGWRESDKMKAYTTTVLPENRHRWKAKNMPTKTIFASNFKTIF

SEQ ID NO: 168367 - protein, 99 aa, Glycine max
  Coding DNA Sequence Number=SeqID_76682
  Gene Ontology: Mol. function=transcription cofactor activity; Biological process=regulation of transcription, DNA-dependent
  Homolog annotation: Hit_ID=Q8H6Q7; Match level="QueryCoverage=35%, HitCoverage=2%, E-value=3e-09, Identity=85%"; Hit description=CTV.22
MIKSMKENYLPELNEMYQKSASKLQRHTSLPQQPKSYKLEKLKKFMKMLECAIAFLQKGEGYLRRQSEWSKKERGMDCDGGAAEDGGDGEQRTKDARLQ

SEQ ID NO: 168368 - protein, 114 aa, Glycine max
  Coding DNA Sequence Number=SeqID_76683
  Homolog annotation: Hit_ID=A7PGU6; Match level="QueryCoverage=84%, HitCoverage=15%, E-value=1e-20, Identity=54%"; Hit description =Chromosome chr17 scaffold_16, whole genome shotgun sequence
MPVASKTRNMLEGLVKEGSLKLLLGEEFEEMENSPSAGKNFIRELSPVANLVVRRCSKILRTSSSDLLESFNQEASDSMKHPSRYARNFLEYCCFKTRLGLIFEDHGSNIQEQF

SEQ ID NO: 168369 - protein, 49 aa, Glycine max
  Coding DNA Sequence Number=SeqID_76684
MENRVRRVAISGYWEVAGVVALLLSCEDVKNKDNNIDKSKVEIKEHSGN

SEQ ID NO: 168370 - protein, 84 aa, Glycine max
  Coding DNA Sequence Number=SeqID_76685
  Gene Ontology: Mol. function=protein kinase activity; Biological process=protein amino acid phosphorylation
  Homolog annotation: Hit_ID=Q70GI5; Match level="QueryCoverage=100%, HitCoverage=50%, E-value=2e-10, Identity=44%"; Hit description =Putative uncharacterized protein
MECVAIMWFKNGSLSGLSESQLKNEVLFLCQLHHPNIMPLIGFCIQKDPQLILSHEYMLNGSFSDHLLHRNNHKLDPLPWKMRL

SEQ ID NO: 168371 - protein, 373 aa, Glycine max
  Coding DNA Sequence Number=SeqID_76686
  Gene Ontology: Mol. function=protein dimerization activity; Cellular component=membrane; Biological process=alkaloid metabolic process
  Homolog annotation: Hit_ID=Q84KK5; Match level="QueryCoverage=94%, HitCoverage=100%, E-value=1e-140, Identity=68%"; Hit description=S -adenosyl-L-methionine: daidzein 7-0-methyltransferase
  Pfam annotation: Domain name=Dimerisation; Domain location=49-97; Score=70.4; E_value=6.2e-18; Accession=PF08100.2; Description =Dimerisation domain
  Pfam annotation: Domain name=Methyltransf_12; Domain location=212 -301; Score=13.7; E_value=0.024; Accession=PF08242.3; Description =Methyltransferase domain
  Pfam annotation: Domain name=Methyltransf_2; Domain location=109-350; Score=354.4; E_value=2e-103; Accession=PF00891.9; Description=O -methyltransferase
  Pfam module annotation: Pfam domain module=Dimerisation::Methyltransf_ 12::Methyltransf_2; Domain location=49-97::212-301::109-350
AAANSETPQNTTKKESDAIMASSNGRKASEIFQGQALIYRHMFAFIDSMCLKTIIELGIPDIIHKHGQPITLSELVSILHVPPARVGHVQSLMHYLSHHRFFESVRIHEKEAYALTAASELLVKSSELSLAPMVEYILDPTLSASFHQMKKWVYEEDLSVFDISLGCSLWDFLNKNPAYNESFNEAMARDSQMSNLALRDCKLVFEGLESIVDVGGGTGATARMISEAFPDLKCVVLDRPHVLENLSESNNLTYVGGDMFKSIPKADAVLLKWILHDWTDKDCIKILENCKEAISSNNGKRGKIIVIDMVIQEKQDEHKVTELKLLWDVAMACVLNGKERNEEEWKKLFMEAGFQDYKISPLTGFLSLIEIYP

SEQ ID NO: 168372 - protein, 134 aa, Glycine max
  Coding DNA Sequence Number=SeqID_76687
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=41%, HitCoverage=28%, E-value=1e-18, Identity=78%"; Hit description =Chromosome chr4 scaffold_32, whole genome shotgun sequence
  Pfam annotation: Domain name=APC10; Domain location=11-120; Score= -45.8; E_value=3.3e-05; Accession=PF03256.7; Description=Anaphase -promoting complex, subunit 10 (APC10)
MELLNIGFIKTDANYLMLTLNALGTIVGAQSSKLSTLPVNKLIVLYVVFKLDKSYMPSKVSILAGDSFHNLKEIKTVELMKPTGWVYLSLSGADPSTAIGPAKLWATESIHDLVKMLVELVLSVVKHGHTIFLI

SEQ ID NO: 168373 - protein, 146 aa, Glycine max
  Coding DNA Sequence Number=SeqID_76688
MATPKTRPENTTGNTFDEKSSTNTGRDNNKIACATTCFVGRGGTFDNNSGADIGRNDIGVSGVVNCFSGDINDMVSVRYCTIGVVIVAESIELSIDGNFSEGKDEEGWLSGVELQRVRQWRPQDGPGDSRKVSHPPSELNESTKML

SEQ ID NO: 168374 - protein, 118 aa, Glycine max
  Coding DNA Sequence Number=SeqID_76689
RVSPMRDAQALDVFARELQDSPSGLSEYDNDHALSAGFALSAPFGFFVGFLCVKLALAAERGDTLGLSLISLMLRLPHASGNLEPFCYSRDTETSVDTITLGLTLAHGLGVTLTLALT

SEQ ID NO: 168375 - protein, 175 aa, Glycine max
  Coding DNA Sequence Number=SeqID_76690
  Subcellular localization annotation: CTP_CleavageSite=33; ConfidenceScore=5.06e-01
MNTPLTGSTSTPKKSRNPNRPETPWTTTTPLTHIDTKGGRPNDILWSTESWRDSKTKFDRLEKRTRKEKVAQGPTHTSWTSNIDWTSINPFKGDQALKGKIEKLIQAGYLTQFVKRPSSNQAEGRLGGHNEDHRRGSDRGQDRRGNKTEDRGRPRHHQQRREHQPQQEQENEPAQ

SEQ ID NO: 168376 - protein, 219 aa, Glycine max
  Coding DNA Sequence Number=SeqID_76691
  Gene Ontology: Mol. function=oxidoreductase activity; Cellular component=cytosol; Biological process=auxin mediated signaling pathway
  Homolog annotation: Hit_ID=Q52QX9; Match level="QueryCoverage=92%, HitCoverage=59%, E-value=4e-99, Identity=87%"; Hit description =Aldo/keto reductase AKR
  Pfam annotation: Domain name=Aldo_ket_red; Domain location=1-189; Score=-24.2; E_value=4.1e-07; Accession=PF00248.12; Description =Aldoketo reductase family
MYDDFNFFCCFLDGKIGELKKLVEEGKIKYIGLSEASASTIRRAHAVHPITAVQLEWSLWSRDVEEEIVPTCRELGIGIVAYSPLGRGFLSSGPKLLENLTQDDFRQSLPRFQPENLEQNKTIFERVNELAAKKGCTPSQLALAWVHHQGKDVCPIPGTTKIENFNQNIGALSVKLTPEDMAELESFAAADAVKGGRYMDGFATWKESDTPPLSSWKAA

SEQ ID NO: 168377 - protein, 212 aa, Glycine max
  Coding DNA Sequence Number=SeqID_76692
  Gene Ontology: Mol. function=transferase activity, transferring glycosyl groups; Cellular component=membrane
  Homolog annotation: Hit_ID=A7NYY7; Match level="QueryCoverage=51%, HitCoverage=22%, E-value=2e-30, Identity=58%"; Hit description =Chromosome chr6 scaffold_3, whole genome shotgun sequence
  Pfam annotation: Domain name=Exostosin; Domain location=87-212; Score= -110.4; E_value=0.058; Accession=PF03016.6; Description=Exostosin family
MPKPSNCFNFNETADCPIKSNHTNQNGVTSGASNVPRCIVENHTETIVPAVHGEVDKRVHMSSPPLNRDNVGLVSKRNLDSCSCQYIYVYDLASRFNEDLLKGCHSLMKWDDMCHYMSNLGLGHKVIEKSKEKVLLKESWYATNQFSLEVIFHNTMKHYKCLTNDSSLASAIYGPYYAGLDVGYKLTFDVSESRGTVAGCRNRCKRHFSSSD

SEQ ID NO: 168378 - protein, 116 aa, Glycine max
  Coding DNA Sequence Number=SeqID_76693
  Gene Ontology: Mol. function=isoflavone 7-O-methyltransferase activity; Biological process=RNA-dependent DNA replication
  Homolog annotation: Hit_ID=O22308; Match level="QueryCoverage=74%, HitCoverage=24%, E-value=2e-35, Identity=86%"; Hit description =Isoflavone-7-O-methyltransferase 6
  Pfam annotation: Domain name=Methyltransf_2; Domain location=1-106; Score=-62.2; E_value=6.4e-05; Accession=PF00891.9; Description=O -methyltransferase
MASDSQMSNLALRDCKLVFEGLESIVDVGGGTGTTAKIICEAFPNLKCIVFDRPQVVENLSGSLNLTYVGGDMFKSIPKVDAVLLKICDAVDDDVEGEENVVAWAGSRFCEKRKWK

SEQ ID NO: 168379 - protein, 148 aa, Glycine max
  Coding DNA Sequence Number=SeqID_76694
  Gene Ontology: Mol. function=protein dimerization activity; Biological process=lignin biosynthetic process
  Homolog annotation: Hit_ID=Q84KK5; Match level="QueryCoverage=91%, HitCoverage=77%, E-value=1e-22, Identity=64%"; Hit description=S -adenosyl-L-methionine: daidzein 7-0-methyltransferase
  Pfam annotation: Domain name=Dimerisation; Domain location=31-79; Score=32.0; E_value=2.2e-06; Accession=PF08100.2; Description =Dimerisation domain
  Pfam annotation: Domain name=Methyltransf_2; Domain location=10-145; Score=-105.1; E_value=0.019; Accession=PF00891.9; Description=O -methyltransferase
  Pfam module annotation: Pfam domain module=Dimerisation::Methyltransf_ 2; Domain location=31-79::10-145
MASSMNGRNVSEIFQGQTLLYKHLYAFIDSMCLKRVVELWISDKIHNHAQSITLPELVSVLLVPSTKIGQVQSLMHYLAHNGFFERRTCQGSNNLTFVGGDMFKSIPKADSILLKWILHNWFDKDCIKILKNCKEYMKPFKSLFFKNI

SEQ ID NO: 168380 - protein, 21 aa, Glycine max
  Coding DNA Sequence Number=SeqID_76695
MSRFLNTYFQVARSLYPLKGE

SEQ ID NO: 168381 - protein, 472 aa, Glycine max
  Coding DNA Sequence Number=SeqID_76696
MACLINGKERSEEECKKLLQTSILVSKAKASTYKRDSNAQVKRVQLRVIKVTWSNEVFSLDACVAGGYLIWYTSPQTDWVPYLVRHQGSQLEESKVRWYNDVLPPNAPEKVGESIAAPVVAAAVEVGMSQRATSRPKKCPPPSITLLEYTWVDRELAVDQYHNRSKDVLGHSAHGPSLCDDFTMGVLRILNVAPMQQHPNKWAAMQANDYSGQRQHECFQLGSAKPDRCRKAKTQEAEPSGASKGLRDHSRHREGTSREKRLKQSMLGFQPTTATTLENMATLTNQSFFNNNFWSNRLIQSKIISEHGCQVLSKGDNAANWANFWVFLSRVPIIAQHLQGSSNIKALKEQLLKAKDSLNSTLQANMKLAGDNKILEERVLPLLNDAKRLETRALNVEALVRKGFSKRPLMMSIMHMRLHMCDISDLSVFDINKDVHEVLIDDISEDDIALSPHKPTTLVEEPHVKEIKDGEF

SEQ ID NO: 168382 - protein, 499 aa, Glycine max
  Coding DNA Sequence Number=SeqID_76697
  Gene Ontology: Mol. function=nucleic acid binding; Cellular component= intracellular; Biological process=transport
  Homolog annotation: Hit_ID=A7PAA0; Match level="QueryCoverage=81%, HitCoverage=87%, E-value=1e-101, Identity=51%"; Hit description =Chromosome chr14 scaffold_9, whole genome shotgun sequence
  Pfam annotation: Domain name=NTF2; Domain location=17-133; Score =151.0; E_value=3.3e-42; Accession=PF02136.11; Description=Nuclear transport factor 2 (NTF2) domain
MALQTATPPTTPSAQVVGNAFVEQYYHILHHSPGSVYRFYQDSSVISRPDSSGVMTSVTTMKGINEKILSLNFKEFKAEIKTADAQKSYKEGVTVLVTGCLTGKDNLRRKFAQSFFLAPQDNGYFVLNDVFRYVEDHEPSELPPVTGDGDSAAVTVTPELGKIIIQKIVSSLSKFIQELHSCCSPFFTEPSHVADSCAPEPTNSHVNKGQTVAENAYELSNNHERQIPVENEGNVESHFQSNGNDDSQATELASSAQDDAPKKSYASIVKVQKGSSVPTKVYVPTNTLKSGPNKTESKVVESVESTEVPEAALESVSNPESSDAHEEVEGHSIYIRNLPLNVTVAQLELEFKKFGPIKPGGIQVRNNKASPVPIGGRQAVVEIKRTTTRVGSGINGTGRPRIPSGRGGLRNDSFRGRGNYVGGRGYGRNDYVSRGGFSGRGRGHGEGAEEEELNGNWVNNQEQELLNTVLLKDEDNVVGYGMSMNIISRKDLLVHVYMV

SEQ ID NO: 168383 - protein, 657 aa, Glycine max
  Coding DNA Sequence Number=SeqID_76698
  Homolog annotation: Hit_ID=A5AJA0; Match level="QueryCoverage=36%, HitCoverage=51%, E-value=3e-33, Identity=35%"; Hit description =Putative uncharacterized protein
MPIMYRSQVIKFPVPSSARLCAETQNEKPQLGMKFFASSFVKKGENSAEKVSELSLEKGEEVAKASHESLVSDAKWVCESPKAGVSSTASGWPSFNDIKAPPLTYSLSAEEKATMAVLQLQHKALEACQKFLVGDAGSDSDEDDKDDEDEDELVDDYDSKECEEYKFFEKVFAEDGDLRRYYESNYKEGDFHCLVCGGIGKKVWKRFKNCKTLIHHSTAILRTKRKRAHRAYAQVICKVVGWDIDQLPAIVLKDLDSFFIGSRKLLGFEKESVSLDGKVLEPSSENGGEIVKRKLPRFTGVDGTLWHSYENVIFGAPSKAEESHESLVSGAEWESESPKAGFSSTTSGWPSFDDIKSSSLNYSLSVEEKATVAVLQLQHRALEACQKFLVGDVGSDSDEDDEEAEDDELLDNDSKESEEYKFFEKVFAEDGDLRRYYENNHKEEDFYCLVCGGIGKKVEPKNPAMGCTDDTNSNDVLPKFARKGLNFFETREESNEQNSGSNNTLSESERVTKAETKILALKKAIAKLEDEREAGLLQYQQSLEKMSNLELEVSTAQENSQKLDDEASLLQYQECLEQISNLEKNISSLQKEAGELNERATKVETETESLKQELARVEAEKEATLVQYNQCLETISKLEERIKEVEENARRLRSMPI

SEQ ID NO: 168384 - protein, 459 aa, Glycine max
  Coding DNA Sequence Number=SeqID_76699
  Gene Ontology: Mol. function=receptor activity; Cellular component =fungal-type cell wall; Biological process=metabolic process
  Homolog annotation: Hit_ID=A0EJF1; Match level="QueryCoverage=95%, HitCoverage=67%, E-value=0.0, Identity=69%"; Hit description=Beta -glucan-binding protein 2
  Pfam annotation: Domain name=Glyco_hydro_81; Domain location=1-459; Score=325.2; E_value=1.2e-94; Accession=PF03639.4; Description =Glycosyl hydrolase family 81
MMLLPTLLPSIFWHNSRSSVACFQLQECGNSRQPFRVTYEWQKKGPGFLLTLAHPLHVKLLQYKKNHRMIVLRDFKYRSIDGDLVGVVGDSWLLKTDTIPVTWHSNKGVEKESHDEIVSALSKDVEALSSSPIATESSYYYGKLIGRAARLALIAEEVSSPNVIPTIQKFLKDSIEPWLDGTFQGNGFLYENKWGGLVTKQGSTDSGADFGFGVYNDHHYHLGYFLYGIAVLAKVDLQWGQKYKPQVYSLVSDFMNSGQKYNSHYPRLRCFDLYKLHSWTSGVTEFTDGRNQESTSEAVNAYYSAALVGLAYDDSNLVATGSTLLALEILAAQTWWHVKAEGNLYEEEFAKENKIVDALWANKRDSALWWAPATCRECRLGIEVLPLSPVTETLFYDADYVKELVEWTMPSLTSEGWKGMTYALQGIYDKETVLQNIRMLTGFDDGNSFTNLLWWIHSR

SEQ ID NO: 168385 - protein, 772 aa, Glycine max
  Coding DNA Sequence Number=SeqID_76700
  Gene Ontology: Mol. function=RNA binding; Cellular component=nucleus; Biological process=nuclear mRNA splicing, via spliceosome
  Homolog annotation: Hit_ID=A7PAA8; Match level="QueryCoverage=65%, HitCoverage=93%, E-value=1e-120, Identity=54%"; Hit description =Chromosome chr14 scaffold_9, whole genome shotgun sequence
  Pfam annotation: Domain name=Extensin_2; Domain location=273-655; Score=-135.4; E_value=0.054; Accession=PF04554.4; Description =Extensin-like region
MEMEMEMEMDASFATMERRREAVEDTLKVLEMMIAMETQFVFELRIAQTMTEDSSVRVSSSDKTSAANDASQTRQRKKRKWDQPAESLMPVGMAVPGALPLSNAVSLGGVAFPAMAPMISGALLRNPLAASSQLPQHTVAAAVAAQKLNQVSVGFLISYDQKIQDELIIAREIVINDAESSVRYKLTKRQTQEEIQRCTGAIVITRGKYRLPNAPHDGGKPLYLHISAGAHIKETAERILAVDRAAAMIEEMLKQEQNSQSISSASPSALVNILKMLSTCVFLGFDADPSLNIVARIRGPNDQYINHIMNETGATVVLRGRGSGNNECLNGEDGQQPLHLFLSSNNAKSLEDAKLLAENLLDTICTECGALSAVPPPQQVYTAVPPPQQVYSGPSLLKQIPTAISPPQQVYSAVPPPQQLLTGVQSSGIDLEAGTSLTSSSMSAAGVLTPVPPASLVGVTGVTGSLTLGTPSQSIGHLSSGPQANMIGYTPPPLVSGGTSYIGYGGLYPQATPLQQVALALRHSPPVTSTDAPTTSASNGESRPTSSSDLEKEKRPPQRRKFQELPVGSKGTTKLNQGLQPLKPYEQSDGLVVRNILTMPAPKKLVPPSSNGMPPPLLRTMPPPPPPKFSDPFEVKVHNKNKTLLKTKSDAVPDTLVNLMEYGEEDDDDIDDSSEESLPHDTRATGDMKVVVAWVASLCVKDDIVVTLVGAPQEKQIIYHKDRNLEIHLVLKPQEVQLLMLGSNSLMKDWKVFQHDEGSSAKWRGRRGREVE

SEQ ID NO: 168386 - protein, 652 aa, Glycine max
  Coding DNA Sequence Number=SeqID_76701
  Gene Ontology: Mol. function=receptor activity; Cellular component =cell septum surface; Biological process=cell separation during cytokinesis
  Homolog annotation: Hit_ID=A0EJF1; Match level="QueryCoverage=99%, HitCoverage=99%, E-value=0.0, Identity=65%"; Hit description=Beta -glucan-binding protein 2
  Pfam annotation: Domain name=Glyco_hydro_81; Domain location=6-652; Score=828.0; E_value=5.1e-246; Accession=PF03639.4; Description =Glycosyl hydrolase family 81
  Subcellular localization annotation: CTP_CleavageSite=22; ConfidenceScore=5.55e-01
MSSFLFPQTQSTVLSDPSTYFSSNLLSSPLPTNSFFQNFVIPNGSQAEYIHPYLIKTSNSSLSASYPLLILFTTAVLYQTFVADITISSTQTTSQNHVISSYSDLGVTLDIPSSNLRFFLSRGSPFLTVSVTSPTSLSITTVHTIVSLSSNDDNNTKYTLKLNNTQTWLIYTSSPIYFTHNNASEVTSKPFSGIIRVAVLPNHNYVTILDKFSTCYPLSGNATLVEPFRVVYEWQKEGSGDLLMLAHPLHVKLLSNNYNGLVTVLNDFKYRSIDGDLVGVVGDSWVLETNPIPVTWYSNKGMEKDSYDEIVSALVKDVQELNSSSIGTSSSYFYGKRVGRAARLALIAEEVSFSNVVPTIKKFLKESIEPWLDGTLQGNGFLYENKWGGLVTKLGSTDSTADFGFGVYNDHHYHLGYFLYGIAVLAKIDPEWGQKYNPQVYSLVTDFMNLGQKYNSRYPRLRCFDLYNLHSWASGVTEFADGRNQESTSEAVNAYYSAALVGLAYGDSNLVAIGSTLLALEILAAQTWWHVKAEGNLYEEEFAKENKIVGVLWANKRDSALWWGPATCRECRLGIQVLPLSPVTETLFSDADYVKELVEWTMPSLTSEGWKGMTYALQGIYDKETALENIRKLKGFDDGNSLSNLLWWIHSR

SEQ ID NO: 168387 - protein, 181 aa, Glycine max
  Coding DNA Sequence Number=SeqID_76702
  Gene Ontology: Mol. function=translation initiation factor activity; Cellular component=transcription factor complex; Biological process =regulation of transcription, DNA-dependent
  Homolog annotation: Hit_ID=A5BBG2; Match level="QueryCoverage=62%, HitCoverage=46%, E-value=4e-14, Identity=33%"; Hit description =Putative uncharacterized protein
  Pfam annotation: Domain name=TFIIB; Domain location=54-124; Score =30.6; E_value=5.9e-06; Accession=PF00382.10; Description =Transcription factor TFIIB repeat
MALVDEEYCSDCKSKLHSISDDDDNDNDQNEHHKKESSLSAPLLTSGAGLSTSVAHTPSNSDLSIKNHAKELYKKAQGRKIFKWRRHSRASMMACLYLACQEEGFPRTVKEIQSVADGAKEKQINKAIGVFNKHLQAVREVLHKAHEFYVRRKPSIILATTIDMVDQLSSKNKIFQGRVIL

SEQ ID NO: 168388 - protein, 90 aa, Glycine max
  Coding DNA Sequence Number=SeqID_76703
MKVLKHKLHSLFQEYVNNFKKETTTKGQQESQAHPSLAKGKSTPQVALTDEFIQFGNDNISQHGTSQLDIYLEEQKLSLAYHPNLEILNY

SEQ ID NO: 168389 - protein, 63 aa, Glycine max
  Coding DNA Sequence Number=SeqID_76704
MGMKKRRFGAEGEDEGLVIMWQGGFEGKDWSAASYMGLEGRSGVRRGSLMSEIETTEARKLGD

SEQ ID NO: 168390 - protein, 212 aa, Glycine max
  Coding DNA Sequence Number=SeqID_76705
MLALVDLKGGACMGLLPIHFRGRMAPLLGQHTPPKHPSEAKHGKVIKFDAQTLNSFFETLVIILEGEQLTIYSQYLHTYPDHKAIAAKLYTSGGQFILNAEGAPWKILRKDLTTLAQMWSILSYFNLAPTSHTSDLNVNHVQLIYGQVMKMDLDLGSLISFENTQIAQSISSWLGFPTLITTLCDAKEVTFDSLTFELLSPMINLAYIWKNC

SEQ ID NO: 168391 - protein, 266 aa, Glycine max
  Coding DNA Sequence Number=SeqID_76706
  Gene Ontology: Mol. function=unfolded protein binding; Cellular component=chloroplast; Biological process=response to stress
  Homolog annotation: Hit_ID=A8W7B5; Match level="QueryCoverage=80%, HitCoverage=34%, E-value=3e-28, Identity=38%"; Hit description=Heat shock protein 70
MKAVFIKVKSIPRRLHPLRVVNEKVVDIDLRTTNSVVAAKEGGSLARSPSVRQSLTSRTLSSSLRGSLDARCLRSKKSPSRSLTKSLETTTTTSNSIAPPLANSSQLRKFLPRFLCRLVLRKLVDAASKFLNDKVTKVVVTVPTYFNDSQRIATKDASRIIGLKVLHIINEPIAASLVFGLKRKTTKLSLFLTLEAVPLMSLFKVGNGVFEVLSTFGDTHLGGRGLYHKRPKFDQETKGKVNEETYPDERCRKDQEQYLDASTKKC

SEQ ID NO: 168392 - protein, 442 aa, Glycine max
  Coding DNA Sequence Number=SeqID_76707
  Gene Ontology: Mol. function=transferase activity, transferring glycosyl groups; Cellular component=cytoplasm; Biological process =metabolic process
  Homolog annotation: Hit_ID=A7PA89; Match level="QueryCoverage=99%, HitCoverage=99%, E-value=1e-124, Identity=50%"; Hit description =Chromosome chr14 scaffold_9, whole genome shotgun sequence
  Pfam annotation: Domain name=UDPGT; Domain location=4-432; Score= -102.6; E_value=2e-05; Accession=PF00201.9; Description=UDP -glucoronosyl and UDP-glucosyl transferase
MGVPHFLLIPYPTLGHVNPLMQLSQVLARHGCKITFLNTEFNHKGANTAAGVGIDNAHIKFVTLPDGLVPEDDRSDHKKVIFSIKSHMPPMLPKLIQDIDALDANNNITCIVVTVNMGWALEVGHKLGIKGALLWPASATSLATCDCIPWLIHDGIIDSDGNPIKKQEIQLSTNLPMMDTENLPWCSLGKMLFHHIAQEMQTIKLGDWWLCNTTYDLESAAFSISRRFLPIGPLIASDSNKSSLWQGDTTFLDWLDQQPPQSVIYVAFGSLAVIDHNQLKELALGLNFLDKPFLWVVRPSNDNEANNACSDEFHGSKGRIVSWAPQKKILNHPAIACFISHCGWNSTIEGVCGGVPFLCWPLAKDQFVNKSYICDVWKVGLGLDKAENGLISKGEIRKKVEQLLGDEGIKARSLKLKELTLNNIVEGGHSSKNLKNFISWAE

SEQ ID NO: 168393 - protein, 157 aa, Glycine max
  Coding DNA Sequence Number=SeqID_76708
  Gene Ontology: Mol. function=transferase activity, transferring glycosyl groups; Cellular component=membrane
  Homolog annotation: Hit_ID=Q2PF02; Match level="QueryCoverage=35%, HitCoverage=10%, E-value=3e-19, Identity=76%"; Hit description =Putative uncharacterized protein
MLKYTNKQGHRSAIRISRIVSEALRLGMKDMQWFMMSDDDSIFFTENLIHILRKYNHNRSIRWGVCRRVTCKTFSSLTTWPMAEEWFWTQTDGVEETKRGIESKKVKCYGRYGYFEANQVVHYMYEQTNHGIDLDIQNPHSSSFLLYDHRYKSFESA

SEQ ID NO: 168394 - protein, 114 aa, Glycine max
  Coding DNA Sequence Number=SeqID_76709
  Gene Ontology: Mol. function=transferase activity, transferring glycosyl groups; Biological process=metabolic process
  Homolog annotation: Hit_ID=A7PA90; Match level="QueryCoverage=39%, HitCoverage=9%, E-value=8e-15, Identity=64%"; Hit description =Chromosome chr14 scaffold_9, whole genome shotgun sequence
MAKYTEGLPRVPVSPTTMAKCPACCHLPSLVNLSIDLLKKPFLWVVRPSNDNNKVNNPYPNEFHGSKGVCGGIPFLCWPFFSDQFINKSYVCDVWKVGLGLNKDENGLILKGGR

SEQ ID NO: 168395 - protein, 336 aa, Glycine max
  Coding DNA Sequence Number=SeqID_76710
  Gene Ontology: Mol. function=helicase activity; Cellular component =chromatin; Biological process=viral genome replication
  Homolog annotation: Hit_ID=Q2QZU2; Match level="QueryCoverage=98%, HitCoverage=24%, E-value=1e-54, Identity=31%"; Hit description=AT hook motif-containing protein, putative, expressed
MDLYEATWRIFGFPIHGRKPVVERLHFHLPRQHSVLYQDHDDIDAALSNPSISDSKFISWMNSDQSFAEGRTLMQNLFLRPTSFKDIRTVANVQYPAYREACFAMGFLQDDREFVEAIKEVKDWGIAHYLRKLFVLILLTATMNKPEEVWDQTWHWLVDDIAYHHRKTKTNIEIRFNDDHLKILVLLEIEQLLQANQKSLRDYPLMPYPEDGNWATCLDNSLILLELNYNNDEVRLEFLHLFSQMTGKTFMWKTLASSLRADNKIVIMVSSSGIASLLFLGGRTAHSKFKIPIPIFEDSTCNIHQGSQLAELLNQTSLIIWDEAPMTHKFFLKHLI

SEQ ID NO: 168396 - protein, 149 aa, Glycine max
  Coding DNA Sequence Number=SeqID_76711
MARKLRLRSPNFSGIFDVLAKRACSLSELKEPCSLSHCVVLAKRGWHLGRDNQPPPDLKNHMTRPDLFQRQPNGRIDVALVKEFYANLFDSEDKSPRKVQVRGKLITFDGETLNAFLETPVVLEPRSILEAPEEGFDYSGTDLERLVIF

SEQ ID NO: 168397 - protein, 232 aa, Glycine max
  Coding DNA Sequence Number=SeqID_76712
  Gene Ontology: Mol. function=catalytic activity
  Homolog annotation: Hit_ID=A6NA79; Match level="QueryCoverage=82%, HitCoverage=40%, E-value=4e-44, Identity=50%"; Hit description =Protein phosphatase 2c
MTQAVEVLNRYGTDLVGEPRDSDSECLAGFECFLNIVRALGMGSCISEVGAGGNSPPLLPYSPESNMDGGKRRRLRGSSSFDFKVPGRMFLNGSSEVASMYCKQGRKGINQDAMLVWENFCSKEDTIFCGVFDGHGPYGHRVAKKVRDSFPLKLNAQWDLHHKNRDRLSDHSSATGSYKSEGNGFRLVDEKTSPIDHEHEETDTILTLRESFLKACKIMDKELKLHPDIDCF

SEQ ID NO: 168398 - protein, 218 aa, Glycine max
  Coding DNA Sequence Number=SeqID_76713
  Pfam annotation: Domain name=PPTA; Domain location=53-83; Score=15.7; E_value=0.066; Accession=PF01239.13; Description=Protein prenyltransferase alpha subunit repeat
MDQFKSFGYEDLAISTKSLLDDGCLESILIPPSDRFEGFNPSINEAINLIQAEMMDYIAIKITTCPSNFTAQNYHCHVMKLLPEDHRDYPCLFNDEYESWNVQGNTQYQYSHMRAQIQGYQWFFSEEDKPFLALIQWEIFHSFPGGSKYSSSRKRKKTMRFMKPADAMDNKLLLSLLLISQWKINLTFSVLRISKTKKMLRSLSQLRVKDKCILPKHS

SEQ ID NO: 168399 - protein, 67 aa, Glycine max
  Coding DNA Sequence Number=SeqID_76714
MAAFRKALPENQPDAHMKNYKDPLKKISKWMKKDGLYLFITFATKHLPTSLSHPPLASKWETLHTDQ

SEQ ID NO: 168400 - protein, 176 aa, Glycine max
  Coding DNA Sequence Number=SeqID_76715
  Gene Ontology: Mol. function=catalytic activity; Cellular component =nucleus; Biological process=metabolic process
  Homolog annotation: Hit_ID=A7Q8M5; Match level="QueryCoverage=79%, HitCoverage=24%, E-value=2e-59, Identity=73%"; Hit description =Chromosome chr5 scaffold_64, whole genome shotgun sequence
MRVHTTKALKYALGKGAVDYEDFLQSGDPEYAWKPPEDEWQSNSLGYTSGTTASPKGVVLHHRGAYLMSLSGALIWGMTEGAVYLWTLPMFHCNGWCYTWILAALCGTNICLWQVTTMVVYEAIAKYKGSHFCAAQVVALLRSLLNGKLFVEWICPAVAQVYQCHISAHAVRTNLF

SEQ ID NO: 168401 - protein, 72 aa, Glycine max
  Coding DNA Sequence Number=SeqID_76716
MPQVRERDDARGRASLRGTKHFNRGLHTRGSSSLREGKLVDRGRPRKFERSSSRVREIVEVLLVAHGPLLGF

SEQ ID NO: 168402 - protein, 150 aa, Glycine max
  Coding DNA Sequence Number=SeqID_76717
MKNRSNESDFAPHMQDLSSILTPERLDGTSYPEWHQNGKNVKSPKDNSTTATGFVGTFQPICGFSVTTKGNNWIIDTSAANHMTCDRNMFTQFSSNSFVSVIINTNGASSPVMGSRTNIHTKKKISRGKRSEGLYYLEGNSHKMTCTRMT

SEQ ID NO: 168403 - protein, 565 aa, Glycine max
  Coding DNA Sequence Number=SeqID_76718
  Gene Ontology: Mol. function=binding
  Homolog annotation: Hit_ID=A7PLQ2; Match level="QueryCoverage=99%, HitCoverage=45%, E-value=1e-38, Identity=46%"; Hit description =Chromosome chr7 scaffold_20, whole genome shotgun sequence
MLEAYGDILFWAWPAAQGDSRTEIKNGFLQEMIEAAIHASFGAFASYIMRVLEAFINHRTTDGVEKILYRLAEPVIFRSLQATYRYDCLEVRTIVVEGSCRILHLFWEVIPSLIITKMITKIVDDISHDGCNETSAPNVGQSPSNTSCCSGSLTPSKGCSRFSVQQGGGARCAIVCAYKAPMAGARFFQFAILERASKSHLMELVKVFLSLILSPDKLDANQINGFLVATSYVCDSLACEPCYKNALKELLDGEKMKEPEHNGTWKAAGRGALTTYKNIPNLAIGFEEGLQAKAMAKAETRAETYLKKRTRRLKLVRQVSGGRRAMRGLHALETRHCSGDAWLRCWSHDLQGWIALLEAHPTLVSPKNLTATADSGGERRQSEQDHDVARLLEECMGVVTNCSGLPEDVDRQIEIRSAHKLLLSLGGFDDLIEALTASLHKVAYRCHIKFGVDMPSHSVSFAKRKKSKSSGKFSIKSKIINRKQSFEDDYLVAVGVTWQVRDLLLQEDTRKAILESPSLEMSFVSLKVISEVSIMHCGHHEYIDICPVLAYVAFAVQMTVDNWQK

SEQ ID NO: 168404 - protein, 475 aa, Glycine max
  Coding DNA Sequence Number=SeqID_76719
  Gene Ontology: Mol. function=nucleic acid binding
  Homolog annotation: Hit_ID=A7PN40; Match level="QueryCoverage=87%, HitCoverage=85%, E-value=2e-97, Identity=49%"; Hit description =Chromosome chr14 scaffold_21, whole genome shotgun sequence
  Pfam annotation: Domain name=TPX2; Domain location=370-426; Score =81.1; E_value=3.7e-21; Accession=PF06886.2; Description=Targeting protein for Xklp2 (TPX2)
  Subcellular localization annotation: CTP_CleavageSite=69; ConfidenceScore=5.72e-01
MAAVASSPTPRKSRSKNLENFDPNKQQQSPVFKPSCSSSSSPLVKPKNPNNKVKYFSPQNKIRQRKFLVAKKKKETKKEEKEGSGAADSCKCKATGANANKNHKCVCVAYNNLRKSQEEFFKNKDDGVVEEGGFESETESVVVEEEKEGESLLGNGLVVKRRRERLMEEARKSVPQSGSGKVMHLVKAFEKLLSIPKTEEEEDEEEGSKYQEKDDNKMVGKWALPGLQQHDSEVSFCPPNCVLTLQNLGLDPGASVSASWDSSRASVSSRTSTGGRRSRRNSLESSSTFGRRRLKKKQQKVTSQKPFKLRTEQRGKLKEEEFVKKIQEMAAVEEKQRIPVAQGLPWTTDEPECLVKPPVKDITRPVDLKLHSDVRALDRAEFDHQVQEKLSLIEQYKLERERQQKLAEEEELRRLRKELVPKAQPMPYFDRPFIPMRSMKNPTIPREPKFHNHKKIKCSLSSWNDMSPYSSSCLN

SEQ ID NO: 168405 - protein, 161 aa, Glycine max
  Coding DNA Sequence Number=SeqID_76720
  Homolog annotation: Hit_ID=A5B800; Match level="QueryCoverage=29%, HitCoverage=19%, E-value=3e-12, Identity=68%"; Hit description =Putative uncharacterized protein
MGVNAFCKVVRRLVKDEVVANGRQDRSSGVIQDRDSGLGQDSCGSSKHADHRYPDPKEGDQSGSRCFARMLQPYEISIGLKEHSNPVTPKAYTPKSPSGPLPPDSDSSGFLRERKRLQCEGCFSQFRHDIEILNGENARNCVANVVLKFHDDPTVNESEIV

SEQ ID NO: 168406 - protein, 720 aa, Glycine max
  Coding DNA Sequence Number=SeqID_76721
  Subcellular localization annotation: CTP_CleavageSite=45; ConfidenceScore=5.07e-01
MLNEFVLCRGSLSDVGGSSLDKQRVTNFSSPKYGRMLFGVGCAVRDGHVVSVSEWTRIGVAVVREWGSFVVQNFRAPLQLLPVAVTLGARLSNPSWIERSSRLIVPHWRILTEMPLIVSPLIRRGVRPSIAVGKLVPVTMILPHSAFGGVRRGSDGGDTSPVSPRQRVSLCFNARPLMNQVRLAGRFVPSSVAALTIGEGGELVVEVAPFAVVVESSRLMTSHDVHPAPPTIEARTVAAITPAPSPPPVVVVQEVTPTAIELTVPATQADSIVATSSTIVTPLLIADVVTIGAPMVLALSSLAPMAFPSTVLVTMASPYSFSRLRVSMGHLYTSSNANQLWGYLEDGRPKVERLKVANATVAFVETVRSNHQLYFKVGVQLKELESWLESMTTERDGLAKIIVDLEAKLKELESRLEESNLRATKYRESSKEPEEELLLYKKETDLDLGLFNPFKDVKDGVLVDEEDIAVEEKVVDEWQGVAEQGDDACVYVAFVFIFFSSFSGFDHRVMFDLPLVEGLANQSGKGWTVAPLMVMKSKCELHLIEGMTSTRLKVLPNSGMQVHLVEFGPLTVVIVVATYERTKGVPWITVRNKEYCQGHTCVPSVPVEMELSKRKGSPRMNLGFDETWTRDVFALGFVKPSELCRGLPMRDMTLTEGGMYWRRNGMLLHMCLLQSGTYWSVMYWRLSSMLLPLCHSLCVANIGVIVDAAVHMSLAMGDMY

SEQ ID NO: 168407 - protein, 118 aa, Glycine max
  Coding DNA Sequence Number=SeqID_76722
MAAKSTWVWLENEDLRALNVDLMEASGVAEGVVGVVVERGFEGFDAVEEGGHGGMRLALRVMVLSGKVEILVGVVLLGGNGNGNRGVQQEEGCGGGDGGERPFSVCPVEPTSTTVKEK

SEQ ID NO: 168408 - protein, 196 aa, Glycine max
  Coding DNA Sequence Number=SeqID_76723
  Homolog annotation: Hit_ID=A9PDG3; Match level="QueryCoverage=33%, HitCoverage=72%, E-value=5e-16, Identity=65%"; Hit description =Putative uncharacterized protein
  Pfam annotation: Domain name=Complex1_LYR; Domain location=11-75; Score=65.1; E_value=2.4e-16; Accession=PF05347.6; Description =Complex 1 protein (LYR family)
  Subcellular localization annotation: CTP_CleavageSite=25; ConfidenceScore=5.09e-01
MSAAASSSATPSAAQVLSLFRSLLRAAREFPDYNIREYTKRRTIDSFRHNATLSDPSQISTAFAHGKSQLAVVKRQAVVYSLYDSPLRSVMELQQSLKPHEREVEDIVGEVEESMAEVEVGEEWRRPNQEQWVMEVFRENGVLSVMVALIFTKMVVPKSVFHVNCSLSTMHVLPSWLLSVSVFALGWADSWYAGNG

SEQ ID NO: 168409 - protein, 250 aa, Glycine max
  Coding DNA Sequence Number=SeqID_76724
MVVCILAVEDEGASFHLLYHIVARICDEITLILHHNGKLIQNANEALDGLQRLENDYDVLSLCKIGLANPKKKVHVYLEHVEPEGGLVIEIGLEIEIDVLPLNCNAEKVVVLEDSTQNVIEDMDVDGANNVGKGGLDGETGVVGVETQVDVQDAKTKVVGVETQVNNGVDDDEVKEHDKDANFFYHSESDLDYMLAIKDSRLVANLLLVLMVVFLKGYYGGHLLAAMGQDANNVIFVIAYAIVNAEDEDN

SEQ ID NO: 168410 - protein, 168 aa, Glycine max
  Coding DNA Sequence Number=SeqID_76725
  Subcellular localization annotation: CTP_CleavageSite=44; ConfidenceScore=5.29e-01
MATPPRSPPYSDIPSKATSRRTRQSIWLRRLTIGSLDQQRPMVNVNPASGRGSGPNKEKFHSYLEAKLDIHEGGNAKKKGQQKDDPSVKYGIDAATWAEFAKSRQTPNWQGTGVKISQYFGQASRGSNTSSASITQQQLTKIIGNLKEEWRKEVEEENKNLQESWRRK

SEQ ID NO: 168411 - protein, 143 aa, Glycine max
  Coding DNA Sequence Number=SeqID_76726
  Homolog annotation: Hit_ID=Q9FJ19; Match level="QueryCoverage=51%, HitCoverage=45%, E-value=3e-11, Identity=44%"; Hit description =Genomic DNA, chromosome 5, TAC clone:K21P3
MTVGDKTHFNAITTSIDTRVLIEGDRYSEETSYGASDFVEGILTLPYPPCCAENHCQFSNVLNGNNNDSSDEEAETKLAQLQREHAEQVKGFRKEYIREMEVVKIEKECKAKNRREVLRVANEEHKKLEAQASQLRAQEHDLE

SEQ ID NO: 168412 - protein, 594 aa, Glycine max
  Coding DNA Sequence Number=SeqID_76727
  Homolog annotation: Hit_ID=A7PN25; Match level="QueryCoverage=99%, HitCoverage=99%, E-value=3e-37, Identity=26%"; Hit description =Chromosome chr14 scaffold_21, whole genome shotgun sequence
  Pfam annotation: Domain name=CaM_binding; Domain location=466-581; Score=28.5; E_value=8.6e-07; Accession=PF07839.2; Description=Plant calmodulin-binding domain
MAKESVDLPLIPKVTMSSGVALRRHSAGIANSGNNEKKLVPHYLRASTGSCHDFCKYGRKNVEEAREKLSIIKRAGRKSLSRSSEDIIDGIMTSVAKQKTSLDSTSTKMSTVKHSESVGTNKMELPTKSSGSQKQMGNKVLVNTSKASLVSVKPSFLPKSHISSIPEARRGGISLSFEVEALSKPTSKRVEASPTETSERVKTHPKSTSQIVKTSPKSMFKKKQTLKVSPFEEKEMELSDKHVTSLNPDFITKQTISSVNSSDVFGGQRNSKIKMNKKEVSSKSSSRGIGSVSARKHKGLKIVPHLMNQPKPIKVELEEHNNEAQEKTLYIIKMESTKQSSHSDQNESQDIEDQEESEYSNSEFEEDACPENHEIEYMANVDTLEVEKNGKPQNDEIVCSEEKECQQLGGKLVETQIEYMANVDTFEAEKNGKPQKDGIVCSEDKECHKLRGELVETQIEYMANVDTLEAEENGKPQKHGINCSEAKECQKLGGELLETHIEKGSLRSLEVQKEVLGAITTDVKAVAITAPEKVLLRHQHVQVKKDGQGLYNNVIKETTKHVETQKGKVKALIDAFEAVISLEEKSISAANIVN

SEQ ID NO: 168413 - protein, 120 aa, Glycine max
  Coding DNA Sequence Number=SeqID_76728
  Homolog annotation: Hit_ID=A7Q8P9; Match level="QueryCoverage=45%, HitCoverage=8%, E-value=5e-09, Identity=57%"; Hit description =Chromosome chr5 scaffold_64, whole genome shotgun sequence
  Subcellular localization annotation: CTP_CleavageSite=46; ConfidenceScore=5.60e-01
MLASVTLTSSSALRITSTSSSGAGPTLKSSASPNPAPSYPSALETIATKINKRRRKKNKNLFLKFVDYARSRLFSLECDQNEDDEGSDGLGWSCIVAHILKTCVAYSSGVTLVILLSEIS

SEQ ID NO: 168414 - protein, 199 aa, Glycine max
  Coding DNA Sequence Number=SeqID_76729
MEMPKAGAGGAEEEGAKASDGPRALALRVPEKVIVGSSGDSKVNESGTTPRATHKAVISIGNLSLEELEYDRTLQVYASVFKSFLRSFQGLCECCRTWYMQYTAPLAPELVVCIKFLEPGHIYVPIHLPGQGFMPILPLKFLAKLIVLRDGSLGLEAVAFLFLEAISIKKNHRNQVRQGALSATTQKQRLWLSETHSLS

SEQ ID NO: 168415 - protein, 114 aa, Glycine max
  Coding DNA Sequence Number=SeqID_76730
MKKKKVEATGVSLSEALSSLSKLGESGRESVIHARGQRAISSLFASHSPNCDTNQQVYRVTSSINDSKGFYIKVQQKPPTKELAFHCKLAPFSPRTGFGRISKITKLWGCLLHL

SEQ ID NO: 168416 - protein, 88 aa, Glycine max
  Coding DNA Sequence Number=SeqID_76731
MSMKFSSSSVWSRKEIGYGDDGVIFTTSSNAKYPEKMFRISPNWKGLDSLSWSLEATNVVEGLDALHWVFGWGRWDVICYEFGLHKER

SEQ ID NO: 168417 - protein, 84 aa, Glycine max
  Coding DNA Sequence Number=SeqID_76732
MEGELPVHDKIQGAFAEPSQVFASRSKYNGLFREKIYEDEDLSEEELKKKEIKVWHEVKEIFRDDKNGIRILMTIRNNDVELYT

SEQ ID NO: 168418 - protein, 75 aa, Glycine max
  Coding DNA Sequence Number=SeqID_76733
MKVKLAEREGIVWGLRMEKRESSPECCWSERSLGVKRNNEIKGTLKLKIGKGTKNQRGTKHRVLLRCLHLRQRLC

SEQ ID NO: 168419 - protein, 24 aa, Glycine max
  Coding DNA Sequence Number=SeqID_76734
MAKIMLKVTVASDAILNTFNAKDQ

SEQ ID NO: 168420 - protein, 63 aa, Glycine max
  Coding DNA Sequence Number=SeqID_76735
MSNISGLLNFARRLRVIFVRRTREGTCKAKDFNTQKQQQRKKGEAHRHAKECYTASLLAWTCT

SEQ ID NO: 168421 - protein, 131 aa, Glycine max
  Coding DNA Sequence Number=SeqID_76736
SKEFQRPPTTWKKYQYRRDEILQHLTEEGTSTQDSPNTATSVNDNKIYLNVVGGPNYNGNVYGLDTLSKRFSCSKSAPSTSIAPMEDQIEEIRETINKLNAELLAKANKEKTLKEKMLQLMENHDHQSQEM

SEQ ID NO: 168422 - protein, 275 aa, Glycine max
  Coding DNA Sequence Number=SeqID_76737
MHIQQDHNLVGGVVVRQRQIHKERKQDIKETFNEDGEVVQEGIDLVLVDIANGGKTANNTEEQETGQEGALQGGSILEVEVSVGVGVGVTFDFGLVVIGTKQALQARLRRGSGGAWSQEVTVRASMRCEDKRTRGREASRLQGYVRSHSYHGLVQNILILRLKEGAFPNFTRFVKLTKSFPPPSPLAATALPPPPPPAATGPPPPLPSTEDHTHSSQLPYIGSLVTLHHHLALCLPHLQMDPWCEANHVRAEKDSSVPSGSVISDMSNIKVVVAK

SEQ ID NO: 168423 - protein, 269 aa, Glycine max
  Coding DNA Sequence Number=SeqID_76738
  Gene Ontology: Mol. function=molecular_function; Cellular component =cellular_component; Biological process=biological_process
  Homolog annotation: Hit_ID=A7QHB2; Match level="QueryCoverage=77%, HitCoverage=98%, E-value=3e-80, Identity=70%"; Hit description =Chromosome chr18 scaffold_96, whole genome shotgun sequence
  Pfam annotation: Domain name=SPRY; Domain location=92-213; Score =109.1; E_value=1.3e-29; Accession=PF00622.19; Description=SPRY domain
MSESNGNSRRRNVEDQDLGLYFLEACREMKEKEEEEEEEEEEEAPRELNTINSSGGFVVVSTDKLSVKYTSVNLHGHDVGVIQANKPAPTKRLMYYFEIHVKDAGVKGQIAIGFTCETFKMRRQPGWEANSCGYHGDDGLLYRGHCKGEAFGPTYTSGDVVGAGINYAAQEFFFTKNGQVVGSVYKDMKGPLFPTIAVHSQNEEVHVNFGQKPFTFDLKVYSIVGISVIRIASLNCDAILHLSRTYLFLVHFGAGFVHWRQCERVEAEE

SEQ ID NO: 168424 - protein, 115 aa, Glycine max
  Coding DNA Sequence Number=SeqID_76739
MMLLSPNKARPENGFKVCQYLFDELALGQDRPKPIKVARAKSNKEIKKFQLKSIKEQLQRVRTLQPLAVSGVRHAPCQCPTPTRHPYYVLYFGHYRCPHVRVRVVFGVHVGVDAS

SEQ ID NO: 168425 - protein, 179 aa, Glycine max
  Coding DNA Sequence Number=SeqID_76740
  Homolog annotation: Hit_ID=A5BEV8; Match level="QueryCoverage=77%, HitCoverage=18%, E-value=5e-11, Identity=34%"; Hit description =Putative uncharacterized protein
  Pfam annotation: Domain name=FAR1; Domain location=95-156; Score= -22.3; E_value=0.015; Accession=PF03101.6; Description=FAR1 family
MKVKVRCGGRRRQTRYAEGGGCVANMDEDEWMYEIMSEQADMDYENEEACGANDPHVDCSDAFNTSQARFVAHENRFVAVILRSDTNTGSRGRTTFVLIGYERSSEYRCRKKEFIRRDTGTRKCGCPFKLRCKLVVGGEGWMVKLICGVHNHELAKSLVRHPFAGRLTKAEKTLIADMT

SEQ ID NO: 168426 - protein, 116 aa, Glycine max
  Coding DNA Sequence Number=SeqID_76741
MPRLLNTNELHDCRTQTPSTEEEDDAHGGNATRRTSTVGQAFLKPATTSCKQNERKKNAAEVRSGVRKETKTTPRQQRRRENARGTKVFLHQLLGAPAKMLGAPSSTRKFWIMFFG

SEQ ID NO: 168427 - protein, 134 aa, Glycine max
  Coding DNA Sequence Number=SeqID_76742
  Homolog annotation: Hit_ID=Q00M75; Match level="QueryCoverage=24%, HitCoverage=5%, E-value=5e-09, Identity=93%"; Hit description=PPR -repeat containing protein
MGASPGAAVKLLCLGDLLVMGSNPETASLHMQGIYVWLGSFDFQLAYGCAIIFMHSTFWCSKLVLLKKVESKLREATMRLEEQLAEEQAARLKAEENAMLAQMRSDDEIRKLREHLEKAHEELRKRGGGGCAIL

SEQ ID NO: 168428 - protein, 319 aa, Glycine max
  Coding DNA Sequence Number=SeqID_76743
  Gene Ontology: Mol. function=nucleoside-triphosphatase activity; Biological process=proteolysis
  Homolog annotation: Hit_ID=Q1ENY8; Match level="QueryCoverage=28%, HitCoverage=23%, E-value=4e-32, Identity=67%"; Hit description =Putative uncharacterized protein
MGEVQTDGTWRDRLNKWREILSKERFSEQVDSLNAKYVVEFDMKEVENSLRKDVAEKVTPTQGTRALWIAKRWWRYRPKLPYTYFLDKLDSSEMGGYKDGEWEWNLSWRRPLFDNEIPIAVNFLKDVERSATQTNRRDEWVWKADPSGRYTAQTAYNVMRGVAVDGIQDRAFEELWKLKIPIKFARYWIGVAHFAEEAEEEARHLFFHCNKVIPIWWESLSWVNKSGAFPKDPRQHFLHHGDILGDGSRATRWKCWWVVVTWTIWQQRNKMIFSNETFDSNKLIDEAAFLLWTWLRHLEKDFSLHFNQWSSNFREGIVY

SEQ ID NO: 168429 - protein, 159 aa, Glycine max
  Coding DNA Sequence Number=SeqID_76744
  Homolog annotation: Hit_ID=A5AD69; Match level="QueryCoverage=62%, HitCoverage=8%, E-value=6e-16, Identity=40%"; Hit description =Putative uncharacterized protein
  Subcellular localization annotation: CTP_CleavageSite=65; ConfidenceScore=5.65e-01
MASASFPPPPPSSSPAMTPSPASFSHSIPTKLTNSSYILWCNQVQPVIKGHGLSYFLVAPIIPSRFDTVADCNAGIVLKEYLNWEKQDQFLLSWLQSTISNVVLPHLVGCNTSWHLWEKLHAHFYLPPGLPLVANGSSGSMKTLIVQLTNIKSGPKSMV

SEQ ID NO: 168430 - protein, 773 aa, Glycine max
  Coding DNA Sequence Number=SeqID_76745
  Homolog annotation: Hit_ID=A2Q4W6; Match level="QueryCoverage=17%, HitCoverage=16%, E-value=7e-09, Identity=29%"; Hit description=RNA -binding region RNP-1
  Pfam annotation: Domain name=RRM_1; Domain location=150-220; Score =31.6; E_value=2.8e-06; Accession=PF00076.13; Description=RNA recognition motif. (a.k.a. RRM, RB
MGRESPGLMYMAGLKVWALKNGLYEVLGALDTGTKSCKVWPILANYRPKIEGRDHYRIMIGYDISYPTCILLLSIDVDTFRSSCYNLICNSSNWGQRNGFDGVRARWEGRDSVRRRETRDPRRNIVGEGNGKQQSYVRTNWRDYHNISSFYFTRFPEEATKVELWQHFKNVGDVREVFISRKRNRSGRRYGFARFKGVDDVKQLERRLDNIVLGGLKLYVNIPKYERDTHEGRQPETRAQAATRQQKSRSEVHLEIPLSGKKWLQDAWVGRLQNLTMYDRIEEDMLWDFGLDIVPKYIGEDMVLLLGLIEEKARRLMEVDEEGRDALFYSLERWNPTVRVRNRLTWVQAWGIPLMAWDAQHMKTIVAGIGDAVDVDDDVEELRKMDRARILIKTPWPALIQHTVTVHIQGEEFMVHIIEETGAYSNTCRCRRGIEYSSSEDILSEESELGASCMMGVSEEMAVQIGSSEEEMVRAIAIHKAPMEKTRARGDLLEMALAAQKGSPETKAVRSRELEMVTEEEAEIGSDEAELERLLSSECAKHHDQVDNTYDTERSTCILTTGGVNQTAETARGNAGGVVTVLPDLGEEIENGSTTAPLAVDIHKNGRVHAEETVEVLEPFLKQSEVARVKEGAEICGLGFTPHTPINPKVQLQQSFLKIQAEKTPIINVYSKKRWRKKQTEPKSPDRYLLKHVDQQGSPPNQDKKRGDNLYAKQQQKEDVYNTSVELKQHNNIDKEAERLWQLAQEMGIAYPKEQTSQVQRLVHMEERDIMET

SEQ ID NO: 168431 - protein, 73 aa, Glycine max
  Coding DNA Sequence Number=SeqID_76746
MEVQKLKHQLPSRVLALYNATIWGFIPHPKRQIFSNLKRFDMWKNQGMSRLSCLKSKDLELGSLVYCIKPRGS

SEQ ID NO: 168432 - protein, 81 aa, Glycine max
  Coding DNA Sequence Number=SeqID_76747
MVKCVLEDGVKLGWDWKERWAKVVIVVGGGALELEGVDGRGRFLVISCYFLHWSEILYKFLMSDVALQGPQKVLWEPQKDD

SEQ ID NO: 168433 - protein, 302 aa, Glycine max
  Coding DNA Sequence Number=SeqID_76748
  Gene Ontology: Mol. function=aspartic-type endopeptidase activity; Cellular component=anchored to membrane; Biological process =proteolysis
  Homolog annotation: Hit_ID=A7Q9Q7; Match level="QueryCoverage=79%, HitCoverage=49%, E-value=5e-96, Identity=72%"; Hit description =Chromosome chr5 scaffold_67, whole genome shotgun sequence
  Pfam annotation: Domain name=Asp; Domain location=17-276; Score= -180.4; E_value=0.0062; Accession=PF00026.14; Description=Eukaryotic aspartyl protease
MDLTLYDIKESSSGKLVPCDQEFCKEINGGLLTGCTANISCPYLEIYGDGSSTAGYFVKDIVLYDQVSGDLKTDSANGSIVFGCGARQSGDLSSSNEEALDGILGFGKANSSMISQLASSGKVKKMFAHCLNGVNGGGIFAIGHVVQPKVNMTPLLPDQPHYSVNMTAVQVGHTFLSLSTDTSAQGDRKGTIIDSGTTLAYLPEGIYEPLVYKMISQHPDLKVQTLHDEYTCFQYSESVLLLVGTSASVLLAYFGIQALEEFFVVQLVLEGRVGPKVCGFDNGGSGLTMLLTVLPYCNGIVF

SEQ ID NO: 168434 - protein, 437 aa, Glycine max
  Coding DNA Sequence Number=SeqID_76749
  Gene Ontology: Mol. function=protein-tyrosine kinase activity; Biological process=protein amino acid phosphorylation
  Homolog annotation: Hit_ID=A7QMH3; Match level="QueryCoverage=98%, HitCoverage=38%, E-value=1e-109, Identity=52%"; Hit description =Chromosome chr19 scaffold_126, whole genome shotgun sequence
  Pfam annotation: Domain name=PB1; Domain location=177-264; Score =97.4; E_value=4.3e-26; Accession=PF00564.15; Description=PB1 domain
MEPRNEEFQSGSQSVIQDHMDGMHTIRRPPDYSMSDFKPVLNYSIQTGEEFALEFMRDRVNLRKPVFSNVSDSHSNYATGCMELKGVLGISQAPSESGSDISMLSKAEKGSTEFNRQSTSLHGDRSNYGSIRSIPRTSLNQENSRFVRGYGSSVGSDSSSTMMKCLCSFGGRILPRPSDGKLRYVGGQTRIIRLRKDISWQELMQKALPIYNLVHVLKYQLPGEDLDALVSVSSEEDLQNMMEECNLLEDRERSQKLRLFLFSLSDLEDAQFALGSIGGDSQVQYVLAVNAMDFGSINSSTPLGVSFSADDLHELERQTAERETCRVTVESIGVSNAPLSNKSDSSLTIHSSQPVLPNASNAYEINRLSYGDQMTQVWDYSRQYFVHHGLTSSHNPVVGETPVPMAPHLLNNQQGVLNEDNLPSGLQVQNSQLSTMQ

SEQ ID NO: 168435 - protein, 224 aa, Glycine max
  Coding DNA Sequence Number=SeqID_76750
  Gene Ontology: Mol. function=nucleic acid binding; Biological process= proteolysis
  Homolog annotation: Hit_ID=A2WQR9; Match level="QueryCoverage=44%, HitCoverage=45%, E-value=5e-13, Identity=39%"; Hit description =Putative uncharacterized protein
  Pfam annotation: Domain name=FAR1; Domain location=98-167; Score =34.3; E_value=1.9e-08; Accession=PF03101.6; Description=FAR1 family
MDKSLKVGKEEWKEKERGSTKFCASKEAHENPRAFSCISGPIYLESSIQCPCRGYTVLKFQAFGVVTKKFDSDSENEVVTNVGNENNDDKADEVAYDKKHNRVMHKFLCNKEGFRDKKHFIRNNRKKDHRPLTCTNCEARLHARLDKDTGLWVVKTFLDGHNHRLCPYDYVPLILTYCGLSYGDKAEVDALHRQVERGDVLAAINHSQVDNDAMFFARYMLTED

SEQ ID NO: 168436 - protein, 268 aa, Glycine max
  Coding DNA Sequence Number=SeqID_76751
  Pfam annotation: Domain name=SWIM; Domain location=70-105; Score =15.4; E_value=0.01; Accession=PF04434.8; Description=SWIM zinc finger
MLLLSTYNDIWNKDGVGPVVDTDFNIFYTKPYINTSLPTIKREAANLYTQNVYDLVKKKILNVGGVNVINRCQVGDKVTFKCDCMMFESSGIPCSHIMCAMHLDHIHAFPSSLICSKDANNFKFVRDGLLKLTERLQKRLDLGGDPVRHPSDDLSCGEDFNFNDPSVNNTEGANVSFSQDAAPVGCTETPVAMSKNANANKVMDEVGVLSERLNMNNPLTLEHKSDVNMGGEICGSSNPIQTTQTSDNKGASIYGSTNLVQQRSGFWL

SEQ ID NO: 168437 - protein, 168 aa, Glycine max
  Coding DNA Sequence Number=SeqID_76752
  Gene Ontology: Mol. function=kinase activity
  Homolog annotation: Hit_ID=A5BW13; Match level="QueryCoverage=45%, HitCoverage=28%, E-value=3e-22, Identity=69%"; Hit description =Putative uncharacterized protein
MDVEIFKKTLKLTSTSSRRGCNIESLTFGLNEDKAIPSSPRRSFSVWWSERSCWSTCWSTVTTRWGATLKVFGKSVVFVATESEMVLVERLVDRKAEIMESLLVRIGTAREEMKHVKNFDYVVVNAKGKLDNAVKLMESIIDARKLGSHGFIDDDTNKALDGYGARRD

SEQ ID NO: 168438 - protein, 126 aa, Glycine max
  Coding DNA Sequence Number=SeqID_76753
MQWWFQSQKRCKDKLELTRNKHRTMVTSKENERVPLGVGFQRRTTAICGGYWWLWVMEKKLGTLKMTKFREDPTVNEGYEAFLPRQLHVASLRSFIKRLPRGFFEKLFSRGFFEKLDFIYPHPSIN

SEQ ID NO: 168439 - protein, 126 aa, Glycine max
  Coding DNA Sequence Number=SeqID_76754
MAENTRSATTIKEVEDRVVARLETRLIKLAGNIQKVLEDSLKDSLQELVKDTQEHNTPSLSSGLIPRGDHSLNLQYNCGTRLARIDFPIFNGKKLLKEASREKLLKEATRKPLNEASQGSYMKLSR

SEQ ID NO: 168440 - protein, 416 aa, Glycine max
  Coding DNA Sequence Number=SeqID_76755
  Gene Ontology: Mol. function=GTP binding; Cellular component =intracellular; Biological process=regulation of transcription, DNA -dependent
  Homolog annotation: Hit_ID=A7PWT8; Match level="QueryCoverage=76%, HitCoverage=86%, E-value=1e-148, Identity=86%"; Hit description =Chromosome chr19 scaffold_35, whole genome shotgun sequence
  Pfam annotation: Domain name=DUF933; Domain location=359-414; Score =67.1; E_value=5.8e-17; Accession=PF06071.4; Description=Protein of unknown function (DUF933)
  Pfam annotation: Domain name=MMR_HSR1; Domain location=92-220; Score =34.0; E_value=5.3e-07; Accession=PF01926.14; Description=GTPase of unknown function
  Pfam module annotation: Pfam domain module=DUF933::MMR_HSR1; Domain location=359-414::92-220
MGREDTKIIVISFCGSINIWELESIDSKQECLIKVDEEWSMSKISKLSSIFGDSYFTTAKTKVLSIPLGEVDYMDHMMPFGSIKDWRVEIHTFFVKVENGKAQAANFPFCTIEPNVGIVAVPDSRLHVLSDLSKSQRAVPASIEFVDIAGLVKGASQGEGLGNKFLSHIREVDSILQVVRCFEDNDIVHVNGKVDPKSDIDVINLELVFSDLDQIEKRIDKLKKGKAKDSQKLKEEAEKSALEKIREALMDGKPARSVTLTDFERDAVKHLCLLTMKPVIYVANVAESDLADPANNNYVKDVTNVVSELQSRIVTISAQVEAELTELPVEERQEYLQSLGVSESGLGNLIRATYDLLGLRTYFTSGEKETKAWTILAGMTAPQAAGVIHSDFEKGFIRAETVSTKDIILNYYMHIK

SEQ ID NO: 168441 - protein, 174 aa, Glycine max
  Coding DNA Sequence Number=SeqID_76756
  Homolog annotation: Hit_ID=A7UQU7; Match level="QueryCoverage=64%, HitCoverage=18%, E-value=3e-11, Identity=36%"; Hit description=IMP dehydrogenase/GMP reductase, putative
MLLSAPADNLVVTSRCCRAYIYLGCDTENKRGYISCASVQVERTSTWLFKENKGGYIPCGSLLCWIYKHFSSVAESTADLDYDEDSSRACRWIATKKTVKSRRTPAYRECLDRLRISDVYWIPYREHRPVWDFHMISCYSGLLRWGPVAVYYQPEMVMQQFRHTQNILVSPVDS

SEQ ID NO: 168442 - protein, 110 aa, Glycine max
  Coding DNA Sequence Number=SeqID_76757
  Subcellular localization annotation: CTP_CleavageSite=40; ConfidenceScore=5.86e-01
MGLSKVKGGISRGRGSGSSSPFASPSFTPCSSPPFTPWVVAAGCSGSRAAGSEAGCRGRGWFRGRAVLKLRGLQQRSERKPLRNSAMAPPWPPFNNTACNMNLMKIAGLQ

SEQ ID NO: 168443 - protein, 29 aa, Glycine max
  Coding DNA Sequence Number=SeqID_76758
MGAEEVEGQGKGEKPGRIRGTKLELTGDA

SEQ ID NO: 168444 - protein, 255 aa, Glycine max
  Coding DNA Sequence Number=SeqID_76759
MVIDEFVFFSLTHLPSQGAPFEGTIVNDWKFDYSSHDACHMVCIDQADMTGRLLVGSLTFDCRIMHYITIRILLPRSSNLAQAFEEDLILMWAFLTGRPIDCAHLIRYRMHKALRSNAPLPYPQLVTLFLHHFQIPLDNEPFVQVKRSFAIGVGVVTSFGYRKDMDGQWLKKDRQPPQDEHTPSPPPQRDDSSTLMHEVLSELRGLCSYVGERFDSLDGRINAIDARFAGMDTHIIQLEDDMSFIRRCFNPPADS

SEQ ID NO: 168445 - protein, 74 aa, Glycine max
  Coding DNA Sequence Number=SeqID_76760
MGPAVCEGYGPIFLNGPLLCHIFGPAPLNPRTMRVWPERSTGCPQPALGKKDEDMKMEKAQATSNMESFVVGDV

SEQ ID NO: 168446 - protein, 93 aa, Glycine max
  Coding DNA Sequence Number=SeqID_76761
MSVIVRVTETPELPHHALYNHKLKKKEKGDELVCDSSNINRGKDELVCGSYNFSDNASFNGGSPVGRKEKGETKREKGKEGFSAWGPKLVFNL

SEQ ID NO: 168447 - protein, 279 aa, Glycine max
  Coding DNA Sequence Number=SeqID_76762
MQNSLSANLRAKPNFLSGISNFCSGLNEFARLAHEYENSNINFARLAKVCVEGLQNPNLSRVFDELAKRDCALSEVISFACFFGFPDELAKHGPDLLSEFIFSDEGLNPGLSEFISLSPRNLCLFLNGCLSAKPALLAKRTIFSVFVIFGTGLSEPCSLSHLFFQRLCRAKRTLCAKRNLFSVFELGLTSLLAKPIMQFCKLRPDPQELAARLCIPGRGFVLNAEGLPWKLLRKDLTTLTETWSVLSYFNLAPTSHTSDLNLDRARLVYGRTRDEDGYE

SEQ ID NO: 168448 - protein, 182 aa, Glycine max
  Coding DNA Sequence Number=SeqID_76763
  Homolog annotation: Hit_ID=A5ALZ8; Match level="QueryCoverage=66%, HitCoverage=20%, E-value=4e-09, Identity=30%"; Hit description =Putative uncharacterized protein
MASAMSNLISQLFPNSIAEKLDDSNYLHWRQHVEPVIKSHKLQRFVVSPIVPPRYLIEDDRITDCVNPEYGIWFGSKSMNISVSTLNHVRINSTTDEYLRKMKGYVDELTGVGVPVWHEEYIDALLEGLPSDYALVIFVNESLFGRGGGRDTFFDRNRDVVAVVPAKAVEVAGLPIFSAKSV

SEQ ID NO: 168449 - protein, 120 aa, Glycine max
  Coding DNA Sequence Number=SeqID_76764
  Homolog annotation: Hit_ID=A5AT31; Match level="QueryCoverage=60%, HitCoverage=8%, E-value=1e-07, Identity=35%"; Hit description =Putative uncharacterized protein
MWIKIQHLPIELYNNIFLDRIGMSLKKFLKVNRLTSIHSRGKFVRICMEQDLKKPLETHIYVCGFKLNLEYEGKKGPNKNIESSMITNNRIGEHGKNYPKYMMRKSGGQSKHLDHVAQKD

SEQ ID NO: 168450 - protein, 58 aa, Glycine max
  Coding DNA Sequence Number=SeqID_76765
MQKQRRRRNEILSIVIEAHRYQEAAPMKEAIASSKSPGMMDSTLGSSRISEILSKVIL

SEQ ID NO: 168451 - protein, 99 aa, Glycine max
  Coding DNA Sequence Number=SeqID_76766
MPMLDQFQPFIHNFIDNIVDVKADGMGEDSWSLVRNHLLKELVKFSNDYIKLFDGTDKFEELRRSRLVDGLSKVYLKDRCPLPPLALLWSRSCHPEAKQ

SEQ ID NO: 168452 - protein, 204 aa, Glycine max
  Coding DNA Sequence Number=SeqID_76767
  Gene Ontology: Mol. function=oxidoreductase activity; Cellular component=cytosol; Biological process=metabolic process
  Homolog annotation: Hit_ID=A5BKL3; Match level="QueryCoverage=69%, HitCoverage=45%, E-value=5e-39, Identity=49%"; Hit description =Putative uncharacterized protein
MGYYVVGSAGSKDKVEILKNKFGFDGAFNYKEEQDLDATLKRMLKILNVVGLNGARYFPEGTDVRSSDLDEPQGIKNLVNIIYKQIKVEAFTVYDYYHLYPKFLDTVLPYIREGKITYVEDITEGLENGPIALEAMFQGRSADLMGTRTPSMVLDGVEVEGDGIADIEGLDDTVEELQEYLTKKFNLCMVFPLYSLDLEPSKGK

SEQ ID NO: 168453 - protein, 39 aa, Glycine max
  Coding DNA Sequence Number=SeqID_76768
MVLQHRVFSHKLFACVLLWVFQICHGYFYGEWWKKDVEV

SEQ ID NO: 168454 - protein, 75 aa, Glycine max
  Coding DNA Sequence Number=SeqID_76769
MCFGFIHGAAKVIGVKGHDYVNGGGGKGATVLAGGGLSEEMKLWGWTTDNNNLMYHLPEVTRTMMAKKATKTWIR

SEQ ID NO: 168455 - protein, 309 aa, Glycine max
  Coding DNA Sequence Number=SeqID_76770
  Homolog annotation: Hit_ID=A7QFL9; Match level="QueryCoverage=54%, HitCoverage=32%, E-value=3e-14, Identity=33%"; Hit description =Chromosome chr8 scaffold_88, whole genome shotgun sequence
MVTGKHNGGVTNKAALEATRITVSFFVNELRGNGNGNGKENNDNVNIPLSVVDTNGVVYELQVLVKTGSDSRSCIAKAGAILLLDRFLNAEENLSLQANIVMTTTMKVFSLSGCGVGKEWARGARRDALAAMLNLVADKETVARLVERGVVGISAMSEEGLTILEAVVKREARGGAEGGMGESEGERGGDASDSVEDSTAARLNGGEKERFTTTTTMVSSSTILKSILYSRYHVVIMFRNTRFGIRLLIKPLNEEEVSTMQEMLLRANVRDYGRFDPPPGHVQPPSKGIPAAAPDPNHPPPPPGNGGCK

SEQ ID NO: 168456 - protein, 596 aa, Glycine max
  Coding DNA Sequence Number=SeqID_76771
  Gene Ontology: Mol. function=cyclin-dependent protein kinase regulator activity; Cellular component=nucleus; Biological process =cell division
  Homolog annotation: Hit_ID=Q9ZRG1; Match level="QueryCoverage=32%, HitCoverage=74%, E-value=2e-92, Identity=87%"; Hit description=Cyclin
  Pfam annotation: Domain name=Cyclin_C; Domain location=276-397; Score= 172.3; E_value=1.2e-48; Accession=PF02984.10; Description=Cyclin, C -terminal domain
  Pfam annotation: Domain name=Cyclin_N; Domain location=156-274; Score= 100.7; E_value=4.7e-27; Accession=PF00134.14; Description=Cyclin, N -terminal domain
  Pfam module annotation: Pfam domain module=Cyclin_C::Cyclin_N; Domain location=276-397::156-274
MAMAAAIRNPQRHRYLVAFFPKICDARPPWRRHNRYLITLLPIVKTTIKAVTAQRTLKSKSRLSQNKLESTTATSSQNKSLSAQKNLESTTVTSSQDKESVSLSLPEKSLTVSDDTNQSCLPSGESNLTTNLLELIPRKKSFRRKSYTTSLIEGSKILKESGDVREQDNLPNIDNECNQLEVSEYIDDIYLYYWVTETLYLTVTLLDQYLSLVTIKKTDMQLVGLTALLLASKYEDFWHPRVKDLISISAESYTRDQMLGMEKLILRKLKFRLNAPTPYVFMVRFLKAAQSDKKLEHMAFFLVDLCLVEYEALAFKPSLLCASALYVARCTLQITPPWTPLLHKHARYEVSQIRDCADMILKFHKAAGVGKLKVIYEKYSRQELSRVAAVKPLDKLPWTPTTSQTSTDCADMILKFHKAAGVTYEKYSRLELSKGVAAVKPLDRLTLGFFFPGCMYNLGSRWDAVGCTTLVQLVMMDGPKRNSEARAKIMAFLLSNLKPSLLPQTKSKPIPQTPSPSSAKPTSQSPSLFFFTSSAPLSALQSSTAQVAQGHTPTTGARDELQQQKDEFYLNLGLAVRTLREDMPFIFVKDLNYDIY

SEQ ID NO: 168457 - protein, 262 aa, Glycine max
  Coding DNA Sequence Number=SeqID_76772
  Gene Ontology: Mol. function=protein binding; Cellular component =membrane; Biological process=cell division
  Homolog annotation: Hit_ID=A7QMK1; Match level="QueryCoverage=95%, HitCoverage=65%, E-value=7e-91, Identity=65%"; Hit description =Chromosome chr19 scaffold_126, whole genome shotgun sequence
  Pfam annotation: Domain name=CDC50; Domain location=64-262; Score =63.4; E_value=7.8e-16; Accession=PF03381.6; Description=LEM3 (ligand- effect modulator 3) family  CDC50 family
  Subcellular localization annotation: CTP_CleavageSite=48; ConfidenceScore=5.28e-01
MSTSDAGGAGSNDSNATRRQSKRPKYSKFTQQELPACKPILTPRAVISAFLIVTIVFIPIGVASLIASHDVVEIIDRYDSHCIPSNVTDKVAYIQTPGEKPCNRQLTVEKRMKSPIYVYYQLDNFYQNHRRCLSLQCLRLTGSFNNSVFEVWYVKSRNDDQLRDSGKASSVSGCEPENNVNGMAILPCGLIAWSLFNDTYSFSRNSNNLTVNKTGISWKSDRDHKFGSDVFPKNFQNGPIIGGGGLDENVPLLFDYFRNPND

SEQ ID NO: 168458 - protein, 149 aa, Glycine max
  Coding DNA Sequence Number=SeqID_76773
  Gene Ontology: Mol. function=RNA binding
  Homolog annotation: Hit_ID=A2X1G1; Match level="QueryCoverage=42%, HitCoverage=13%, E-value=7e-28, Identity=90%"; Hit description =Putative uncharacterized protein
MKQLPTLLMKSLSLSVCSLPAAASTTTLQQIALHQPKGVAKVVLKKGKTQLFKDGNPMVYSGAVDRIIGRPPPKTGDVVLVADGTEKPIGWGMYNSVSMFCVRLMQLEDEATSLSPLNKQCRTNQECASWLGTPLINKPRVLLLGKVFP

SEQ ID NO: 168459 - protein, 85 aa, Glycine max
  Coding DNA Sequence Number=SeqID_76774
MVNTRSGLRCETPLENSHPHPAAMTDTDTLQQLQNRIAEMEQHHEKELTKLKANHDKLEARVRRPQGNEQSAHTFPERTQGESYP

SEQ ID NO: 168460 - protein, 332 aa, Glycine max
  Coding DNA Sequence Number=SeqID_76775
MSLAHGWHVLETQWSAHAYMSLVVGGMYWRHSATRRAHQGQTLDFKSLIGMTMDTLVLIREIPLSQNPDFSIFGTIDLSREKSTTLGLECRLAEVELQSVRSIVKVGYDPEGTFPVGAKLSRSGIFSGFTSDSPYEGPEDDSITYLCMSVSLRMFDRDDYVLDTSPCPEVFISISFELSAIICDNDVWEVVPVDESMTTCKYLTTPWAFGNGPNMSIPHMAKGQGELKLLRLSGGLAGTFANSWHRLHLLGASSSMETTDPFMKLSHDIVCLLVSGFILVWWQYLPDQEVLVGGHLVWFLLFSSHIFLNIYGGSLERLLDDGLEVPNLLDAG

SEQ ID NO: 168461 - protein, 66 aa, Glycine max
  Coding DNA Sequence Number=SeqID_76776
MEGGDDASNDDNSQGNKDMVVNNDNNDDHDDKEVIVTAVDDSDDDDDNYGGSNNNNNDSDDLCEIV

SEQ ID NO: 168462 - protein, 115 aa, Glycine max
  Coding DNA Sequence Number=SeqID_76777
MDVKTIFLHDDLKEKIYMEHLEGFSKCGPGRMVFKLKKSLRYEYCNIPDFQLLSDCHTTTLHTVALHSKSLLVKTLHKTLQRVLSLLTRFLGNFPKGHPSHYYSKPSTLNFGVLM

SEQ ID NO: 168463 - protein, 83 aa, Glycine max
  Coding DNA Sequence Number=SeqID_76778
MDEDDDNDVGNDLVFEDDDALNWATVYEASGGKKQPTSAGITPTAAAAHTSKKQAMVVGSSSRKQKAVQENDEDLVFEDIELI

SEQ ID NO: 168464 - protein, 126 aa, Glycine max
  Coding DNA Sequence Number=SeqID_76779
MSDDNTKAWNQILLLTIVLAIWWLLCHLAEDRETNPIDNEVDDELGEILEHPNGELDHYFDEDGHHRAAEPGGDANGRHGGCSICGNFSTTRCASCKAARYWGSLLYVGAAIDTDGKLEPPVTMAG

SEQ ID NO: 168465 - protein, 162 aa, Glycine max
  Coding DNA Sequence Number=SeqID_76780
  Gene Ontology: Mol. function=protein serine/threonine kinase activity; Cellular component=integral to membrane; Biological process=protein amino acid phosphorylation
  Homolog annotation: Hit_ID=A7P7C4; Match level="QueryCoverage=59%, HitCoverage=12%, E-value=4e-19, Identity=51%"; Hit description =Chromosome chr9 scaffold_7, whole genome shotgun sequence
  Pfam annotation: Domain name=B_lectin; Domain location=20-130; Score =26.0; E_value=1e-05; Accession=PF01453.15; Description=D-mannose binding lectin
MVDYLYPRYCYISQFESWENIEFHKNQLVNNDFVVLLLDHYGVLKIESNGSEHVILYSSPQPANNNTMATLWDTSNFVLQQLHPNGTKSMLWQSFDYPGDDLLPRMKLGVNFKTVRNWSIVSWMGSLNPSLGTFRMELGTQKKRIGHQATKTIVLDKWRAKK

SEQ ID NO: 168466 - protein, 515 aa, Glycine max
  Coding DNA Sequence Number=SeqID_76781
  Gene Ontology: Mol. function=binding; Cellular component=nucleus; Biological process=mRNA modification
  Homolog annotation: Hit_ID=A7QQL3; Match level="QueryCoverage=88%, HitCoverage=89%, E-value=1e-135, Identity=48%"; Hit description =Chromosome undetermined scaffold_143, whole genome shotgun sequence
  Pfam annotation: Domain name=PPR; Domain location=133-167; Score=7.9; E_value=0.89; Accession=PF01535.11; Description=PPR repeat
  Pfam annotation: Domain name=PPR; Domain location=199-233; Score =42.4; E_value=1.6e-09; Accession=PF01535.11; Description=PPR repeat
  Pfam annotation: Domain name=PPR; Domain location=249-283; Score =13.8; E_value=0.18; Accession=PF01535.11; Description=PPR repeat
  Pfam annotation: Domain name=PPR; Domain location=359-393; Score =12.1; E_value=0.28; Accession=PF01535.11; Description=PPR repeat
  Pfam annotation: Domain name=PPR; Domain location=439-473; Score=0.9; E_value=6.1; Accession=PF01535.11; Description=PPR repeat
  Pfam annotation: Domain name=PPR; Domain location=98-132; Score=27.5; E_value=4.8e-05; Accession=PF01535.11; Description=PPR repeat
  Pfam module annotation: Pfam domain module=PPR::PPR::PPR::PPR::PPR::PP R; Domain location=133-167::199-233::249-283::359-393::439-473::98-132
MNGRTLLRTVIPKPQQHHHHCRGFSTYDIGTCISTLQSCAHNANLSKGKELHTHLLKNAFFKSPIAITNLINMYSKCSLINHSLRVFNFPTHHNKNIFAYNALIAGFLANAFPQRALALYNQMRHLGIALDKFTFPCVIRACGDDDDGVMVMKIHGLLFKLGLELDVFVGSALVNTYLKFGLVREAYRVFEELPVRDVVLWNAMVNGFVQIGRFEEALRVFRRMEGNRVVPCRYTVTGCVRDDGRDIYFSWNSIMSVHERCSDHYGTLRLFDRMMRSNRVQPDLVIVTTILPACTHLAALMHGREIHGYMVVNGLAKEESHDVFDDVLLNNALMDMYAKCGNIRDARMVFVNMREKDVASWNIMITGYRMHGYGGEALDFFLVCVRLKWYLMKSVLLDCYLHAAMLAWSLLVACRLHNDIDLAEVAASKVIELEPYHCENYVLMPNVYGVVGRYEEVLEWRYTMKQQNVKKRPGCSWIELQFCKSMATSPLSSIWSAKKVRHEFMTTYVVGMDMC

SEQ ID NO: 168467 - protein, 248 aa, Glycine max
  Coding DNA Sequence Number=SeqID_76782
  Homolog annotation: Hit_ID=Q5XM22; Match level="QueryCoverage=38%, HitCoverage=76%, E-value=2e-18, Identity=41%"; Hit description =Resistance-like protein HAAS-2
VAPGDEYFPSSSGEGIHHVGRHHVSSSSADRWRLPRLPASAHQRGGVDVDVYRHRCQTQHWTAAARAYLLHLLGYTLFANKSVTHVHVVHLDALRDLTQARRYAWGTTGLVHMYDHLNDASISTSRQHFPSVAECNADPDYDETSDPPRDESGTQPRHIPQEPAPASTHANTDANEPRHAVSFTSKDPQGMYPPLFSLNNLVDVPSTRTDPQEMYPFLFSVTTTQVDVPSTCTTKDVPSNVLRQSSQA

SEQ ID NO: 168468 - protein, 204 aa, Glycine max
  Coding DNA Sequence Number=SeqID_76783
  Gene Ontology: Mol. function=metal ion binding; Cellular component =nucleus; Biological process=positive regulation of transcription from RNA polymerase II promoter
  Homolog annotation: Hit_ID=A7QML6; Match level="QueryCoverage=64%, HitCoverage=10%, E-value=1e-64, Identity=90%"; Hit description =Chromosome chr19 scaffold_126, whole genome shotgun sequence
MRLGLGRQVCPTKFGDEVAVEVERDEDEGGMVGETFTDYRPPKVSIGPPHPDPVVETSSLSAVQPPEPTYDPKIKDDLENSKALSCLQIETLVYASQRHLQHLSNGARAGFFIGDGAGVGKGRTIAGLIWENWHHYRRKALWISVGSDLKFDARRDLDDVGATCIEVHGVVVFSNISHRTGILDVYVGGSWPVIPNKINTVRIQ

SEQ ID NO: 168469 - protein, 138 aa, Glycine max
  Coding DNA Sequence Number=SeqID_76784
  Subcellular localization annotation: CTP_CleavageSite=71; ConfidenceScore=5.48e-01
MSLSFCNSSFHETLKANPQLQASLFSALSPASFPLPPPTSTSLPSPRSFTQESAKPHGSPGTPPPPPNSPPSSTVSAATPNLNPSFSTPVPSYSHANVTSFFSTANSSIHTPSETPTPPSTPLLVTSITLFALPPPFT

SEQ ID NO: 168470 - protein, 282 aa, Glycine max
  Coding DNA Sequence Number=SeqID_76785
  Gene Ontology: Mol. function=metal ion binding; Cellular component =nucleus; Biological process=positive regulation of transcription from RNA polymerase II promoter
  Homolog annotation: Hit_ID=A7QML6; Match level="QueryCoverage=80%, HitCoverage=17%, E-value=1e-113, Identity=87%"; Hit description =Chromosome chr19 scaffold_126, whole genome shotgun sequence
  Pfam annotation: Domain name=PHD; Domain location=17-65; Score=26.8; E_value=9.6e-06; Accession=PF00628.20; Description=PHD-finger
  Pfam annotation: Domain name=zf-C3HC4; Domain location=18-62; Score= -0.5; E_value=0.1; Accession=PF00097.16; Description=Zinc finger, C3HC4 type (RING finger)
  Pfam module annotation: Pfam domain module=PHD::zf-C3HC4; Domain location=17-65::18-62
MADSGIESTDSDDEFQICEICTTEEERKKLLQCSCCSKLVHSTCLMPPIGDIVPEEWSCHLCKEKTDEYLQARQAYIAELQKRYDAASERKTKILDIIRALDLPNNPLDDIVDQLGGPDKVAEMTGRRGMLVRASTGKGVTYQARNTKDVTMEMVNMHEKQLFMDGKKFVAIISEAGSAGVSLQADRRAANQKRRVHLTLELPWSADRAIQQFGRTHRSNQASAPEYRFYKLMLNEHIVCNKTISQNDTDSERNHSGVKNSRKAATKWCCGLNKHYKNPISV

SEQ ID NO: 168471 - protein, 160 aa, Glycine max
  Coding DNA Sequence Number=SeqID_76786
VAGCTICGGAHESGCCIPIEEQPTHEVNYMGNQPRNNFNAGGFSGFQHGQQYNQQQGQWRNHPGNQFNRDQGFYVQPEEHRVCHKESGDPSGTTNTEKIPKEECKAVMTRSRRAIHVDESEAEKKMEEHKQQLAPKPALEPVYDFAELEEINKEAENDKE

SEQ ID NO: 168472 - protein, 154 aa, Glycine max
  Coding DNA Sequence Number=SeqID_76787
MTPTHDALLYYNERWNMPRQNEFVDYSFTGKNPKKFDIPFECTFDELKDLIKQVAPHGIPPYGIHESQTKLWLICASPTSRPHIHIVVYYDTPSNPDVVFHDLVCLCACDDYHVPYVRAARYIGQGFTITLSHANRLSKRSNLSAIAWQVSKAK

SEQ ID NO: 168473 - protein, 368 aa, Glycine max
  Coding DNA Sequence Number=SeqID_76788
  Homolog annotation: Hit_ID=A5AH08; Match level="QueryCoverage=85%, HitCoverage=89%, E-value=2e-14, Identity=23%"; Hit description =Putative uncharacterized protein
  Subcellular localization annotation: CTP_CleavageSite=32; ConfidenceScore=5.03e-01
MAEPSKKRKGSSSRSQRHSGSQETPIPPSIPSGSLFSSEEQHICYTNLFSSRSIVDPKFIDMEFFSNENFECFQAFENSNLIPFMSLKLPVYSELVKAFYSNLKIHEGILMSEIYGIKMVIDQSLFYDLTKLPSEGVPFEGALIDDWKFDFFVHDACQLVCTNQVDMTERLLAGSLAFESRILHYLIVRILLPRSSNLTQVSEEYLIVMWTFHKGLQIDWAHLVRYRMHKALRLNAPLPYPHLVTLFLQHFNIPLDSEPYVPIKRSFLIGASVIASFGYIKEHDGSWVKKGARNVGEEGHEGEDSSLLSKIMDRFDGLQTFVGERFDTLELQVDMRFNEMESRITKVEEDVSYIRSSFDLPPPPPPSS

SEQ ID NO: 168474 - protein, 100 aa, Glycine max
  Coding DNA Sequence Number=SeqID_76789
MNLCMGFLQFDVKPRSCAAVTTRCSRSSGCIATKGRAADLKHGHVRSDLAAEVSYSTVEGRQRVVVVVVEGCSAEDGGGWGGENGITLLRKDGDILVKNH

SEQ ID NO: 168475 - protein, 82 aa, Glycine max
  Coding DNA Sequence Number=SeqID_76790
MSSDMAWNLWQCETTDQSSSRIVEGEKGVEDWRWMREGLWLRPTSKWVVGDPVWQIWIVVVFGSWPQPAWLGCVWEKKSEKV

SEQ ID NO: 168476 - protein, 223 aa, Glycine max
  Coding DNA Sequence Number=SeqID_76791
MALGVMAARPSELLLQPEVTLLARRADYFTLSYLGAQASQRLASASQAILQELRRKQKLPRGSKANALRLLSTVEMIIDVAAWKEVVNLDMGGVRKCDEIDDVYNKMQTYREMYLDPTRNLRNFLGVGGLTVEDRIIVYLITYILTPRSYNMLKSHRMVDYEFPYAIFALRFIDYVNVNVSNEIVEFTKAYKPIAGNFEQMDEDPEAEDPQEPAHQWSPLSHL

SEQ ID NO: 168477 - protein, 396 aa, Glycine max
  Coding DNA Sequence Number=SeqID_76792
  Homolog annotation: Hit_ID=A7QUQ8; Match level="QueryCoverage=21%, HitCoverage=21%, E-value=6e-11, Identity=47%"; Hit description =Chromosome chr1 scaffold_180, whole genome shotgun sequence
MVPSQNGKQQQNNINRSGDYVIYGNTTTNSAMNQVEGGYNCLLGADIVVRRHIMAEAEESSRHNNPNEEDEVGGCGSTSKEEEEEEGAHNNNNKNNNWLQLSIGLTSTKQERDNRTAVPTTTGSGLVELDLLPSRRSSEQQPSPAIFPGVASGRGGGSSFGGSSSSRLLFEQHRPTTSYSSSSSSSSSSMSSSMMSMASGPITSSTFGHHEMMNRAFGPLLPHSMPIMPSSSSFTPLPIPSSSSSSQTCYSSLRPHPLGSYFPTVPFHHFPSSTSSSGFDQYDVAAAGAGPSSDNVTVRVVDPPRRPHSGIWFMLLVSPNQAREPFLSQIPKNYLRIKDGRMTVRLLLKYLVSKLRLESESERDEENEHRGLHRSVRKGNGTTFSSKVPKYIKIET

SEQ ID NO: 168478 - protein, 413 aa, Glycine max
  Coding DNA Sequence Number=SeqID_76793
  Homolog annotation: Hit_ID=Q5XM22; Match level="QueryCoverage=24%, HitCoverage=59%, E-value=2e-16, Identity=47%"; Hit description =Resistance-like protein HAAS-2
  Pfam annotation: Domain name=DUF1723; Domain location=119-167; Score =15.2; E_value=0.0085; Accession=PF08330.1; Description=Protein of unknown function (DUF1723)
MVRIRGLGRALGRIIRRALGREVNCDVDDAPQRRRPTASARRQWEVALVAEDVDNMDHADKEGFLGKPHDTLVLQDYVYHVAVKVWSGEVEKFRRPAPEIEGLVAAIGLSPMITCSLDIGDRGLMSAFIERWHKETSSFHLPIGESLHVDDAILLLVELLEWTPAARAYLLHLFGCTLFANKSATHIHVVFLDALMDLTQIGSYTWGATTLVHMYDSLNDASKSMTRQLVGYITLLQSGKASPISIYRRRLDRLTSDVVCWIPYGDYRASREFETIPPHLATTFLCIKDIDDRWIQFSKYTAPIGQICVALGQPPVQQHDTFKEPHVAQHPMATMGMNEAAEDAYAGVERPRHAVEACQAMGKRLERLLNLRKVTKGTKTYNVMEDCLRIARGVTVDHNVYVRSRRRRHTEDA

SEQ ID NO: 168479 - protein, 79 aa, Glycine max
  Coding DNA Sequence Number=SeqID_76794
MSSPLLSLLILMQIPEPSPAPIPDDAIPSAPTPELEQPISQDSPAAQVLDLNEHAQGNHMSRTLKFVHLEHFSLFSVIL

SEQ ID NO: 168480 - protein, 53 aa, Glycine max
  Coding DNA Sequence Number=SeqID_76795
MAANEKRGTGWDLMKEGREGAEKSVQRGKCLTESTVGKRRLGGENWRVVRGDG

SEQ ID NO: 168481 - protein, 112 aa, Glycine max
  Coding DNA Sequence Number=SeqID_76796
  Gene Ontology: Mol. function=N-acetyltransferase activity; Biological process=metabolic process
  Homolog annotation: Hit_ID=Q3HRZ7; Match level="QueryCoverage=62%, HitCoverage=34%, E-value=1e-20, Identity=66%"; Hit description =Putative uncharacterized protein
MDENVELDAWEIEYVSYGGEQHLPLVMNLVDQELSEPYSIFTYRYFVYLWPQLSFLVLPQLFHFQMVCKMGNTVTLSEATLSCWLSSSPTEEEALVVKRYVCAVFCSLSMWK

SEQ ID NO: 168482 - protein, 50 aa, Glycine max
  Coding DNA Sequence Number=SeqID_76797
MFAYSPFTKRKTRAKHIFGHALSGEPLALSAQPLHLRLIWSAKLTKAELS

SEQ ID NO: 168483 - protein, 108 aa, Glycine max
  Coding DNA Sequence Number=SeqID_76798
  Subcellular localization annotation: CTP_CleavageSite=51; ConfidenceScore=5.03e-01
MTGKYECTLSASRLSPSRLSASLALSKNSLTRAKRENGAKHDIKLISWAKRASTAKRSFSALSAIEESGRASISRLRAKREISALSVAGVFNLSQRTIGAKLKSTYSR

SEQ ID NO: 168484 - protein, 112 aa, Glycine max
  Coding DNA Sequence Number=SeqID_76799
  Homolog annotation: Hit_ID=A2Q1D6; Match level="QueryCoverage=73%, HitCoverage=13%, E-value=4e-09, Identity=37%"; Hit description =Ovarian tumour, otubain, related
MDEEQWMYNSMMSEEVDSNVENEKDVGIKLFASRDEVLEWARSLAHDIGFVAIIMRSNIDTGVRERTSFLLICCERSGEYRPKKHNLLKTCTGSRKCGCPFKLRVKTILRGE

SEQ ID NO: 168485 - protein, 207 aa, Glycine max
  Coding DNA Sequence Number=SeqID_76800
  Homolog annotation: Hit_ID=A2Q6G0; Match level="QueryCoverage=85%, HitCoverage=62%, E-value=1e-17, Identity=35%"; Hit description=IMP dehydrogenase/GMP reductase, putative
  Pfam annotation: Domain name=DUF1723; Domain location=107-156; Score =45.2; E_value=2.3e-10; Accession=PF08330.1; Description=Protein of unknown function (DUF1723)
MGRVSEDVAEMSADVPAPGAKGLAGDGAEGLAVDDAEGFPGGPHDPSVLTSFAEHVAHSIWSGDERPELKLVSHGKKVEKFGRPASKIEGLVATTGLTPLIACSVVIGDPEVISAFVERWHRETSSFHLLVGELTITLDDVALLLHLQIIGAFHIFEPLLMDDAIIMLVELLEVSGEEARAETFRCHGAYVRLSWLWDIYQTRCEAR

SEQ ID NO: 168486 - protein, 131 aa, Glycine max
  Coding DNA Sequence Number=SeqID_76801
MEVYLVKKGVQIAIRPTWAFQDVPTEGGAFWWKQPSSPGRAGKEGRTNSFNPPENPSRGASVTLPRCFRGRFREGFPPFFIVLRSFYVVLRSSTVLKELRRSDFLITNEEYVGARETPLSTTKRFKKYKKA

SEQ ID NO: 168487 - protein, 197 aa, Glycine max
  Coding DNA Sequence Number=SeqID_76802
  Subcellular localization annotation: CTP_CleavageSite=41; ConfidenceScore=5.56e-01
PSSPTFLASFFSSSAPSSSPRLPTAISDQPSLLRFCHRDVVGKNGEKADLECLVRPEEPSFGNFPEEPLLPRVPEEVVPEVSPEEGSSRNFLEEIVPETFRKKVLMDDHLVLLKEPSGTTSSGSFSRRSGRVISRDRQDEHDAVDVPQRHRPIASARRQQVHQMTEDVPHMTEDLPHMAEDAPEMTADVQATVAEDL

SEQ ID NO: 168488 - protein, 87 aa, Glycine max
  Coding DNA Sequence Number=SeqID_76803
MVSVLPDLAAHPVVCFSSPPSTYFLDIHNPHEITRSTWTRGLSTPTGLVTNDLRHVTFLVRFKVEGECDAASVGGGGGELGGVVIFR

SEQ ID NO: 168489 - protein, 115 aa, Glycine max
  Coding DNA Sequence Number=SeqID_76804
MTRGNPGDLQPFDPEIDRTFHRLLRHSVHPDHSVHFKHSEYFVAGDSEHSDFEYSTTNFHTENMAQPPPRERTLREMAAPDFTYESLCIQYLDEGVPYVLKTGLIHLLPKFHGLA

SEQ ID NO: 168490 - protein, 68 aa, Glycine max
  Coding DNA Sequence Number=SeqID_76805
MRGLAKNVVATIVEAMPCHSTMALGKNSTMRKKYLLTERQSREDGAHTEKRQSREDKVESKKKRARGK

SEQ ID NO: 168491 - protein, 74 aa, Glycine max
  Coding DNA Sequence Number=SeqID_76806
MSTAFKTFTKSTIPPLRLPLLLPWLEHRVMMVLEATDSPACYFRSAATAMNSIIDGLGVLLRTRGNSNHKNTAE

SEQ ID NO: 168492 - protein, 174 aa, Glycine max
  Coding DNA Sequence Number=SeqID_76807
  Gene Ontology: Mol. function=catalytic activity; Cellular component =cellular_component; Biological process=metabolic process
  Homolog annotation: Hit_ID=Q9MB42; Match level="QueryCoverage=48%, HitCoverage=10%, E-value=2e-16, Identity=53%"; Hit description=Beta -amyrin synthase
MDYIYGTIKWILILIVEYQSMSFVCIDLVLLLMEVRQHLMGAQDMEEKMKLIWTHLLDPTKFLGNIVVEHDYAECTGSSIQALVLFKKLYPRHREIEIKNSIANAVHGMEVREFATFMSLGLHFVVLQRRVKLTLIVLPFAKLLNFYFQHRNMMVGGEKAIFHAQNRFVIEWSW

SEQ ID NO: 168493 - protein, 79 aa, Glycine max
  Coding DNA Sequence Number=SeqID_76808
  Gene Ontology: Mol. function=nucleoside-triphosphatase activity; Cellular component=nucleus; Biological process=regulation of transcription, DNA-dependent
  Homolog annotation: Hit_ID=Q8H1A2; Match level="QueryCoverage=54%, HitCoverage=6%, E-value=2e-14, Identity=90%"; Hit description=Mini -chromosome maintenance protein MCM3
MESVSRANFFPFERFWLPFQSFLIKTRCPYGLFLYPENSAPGQLPRTVDVIAEDDLVDFCKPGDRVEIVGIYKALARKR

SEQ ID NO: 168494 - protein, 293 aa, Glycine max
  Coding DNA Sequence Number=SeqID_76809
  Homolog annotation: Hit_ID=Q49RA6; Match level="QueryCoverage=49%, HitCoverage=11%, E-value=5e-07, Identity=28%"; Hit description =Serine-rich repeat protein 2
MLKGLTKGVTKISKIISPDSLSYPSKLISSNPLQEVSKIISNTVSDVTSDTLSDTSNIILDVSKIISSDPLSSASNMIISSWAISNASKFNSSNPLSGAPKTNPSDTLSDYASKIISNSLPNASKINSSNPLQIASNITDTVSDVTNTITSNTSDIVTNTLSETSNIVSDSLTGASKLINPLNSLRNISYVSKTVASKTSDIVSNALSETADTISDVSNIIISSSNSLSGGTASSSSNPLQIASDNISDTVSGISNTIEDVANIFVPNPLQIASKIVTSKITGNAGNKSKIST

SEQ ID NO: 168495 - protein, 75 aa, Glycine max
  Coding DNA Sequence Number=SeqID_76810
  Gene Ontology: Biological process=intracellular signaling cascade
  Homolog annotation: Hit_ID=Q1KUN5; Match level="QueryCoverage=82%, HitCoverage=12%, E-value=6e-24, Identity=77%"; Hit description =Putative uncharacterized protein
MKYGRPDSEFMKWKWKPNGCDLPVFNPFQFLEIMRGKSMAFVGDSVGRNQMQSMICLLSRTQEILNKFGNLPTSQ

SEQ ID NO: 168496 - protein, 183 aa, Glycine max
  Coding DNA Sequence Number=SeqID_76811
MAKYVTLVQVSREICEAAYRDQKEYDKMLHFLSNELRRIKSKKNKQPCLNENDNQQADNYDSILDLVVVRTKGCKQVGIDESGKEWEESKEFSDCVVLNSLTKEKGDTKEFRRLVLRSFGKGRRETQKEFRRLVLGEFFLAKGEENEKMNSTSFQGLENQKTSESFWYKEEEEVQRDLGLVKD

SEQ ID NO: 168497 - protein, 478 aa, Glycine max
  Coding DNA Sequence Number=SeqID_76812
MTSYTLQKQHGFKTNLGDLHDLLFKFYMVLGIDYEHDQTYMDCDMLESDDRGNGDNEAEKSVGIKGEARKEHFLEVPLPTNMGSLRVEKDKVVVGDISGGATLDDMVAAIKHLGQKMENMDNHNKRRLDAMEKTNTIMLKAMCNLVKQDYNQSAKDVVKDVAMSGTHNTSTYDETLRCRNPNKAISKATVRCRRKKAYGKCKAYFKNIETIFIPGDDDDDFPMPKHNVVKAKFQAIMSNYIRGVEAKPESNKETSMAPRKLSFPHHNSVSQTSKKPKIEKQPHILNVPKFQYTKGTSLGNMSKASRIFQRPQTNSNMPYSFKPIIDMNLTFEETQVYAYVFNPNVDPSGNEILYGVGNNLGTRQNFQSLCPNKPIREELYGSFIPKYPIVAYSKLYHTRSVWCMPPAYALDVIDGTLVETLIKHYGKDWMPSFSNLKLGHVMLNVLQIVFETQDLLFGFDGMDSWDIVEARGIPNHGS

SEQ ID NO: 168498 - protein, 181 aa, Glycine max
  Coding DNA Sequence Number=SeqID_76813
MQLELVLELECGVGKWYPNVARGVDHFIEYLRFMMMSLVKLVEAPVLYYCNTVMPPYGDHRDFLFFVVIIFIRHTKLCTRYEQGPPYAEEDSPHYVLGPPYTGDDLEHTVATPLVPIPNVRDDNIEEDPEMMEEYRSKVAEEPSDLVIRMMGELPQGGVEWLIGESSEEEDPDKDMYDASS

SEQ ID NO: 168499 - protein, 123 aa, Glycine max
  Coding DNA Sequence Number=SeqID_76814
MRARVISKICTSMQNFAVKKMLRHDCLWKGLYILGSGSFLEEGTSWSKEVGELEDANGLGGGGATRGASAGALRDPEKVIKGSSRLRDSKVRESKTTPWALQRVVIRAEKPNLEELDWAIREI

SEQ ID NO: 168500 - protein, 123 aa, Glycine max
  Coding DNA Sequence Number=SeqID_76815
MKVGLAVETKLENHSSHEDNNKTTKPRGKDVEEKCTKVRWCRIERKKWREWGNKSEVGRMVRVGGLGQFMKLPAVMDCALTTAMRLVRSLTTVMALKYQTLSEGISLSDLRTKSFGLPPNVLL

SEQ ID NO: 168501 - protein, 159 aa, Glycine max
  Coding DNA Sequence Number=SeqID_76816
MTPQVSPATTPVLEVFEDEEGAEDTDYATDLQAAQSTWDPWLTAAQETPQPAQDTPSPPHGEQTSPQEELAADVSLSKACVLSENHALSEALIPLSELGESQGEFEKLLRAQRVISSFSEEFVSSRAKKGPVTRAMSKRLQVDWARVAEEGPRVLMNLR

SEQ ID NO: 168502 - protein, 110 aa, Glycine max
  Coding DNA Sequence Number=SeqID_76817
  Homolog annotation: Hit_ID=Q1KUW3; Match level="QueryCoverage=78%, HitCoverage=12%, E-value=1e-17, Identity=50%"; Hit description =Putative uncharacterized protein
MASSPPPSPFSRPHSQSLSAQADTDNLLVVDIFSKPADSEDFKTLLDSNRVMITHDAVLAVLWKLDSNVEAARRFFLWVSENHPERLSSKCYNSMLRVLGTNGVVHEFWT

SEQ ID NO: 168503 - protein, 187 aa, Glycine max
  Coding DNA Sequence Number=SeqID_76818
  Gene Ontology: Mol. function=oxidoreductase activity; Biological process=metabolic process
  Homolog annotation: Hit_ID=A5BAM4; Match level="QueryCoverage=100%, HitCoverage=81%, E-value=1e-36, Identity=40%"; Hit description =Putative uncharacterized protein
  Pfam annotation: Domain name=adh_short; Domain location=24-169; Score= -0.4; E_value=1.3e-05; Accession=PF00106.16; Description=short chain dehydrogenase
MEPQHVTDQNIETQKSSTKGLADKVAVITGGARGIGAAAAKLFAEIGAHVVIADVLDDLGTTMAESIGGRYIHCNVSKEDDVESAINLALSWKGNLDIMLSNAGIEGPKGSVTTLDMDQVRHLFSINLHGINHAARAMIKEHWIRVNCISPHGVPSEMLLSACRRFAHGHINPQGLKELIGSRAILL

SEQ ID NO: 168504 - protein, 261 aa, Glycine max
  Coding DNA Sequence Number=SeqID_76819
MPEVNELAYFFLTHSADVPRHSLAVERGGMPSSSPPGPRATHEATSRVATRVKAHRSEVLDGPRDRGPLRAGPRAGVEEEEAGDAGVVVEFANGFGKHVVVEAFFLGEALGFREAAGVAGGARVELHNMDHVIPVEEVVPHDGLIEWVRAVADVDAFDAFGDFSDHREELMRQVLRHGGEVASDLDTQVGDFGEWGEAITGLVSLAGVVVVVVVVVVVEEELIANESSDKQVVGETSVQINYSDGDGLSELEKLLKQKTFT

SEQ ID NO: 168505 - protein, 242 aa, Glycine max
  Coding DNA Sequence Number=SeqID_76820
  Gene Ontology: Mol. function=microtubule motor activity; Cellular component=microtubule associated complex; Biological process =microtubule-based movement
  Homolog annotation: Hit_ID=A7NVF5; Match level="QueryCoverage=66%, HitCoverage=16%, E-value=3e-50, Identity=61%"; Hit description =Chromosome chr18 scaffold_1, whole genome shotgun sequence
MMLLVIHCCFRDGRRLKDIWMWMLTFKDVVFGIVVEGTFVEGIKEEVVLSPTHALSLIAAGEGCTDVLMVIAKLTDGKETHIPYRDSKLTRLLQSSLSGHGRISIMDEKSLIKKYQKEISELKQELQQLKRGMVENPNMATSSQEDLITLKLQGCADAYILDYLISVTLEAVQSKLKSRLQEEEQAKAALMRRIQRLTKLILVSTKNAMSSSIAERPSHRRRHSFGEDEIQISNFFEWPIKL

SEQ ID NO: 168506 - protein, 97 aa, Glycine max
  Coding DNA Sequence Number=SeqID_76821
MSVKNLVERLGVHDKTDHILVSQVTLTRFPSVKDKEKGLELQFHYLRVKIISLSTNTISQIPMVRVCEKKRGFWGDEVGKTNLRGKESAETHRKCKN

SEQ ID NO: 168507 - protein, 24 aa, Glycine max
  Coding DNA Sequence Number=SeqID_76822
MVRSPYLKIVSAMVSHDLFSNGDP

SEQ ID NO: 168508 - protein, 71 aa, Glycine max
  Coding DNA Sequence Number=SeqID_76823
MCRCYSLYNLLCTSTRTPLVYCHTNQCDKNMNKISGVLIQGERGLQRVVLFQLAFLLRWTKKKMNERVEKM

SEQ ID NO: 168509 - protein, 468 aa, Glycine max
  Coding DNA Sequence Number=SeqID_76824
MGDATWGRQLVLMDNHFGQNMLTSGGHRQVFYCVEGFIVLKGILLVVPYQSYQVREYSAKQIGTTCKRYFNAQLLPNVAEKVAKSVRAPVVATTTEAGTSEKAASRPKRLPMLKERCLLPFIMFPEYMRVDKEVGTYFSRYNHKSYFTNLISWLPINTITDLETYLVTVHTIQLDATPLAEFVFMNRGDEQGLLSHDHFYDLVGNHLFPFYWQQCPQRYDKYPNKHLSVDESRDLEFLESLPRQLPARRNRIATTGGQSPHATTNQTSRPREDHWSGSREHSGHREGISLEKRLKNDFGAGSPSIEQRRRCSQLGQFWPFLSRVSAVAQHLQGSFNVEALKDQLLKDRVLGLSNDAKGLETHALNVEALTRSQDTEIVRLRSALANANKEMEENNVEKERIQHKVLHMCNVLNPSVFDINKDVHERELMLIDDIPEDDVTHSPQRPTTLAEELHAKETEGRENVEPRD

SEQ ID NO: 168510 - protein, 94 aa, Glycine max
  Coding DNA Sequence Number=SeqID_76825
MLYAALPLHMQRGCFRIRTHDQQVTKAQLYRCTRTRPLKLRTPLPRGSSLCEGMGEGYCTQPYPCICKEAVSGFEPMTNKSPRHNFTAAPGLAL

SEQ ID NO: 168511 - protein, 605 aa, Glycine max
  Coding DNA Sequence Number=SeqID_76826
MVVVVLLAPRALFFKLDHYVYVCLRIFDNEGFEIGTSSCPKWGDVHLLNEESTRELDTYNVESELRVLVDMGCYGDVTTLVDNYRFVDNSQGCPLSNEIVPCRGRLFEVVGSSLDNLSSPRAWTSVIHDASVKLLWVDMLLVLQASSDITLPYKSLVEWARTRDVDTCHGVSKSESFSSERLRVSRRTGGDTSCLRRRAQPSHASPAGDLIPITMILPHFTFGGVEKSGGGDVRDDILKYKSSITFVVSVAALQCQAVLGNPPFFFMYKCLFEVLGLVLPLTAFQCALLEHLNVTPSQLHPNSWAMVRAFKILCLFFNIRPRSIDPYGEGRQSYFEVVADLFGRAGIMGDFPWRPLVKQVGPLGGTVSLSAIAIAAGERSQLAIEVGLVAGVAEDGDAGMSSRKKLRALFSLHALRQAAFAFAVVVVVTPTPPPPLVVLVQEATPTTEVDAPAALASPIVSPSFTVATSLLSVGVVTMSAPMMPPPFSLTPLCWHRLPPLFTPYAGVNHATNSAKVFLLRSLTILEKNGQRNQEALSKVASLECPKVSSATVAFVEAVKLNHELSSKVGSVLAKLLRTRLDVEVWCELTMCDLLDVDVELCGVIL

SEQ ID NO: 168512 - protein, 290 aa, Glycine max
  Coding DNA Sequence Number=SeqID_76827
MEKISSGKHQYPPVIGPRTTLAPEIGNTWRSTINVMARMEMETALQTQCFHRPPEALRHGQRSSPQNTTFQALGNLPENSDLIGPSMDPGLWVRYRVRRFILFRDEEEYLRGTTVTSMGGRGEGGGRAGRKDERGGKGLRRGKTSGGGQGRDSGQGRWSPKMKQLRRNSIGKPTMRLAKSSNSDRSFVAGNRLHVENSNSKPFSTAISQPCLLVIDYTAWYCGGGAEGRGNWWSGGGEERGHTVEKRMRVASSLSTDVEDLEGTTMVKNNESTNCYKLQTKDCFRGPGPP

SEQ ID NO: 168513 - protein, 125 aa, Glycine max
  Coding DNA Sequence Number=SeqID_76828
  Homolog annotation: Hit_ID=A7PAH2; Match level="QueryCoverage=68%, HitCoverage=16%, E-value=7e-08, Identity=40%"; Hit description =Chromosome chr14 scaffold_9, whole genome shotgun sequence
MASLEQELILMEGEAIDACERWLEADNAREILKRISKQLLEQLKEKDVPVDKIEHLNDKLILANSQVVALSVKVCSLEKQLNESECQIGMLGGIITPSGGSKSGICKRYRKADQSIKKIGDVAGC

SEQ ID NO: 168514 - protein, 116 aa, Glycine max
  Coding DNA Sequence Number=SeqID_76829
  Homolog annotation: Hit_ID=A7PIW0; Match level="QueryCoverage=91%, HitCoverage=21%, E-value=1e-32, Identity=61%"; Hit description =Chromosome chr13 scaffold_17, whole genome shotgun sequence
MNGIIDSEEDAKILREKGVILNRLKSDKEVANLWNRMSKSIKLTRVPFLDKVIEDVNQHYNGRMNIKVRKFMKLYVFASWKFLTFLAAIFLLFLMSLKVFCSFYKCNHRCRASVTR

SEQ ID NO: 168515 - protein, 48 aa, Glycine max
  Coding DNA Sequence Number=SeqID_76830
MEKAEITRSCVSGRDEKKLWIEAWFNPFYLSRSMCASFLPFISATYDR

SEQ ID NO: 168516 - protein, 134 aa, Glycine max
  Coding DNA Sequence Number=SeqID_76831
MDQLKRLSIPSEMFRFSNHASYPRLGHPTRKISMQQGQADILIARFPDPNYGVKTIRVFVLYRNRKPSWKIPLRLKGSSRCGFSMENNDGLLWLMVAVGDGESAWNFINGFGRKKEEEMTFFVSYTKAKAEMLK

SEQ ID NO: 168517 - protein, 194 aa, Glycine max
  Coding DNA Sequence Number=SeqID_76832
  Homolog annotation: Hit_ID=O04291; Match level="QueryCoverage=17%, HitCoverage=3%, E-value=4e-08, Identity=82%"; Hit description=HD-Zip protein
MNGVVRVEVEEDVGGIGAGEEVRVIRIFNGGKRIEVGEDFSVETIVQRVKIIARDFEGLVKVETVFEAKEPLVKDVKCRVVVAGYKQAGERTLYEKEDFCCSHDFIKGHFTENDTLTARVLDEGIGSNLNFIIHSNNGYELFARLKSPTTSQESKKNLALRHARQIVQESSGDVHYGGGRQPIVLRTFSQRLRK

SEQ ID NO: 168518 - protein, 89 aa, Glycine max
  Coding DNA Sequence Number=SeqID_76833
MTFQSFFFEISSLVIDYRILRLNNITIDGNVNGHGYFAGDNDMDEDSAIDGHDNFDGEDDGYGWDMITLLEIMKWMEKMAWMDMMICYR

SEQ ID NO: 168519 - protein, 421 aa, Glycine max
  Coding DNA Sequence Number=SeqID_76834
  Gene Ontology: Mol. function=cation transmembrane transporter activity; Cellular component=membrane; Biological process=cation transport
  Homolog annotation: Hit_ID=Q84ND4; Match level="QueryCoverage=100%, HitCoverage=96%, E-value=1e-166, Identity=69%"; Hit description =Cation diffusion facilitator 10
  Pfam annotation: Domain name=Cation_efflux; Domain location=150-414; Score=208.4; E_value=1.8e-59; Accession=PF01545.12; Description =Cation efflux family
MAESDGRHRRREPLPVSSEEDAANASWRLNVEEFRLPNQTHDHHQQHRSFTFRGLLRKPSVQAHFPLNVQALNFNVFALCDCFPLSGDASEHRRSQSSGKQRKVAEYYKKQESLLEGFNEMETMTETGGFPGTLTEDELKQLAKSERIAVHVSNICNLVLFVAKVYASVASRSLAVIASTMDSLLDLLSGFILWFTAHAMKNPNQYRYPIGKKRMQPVILIESGRQLISKVKPDMDSAKLHWMMGIMVFVTVVKFILMVYCRRFKNEIIRAYAQDHLFDVITNSVGLAAAVLAVKFYWWIDPTGAIVIALYTINTWTKTVIENVGSLIGRTAPPDFLAKLTYLIWNHHEQIKHIDTVRAYTFGAHYFVEVDIVLPEDMLLHQAHNIGETLQVKLEQLPEVERAFVHIDFEFTHRPEHNTMV

SEQ ID NO: 168520 - protein, 725 aa, Glycine max
  Coding DNA Sequence Number=SeqID_76835
  Gene Ontology: Mol. function=beta-pyrazolylalanine synthase activity; Cellular component=cytoplasm; Biological process=cysteine biosynthetic process from serine
  Homolog annotation: Hit_ID=A3RM05; Match level="QueryCoverage=99%, HitCoverage=99%, E-value=1e-98, Identity=73%"; Hit description =Cysteine synthase
  Pfam annotation: Domain name=PALP; Domain location=9-276; Score =323.1; E_value=5e-94; Accession=PF00291.16; Description=Pyridoxal -phosphate dependent enzyme
MECAIKQDVTELIGNTPMVYLNKVVEGCVARIAAKLESMEPCSSVKDRLALSMIKDAEDKGLITPGKTVLVETTSGNTGIGLAFIAALKGYRLILAMPASMSLERRVVLRALGAELHLTDPAKGFKGSLQKAEELLRETPDAFMPHQFENPANPKIHYETTGPEIWTDSGGKVDALVAGIGTGGTITGAGKFLKERNPKIKVYGVEPVESAVLSGGQPGGHLIQGIGAGIVPAVLDVNLLDEILQGVTDHPSSHQVFKSKDAIFHKNENGGCCDTLVIHLEPKEPRFRLGVIFHIFDQKIHRSLCMDGSGSECSGAKASSLTRKVELPSFDRSIEGGTDLKGSSFECDSDPLQFLKSENRSKEGSIIKNHTRCGGEETKDDEAKLARETKIEKVMEEEVDPLIKREKHKENRVTNVGAKTEVEAGDATKPHCFQDSDFHTKIVMMKHKSLMKVVGTSMVLESWNVNLLGELLALNFVVSMDDSLTMEPRQKGGTETVMMIQLPGSSPSSPPLSKPPDLSLHEVASRMRKRKGKFWNSTKSQAYGRKAPKCYLERQMKIMVMKMSHGIQLPHFQPETWSLKWVARFIPLNLDAGLADDMIIEKRWKKIAASAMEVQSEFAFIPTSTSTRMQGSRSFPDLTLGFLSVNIFQVSSEEAIETAKLLALKEGLLVGISSGAAAAAAIKLGKRPENADKLIVVVFPSSGERYLSSPLFESIRQEAEQMTFD

SEQ ID NO: 168521 - protein, 96 aa, Glycine max
  Coding DNA Sequence Number=SeqID_76836
MEGSKIKLVEWEEDHKPLLPYCRFIKNLLQSTQMCKPKIVKDVRVRDPFTNPSIVWLIPNPNFATTAWSQEWLKQCRGILDRLDFLGGDKSLQRVY

SEQ ID NO: 168522 - protein, 288 aa, Glycine max
  Coding DNA Sequence Number=SeqID_76837
  Gene Ontology: Mol. function=protein binding; Cellular component =membrane; Biological process=cell division
  Homolog annotation: Hit_ID=Q6BBR1; Match level="QueryCoverage=51%, HitCoverage=44%, E-value=2e-55, Identity=73%"; Hit description =Putative uncharacterized protein Lj-CDC50 like 1
  Pfam annotation: Domain name=CDC50; Domain location=4-192; Score =39.6; E_value=6.1e-14; Accession=PF03381.6; Description=LEM3 (ligand- effect modulator 3) family  CDC50 family
MDSVVYDWLFSYNHGYFVYFRYVKSRSDEQLRDRREENSTSACNPEDIANGKAIVPCGLIAWSLFNDTYSFSRDNKNLTVNKNGISWKSDREHKFGKDVFPKNFQSSAIRGGASLNESIPEDLIVWMRTAALPTFRKLYGKIEVDLNAAGLVGRMTSWALPISLLEGCVSFWHWLLPLYILSSQARGNEGGISGAQTGGHVAELGGERRSTRLKITNSKLAEYSDYETWTLQLLAVSGVRHDTDTHVRVEFDVFDRCLRVRVVSGVRVSVGASYQSNSDGRRAYLAYV

SEQ ID NO: 168523 - protein, 264 aa, Glycine max
  Coding DNA Sequence Number=SeqID_76838
MCHLTTYVCVYYDGQICNTNEGTTFVSNNTKTFMVDKVITFTQLLELVHQKLNIDPEQHIQHLHFRRPIFESGQRYMYTSFILRDDADVRQMFNIFYNNPSLPFVELFAIICHNNDPPGNQHGSTSNLEDLSELLCTIIRTSDAILNLLQSTITPTHDAIMYYNGKWNIPRQGEFLGYSFTGTNPIRFGIPSGCDMEKLKDLIKQVAPTGVPPNGIHGSQLVRRLFFRQPGHSKYSENLIEYDITELENDEDVLKVLAQSNYWK

SEQ ID NO: 168524 - protein, 92 aa, Glycine max
  Coding DNA Sequence Number=SeqID_76839
MWFGISRHYNYINCNIEAMRNVENKANAVIVRMWVNSVQENVIGSRALESRCVTVPQLMLMCFGISRPCNETIINVLWILETFTITLTYTCG

SEQ ID NO: 168525 - protein, 90 aa, Glycine max
  Coding DNA Sequence Number=SeqID_76840
MEEHFLEHDGERGVMAVDHHCHGVADETDVDVNRVEVHHDGVVVGGDHGDRLGGMVLLPQLAQCYTLKSSIMRWKMKVKEEKERRGIRIR

SEQ ID NO: 168526 - protein, 40 aa, Glycine max
  Coding DNA Sequence Number=SeqID_76841
MSYNYFIFLLCRADFERTGLSSLVTMQVRDIQGEPTSQAK

SEQ ID NO: 168527 - protein, 134 aa, Glycine max
  Coding DNA Sequence Number=SeqID_76842
  Gene Ontology: Mol. function=structural molecule activity; Cellular component=protein complex; Biological process=microtubule-based movement
  Homolog annotation: Hit_ID=P29512; Match level="QueryCoverage=73%, HitCoverage=21%, E-value=2e-26, Identity=63%"; Hit description =Tubulin beta-2/beta-3 chain
  Pfam annotation: Domain name=Tubulin; Domain location=1-111; Score= -24.9; E_value=3.3e-05; Accession=PF00091.16; Description=TubulinFtsZ family, GTPase domain
MTGLQIFHSLGGGTGSGMGTLLISKIREEYPDRMMLTFLVFLSPKVSNTVVESYNATLSIHQLVDITNECMVLDNEALYDICVCTLKLTNPSCIDVGYQFYSRAEMVAVGFHSHWLNGIDYMGQSYAKAEKENL

SEQ ID NO: 168528 - protein, 347 aa, Glycine max
  Coding DNA Sequence Number=SeqID_76843
  Gene Ontology: Mol. function=DNA binding; Cellular component=nucleus; Biological process=regulation of transcription
  Homolog annotation: Hit_ID=A7QML1; Match level="QueryCoverage=79%, HitCoverage=95%, E-value=1e-106, Identity=70%"; Hit description =Chromosome chr19 scaffold_126, whole genome shotgun sequence
  Pfam annotation: Domain name=NAM; Domain location=6-134; Score=320.0; E_value=4.5e-93; Accession=PF02365.6; Description=No apical meristem (NAM) protein
MAPMSLPPGFRFHPTDEELVAYYLERKITGRSIELDIIAEVDLYKCEPWDLPDKSFLPSKDMEWYFYSPRDRKYPNGSRTNRATQAGYWKATGKDRPVHSQKKQVGMKKTLVYYRGRAPHGIRTNWVMHEYRLIESVPGATLSSLKDSYSLCRIFKKTIQIPAKTNNKEEEQVENAKKESMWISEEQMLGEDSSGTEISREMEAVDEKILNHEHPKFPCDASSSDLTQGTCTPTDTGIAEDFQPQFACDEANSAANSYTMGIGYPTNLFQDVQIPSYAGMHYQLPYTPLVMEDFPQINLPETKITKPEVTDDCMLYDRYRDCMNGTLEEIISLCCTQDNSVPFPMLE

SEQ ID NO: 168529 - protein, 220 aa, Glycine max
  Coding DNA Sequence Number=SeqID_76844
MKGRMHKYGFNNNKRKKPEKIMGSPPAFPPPPPSPPHSPPPPAPSDASVVHVDPATGKANGPHRKKLRTYLGIVARDNVDVTYENWKEVPTAQKDLIWEDIQRNLISQKLLTVGRKGSYFRPLGRDGGSLNQTSRGNGPLQLIKMMSRTLSVRNTASAKKSGPNFARLAETLLGRMCARRHKPSRSRILSPTFSLVGVMTIWSRSSWLRRQRRSCTVRKC

SEQ ID NO: 168530 - protein, 175 aa, Glycine max
  Coding DNA Sequence Number=SeqID_76845
MAVMPAGGGCVHSARGFFSSENVVELKISNEKRCGLCNTTSFCSPVISAKVYFLNIITRPRLRGLNVNHKTDPRSEVRLQCLGLEYLPDHPSFPWLEHFLAKMGVPETFLNGHDCDMLEKLSRMLHDSILHCRGGIQTNCFCIFAMVLNSRCSYNIVNTICYFRGNLEWFVQSGT

SEQ ID NO: 168531 - protein, 445 aa, Glycine max
  Coding DNA Sequence Number=SeqID_76846
  Gene Ontology: Mol. function=microtubule motor activity; Cellular component=nuclear pore; Biological process=protein import into nucleus
  Homolog annotation: Hit_ID=A7QMM2; Match level="QueryCoverage=98%, HitCoverage=31%, E-value=1e-118, Identity=34%"; Hit description =Chromosome chr19 scaffold_126, whole genome shotgun sequence
  Pfam annotation: Domain name=TPR_MLP1_2; Domain location=121-337; Score=24.1; E_value=1.6e-05; Accession=PF07926.3; Description =TPRMLP1MLP2-like protein
MSKELANALRAVASAESRAAVAEAKLSGLQRKMGSTDDKAKDEIEKWKEEAHANKAHMLQYKSIAEVNEDALKEIEKAHEKFKTEADNGKKVLESELNSLREKMLEIENESSLKYEEVASETVGKEEALTSAMAEITNLKEEILTKSSQISAMEIQISGLKENLDREHQKWRATQTNYERQNELKTKWEDEKAQLEKSRNDAEKKYNEINEQNKILHSQLEAFHIQWAEKERNAAGISSGSSSADAFGDAGLQNAETEVSLLKQEKLRLQSQLETALKAAESAHASLETERAKSRSFLFTEEEFKALQLQKLRELAQKVRAETENLENLLKEREIKLDGHTKEIETLKMEKDHLNKKVTELLERSKNVDVEDYDRVKKLAKEIQDKLRERDARIEEIGKSLSEKQDSVSSLEKDLSNCRLELAEREKRINDILHNEVSEILSIFD

SEQ ID NO: 168532 - protein, 122 aa, Glycine max
  Coding DNA Sequence Number=SeqID_76847
MVKFGFGVVGLGFCVDRLDFGVARFRFGVASLGFFVADRGGIMDIHENAYAHEETKIVRIIFIVIFHKFFDEITKVLSNNIIHETYRNIVNLDPVGTVKKGINAGSLSSFIAPNIKRSLSKL

SEQ ID NO: 168533 - protein, 121 aa, Glycine max
  Coding DNA Sequence Number=SeqID_76848
MEMAVKFVEVSTRTEKTSRYGRKMHLVYTQRGVGTRRLCQPKLMKIRMVFLLSCGRSRPLAKQNNAALVGINIVDKHFKTIFADLENALPLACGLVWKGNGSSSQNWKCWWISLTWTIWQH

SEQ ID NO: 168534 - protein, 195 aa, Glycine max
  Coding DNA Sequence Number=SeqID_76849
MHYDHGESTTIVIASDIEALGHYGLTMALLVDRDPHELTITLMNLPWSLSDRDIILEGCYHFIVAMLLTMVVIMGCECNCNLLQTGGFFPGLGHMLTLQFRPYFPRRRQAYNVIHDLTCQTQSYGRRNPLLQLLSICIVDAINLQFNFTISPMYRTMRTSSYTRHGKKTRTRVYPSESVSTLTGNTRVDRVWIRI

SEQ ID NO: 168535 - protein, 315 aa, Glycine max
  Coding DNA Sequence Number=SeqID_76850
  Gene Ontology: Mol. function=aspartic-type endopeptidase activity; Cellular component=extracellular region; Biological process =proteolysis
  Homolog annotation: Hit_ID=A7QMM5; Match level="QueryCoverage=86%, HitCoverage=56%, E-value=7e-77, Identity=54%"; Hit description =Chromosome chr19 scaffold_126, whole genome shotgun sequence
  Pfam annotation: Domain name=Asp; Domain location=20-312; Score= -109.4; E_value=4e-07; Accession=PF00026.14; Description=Eukaryotic aspartyl protease
MEGMGLKRIEVLSVFLILETSVAIELGGAQLFDFSNLIILDSYADGSSAKGFFGTDSITVGLTNGKQGKLNNLTIGCTKSMLNGVNFNEETGGILGLGFAKDSFIDKAANKYGAKFSYCLVDHLSHRSVSSNLTIGGHHNAKLLGEIRRTELILFPPFYGVNVVGISIGGQMLKIPPQVWDFNAEGGTLIDSGTTLTSLLLPAYEAVFEALTKSLTKVKRVTGEDFDALEFCFDAEGFDDSVVPRLVFHFAGGARFEPPVKSYIIDVAPLVKCIGIVPIDGIGGASVIGNIMQQNHLWEFDLSTNTVGFAPSTCT

SEQ ID NO: 168536 - protein, 91 aa, Glycine max
  Coding DNA Sequence Number=SeqID_76851
MSSTLCFSPLPCLFSIKFFSPSRSFILLITKFGAAIDIVEEANQHRHEAFRSEEKMVVLLETLAFQEQVEPIVAVSVQIGDGDDDVVLGEE

SEQ ID NO: 168537 - protein, 178 aa, Glycine max
  Coding DNA Sequence Number=SeqID_76852
MTCLPNRFMNECGRSKADQSLYGLLEPQSIQNAKERRQQCQQYIETWVKESQRQLAHWQLFVLHPRENTVVWFCSLRKKPDINIKGAINSAMKTITSSFEGMSNQGAPWWVEPKTNVQSRGFECGYYVMHWMWCIVTADLKDDWHKWFSDGSSLDVEAITTVRQKWATYFLSLRKSSC

SEQ ID NO: 168538 - protein, 35 aa, Glycine max
  Coding DNA Sequence Number=SeqID_76853
MGEDVSGGGCRIVEHGVFGFGGVGAFGGGRSEVKD

SEQ ID NO: 168539 - protein, 90 aa, Glycine max
  Coding DNA Sequence Number=SeqID_76854
  Gene Ontology: Mol. function=kinase activity; Cellular component =nucleus; Biological process=protein amino acid phosphorylation
  Homolog annotation: Hit_ID=Q84PE0; Match level="QueryCoverage=83%, HitCoverage=15%, E-value=5e-28, Identity=80%"; Hit description=AKIN betagamma
MNEISRQCISAFLSSHTAYELLPESGKVVALDVDLPVKQAFHILHEQGVFMAPLWDFCKGQFVGVLSASDFILILREFNLNLFDPAEINL

SEQ ID NO: 168540 - protein, 65 aa, Glycine max
  Coding DNA Sequence Number=SeqID_76855
MEFQQATGGHIEASWRYEPRINKSYHVLVLGSGDESKSRRAMRVRAYVDVRKPLKRAMNLKVRPN

SEQ ID NO: 168541 - protein, 190 aa, Glycine max
  Coding DNA Sequence Number=SeqID_76856
MGGWIVKGIHTQAIPIKNPHRDEALLHCYFPFSTYGNPSIFSKYELGFSILSKILKKGYELDTVTFNTLIKGHTPINYAPPNAVTKDQVQDMIGQAMNTFAECRRQENEQFSLSMQNVITIQFFNLGVVLLQNLQQAQMSMLGVVASPAPHVVAPAPPAIVQPPPTTVEPTPPPPPPTQPSSPPQVQEWQ

SEQ ID NO: 168542 - protein, 89 aa, Glycine max
  Coding DNA Sequence Number=SeqID_76857
MNTRRERMFSEDISMFSFARFLNECKEILGVWNVNELEQSLDTICIGNIKMHVNLPRFVRGGGREDVSKGVGRKECVLGASGEQHKVGG

SEQ ID NO: 168543 - protein, 163 aa, Glycine max
  Coding DNA Sequence Number=SeqID_76858
  Gene Ontology: Mol. function=structural constituent of ribosome; Cellular component=ribonucleoprotein complex; Biological process =translation
  Homolog annotation: Hit_ID=O65751; Match level="QueryCoverage=84%, HitCoverage=40%, E-value=2e-37, Identity=61%"; Hit description=40S ribosomal protein SA
MRYVDVGIPANNKGKHSIGCLFWLLARMVLQMRGTIRPGHKWDVMVDLFFYREPEEAKQQEEDEAPPAQDYAISDFNAAGIGSFPASDGQWPAAVEQPWTEEAPQPISAAPTNLTPEAAVTICLTEVPLAVAGDWGEAVPAPVPAPQAGVPPAQAFPPATGWD

SEQ ID NO: 168544 - protein, 564 aa, Glycine max
  Coding DNA Sequence Number=SeqID_76859
  Homolog annotation: Hit_ID=A2Q3C0; Match level="QueryCoverage=99%, HitCoverage=99%, E-value=1e-174, Identity=59%"; Hit description =Legume lectin, beta domain
  Pfam annotation: Domain name=DUF936; Domain location=1-564; Score =271.7; E_value=1.5e-78; Accession=PF06075.3; Description=Plant protein of unknown function (DUF936)
  Pfam annotation: Domain name=Rep-A_N; Domain location=3-105; Score= -26.2; E_value=0.04; Accession=PF04057.3; Description=Replication factor-A protein 1, N-terminal domain
  Pfam module annotation: Pfam domain module=DUF936::Rep-A_N; Domain location=1-564::3-105
  Subcellular localization annotation: CTP_CleavageSite=21; ConfidenceScore=5.02e-01
MASLTPGVLSKLLDNAGSKVTAPHRQALLQVTEIVPRLSSTSPLQSRGYFLKLSDSLHSAYVSVPDADADLISAGKLNLGQFVYVTRLDAASPVPLVRGLNPLPKRRPCVGNPIELVPSERLRVTTTTTKKKKKKVEVFKRGKGSPEWKKEKGLEMMRRLSLDSSRRVWDHSPVSEGITASASNKLKAKKSNPTLPNEIDKKVFSVKPDSPLKSPTSSISPLKNKNENLCPKSLTSTPCGGTVHSQLVKVPLNCKSWRHDTPACCEDVSSPMCDLGKQVVAHRNVAFLAAVRSLEEASATDTVIQCMCMYAELCQSGQTHSPGSLVKQFLELHLSLQRVTVLIDLLLNPFPETKSSSHSTLQCLTEDACKVPARKNAISWVQAAIGTNLSKFNLFKTQAKSEVLNGEKCHYVVIESSPEDINTENSPAQNKQNRVTQANHLPNSTAKKLPSSKRNLLAAKNKDADKHDRSKEIKLKEVASLAEKLLEASSEWFLKYLEESLSNEYGLKNEGNIEIASLLGQLKQVNHWLDNLAGGDKVDHRVEKLRKNLYRFLLEHVNSAVTCN

SEQ ID NO: 168545 - protein, 124 aa, Glycine max
  Coding DNA Sequence Number=SeqID_76860
MDNRGRFLMGFSSFLGTCMITHEELNVILKGLQLVKSKGLVKILVEFDSKTAIKFLSKGCPLNHHVVHVVDSIWRLIFADMEVVENQGNYKIMMTSRMDLLLEGIIDRASMELEVVFFSFFSGV

SEQ ID NO: 168546 - protein, 180 aa, Glycine max
  Coding DNA Sequence Number=SeqID_76861
MVTTKKLETRLESFEQTFTEAQESTKKTLDSLQKMLESLVSSIASLNGEKKILTDEDDDIDAPDSSRPIVECAQIQFPMFDGTNFRYWRAKAEQFFELEAKSIAQHVAYRFDDSAFDDPVVELSRLKQGDLGKYLEAFDSLPARGPQTVVSARSRTYCKIARRNSKRIGKEDVAEKKGQT

SEQ ID NO: 168547 - protein, 281 aa, Glycine max
  Coding DNA Sequence Number=SeqID_76862
  Homolog annotation: Hit_ID=A7PP62; Match level="QueryCoverage=80%, HitCoverage=67%, E-value=4e-87, Identity=68%"; Hit description =Chromosome chr8 scaffold_23, whole genome shotgun sequence
  Pfam annotation: Domain name=mTERF; Domain location=15-277; Score =119.2; E_value=1.2e-32; Accession=PF02536.5; Description=mTERF
MVGVARWLMVAKVIGGMVDGLSNTRMQLQVIKWRCPKQTIPPNDTGFQKKLLYLESIGIDSFLLIENHPTVITTSLADIRSTVEYITSLDFTAIEFRRMVGMCPEILTTQVSDLIPVFTFLHREVHVPGSDIKRVINRRPRLLVSSVSKRLRPTLYFLQSIGIEEVNKHTDLLSCSVEEKFMPRIDYFENIGFSRRDATSMFRRFPQLFCYSIKNNLEPKYSYFVVEMGRDLKELKEFPQYFSFSLENRIKPRHKQCVEMGYNIDGAVPGSPSHATCGGFY

SEQ ID NO: 168548 - protein, 164 aa, Glycine max
  Coding DNA Sequence Number=SeqID_76863
  Gene Ontology: Mol. function=transferase activity, transferring acyl groups, acyl groups converted into alkyl on transfer; Cellular component=mitochondrial matrix; Biological process=cellular carbohydrate metabolic process
  Homolog annotation: Hit_ID=Q946X8; Match level="QueryCoverage=89%, HitCoverage=31%, E-value=1e-61, Identity=76%"; Hit description =Citrate synthase
MAFFRSVSALSRLRSRVDLYSELKELVPEYQERVKKLKKDHGSVELGKITVDMVLGGMRGMTALVWLGSAVDPDEGIRFRGMSIPECQKKLPGAFTGGEPLPEAVLWLLLTGKIPSKAQVDSLSKELRSRATIPDYAYKAIDALPVSAHPMTQFTTGVMALQVE

SEQ ID NO: 168549 - protein, 47 aa, Glycine max
  Coding DNA Sequence Number=SeqID_76864
MKEWGVKETTTATGSSLMECQSHDIWPNVISSHIKLILKWCLLLEKG

SEQ ID NO: 168550 - protein, 318 aa, Glycine max
  Coding DNA Sequence Number=SeqID_76865
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=A7QR97; Match level="QueryCoverage=89%, HitCoverage=14%, E-value=1e-117, Identity=75%"; Hit description =Chromosome chr13 scaffold_149, whole genome shotgun sequence
  Pfam annotation: Domain name=DUF605; Domain location=40-259; Score= -128.5; E_value=0.015; Accession=PF04652.7; Description=Protein of unknown function, DUF605
MSYRRGSDQPPQRRILRTQTAGNLGADPILDSEVVPSSLVEIAPILRVANEVEASNKRVGYLCRFYAFELAHRLDPQSSGRGVRQFKTALLQRLEKENVTTQEGRKKSDAREMQAFYRQYYEKYIQALDKAADKDRAQLTKAYQTAAVLFEVLKAVNRIEDIPVSDEIMEAHIKVEEQKQLYAPYNILPLDPNSGKEAIMRYHEIQASVSALRNTRGLPWPKEHGNKVNEDILDWLQLMFGFQKDNVENQREHLILLLANVHIRQVPKPDQQPKVANHSAGNATAKIIIYGSISSYMGRSCKFEIYARMPLLYLPSCK

SEQ ID NO: 168551 - protein, 455 aa, Glycine max
  Coding DNA Sequence Number=SeqID_76866
  Homolog annotation: Hit_ID=A2Q454; Match level="QueryCoverage=30%, HitCoverage=81%, E-value=2e-36, Identity=45%"; Hit description =Retrotransposon gag protein
  Pfam annotation: Domain name=Chromo; Domain location=339-393; Score =51.5; E_value=3e-12; Accession=PF00385.15; Description='chromo' (CHRromatin Organisation MOdi
  Pfam annotation: Domain name=Retrotrans_gag; Domain location=69-160; Score=7.4; E_value=0.01; Accession=PF03732.8; Description =Retrotransposon gag protein
  Pfam module annotation: Pfam domain module=Chromo::Retrotrans_gag; Domain location=339-393::69-160
MEAKVAAIESEVAGLKTAMKSMQLKAEENHERLIKAELPMFDREDPTGWIVCVEVYFQVQEMHPDVKVSLAQLCMDGSTIHFFKSLLNEHNVLTWEQLKAELLERYGGIGDGDIFEQLAAIQQEGSINEYITKFECLTAQYAYAGSINVFEDDESHQGDGIIVPRGKEIGMGFDHPIRGRSGLGQGNRNSPSFTSEFHGSDLSPILNHNVLPPMTEAFVIYPTRSSRSARGKGSATREEMDDEANAMIAEDELDDEEDEGECTRINGVPVLVLVDRGAHITSSPRRNVQGCYLGSGFIVVNSGHSVILFGGHQLDFGGSLAHSFGGDASGLASNSTITPEPEAVLAPRSVQKGGELVNQVLVQWKDEGLEEATWEEEFNIKSQFPDLRLEDKSLFEGGIDRNGSVGLEVRERPKIWRVNARRNKSVKERDGYWEFLEFCHGERIVTSLEELGSGQ

SEQ ID NO: 168552 - protein, 203 aa, Glycine max
  Coding DNA Sequence Number=SeqID_76867
  Gene Ontology: Mol. function=hydrolase activity, acting on glycosyl bonds; Cellular component=extracellular region; Biological process =cell wall organization and biogenesis
  Homolog annotation: Hit_ID=A7PJP5; Match level="QueryCoverage=84%, HitCoverage=42%, E-value=1e-46, Identity=52%"; Hit description =Chromosome chr12 scaffold_18, whole genome shotgun sequence
  Pfam annotation: Domain name=Glyco_hydro_28; Domain location=1-198; Score=43.6; E_value=2.6e-11; Accession=PF00295.8; Description =Glycosyl hydrolases family 28
MDFDFITNGHVQNLHSIDSKGGHFIVFGCENMTFTDLTLKSPENNHNTDGIKISQTNGINITGVKIGTGDDCVAMISGTKNVRISNVVCGPGHGISVGSLGKNDGETDVEDIVVKNCTFVGTSNGLRIKTWAAPLKKNLKASKFVYEDIVMNNVQNPVVIDQQYCPLHQCDLKLKLNKIFGVWKLTRANQQRGMQKYSRKQQI

SEQ ID NO: 168553 - protein, 77 aa, Glycine max
  Coding DNA Sequence Number=SeqID_76868
MCARGREGKGRVLCVLGKGRVLEWKEKEKGGGSRWGRKEEEKGRGRELYEIGGKMTDRGMHPVVEEARKIIDMRMQD

SEQ ID NO: 168554 - protein, 469 aa, Glycine max
  Coding DNA Sequence Number=SeqID_76869
  Homolog annotation: Hit_ID=A7UQU7; Match level="QueryCoverage=31%, HitCoverage=29%, E-value=9e-19, Identity=34%"; Hit description=IMP dehydrogenase/GMP reductase, putative
MVRTRGLGRALGKVIGRALGREDSHDSDDAPQRRRPTASARRQRGVVPVAEDEPVVPADEPMVPVDDPVVAFDEPMVAADVHDTGADTVADEPEGFPGGLSDPSVLTKYVEHVAASVWSEEERPELKLFSHGRKVQKLGRPVPAIEGLVAGTGLSPLIACSVDTDDRELISSFVESQCLPYLLASARRQGGLDRKCQAGHWTAAAHAYLLHLLGCIVFANKSATHVHVVFLDTLRDLSQIGMYAWGAIALLTAYWLHHPLTVAECIADLDYNEVSPRACRWIATNATVKTKSTATYRQRLDRLRIPDVCWMPYGEHQPVREFHLISCFSGRLRWGLVAVRHRPERVMHQFGYVQSIPTQPIDSWESFDEIDDRWIHYLDHLAPTGEMCVVPEPATTSTHARSDVEQSKHAVEACHAIVERLERLLNLRIVTKGTETYEVMEDCIRIVRGVIEDHIVYVRSRHRPCMDQQ

SEQ ID NO: 168555 - protein, 325 aa, Glycine max
  Coding DNA Sequence Number=SeqID_76870
  Gene Ontology: Mol. function=protein kinase activity; Cellular component=membrane; Biological process=protein amino acid phosphorylation
  Homolog annotation: Hit_ID=Q53UK1; Match level="QueryCoverage=100%, HitCoverage=95%, E-value=1e-152, Identity=82%"; Hit description =Ser/Thr protein kinase
  Pfam annotation: Domain name=Pkinase; Domain location=27-324; Score =129.0; E_value=1.4e-35; Accession=PF00069.16; Description=Protein kinase domain
  Pfam annotation: Domain name=Pkinase_Tyr; Domain location=27-324; Score=-15.5; E_value=1.9e-11; Accession=PF07714.8; Description =Protein tyrosine kinase
  Pfam module annotation: Pfam domain module=Pkinase::Pkinase_Tyr; Domain location=27-324::27-324
MWRFKPFSHKEQTGLEGRTIDVSNLKINIIKAIAEGGFSCVYLARDAVHMSKQYALKHMICNDEESLGLVKKEISVMKMLAGHPNVVTLHAHAIVDMGRTKEAFVVMEFCERSLVNVLESRGAGYFDEKQVLLIFRDVCNAVLAMHCQSPPIAHRDLKAENLLLGSDGLWKLCDFGSTSTNHKRFEKPEEMGIEEDNIRKYTTPAYRAPEVTIEGCGESTTASSKLWEFLGSILDCPSGEQMWDLFLREVINEKVDIWALGCLLFRICYFKSAFDGESKLQVLNGNYRIPELPKYTSPVTDLIREMLQARPDDRPDITQASALLD

SEQ ID NO: 168556 - protein, 101 aa, Glycine max
  Coding DNA Sequence Number=SeqID_76871
  Pfam annotation: Domain name=POX; Domain location=1-63; Score=-22.4; E_value=5.3e-05; Accession=PF07526.2; Description=Associated with HOX
MVYDKIQVENEFSELSTTERQEILMKKAKLIGMLDEVEQRYRQYQQQMEIVVLSSSSPHSIAAYESIDMQNPKRFAAQLKGEQCGSTLLPLDVSESLTISS

SEQ ID NO: 168557 - protein, 87 aa, Glycine max
  Coding DNA Sequence Number=SeqID_76872
MDDLRGTLGYNGQRGSKNLGELASGNYLTFDVLIWRRELIDLTLLLLTGSDTMLFGVESLGIDIRCTRTSVRGDHDDLMPTEIEEYK

SEQ ID NO: 168558 - protein, 399 aa, Glycine max
  Coding DNA Sequence Number=SeqID_76873
MEVAFRFLHLHHEFVTLEVVIDGEKSKGPKTSFGADVVVDDVVDINNNTALVDHNMGDSSVDVFEPLLDEAIGGGDGGVKVSEDGKVGWVSMMGARGSLFTLFNSSWKKFKTHFLKITLNPKLGDFPFIGKNSHKGSNLGQAHYYLLRIGIMKGFNFRKVWASMSKSHNPSIPPTLCRPSEAKEKEKSCYRVQNYCEPATKGRNVDVIQPHNDEKSITNVDVNDKHVEKSTTLIPSNQPQDEKDVPHNTLFEKQSGGMVIRHHQGPPRRIDHVIITHDLPSLWNVDIKGFEFITTDRLLTKVDSEMMDFVRADNSLDYTKVFLYKKIVKALNEKNSLMIGKIEIIKGIQKKIANHEKMVSMKAVENQKLVKAIESLNKNFNATVKDLEETKNTVKALND

SEQ ID NO: 168559 - protein, 254 aa, Glycine max
  Coding DNA Sequence Number=SeqID_76874
MTWKIGDGSLANIWRQSWLRSKHNSFISSQPMIGNEHATVNALIHSNSFLVEEILPIPLLNKDDTDQIIRKQSPNGSYTVRLAYHPTHGFNCRYLEFEGPWKLEAHLEFKYSSQDQPLHLALSFGAFGTQGTTKYGKKMTIQLKWWYLTVCNTSTIGRIQVQCRSDSFQRRSFFWRCSNSCTNGLPEPKEAESCGLLQAAIWISSLNMHKVTFEFDCKSVMDTINTATQGISETNVILSSCTQFLLDSPNWVMS

SEQ ID NO: 168560 - protein, 78 aa, Glycine max
  Coding DNA Sequence Number=SeqID_76875
MGGQMMESSGAEHNRAYALWTWVTCCWVTMWVEGAGMQQHQYALTTPMTTMTASTVREQRCRKHYGGGTKRRKEIKAE

SEQ ID NO: 168561 - protein, 118 aa, Glycine max
  Coding DNA Sequence Number=SeqID_76876
MELYQLKMEMGRDLHQQVQSVNVILRENERILITENVDDEHHALVVVESKQGRNHPRRHDEPRGRSKSQSQSHPQRARCKQMKEDLMKLRDINKDGVNSQANVVKSVKNENDEVAKTK

SEQ ID NO: 168562 - protein, 322 aa, Glycine max
  Coding DNA Sequence Number=SeqID_76877
  Gene Ontology: Mol. function=binding; Cellular component=eukaryotic translation initiation factor 3 complex; Biological process =translation
  Homolog annotation: Hit_ID=A7QWW8; Match level="QueryCoverage=87%, HitCoverage=21%, E-value=1e-116, Identity=74%"; Hit description =Chromosome chr13 scaffold_210, whole genome shotgun sequence
MAKIANLVKLVSFFLVMDMPELHLHLMTNISKLDHAGDLQLYPVSVKTQTGEKLELQLNPGDSVMDVRQFLLDAPETCFITCYDLLLHTKDGSTHHLEDYNEISEVADITTGGCSLEMVPAFYDDRSIRAHVHRTRELLSLSNLHASLSTSLALQNEIAQNKGANSGGDTLKPEVPELDGLGYMEDISGSLGNLLSSPLKDIKCVESIVFSSFNPPPSYRRLVGDLIYLDVVTLEGNKFCITGSTKMFYVNSSSANNLDPRPSKATFEATTLVALLQKISPKFKKAFREVLEGRAAAHPFENVQSLLPPNSWLGLYPVPGVH

SEQ ID NO: 168563 - protein, 445 aa, Glycine max
  Coding DNA Sequence Number=SeqID_76878
  Gene Ontology: Mol. function=transcription regulator activity; Cellular component=nucleus; Biological process=regulation of transcription
  Homolog annotation: Hit_ID=A7QWW1; Match level="QueryCoverage=92%, HitCoverage=99%, E-value=4e-51, Identity=35%"; Hit description =Chromosome chr13 scaffold_210, whole genome shotgun sequence
  Pfam annotation: Domain name=HLH; Domain location=370-418; Score =36.9; E_value=7.3e-08; Accession=PF00010.17; Description=Helix-loop -helix DNA-binding domain
MSVMYSPVLNYSDVEYQLWKNQDMDSSIGHPQQHCHQSNSGLLRYCSAPSSMLASLIDNTIHGCVNEEPFTSENQQQQQHYLPSTSSEMETMLSKMPPSNIGWSNSEPLQEFGGKPVKQEIGQSVPQGPPKQNGYSYGGSQLIYQSQQIQGLPNGSSIASISAFDGSFGAVNSMASEDSIQSKMGVRNCSNLFRQKSSPAGFFSIENDLAALREVGSFKDNDVSNGQATASTSGLHSSLTFSSRSSSCLKQMPPQIAENGNESLEENYDQSRNLVNDNGSSKCYIPSFTNEFWESSAFNAPKTENEDEIMFSTSNGLESQETDFSYQNHGLTHHLSLPSSSTKMSSIEMFLQIQGSVPYKIRAKRGFATHPRSIAERERRTRISERIKKLQDLFPRSEKPTSTADMLDLAVEHIKDLQQQVQILSDRKAKCKCTRNEKHYTRTCA

SEQ ID NO: 168564 - protein, 173 aa, Glycine max
  Coding DNA Sequence Number=SeqID_76879
MRRKRKSWTSKDETRDETCLEEKDETFETGPASFQWPEGSAWTSRTGNEALLWLRCWSHDLQGWVALLEAHPTLVLPENLTAAANRDSQNGIGGTNLEDKNQANYVEPFENVVREERGVTSTLATAEVHVDWTAMYTLSPRHHRVVMPPLPAHWPRAIGPCINGATEAYHPSW

SEQ ID NO: 168565 - protein, 428 aa, Glycine max
  Coding DNA Sequence Number=SeqID_76880
  Gene Ontology: Mol. function=nucleic acid binding; Cellular component= intracellular; Biological process=mRNA processing
  Homolog annotation: Hit_ID=A7QWV9; Match level="QueryCoverage=100%, HitCoverage=98%, E-value=1e-162, Identity=67%"; Hit description =Chromosome chr13 scaffold_210, whole genome shotgun sequence
  Pfam annotation: Domain name=G-patch; Domain location=353-398; Score =59.5; E_value=1.1e-14; Accession=PF01585.14; Description=G-patch domain
  Pfam annotation: Domain name=Surp; Domain location=149-194; Score =60.9; E_value=4.4e-15; Accession=PF01805.11; Description=Surp module
  Pfam module annotation: Pfam domain module=G-patch::Surp; Domain location=353-398::149-194
MDKGVPPSLFVNDGSFMERFKQLQQEQDKGKNVKLEDSKPIKVISGSLSPNPSFTKTPVDLKVNDTRKISQGGSSGKLAFSLKQKSKLVPPPVKLSADEDEEETEAGYVSNDAPLKRQKLGQEEGIDQSSRQLDVAPHSPSDPTVKKVADKLASFVAKNGRQFEDVTRQKNPGDTPFKFLFDERCAEYKYYEYRLAQEENALVQSRESQVPRNGGTSTSSSKQTNGHQRSSQQHTYQIPASALYESADNPRASGFSIQTSSVGSSEEPSGSSNADSLALMEFYMKKAAREEKYKQPKHSKDEMPPPASLLGKKGHHMGDFIPPEELEKFLATCNDAAAQKAAMEAAERAKIQADNVGHRLLSKMGWKEGEGLGGSRKGIADPIMAGNVKKNNLGVGAQEPGEVSAEDDIYEQYKKRMMLGYRYRPNPL

SEQ ID NO: 168566 - protein, 74 aa, Glycine max
  Coding DNA Sequence Number=SeqID_76881
MAKDRGFPLRDRLRLWISTMDSSETWSKAFPRVPSHAKLVLHAEQDIALSLELPAKQVSHAEPGLSRMEETILK

SEQ ID NO: 168567 - protein, 75 aa, Glycine max
  Coding DNA Sequence Number=SeqID_76882
  Subcellular localization annotation: CTP_CleavageSite=45; ConfidenceScore=5.35e-01
MESTKSMFMSLAVILFIALFSATVSAQGSPTPAPDGGAAGTVSSSASMIGAANMREFLSLGGVVTKLRLRKLRGH

SEQ ID NO: 168568 - protein, 93 aa, Glycine max
  Coding DNA Sequence Number=SeqID_76883
  Subcellular localization annotation: CTP_CleavageSite=46; ConfidenceScore=5.23e-01
MASQATSFKSFVIALIVALFFAAATAQDLSPAPAQGPDVGVAGSVSSSMAVIGASEFDTMVDYMEESSTKQGFQEQLEALQKKKWPPCNKSRR

SEQ ID NO: 168569 - protein, 528 aa, Glycine max
  Coding DNA Sequence Number=SeqID_76884
  Gene Ontology: Mol. function=nucleic acid binding
  Homolog annotation: Hit_ID=A7QWV2; Match level="QueryCoverage=85%, HitCoverage=64%, E-value=1e-118, Identity=52%"; Hit description =Chromosome chr13 scaffold_210, whole genome shotgun sequence
  Subcellular localization annotation: CTP_CleavageSite=57; ConfidenceScore=5.38e-01
MTMTTMVVKVVVEVVAMSMVVVVAVLVTELRGFSMTARTSSVTLPTKSRYALLFPLSASSHSPILSSVADFDTFESGLGDDRDGNRLIKANFSADGAVRLKESLMEKLKEFMGDYTDDTLVVGTMVRLPCELEVMGSDPGIGLCLQGNGRHKEQARNDLNVFLGENSDSFVSWLWDHLDIYLDSYVQPEALLDEAPKKRFIAEVQAGEDDSQHLNSQSERGKSSKLSRSRHNKDWKGLMRGEAESPSIRSSVVDNAHLELEANQGPRSLSPKPPVQKKRGRADEQPRMKRDVVSQVNIAAPRRLLQFAVRDAVATSRTATGMSVEPSLKRLRSVVSTSAGDSSFVERPQRMQLASRVSNPMATMIKAVAEAAEDVIKSKPSGSVFDRLGRGIDTSDDNRQLEDSYQHQEQHHLFHSQRTEYNGGYAANTTMAGHETGYPSDSNSDNEGFNDINVMDHRVSGASQIRPSVGNRGNDSLMVQYSVAKNVDDSLRQKRNREQEQLAASPNTSHKIVNISVNVNTWKPPQHQ

SEQ ID NO: 168570 - protein, 257 aa, Glycine max
  Coding DNA Sequence Number=SeqID_76885
  Subcellular localization annotation: CTP_CleavageSite=57; ConfidenceScore=5.11e-01
MGKVGIGFVHFLGIVLPPGIISAPTNSSRSTFFVVKTNQIQKDIENFAHKGQESLAEASESVSSNNKTIFDVAGGGNLILKPPLEAIWIIKNMSFNPYNNSRDERILRRQVNQILAFTLPPFTCDKCGEAHAAGEFLVSDALAQALEDDGGITQPLLEGLEGAKLFCLKSYCHTSFNSQTEANAKKEEVNVMSTRNRSKDVEVLIEAQWSLVARGALGLEALNFTDERRSKIFRGNGEGSTHKSKRKGELYAQNQSE

SEQ ID NO: 168571 - protein, 223 aa, Glycine max
  Coding DNA Sequence Number=SeqID_76886
  Homolog annotation: Hit_ID=Q2HVW0; Match level="QueryCoverage=31%, HitCoverage=50%, E-value=7e-07, Identity=41%"; Hit description =Putative uncharacterized protein
  Pfam annotation: Domain name=RRM_1; Domain location=89-159; Score =38.8; E_value=2e-08; Accession=PF00076.13; Description=RNA recognition motif. (a.k.a. RRM, RB
MLYTYTTCVQDFFMQSLQSVGLYMHREGERMRGERNRGWERVRERGKAFERDRVRLRERHQYTQNRLKDRNQRHCNQTNWRDRTEITSFYFTRFSDECTEKELWQHFKKWGDVREIFISKQRNKNGRRYGFVRFKGVEDERKLESQLDNMVIGGLKLYVNLPRYGRQRGEKKTTEVLQPQPHNPPIWNKHEVAHHTQRNRRTYHLSYAEAVAGRRNGTHTHED

SEQ ID NO: 168572 - protein, 263 aa, Glycine max
  Coding DNA Sequence Number=SeqID_76887
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=A7Q2B1; Match level="QueryCoverage=99%, HitCoverage=99%, E-value=8e-73, Identity=56%"; Hit description =Chromosome chr13 scaffold_45, whole genome shotgun sequence
  Pfam annotation: Domain name=OSCP; Domain location=82-254; Score =205.2; E_value=1.5e-58; Accession=PF00213.9; Description=ATP synthase delta (OSCP) subunit
  Subcellular localization annotation: CTP_CleavageSite=47; ConfidenceScore=5.48e-01
MALCNRVRSGISLFTKSTFLTSQRSTLQRSLVAPFISLASRNYANVPGQKETKVKGLVAPHHNELRFKSLLGEVPLALFGGSGNYASALYIASVKANAVEKVETELLQFVEAVKNSPIFSQFIRDLSVAKDVRVKVIQDICGEAKFSDVTKNFLVIVAENGRLKNIDTIAKRFAQLSMAYKGEVQATVTTVVPLPPEEEKALKETLQEIIGSGAKVHLEQKIDPSILGGLVLEFSQKVFDMSIKTRAQQMERILREPVSIANI

SEQ ID NO: 168573 - protein, 176 aa, Glycine max
  Coding DNA Sequence Number=SeqID_76888
MDSSVGFIRPLALELQQLAFAALYLSTPGVQKSATMKAAVAVIEGKLRVFQDAGIKTPRLRATIPSSPFRETINQDPIAARPVRGDLLRQLSNNRQSSWEQLEEIAGLNSKNTATASAAKQHINSINKKGTGYFMRQQRERIGGEWNSVIRGASRIRGVDNLDGSYGQRMLISGGA

SEQ ID NO: 168574 - protein, 281 aa, Glycine max
  Coding DNA Sequence Number=SeqID_76889
  Gene Ontology: Mol. function=thiosulfate sulfurtransferase activity; Cellular component=mitochondrion; Biological process=sulfate transport
  Homolog annotation: Hit_ID=A9PCY9; Match level="QueryCoverage=81%, HitCoverage=59%, E-value=6e-93, Identity=73%"; Hit description =Putative uncharacterized protein
  Pfam annotation: Domain name=Rhodanese; Domain location=67-187; Score= 81.9; E_value=2.1e-21; Accession=PF00581.11; Description=Rhodanese -like domain
  Subcellular localization annotation: CTP_CleavageSite=41; ConfidenceScore=5.45e-01
MAYVSYFNFSMFGVEKRLFCIRAVPVSASTSQNIKTTGWAPCMASSSVGRRATYSTQSVSTNEPVVSVDWLYDNLKEPDIKVLDASWYMPDEQRNPIQEYQVAHIPGALFFDVDGIADRTTKLPHMLPSAEAFAAAVSALGIENKDDLVVYDGKGLFSAARVWWMFRVFGHDRVWVLDGGLPRWRASGYDVESSASSDAILKASAATEAIEKVYKGQTVGPLTFQTKFQPHLVWNIDQENNTLEKWRLTMLVVVEVSKIFLLESIISYLKDEVRFEVAAAI

SEQ ID NO: 168575 - protein, 171 aa, Glycine max
  Coding DNA Sequence Number=SeqID_76890
  Gene Ontology: Mol. function=protein-tyrosine kinase activity; Cellular component=MHC class I protein complex; Biological process =protein amino acid phosphorylation
  Homolog annotation: Hit_ID=A7Q2A8; Match level="QueryCoverage=94%, HitCoverage=47%, E-value=1e-50, Identity=59%"; Hit description =Chromosome chr13 scaffold_45, whole genome shotgun sequence
  Pfam annotation: Domain name=Hin1; Domain location=10-146; Score= -9.6; E_value=0.01; Accession=PF07320.4; Description=Harpin-induced protein 1 (Hin1)
MSPFYIFGCYINLQIARFPEFKLAEGIDRSGVTTKILTCNCSLNLIIENKSRFFGLHIRPPTMDMKFSNLPFAFSNAPELYAESGITIFALQLGAKNKPMYGAGRSMQDMLDSGTGLPLVIRVILSSSFKVVPSLIKPRFHHHAECLVFLKKAYDKKHRTLAFDSTCKVTS

SEQ ID NO: 168576 - protein, 76 aa, Glycine max
  Coding DNA Sequence Number=SeqID_76891
MVEEEETRRRNVPRRRSINSKMKQKRKEEAFHLIPTTMAATKMRKKQKHEEEDFTWEEEAARRRRRTLKMQNKAVE

SEQ ID NO: 168577 - protein, 220 aa, Glycine max
  Coding DNA Sequence Number=SeqID_76892
MEAMKDQMTTMMKAMMSVRKMMEVNAAAVTATSAAIEVDLTHPSGINQSKHPILPYGLPPNYAPSNVAHAPDENVDNSTPIPIVSQKPQSSHAHVPQPMGETHEVPRDHTLAEFEPHVGYAIKGQAFGGVPLPNALGGPQYRPQPQLQPLHFTMGRLPPAMVEREKFDHIEERIRTIEGGGDYPFVNMAKLCLVPDVIISPKFKVLDCDRYKGTTFPRIT

SEQ ID NO: 168578 - protein, 140 aa, Glycine max
  Coding DNA Sequence Number=SeqID_76893
MCPHKFSEDDLILKKVSQVQKDHRGKWAPNYEGPFMVKKMAPKIFFAKRATKATTWEGSSAAPQAEIAFDGHHFRCEEHECLFEPMAKYDPEVVMEFYTNTWPTEEGVMDKRSWVWGQWIPYDTDAINQFFGHPLVLEEG

SEQ ID NO: 168579 - protein, 148 aa, Glycine max
  Coding DNA Sequence Number=SeqID_76894
MASPSPNLFRSLEPQAQRETIKIACKEKPLKSPNVHVHHDHQHQCTKTRNNSMLPKTLGCFKYSILLPANSSTGTLNSTSSSSSPSATANRRRLLHPLPPPELLPLGSPLKNTRHRTDRKPRKLRNCVFYSNETKLAEKNSTGNIKSC

SEQ ID NO: 168580 - protein, 295 aa, Glycine max
  Coding DNA Sequence Number=SeqID_76895
  Homolog annotation: Hit_ID=A5AYG1; Match level="QueryCoverage=92%, HitCoverage=76%, E-value=1e-68, Identity=50%"; Hit description =Putative uncharacterized protein
MLKAVAPLFSRSHKQQSRSFKEYYAEWFNTLKNNHLPLLRHSISGDSLTILSTHVEMLHQHFQSYYHALDAAATSDASQLLSQEWRNSLEKPLLWLGDLHPSLFTNLARSFLQDEHSPDHTDDEDDSDPHHHHHHHHHFPLPERPWQVAMAWRNPSEALTARMDQIECGLRVIVPALSDRLKHAEDAFVGRVMGNWFRCRDHHHKGSGASSKVAVGADVKAHMEELVSVFLYANRLRRNVLVDILSATTVYQAALFLEGLAQFLIGFRDHELVNAVEHCKALPLANNKQCRPRCH

SEQ ID NO: 168581 - protein, 117 aa, Glycine max
  Coding DNA Sequence Number=SeqID_76896
MDHSNSFEEGLIWSDIMQYLKGRNQLLWEGVPLPFHAKKTVSRAEMFYADWLLARKFDGYIENGSTTNMSEGDARGGFIAGKAAWRERLLDCYKLYNGLAILILFHFTNFRVEFVRR

SEQ ID NO: 168582 - protein, 134 aa, Glycine max
  Coding DNA Sequence Number=SeqID_76897
MSSGRSGEEGFFSSRTPIKDALTYKLGTVGHYDGIVGAYWCLGCMDGAIVCPNGSSSPPSSHQIVSQHRRRIIVLSDLCIVVLVVSRALQSRTKWSNDGDINPLHCPSYTFMTSTSQPARRRGGEHVEMEGGDD

SEQ ID NO: 168583 - protein, 403 aa, Glycine max
  Coding DNA Sequence Number=SeqID_76898
  Gene Ontology: Mol. function=hydrolase activity, acting on ester bonds; Cellular component=cellular_component; Biological process =lipid metabolic process
  Homolog annotation: Hit_ID=A7PDQ4; Match level="QueryCoverage=86%, HitCoverage=89%, E-value=1e-145, Identity=69%"; Hit description =Chromosome chr11 scaffold_13, whole genome shotgun sequence
  Pfam annotation: Domain name=Lipase_GDSL; Domain location=48-362; Score=172.6; E_value=1e-48; Accession=PF00657.13; Description=GDSL -like LipaseAcylhydrolase
  Subcellular localization annotation: CTP_CleavageSite=51; ConfidenceScore=5.32e-01
MAKQNFPMDCSFVCITLIQFIASMSFSKSQSLINETNTSTTTTTTKAFFILGDSTVDSGNNNYINTIPENKADYKPYGQNGFFQEPTGRFSDGRVIVDFIAEYANLPLIPPFLQPNADYSNGANFASGGAGVLVETNQGLVIDLQTQLSHFEEVRILLSEKLGEKKAKELISEAIYFFSIGSNDYMGGYLGNPKMQESYNPEQYIRMVIGNLTQAIQTLYEKGARKFGFLSLSPLGCLPALRALNPEANKDGCFEAASALALAHNNALSNVLTSLEHVLEGFMYSNSNFYDWLRERIDDPPNYGFNDGVNACCGSGPYGGVFTCGGTKKIKEFSLCDNVGDFVWWDSFHPTEKIHEQFAKALWNGPASSVGPYNLENFFNKEIKLTIADVVDAPEIHHGEFHY

SEQ ID NO: 168584 - protein, 60 aa, Glycine max
  Coding DNA Sequence Number=SeqID_76899
TVTARAKDVLTKWNRVKVPTETFESNKSQFVPHWNPSPIGSTRSSAMLMRHSLHTWGVSV

SEQ ID NO: 168585 - protein, 122 aa, Glycine max
  Coding DNA Sequence Number=SeqID_76900
  Gene Ontology: Mol. function=transition metal ion binding; Cellular component=chloroplast thylakoid membrane
  Homolog annotation: Hit_ID=A9NRG1; Match level="QueryCoverage=36%, HitCoverage=16%, E-value=4e-13, Identity=79%"; Hit description =Putative uncharacterized protein
MEGTLIKGPPLRPPVQLGEITAEELKAYDGTNPEKPLLMAIKAQIYDVSQSRIMVLVHGKVMPLFVNFLQFYGMYIEICKFVLLGENCAEQCVPVRVIRGHESSSNYTGKVYTYDGLYKVIL

SEQ ID NO: 168586 - protein, 216 aa, Glycine max
  Coding DNA Sequence Number=SeqID_76901
  Gene Ontology: Mol. function=nucleic acid binding; Cellular component= nucleus; Biological process=mRNA processing
  Homolog annotation: Hit_ID=A5AQI8; Match level="QueryCoverage=21%, HitCoverage=10%, E-value=1e-15, Identity=85%"; Hit description =Putative uncharacterized protein
MSTTISTAMTERARGRPSPRTFLWSSQERERETERGKTGIRIERGGIRIRIGETVIGTESAREERRIWSERGNEQRGRDPQGAGVAPRGTETGSEILICAMPVLTSQLLVYLKSVSISRILFKELSMAAVTPLQTPYLGALGIHLATLTLRFSRIHDVGIMLLYISRRFRDKKEVAEPEADPERDLRTVFAYQMPLKATETNVYEFFSKGGKVSCF

SEQ ID NO: 168587 - protein, 88 aa, Glycine max
  Coding DNA Sequence Number=SeqID_76902
  Gene Ontology: Mol. function=nucleic acid binding; Cellular component= nucleus; Biological process=mRNA processing
  Homolog annotation: Hit_ID=Q9FT01; Match level="QueryCoverage=56%, HitCoverage=12%, E-value=3e-18, Identity=90%"; Hit description =Putative splicing factor
MVKPSEAEKNLVQSNASGGAAGVTGPYGAVDRKLYVGNLHFNMTESQLWESWSDSVGNSDTELSKNRNYIIEDTAFKVGYYITTVFEC

SEQ ID NO: 168588 - protein, 72 aa, Glycine max
  Coding DNA Sequence Number=SeqID_76903
  Subcellular localization annotation: CTP_CleavageSite=45; ConfidenceScore=5.09e-01
MGLIATPMPSYLKLIMGSWPPMASKVKLVVAQRPRLLHHISMGIVASTTFVSDCPTNDPNTRLNVEFPTYIS

SEQ ID NO: 168589 - protein, 121 aa, Glycine max
  Coding DNA Sequence Number=SeqID_76904
MARNHQKMGQCVEHQSSNTIQQCPYHRLLLLYKLINFRRGGCSFSYLMYGRRACDNLLLNVQWELHPVSGRSEFHVQSPLNVVSILKKKGHKKMHPCNVIDSEVGVDGGWSLMLEVVKVDG

SEQ ID NO: 168590 - protein, 404 aa, Glycine max
  Coding DNA Sequence Number=SeqID_76905
  Gene Ontology: Cellular component=ribosome
  Homolog annotation: Hit_ID=A2Q6B4; Match level="QueryCoverage=41%, HitCoverage=86%, E-value=1e-15, Identity=27%"; Hit description =Ribosomal protein L33; Nucleic acid-binding, OB-fold
  Pfam annotation: Domain name=DUF223; Domain location=40-135; Score= -5.0; E_value=0.0087; Accession=PF02721.5; Description=Domain of unknown function DUF223
MARILDKIKSIDGSRETLKLAVRITNLWFVGTPNKSEQAEMVIVDSEGDQIHAICKADQLKSWKADLKENSTYVMHNFKAVKNDGQFRVCEHQYKLVFTGVTIVRESDLHQLPFKEFRFVEFGNVIGGNFEAGLLVDIIEFADQFLAYLNERGNDGPIVIILTHARIKDAQGSYPPSVSNSLKASKLLINEPILEIQEFRERILDLGVEVSPVLAPGDQESSQLSGASQLSSKDAFLSKAEAKTISEINAISEVVQYRVEVMVSQNNDSSKFLLWDRECTELIGQTADEVNRVKIEDGDVDLNASPQALDRLLGYVLAFKVRIQSKFRNVVVLRYSNELDFINVVLEMLADTETCSKIDASNVDCNDATHVKCQSLSVTTDHDPVAGFPLTPKKAYHLMKLMMN

SEQ ID NO: 168591 - protein, 58 aa, Glycine max
  Coding DNA Sequence Number=SeqID_76906
MTTYPSPFLRPPPRPSVAIVCDHVQVYQRSLEFLWRNSFFTLKIFDHPLLGDPHKAKS

SEQ ID NO: 168592 - protein, 93 aa, Glycine max
  Coding DNA Sequence Number=SeqID_76907
  Homolog annotation: Hit_ID=Q6UUU1; Match level="QueryCoverage=63%, HitCoverage=40%, E-value=1e-18, Identity=79%"; Hit description =Putative uncharacterized protein
MAYERGGDFLEDARKILNREVRGPRQSRFSIGSAPLTSITKSDAQISGGETRQDYKDTRRFPLAASLVRSPVPAFRFTGVIPLLWAAFVSFHA

SEQ ID NO: 168593 - protein, 159 aa, Glycine max
  Coding DNA Sequence Number=SeqID_76908
MQDKIDCNKINEIREERNVNSIYTGSTTSRAYIQYSSNPLEIFHYLCKTPFTKSKPHKDNPSLVFKIPYNLRDPRSFKQALCIKRIKRNSLLKRRILQLKFMDELLMDLQVFAQEFLLREHLAMKFSWNLSHCFLKFLIPLVGQMWPINRISLRKWKVR

SEQ ID NO: 168594 - protein, 197 aa, Glycine max
  Coding DNA Sequence Number=SeqID_76909
  Homolog annotation: Hit_ID=Q6WAY4; Match level="QueryCoverage=85%, HitCoverage=30%, E-value=8e-20, Identity=36%"; Hit description =Putative uncharacterized protein
MGTNQNGKRFYQVKVKGLDVTSLKELGRLMGPLQRQAFRKVYEKILDLTTAEVFTEAVVSLAQYYDQPLRCFTFRDFLMVPTVEEFEEILGCPLGGRKPYLFSGFLPSLSKIAAVVGDSSKELDRMKQTRNGVVGLPRKYLEGKARDMASQEKWGPFTDILALLIFGVVLFPNVDGLVDLAAIDAFLAYHHSKESLV

SEQ ID NO: 168595 - protein, 85 aa, Glycine max
  Coding DNA Sequence Number=SeqID_76910
  Subcellular localization annotation: CTP_CleavageSite=74; ConfidenceScore=5.49e-01
KIESKCFRNASVSDPVEILHRSSSFFTVLHPFFVRSSFFNGPRLFRFFRRFPQINVGGDSARIPFLEHAPVSPRAALPPKGRLRQ

SEQ ID NO: 168596 - protein, 22 aa, Glycine max
  Coding DNA Sequence Number=SeqID_76911
MARSVFASCPYFRDLHGRVIEA

SEQ ID NO: 168597 - protein, 396 aa, Glycine max
  Coding DNA Sequence Number=SeqID_76912
  Gene Ontology: Mol. function=motor activity; Cellular component=cell projection
  Homolog annotation: Hit_ID=P15305; Match level="QueryCoverage=97%, HitCoverage=77%, E-value=3e-26, Identity=23%"; Hit description =Dynein heavy chain
LHALAFEGLHALTFRGLHALAFVGLHVLTFKGLHVLTFRGPHVLTLRGLHAHAFRGLHALAIRGLHVLAFRGLHALTFRGLHGLTFRGLHVLAIKGLHVLAFVGLHALTFRGLHVLAIRGLHALTFRGLHVLAFRGLHVLTFRGLHVLTFRGLHVLTFRGLHVLAFVGLHALSFRGLHVLAFIGLQALTIRGLHALTFRGLHVLAFRGLHVLTFRGLHVITFRGLHVLTFRGLHVLAIRGLHSLNFRGLHVLTFRGLHALAFIGLHAITFRGLHALAFRGLHVLSFRGLHVLAFRGLHVLAFRGQHAFIFRGLDVLTFRGLHVFAIRGLHILAFRGLHVPTFRGLHVLTFGGLHILTFRGSHVLTVRGLLALAFRGLHVLTFRGLHVLHLQRATRP

SEQ ID NO: 168598 - protein, 105 aa, Glycine max
  Coding DNA Sequence Number=SeqID_76913
MLAIIIKYQEELNLATAHEHKVADEYAQVYTEKEARGRVIDSLHQEATMWMDRFALTLNGTQELPRLLAKAKAMVDTYSAPEEIHGLLSYCQHMIDLMAHIIRSR

SEQ ID NO: 168599 - protein, 284 aa, Glycine max
  Coding DNA Sequence Number=SeqID_76914
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
WNSYVPINVSFSPKVSPELPEYQQRHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLNSILRYGSAAVSDPLAEDPPPLPPRRGWGGEARVPPATAVVAECGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168600 - protein, 238 aa, Glycine max
  Coding DNA Sequence Number=SeqID_76915
  Homolog annotation: Hit_ID=UPI00006A2D9E; Match level="QueryCoverage =41%, HitCoverage=82%, E-value=9e-09, Identity=18%"; Hit description =UPI00006A2D9E related cluster
DYAFSPSEDSTSSPEEGNTHSPLDELHVLPFRGLHVLALRGLHALAFRGLHALTFKGLHAIAFRGLHALAFRGLHVLIFIGLHALTFRGLHLHAFRGLHALAFRGLHVLAFRGLHALAFAYAPGLGASSLLLSVPRPPPDIGGRPTVDRAHKTPCGPEEVQQGPRVSSSGYGPLSVLPGIAPTRHPVDPEKSNRVLGFPALITDLCQFYGVPVAPIKVIRPLINRAFIKKYCAPQEGA

SEQ ID NO: 168601 - protein, 100 aa, Glycine max
  Coding DNA Sequence Number=SeqID_76916
MLGLRIGFPSKTNFQMGIHTIRQMGIHNDKGWEWKFSWRRLLFDNEIDTTINFLREVEGQTIQQQQTDIWKWLGDPSGNYSTRSAYNLIWEEIVGGQKED

SEQ ID NO: 168602 - protein, 89 aa, Glycine max
  Coding DNA Sequence Number=SeqID_76917
MNISKDTNIPVILGRPFMLTASCIVDMGKRKLELGFEDQKIDFDLFFEDKPAPEHNVCLQLSEPRDPLSESCRFSNLQISLSGRINALS

SEQ ID NO: 168603 - protein, 150 aa, Glycine max
  Coding DNA Sequence Number=SeqID_76918
  Homolog annotation: Hit_ID=A5BTR2; Match level="QueryCoverage=100%, HitCoverage=13%, E-value=1e-20, Identity=42%"; Hit description =Putative uncharacterized protein
  Pfam annotation: Domain name=zf-CCHC; Domain location=46-63; Score =22.5; E_value=0.00059; Accession=PF00098.14; Description=Zinc knuckle
MCVREEERLIMQEGERVNLTVHGKKKGDQPKNKGKIPAQPVIKKESKCFLCKKKGHMKKNCLKIKSWTDKKGTPFAFVCYESNMGMENLRRPVGSEQHIYSGGKMSSHVESIGTCNLVATGVKQCVVNEESSMVWHRRLGHISIERIKRL

SEQ ID NO: 168604 - protein, 391 aa, Glycine max
  Coding DNA Sequence Number=SeqID_76919
  Gene Ontology: Mol. function=phosphoprotein phosphatase activity
  Homolog annotation: Hit_ID=A2Q4S5; Match level="QueryCoverage=77%, HitCoverage=53%, E-value=9e-28, Identity=28%"; Hit description=IMP dehydrogenase/GMP reductase, putative
  Pfam annotation: Domain name=DUF1723; Domain location=96-145; Score =71.1; E_value=3.7e-18; Accession=PF08330.1; Description=Protein of unknown function (DUF1723)
MTGAVDAVQTEGVATDGSLGSPVADVGFPGGPRNPSILTDFAEHVAHSIWSGQERPDLKMVSHGRKVDKIGRPAPEIEGLIAGTRLSLLIRRSIITTDPGLISAFVERWHRETNTFHLPVGELTITLDDMASLLHLPITGALHTFKPLVTSDAIGLLTELLEVSHEEATFETRQAGGPHVQLGWLRDLYESQCRARRWVVAARTYLLHLWVVLFSPTRVNPCTCRAPGGFQGPGPGKGICLGSDYISPHCWIYEHFPIVHTSVVHDAYDDGSPRACRWLTGKAHMTGIKGVPYRRRLDALNVTDVCWMPYDHLVPSGELCVVPGQVAPDYMKWFFRISHPFITWTEETATPRHPPPPHHEEFVEPPIPEVLVAINLPTHSVVHWEGCQGMA

SEQ ID NO: 168605 - protein, 48 aa, Glycine max
  Coding DNA Sequence Number=SeqID_76920
MIQVYKLGLGLGFEALDFLIYCRKQKCLRRTGKRQKCLRMSDRFRGQT

SEQ ID NO: 168606 - protein, 48 aa, Glycine max
  Coding DNA Sequence Number=SeqID_76921
MTHGRPIGDQVQSLRTHLVSHDPRNLNKTSASSKGSHTSQNICMCVYV

SEQ ID NO: 168607 - protein, 117 aa, Glycine max
  Coding DNA Sequence Number=SeqID_76922
MWLKGVKTPVVLSRNCDERAKRACALSLFIATVKIMDFQMNVLSGPCRAKRMASKKRKAPFTPTQARFDRSRFTSPEAWQRYTDIVMPQKLLPERNVVVYYTEFDEFKEELERRHWD

SEQ ID NO: 168608 - protein, 60 aa, Glycine max
  Coding DNA Sequence Number=SeqID_76923
GAVLRVPDPPDDVFQLYLVKKIVSVKKIQAEVLPRCFRKQIREGFPPLFTVLHPFFVLQR

SEQ ID NO: 168609 - protein, 117 aa, Glycine max
  Coding DNA Sequence Number=SeqID_76924
MAISSNNHTTKAYMTFSVFASCPYFVEARLHGESKVIQRCFDDNNDDDKGDDKKLKDQSKNNSSESRTIQEFKNQEEFKTQEESLESRIKIQGSRSQKSRSKIQDSRFKNEEKTQSR

SEQ ID NO: 168610 - protein, 191 aa, Glycine max
  Coding DNA Sequence Number=SeqID_76925
MVGDLHAFQPLHVDDAVQMLVDLLMVFAESVRAETAQCREPYVRLQWCWIYEHFPSVTDSIADQEYDEDSPRACRWIAMKKTVKSIHTYTNVQGAPGPNPDSGCLLDLRVVRQFGYRQTIPSPPVDSWVSYDDIHDRWMHYSDHIVPAGEVCAMPAPSRPLDPTDGYPSRAGARSIVDICGGAETCSGSLR

SEQ ID NO: 168611 - protein, 129 aa, Glycine max
  Coding DNA Sequence Number=SeqID_76926
MDRARLVYGLVTGMDMNIGALISGQISTISQSNSSRLGFPALITALCRARGVTSDSLTYESLSPTINLAYIKKNCWNVDDLTVNIRGARKGRHHPLGNKPWKKELHHQECALDKKLEEDALMEEKKERR

SEQ ID NO: 168612 - protein, 45 aa, Glycine max
  Coding DNA Sequence Number=SeqID_76927
MEVEEPWLGLRLLLSYRVDMGARVAFVVGLEMAFVIDLVVGNEKS

SEQ ID NO: 168613 - protein, 28 aa, Glycine max
  Coding DNA Sequence Number=SeqID_76928
MARRLQEDWARDVGEGPRVLMSLRGSIV

SEQ ID NO: 168614 - protein, 153 aa, Glycine max
  Coding DNA Sequence Number=SeqID_76929
  Gene Ontology: Mol. function=aspartic-type endopeptidase activity; Biological process=RNA-dependent DNA replication
  Homolog annotation: Hit_ID=Q69F85; Match level="QueryCoverage=45%, HitCoverage=3%, E-value=4e-09, Identity=41%"; Hit description=Gag -pol polyprotein
MERQIDLTFVVRRLSCDTEQPSTWKNLSNTRAKFEPRLYQPRKRSISPTLTRLGRGDEGINCPENLITPITPHSASKSHILDQALATEILAMPKRANTPPKANFSKLYRYHPNRGHSTKECSILKDKIEDLIKVGTPKGFYPQASFISAQQQL

SEQ ID NO: 168615 - protein, 119 aa, Glycine max
  Coding DNA Sequence Number=SeqID_76930
MGEVDEVQEQIKANIEALKEQMATMMEAMMSMKKIMEVNAAVVAATSTVAKVDPTPSFGLNQINHPTSDMIGREAKNWELPTIHHPMWCTLPMRMSVTPLPYPLRANNPKLIMHMSLNP

SEQ ID NO: 168616 - protein, 324 aa, Glycine max
  Coding DNA Sequence Number=SeqID_76931
  Gene Ontology: Mol. function=motor activity; Cellular component=cell projection
  Homolog annotation: Hit_ID=UPI00006A2D9E; Match level="QueryCoverage =70%, HitCoverage=100%, E-value=2e-13, Identity=17%"; Hit description= UPI00006A2D9E related cluster
GQHVLAFRGLHVLPFRGLHVLTARGLHALPFRGLHAFTFRELLVLAFRGLHPLAFRGLYVLILRGLHVLMFRGLPSSLSEDCTGLHVLAIKGLHVLTFRGLHALAFRGLHVLAFRGLHALALKELHAIAFRGLHALALRGLHVLGFRGLHVLAFRGLHLLPFRGLHVLAIRVLHALPFRGLHALAFEDYTVARPRLHRATRLYLQRTIRLRLQRATRPHLQRATCLRLQRATRPRFQRTISPHLQRTTCPHLQRTTRPRHQRTTHPRHQRAIRLRVQRTPRPRLQRTACPRLQRATRLRLQRTTRPPLLRTTRPRNQRTTCPYL

SEQ ID NO: 168617 - protein, 141 aa, Glycine max
  Coding DNA Sequence Number=SeqID_76932
  Gene Ontology: Mol. function=protein dimerization activity
  Homolog annotation: Hit_ID=Q9ZU73; Match level="QueryCoverage=34%, HitCoverage=15%, E-value=1e-07, Identity=55%"; Hit description=Ac -like transposase
MILDPRMKLEALWFYYSKLDASTCDEKINNIKEKMYKLFDEYVIVKSSSSTASSSQQPTVEEDFSIEENQEMDDPYNEYINYVSQNVGARVLNKYHASLLPSNVQALILTQNWINGFEDIDEINGDVEKEEEVVLDFAVHP

SEQ ID NO: 168618 - protein, 51 aa, Glycine max
  Coding DNA Sequence Number=SeqID_76933
MDRKRIKVIPEWPTPPSVVERIHEFQEPLDLRSNPFQGGGNDAILPPKGIG

SEQ ID NO: 168619 - protein, 89 aa, Glycine max
  Coding DNA Sequence Number=SeqID_76934
MVATPRVFLSWKMHPRAPRRPPAEGPYATKLIPRTVYYHAQPVSQRALLRASEGEAHGCAFHLRRKGARSRHQRLFVENVEKTEGNWSK

SEQ ID NO: 168620 - protein, 297 aa, Glycine max
  Coding DNA Sequence Number=SeqID_76935
  Gene Ontology: Mol. function=nucleic acid binding
  Homolog annotation: Hit_ID=A7PJ72; Match level="QueryCoverage=90%, HitCoverage=49%, E-value=1e-96, Identity=45%"; Hit description =Chromosome chr12 scaffold_18, whole genome shotgun sequence
  Pfam annotation: Domain name=TPX2; Domain location=231-287; Score =39.5; E_value=1.2e-08; Accession=PF06886.2; Description=Targeting protein for Xklp2 (TPX2)
MKKGALILQHRLKRLTQGLHSNQLYAPSWKHHITEPKTPLLQTSLRAHPPKVKTSLELEQEELEKIPKFKAIPLNKKIFESKGDIGVFCLTKKHVSEPQEFHFATDERIPPPAAMADLFGKLSLNSEPSRNHNPIPRNTTPNPFHLHTEKRGAEKEKKLAMDLLQKQWEEENARIPKANPYPYTTDYPVIPAKPEPKQCTRPKPFQLESLGPNPRSEKVRKPLTQVQEFSLHVNHWAVDTAQFDERNTEKEMMYKRYREESEATTMIEEEKELKQMRRTMVPHARPGPNNMQDLPEI

SEQ ID NO: 168621 - protein, 74 aa, Glycine max
  Coding DNA Sequence Number=SeqID_76936
MTPLMPICSTNACTVHHLFDSCNVYYVISMIFKALVILVYSYRKCDSQSSSFEVNEDVKSQAMAKNLETNSEPG

SEQ ID NO: 168622 - protein, 401 aa, Glycine max
  Coding DNA Sequence Number=SeqID_76937
MMIGCGITWMLWKLRRIDGDPTLRGTRIRATWEYVSSVGGGQQGMGETSCFYSLTIEWYLEICRGGQETLGTRAPGSQQIKGTKTTKLGGLLKNEDRRLRWSLVIDYQGVQHVLEASGNRLPGCVIDYTEEHVIGNRLPVRLCNRLPEMKSLKIPLLLACSGYEMHCVATAIVMAAQLIHDRVEMECLEGAWKTLKGNTRCRFRGTIRFTATSLVHPDEPAHTLQRTVEWILPTPTPYRLVEPVHVIEVTSSEEDPEEDPEELPPEPAVDALDFLEGDEDPLPEVDSPEDVMSASEADSMEDSGPGEMAISGGSSSYKYLEVMSDQKEMTPNRVVNWPFRTLYHYFGDATGTTHPLCSGILTTQETLGPLIPFQNVCPRVLERAFGNEVLLESLSFSFERG

SEQ ID NO: 168623 - protein, 78 aa, Glycine max
  Coding DNA Sequence Number=SeqID_76938
MELMISFELQMNQGTFPVHVQNVGSVIDEGKQKKARKVMFDFIRSFFPQSSKSMEIKLEASNVKCSILIYNQDDTISP

SEQ ID NO: 168624 - protein, 60 aa, Glycine max
  Coding DNA Sequence Number=SeqID_76939
MEKIDGLRILKMKVREFFTHGEVEFYFNGDYVILRYERSVETHFKQRKRSPVIKEGDEDA

SEQ ID NO: 168625 - protein, 173 aa, Glycine max
  Coding DNA Sequence Number=SeqID_76940
MWLTKGCRRTILAGWCMWERLRSFVVLPVRRGCHSPWVRSGKVWEDCSSLWGRLTQAFSWSWSVFSFVNSSSWRRSISAMQFWSCCRMHVSVIDAEQGWESVRGVSCLRSDRVLTMDECERIDKKSWGIFYRGPMVGWTWLSGVPNFTRRLGEVPLTGEQTCKTKDSDAQVRI

SEQ ID NO: 168626 - protein, 118 aa, Glycine max
  Coding DNA Sequence Number=SeqID_76941
MASYGVASPFIFLLLHSTAIRPQEAKESIDEEDPRPTSSTWSYIKAPKVTATQTDGRIRQKGRHYGGWKYLGKLEEEEGETKNLESTKSSKKAWKQEGNEQLPEIKRPLHLKGRQTLQ

SEQ ID NO: 168627 - protein, 89 aa, Glycine max
  Coding DNA Sequence Number=SeqID_76942
WIRKQYLPPPIPDERTRSSPPQRDASSTLMHEVLSELRGLRAFVGDHLDAMDSCLDAMDACFEGMDTWMTQLEDDMGFIHRCFNPPAAP

SEQ ID NO: 168628 - protein, 94 aa, Glycine max
  Coding DNA Sequence Number=SeqID_76943
MEAMKEQMTTMMEAMMSIRKMIEVNMATFVATSTTTEVDPTHPSGLNQVNCPASNMVAQGGKALGSTGSPHFVQVQSKHFFPPYGLPPNNTPPN

SEQ ID NO: 168629 - protein, 79 aa, Glycine max
  Coding DNA Sequence Number=SeqID_76944
MSASDTMSDSDDIGFNTMRVRVRVTKGFRGVDSEAGSVTQQKEGYEKSKSFKDVIPLESSRASNRYKATMLNRKLKAEF

SEQ ID NO: 168630 - protein, 56 aa, Glycine max
  Coding DNA Sequence Number=SeqID_76945
MRGCTFGFSPCLPAEGYIKGLSQPTLRQKGEARYNGASSKKENATELPLTFIRGKR

SEQ ID NO: 168631 - protein, 52 aa, Glycine max
  Coding DNA Sequence Number=SeqID_76946
MCGVATNVYLWKTSGKPKVDKSGAFAPTYPPLERKSDLRSSFLRVNQAILFT

SEQ ID NO: 168632 - protein, 103 aa, Glycine max
  Coding DNA Sequence Number=SeqID_76947
MAGILLFLKKQHILNVMWDQKEMTPNRVGRHNSLIAKKDFVVGEKVLLYNSRLELMSVEIKSESTDKSFKVNGHRLKPFLTNPSLVDVVVKETFLLHPTSLPP

SEQ ID NO: 168633 - protein, 114 aa, Glycine max
  Coding DNA Sequence Number=SeqID_76948
MAAQLIHDRVVMECLEGVWETLEVHPKEPAHTLQQPVEWILPTPTPYRLVEPVQVIEVSSSEEDLEEDPEELPPEPAMDDLDLPEDDEDPLLDVDFPEDIMSASEADSTEESGP

SEQ ID NO: 168634 - protein, 443 aa, Glycine max
  Coding DNA Sequence Number=SeqID_76949
  Gene Ontology: Mol. function=metalloexopeptidase activity; Cellular component=cytoplasm; Biological process=proteolysis
  Homolog annotation: Hit_ID=Q6DAP4; Match level="QueryCoverage=100%, HitCoverage=100%, E-value=0.0, Identity=77%"; Hit description=Xaa -Pro dipeptidase
  Pfam annotation: Domain name=Peptidase_M24; Domain location=168-438; Score=269.1; E_value=9e-78; Accession=PF00557.15; Description =metallopeptidase family M24
MDSLKTLYHAHISTLQQRAQQVLARFKLDAMLIHSGELLTVFLDDHDYPFKVNPQFKAWVPVTQVPNCWLWIDGVNKPKLWFYSPVDYWHNVEPLPDSFWTQDVEVIGLKNANDIAQLLPAQRDNVAYIGPVPSRAIQLGIRSEGINPQGVIDFLHYHRSIKTDYELACMREAQKLAVAGHRAAKEAFLSGMSEFDINLAYLTATGHRDIDVPYGNIIALNEHAAVLHYTRLDHQPPAKRHSFLIDAGAEYLGYAADLTRSYAAQSKTRYAEMVAAMNKEELALIATLKAGVRYTDYHLQMHQRIARLLLKFELVQGLSEETLVAENLTGPFMPHGLGHPLGLQVHDVAGFMQDDSGTHLAAPSQYPYLRCTRVLQPGMVLTIEPGFYIIDSLLAPLRSGKFSQHFDWQAIDALKPYGGIRIEDNVVIHASRIENMTRDLHLA

SEQ ID NO: 168635 - protein, 160 aa, Glycine max
  Coding DNA Sequence Number=SeqID_76950
  Homolog annotation: Hit_ID=Q0KIL1; Match level="QueryCoverage=53%, HitCoverage=9%, E-value=4e-07, Identity=39%"; Hit description =Gag/pol polyprotein, 3'-partial, putative
  Pfam annotation: Domain name=G-patch; Domain location=26-70; Score =14.7; E_value=0.0032; Accession=PF01585.14; Description=G-patch domain
MTFQSFEVVSIASIDSLSRQPRLFDAAMMVARVMLGHDYEPGMGLGKNNSGRTSLVSTRGNCEKFGLDYKPTQTDIRKNISERKNKGQGPRLGQRAKEALPGHISRSFICAGLRREGRVAAIYNDDSPTRSDLVRLCLPGFQLGNWRVEERPDVYAKSIM

SEQ ID NO: 168636 - protein, 93 aa, Glycine max
  Coding DNA Sequence Number=SeqID_76951
MPLAIYTFGYGSKMLGFVYMRLHVVFALKEMAPRKLASKRSRKDKVVEGTSSALEYDSHRFRSAEHQQRFEAIKGWSFLRERRVQLKTLKKRY

SEQ ID NO: 168637 - protein, 198 aa, Glycine max
  Coding DNA Sequence Number=SeqID_76952
MEAIKEQMATMMKAMMSMKKIMEANAVIVAAISAVAKVNPMLPSGLKQMNHPTSNMVGKDFGSTDDPMMCKFKTSTPSHHMACLPTIHHPMWHTLSMKISITPLRYSLRTNNLIDQAHISQTMGETHEIPHHNLADFEPWLGYATEGQAVGGISFENTLEGPQFRPQPQPLHFAVGRAPPAMAEKGKGGSSKGKAQGH

SEQ ID NO: 168638 - protein, 709 aa, Glycine max
  Coding DNA Sequence Number=SeqID_76953
  Gene Ontology: Mol. function=ATP binding; Cellular component =phosphopyruvate hydratase complex; Biological process=cell division
  Homolog annotation: Hit_ID=P0ABH3; Match level="QueryCoverage=57%, HitCoverage=92%, E-value=0.0, Identity=93%"; Hit description=Cell division protein ftsA
  Pfam annotation: Domain name=FtsA; Domain location=304-487; Score =257.2; E_value=3.4e-74; Accession=PF02491.11; Description=Cell division protein FtsA
  Pfam annotation: Domain name=FtsA; Domain location=497-673; Score =270.9; E_value=2.6e-78; Accession=PF02491.11; Description=Cell division protein FtsA
  Pfam annotation: Domain name=FtsQ; Domain location=166-284; Score =98.5; E_value=2e-26; Accession=PF03799.6; Description=Cell division protein FtsQ
  Pfam annotation: Domain name=MreB_Mbl; Domain location=423-670; Score= -243.5; E_value=0.00029; Accession=PF06723.4; Description=MreBMbl protein
  Pfam annotation: Domain name=POTRA_1; Domain location=93-163; Score =99.3; E_value=1.2e-26; Accession=PF08478.1; Description=POTRA domain, FtsQ-type
  Pfam module annotation: Pfam domain module=FtsA::FtsA::FtsQ::MreB _Mbl::POTRA_1; Domain location=304-487::497-673::166-284::423-670::93- 163
  Subcellular localization annotation: CTP_CleavageSite=73; ConfidenceScore=5.02e-01
MVDGDGNFQLLEVNTSPGMTSHSLVPMAAKQAGYSFPQLAALRVRNREPQERARSGRSNGARLFGIVFLLLVMGIMVAGGLVVLKWMNDASRLPLSKLVVTGETHYTTHDDIRQAILSLGAPGTFMSQNVDIIQQQIERLPWIKQVSVRKQWPDELKINLVEYVPVARWNDSHMVDADGVSFSVPASHIGKETLPMLYGPEGSEKEVLAGYHTMSDVLRASKFTLKVASMTARRSWQLVTSDDVRIELGRSDTMKRLNRFIELYPELQQQGQSQNQRISYVDLRYDSGAAVGWAPAPIEPQDRLEIGTAKVAALVGEILPDGMVNIIGVGSCPSRGMDKGGVNDLESVVKCVQRAIDQAELMADCQISSVYLALSGKHISCQNEIGMVPISEEEVTQDDVENVVHTAKSVRVRDEHRILHVIPQEYAIDYQEGIKNPVGLSGVRMQAKVHLITCHNDMAKNIVKAVERCGLKVDQLIFAGLASSFSVLTEDERELGVCVVDIGGGTMDIAVYTGGALRHTKVIPYAGNVVTSDIAYAFGTPPTDAEAIKVRHGCALGLIVGKDENVEVPSVGGRPPRSLQRQTLAEVIEPRYTELLNLVNDEILQLQEQLRQQGVKHHLAAGIVLTGGAAQIEGLAACAQRVFHTQVRIGQPLNITGLTDYAQEPYYSTAVGLLHYGKESHMNGDAETEKRASVGNWFKRINSWLKKEF

SEQ ID NO: 168639 - protein, 37 aa, Glycine max
  Coding DNA Sequence Number=SeqID_76954
MARLRVQSRLQLISASLRAICRCAGACTITRSSPTAA

SEQ ID NO: 168640 - protein, 58 aa, Glycine max
  Coding DNA Sequence Number=SeqID_76955
MAYERGGDFLEDARKILNREAFPPGGSLVRSPVLPSVYRCHSAVMAALSHSTPDTQFR

SEQ ID NO: 168641 - protein, 89 aa, Glycine max
  Coding DNA Sequence Number=SeqID_76956
MSDNLARASSAREYQIELQQSSMSLGRQIKVDEPIPDASSRLGIDNGSWSFSSLPGSMSGIKRERIAEYRSATYEAKPALPVELISSRD

SEQ ID NO: 168642 - protein, 24 aa, Glycine max
  Coding DNA Sequence Number=SeqID_76957
MELAVWIKLRIESDALAASNNKEK

SEQ ID NO: 168643 - protein, 75 aa, Glycine max
  Coding DNA Sequence Number=SeqID_76958
MDEIEKVQEQMKADPEALKEQMVGKDLGTPPAMAEKGKVDHLKERLRAIEGGEDYAFANLEELFLIPKHGHSQVQ

SEQ ID NO: 168644 - protein, 128 aa, Glycine max
  Coding DNA Sequence Number=SeqID_76959
GAEDDVSLCVLSGFSSLDSKKNVYTDNHSGISARQRDSNVSMTDLVSAEDDAFRLNRSKKVYTDNHSSISARQRDSNVNMTDLVSAEDDAFRLTDSKKNVYTDNHSGISARQRDSNVSMTDLVSAKDD

SEQ ID NO: 168645 - protein, 28 aa, Glycine max
  Coding DNA Sequence Number=SeqID_76960
MEESGIFFMEDAPMSLASLTCEREIVEL

SEQ ID NO: 168646 - protein, 102 aa, Glycine max
  Coding DNA Sequence Number=SeqID_76961
MATMMEANMSMKEIMEVNVATLLSWWYTPAKHFGRPSVSPTTAPLAFHTRLKPSWYGRNGKVGSSRGKAQSIERGVDYAFASLEELFLVPKHGHSQVQGARL

SEQ ID NO: 168647 - protein, 301 aa, Glycine max
  Coding DNA Sequence Number=SeqID_76962
  Homolog annotation: Hit_ID=Q6WAY6; Match level="QueryCoverage=49%, HitCoverage=23%, E-value=1e-10, Identity=33%"; Hit description =Putative uncharacterized protein
MANQGDWVPFMDVLALLIFGVVLFPNVDGLVDLAAIDAFLAYHHSKESPVVAVLADLFDTFDRRCEKSGTRIICCLPALCVWLVSHLFQEDTRHPCPLLSHRSCTEKRRIDWDQLLAGIGGRTISWFPRWKEGKEGVLFSCGRYPNIPLAWETPLRKDQELRGIRNGIIGGYHEWLKAHIRGLDWLAKLKVVSEESFEAPEEDEEVQTLKSELGKAKLAKEKFKLAATHVRKECAGLREENAITARALEQETKRARKEEYGRNKFRGALWGSNSELKLRREERDQSRAHSMVLKEELIACS

SEQ ID NO: 168648 - protein, 72 aa, Glycine max
  Coding DNA Sequence Number=SeqID_76963
MRDLYEEGFIPNYYWWINHSEELSQFPPVVLQGSYYESGEHREELNPYEQMIIDHARPSIGQYIEQEGVIET

SEQ ID NO: 168649 - protein, 342 aa, Glycine max
  Coding DNA Sequence Number=SeqID_76964
  Gene Ontology: Mol. function=chlorophyll binding; Cellular component =integral to membrane; Biological process=photosynthetic electron transport
  Homolog annotation: Hit_ID=Q2MI75; Match level="QueryCoverage=100%, HitCoverage=83%, E-value=1e-160, Identity=70%"; Hit description =Photosystem II P680 chlorophyll A apoprotein
  Pfam annotation: Domain name=PSII; Domain location=1-342; Score =546.4; E_value=3e-161; Accession=PF00421.10; Description=Photosystem II protein
MHTALVAGWAGSMALYELAVFDPSDPVLDPMWRQGMFVIPFMTRLGITNSWGGWNITGGTITNPGIWSYEGVACFGFGAFHVTGLYGPGIWVSDPYGLTGRIQSVIPRGRGSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPR

SEQ ID NO: 168650 - protein, 371 aa, Glycine max
  Coding DNA Sequence Number=SeqID_76965
  Gene Ontology: Cellular component=integral to membrane
  Homolog annotation: Hit_ID=A9CJZ5; Match level="QueryCoverage=41%, HitCoverage=100%, E-value=7e-50, Identity=65%"; Hit description =Putative uncharacterized protein
  Pfam annotation: Domain name=BA14K; Domain location=58-151; Score =192.5; E_value=1e-54; Accession=PF07886.2; Description=BA14K-like protein
  Subcellular localization annotation: CTP_CleavageSite=37; ConfidenceScore=5.22e-01
MINFRTTSVATALSCPTSFTPSQAFQVPVPIQKPAVSTDNVVQVQYREWDRRHDRRHGDRMYRPRPPRDGYYNGHRGYRDRRPGYRYHNGYWFPLAAFATGAIIGGAIQQPRPAYGGSHVSWCQNRWRSYRAYDNTYQPNSGPRRICVSPYSRFSHTSLGCRSIRHRPDKGGIEQQKFTSYGLSTVVNGGSQMKSYVNPGCRSAIVDSCALQHEPGECNRNHDEDAGRQRAAGADGKRQFIRIHAEETGHQRWRQQECRHQRQDIKVPVGFGREFGIDFFVQQPCTLLQGIDVMIDSLKAPHQAPPHQRQHGAQMPVQANHRAAQRGEPPPFVACLAVIDEILDGVQFLRRLHHQIDERALEFGDEAFEHM

SEQ ID NO: 168651 - protein, 52 aa, Glycine max
  Coding DNA Sequence Number=SeqID_76966
EEVGGHCHEIGGVAYGIWIKLKKSETLVWLDFVECPKVQDEKMEELDMDLME

SEQ ID NO: 168652 - protein, 80 aa, Glycine max
  Coding DNA Sequence Number=SeqID_76967
YPIVRPPAIIQFRAAFDEDMTKSKGKDPLEGLGGPMTRARARKAKEALQQVLSILFEYKPKFQGEKSKVVSCIMAQMEED

SEQ ID NO: 168653 - protein, 66 aa, Glycine max
  Coding DNA Sequence Number=SeqID_76968
MVKKPTRLGEFIASALSFSLLGRAAFAPSAHFLINRRAREAEKGFQGSEVGEIERRQKEEEERRGN

SEQ ID NO: 168654 - protein, 123 aa, Glycine max
  Coding DNA Sequence Number=SeqID_76969
MAPTRHPLDPGEVQQSPGFPALITSLCQFYGVHVTPSKAANHHGQVHIHECLYQFSLSQHGQGFAPFVCPTPEQFGAEVAWPGDWPDAQTGEEPAESPDETDEPHMDKDMTDLLGFLGGSGAT

SEQ ID NO: 168655 - protein, 249 aa, Glycine max
  Coding DNA Sequence Number=SeqID_76970
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFHCICKGQPMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168656 - protein, 162 aa, Glycine max
  Coding DNA Sequence Number=SeqID_76971
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
MAVMEKGHFIKKNREGEYSGDQQLHFLLSQVDENRFSGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 168657 - protein, 298 aa, Glycine max
  Coding DNA Sequence Number=SeqID_76972
  Gene Ontology: Mol. function=protein dimerization activity; Biological process=DNA integration
  Homolog annotation: Hit_ID=A3BRV8; Match level="QueryCoverage=23%, HitCoverage=10%, E-value=8e-14, Identity=47%"; Hit description =Putative uncharacterized protein
VFKLWSCQEWSSYRDDDMRKANFVKEKIVNDDWWDKIDYIIDFTRPIYDMIRVCETDRSCLHLVYEMWDSMIEKTEKLPQSAITQTDTENAEQDGKGKVPKGNTGWPLLGETLEFIACDCTSNPVSFMEKHKSLVLCRLDFCDWSLSLSSHAHTLLHSSHNFKIPNLSFMLHSSHMCVFGVPHLAVCEMRKKIIDPSSGKKFCSLDVTTLRSESYKTNGFEFQHEAESIAFDTECVTSGSSSGEGIHGSRGLVVPARFWQEHNNRIRRQTETPSFDISSILAYDHEHQCYFNLVDKGY

SEQ ID NO: 168658 - protein, 370 aa, Glycine max
  Coding DNA Sequence Number=SeqID_76973
  Homolog annotation: Hit_ID=A7UQU7; Match level="QueryCoverage=31%, HitCoverage=19%, E-value=3e-16, Identity=37%"; Hit description=IMP dehydrogenase/GMP reductase, putative
MVKTRGLDHALGRVGARGLGKGGDGDDIDGAPLRQRPTASARRRRVPVILDDDVPVVPADSPAVPEAEAVVAGDEPMVDAAAQDTGAETNTQDTGAETNGDEPVGFHGGPRDLSVLTEYADHVAGSVWSGQERLELKLCSHGRKVHNLGGPVPVIENMVTGTRLSSLIAFHLPVGEVSITLDNVASLLYLPIVGTFHDFQPLCTDEAVVLLVELLMVSAEVAMAETGQYGGPYAFHDLTLVGRYAWGAAGLVYMYDQLNDASLNTSRQLVGYITLLQCWIYEHFPSIAECNANPDYDEVSPRACRWIATKKTVKKVSTAMYKQRLDRLRIPDVCWMPYAEHRPVQDFHPILCFSGQLRWGPVVVRYRSER

SEQ ID NO: 168659 - protein, 636 aa, Glycine max
  Coding DNA Sequence Number=SeqID_76974
  Gene Ontology: Mol. function=protein binding; Cellular component =nucleoplasm; Biological process=protein modification process
  Homolog annotation: Hit_ID=Q9M2V2; Match level="QueryCoverage=93%, HitCoverage=90%, E-value=3e-60, Identity=31%"; Hit description =Putative uncharacterized protein T12E18_40
  Pfam annotation: Domain name=FHA; Domain location=526-594; Score =37.3; E_value=5.7e-08; Accession=PF00498.17; Description=FHA domain
MEPWLPQDDFLLKNAIEGGASLESLAKGAVRFSRRFSVTELRDRWQALLYDPDVSAAARAAMANLELTKYGGGTGTGEGGGGKKRNSESIRKHYSAMQKRLRRCRHGVAGSDAKNATEGCDGFSLPDMPVNVEGKSHGLEGRVNLKGECGNGVLRLNAPNAVLRDDAKNDLKCLFNLANEDEVVFMDLVRKEVLAADKDKPSYDNVDSLLLSSPCDVQGDDDGREPLGGGCADQHCVSESGNNAGSSGAVQTPHAEQSEGFMICVLNTEDTDIPSNDTTDIPILVPELVPLKFQPIVEELGCLESIINNKKRNESDGSLEKEVVLSQSSAALQTVRQGLVPNVNSSHRPLVLGLKSENPGRNSISAVSRQNNNVNVNINSRHSRLVRATVMPASDGHLKQEETNAPSSVHAKAEEHKALSKSEAKPLSLDHEGGDIEDGDDNDNDDELPNFSDVEEMILEMDLSPMDQETNASREVLRYQLDESKRTIMRLEQSAQSSMGRAISSQGAFAVVYGRILEKYIKTSKVILGRATNDVHVDIDLGKEGQVATRISRRQAVIKLEADGSFIIKNLGKRCIFLNGKEIATGQVRGLSAGSLIEKMRMKRDEDKRKASTLYARDGVFNNRNGVEVRMLRILG

SEQ ID NO: 168660 - protein, 78 aa, Glycine max
  Coding DNA Sequence Number=SeqID_76975
MGKVESIGVGCESILQFCFAFCMEVSGAGSRNKVIWGGHRAREVQELILGAWDYLKEWTIARSCEDSTTQVIARFTKL

SEQ ID NO: 168661 - protein, 54 aa, Glycine max
  Coding DNA Sequence Number=SeqID_76976
MEDNMRSTVFVFVFGVLLVVVVIASPCFADVKNDFHETKGGIVNYTAEVSGGGL

SEQ ID NO: 168662 - protein, 328 aa, Glycine max
  Coding DNA Sequence Number=SeqID_76977
  Homolog annotation: Hit_ID=Q5XM22; Match level="QueryCoverage=29%, HitCoverage=85%, E-value=6e-19, Identity=39%"; Hit description =Resistance-like protein HAAS-2
MVRGLGRALGKVIGRAPGREDNRDSDEVSQRRRPTTSPRRQRKVVTFVKDAPHMVDVAKEECPELKISSHGRKVRKFGRSAVEIEGKCEARHWTIAARAYLLHLLGCTLFANKSATHVHVVFLDAFRDLSQSGSYAWGAAALCWIYEPFPSIVEAFMDVDYDERSPRACRWTSTKASTNALPALTYHKRLDRLMNADGSIVVIHRPEKVVRKFRYVQTIPPHFPGSRLCLENIDDRWMHFFDYLTPVSQICVVPGQCPTDYIDWFYLISHPFMRLTHPGDPLRYPPIVQDETYVELDMPQYPVAVATMEEAPVHAPSDVEQPRHTVAI

SEQ ID NO: 168663 - protein, 92 aa, Glycine max
  Coding DNA Sequence Number=SeqID_76978
  Homolog annotation: Hit_ID=A5BSG1; Match level="QueryCoverage=64%, HitCoverage=1%, E-value=8e-08, Identity=42%"; Hit description =Putative uncharacterized protein
MTYRIHNCNTDMLRHCDSNQGLLASGEGLLPSEQQIKQLKELQSKLWEKANLHECILRQKARSIWVKEGDNNNSYFHKLINYSRRRNAIRVC

SEQ ID NO: 168664 - protein, 140 aa, Glycine max
  Coding DNA Sequence Number=SeqID_76979
MVHLALTELVSLEQSIKEYERKAAMEEELRAMEEPQMRASHIDITSQQKVYWSEMGLQSEAKRILRYVKGFWDYGFSNHGKNVSGEIFGNYDSVMIKLTERVQQDYDNDLQAAHDSNLACQSLQDPQLADSGRFDAQLPS

SEQ ID NO: 168665 - protein, 400 aa, Glycine max
  Coding DNA Sequence Number=SeqID_76980
  Homolog annotation: Hit_ID=A7NT27; Match level="QueryCoverage=72%, HitCoverage=88%, E-value=9e-44, Identity=39%"; Hit description =Chromosome chr18 scaffold_1, whole genome shotgun sequence
  Pfam annotation: Domain name=DUF702; Domain location=191-334; Score =292.0; E_value=1.2e-84; Accession=PF05142.3; Description=Domain of unknown function (DUF702)
MDTKGAMCHEKQRVFRCKGRGNAECCFFDTWHRSQPLKEHGKKIAAPCNVVVLSLCQVKHAGFRHKRRNCSELKKELINSAEKSERERERDGGGRGGDNQEENNNQSSEIPPAETLFWYSKNDDVSSYHRGFELWNQHQEHQHHHHAMHHPHARPLLQRDLYSSGVGPSRGGISDDHSSSRSAAFVAMRAAGAEGGGISCQDCGNQAKKDCPHMRCRTCCKSRGYDCQTHVKSTWVPASKRRERQQQLMALHQQQQEQQQQRDISKRPRDSRLSSSGLEEEGHFPSVVSSPAEFRCVRVSCVEDSDDRYAYQTAVSIGGHVFKGILYDYGPENSNNNNSNNNSNNYMAGETSAVAATAQPLNLAAAASSAALIDPSSLYSAPANAFMAGSGTQFFPHTRS

SEQ ID NO: 168666 - protein, 55 aa, Glycine max
  Coding DNA Sequence Number=SeqID_76981
  Gene Ontology: Mol. function=ATP binding
  Homolog annotation: Hit_ID=O65519; Match level="QueryCoverage=81%, HitCoverage=8%, E-value=9e-12, Identity=71%"; Hit description =Putative uncharacterized protein F23E13.170
MREPLITLLSTLKKLFDDIGSHGTKVVIYNLWLNDEGIYELSFDDDAEVCFGNAF

SEQ ID NO: 168667 - protein, 66 aa, Glycine max
  Coding DNA Sequence Number=SeqID_76982
MCQKGIVCGSTCDSFRGCSGHCCGHRRWDKMVRGPTSKKEQRWLCQTMTESVALFTAGLCARSERE

SEQ ID NO: 168668 - protein, 848 aa, Glycine max
  Coding DNA Sequence Number=SeqID_76983
  Gene Ontology: Mol. function=hydrolase activity, acting on glycosyl bonds; Cellular component=beta-galactosidase complex; Biological process=carbohydrate metabolic process
  Homolog annotation: Hit_ID=A7QE47; Match level="QueryCoverage=96%, HitCoverage=96%, E-value=0.0, Identity=83%"; Hit description=Beta -galactosidase
  Pfam annotation: Domain name=Gal_Lectin; Domain location=762-839; Score=161.7; E_value=1.9e-45; Accession=PF02140.9; Description =Galactose binding lectin domain
  Pfam annotation: Domain name=Glyco_hydro_35; Domain location=33-339; Score=651.8; E_value=5.6e-193; Accession=PF01301.10; Description =Glycosyl hydrolases family 35
  Pfam annotation: Domain name=Glyco_hydro_42; Domain location=54-370; Score=-245.3; E_value=0.02; Accession=PF02449.6; Description=Beta -galactosidase
  Pfam module annotation: Pfam domain module=Gal_Lectin::Glyco_hydro _35::Glyco_hydro_42; Domain location=762-839::33-339::54-370
METTSFSKLLFLFFCFFASCLSSHASVTYDRKAILINGQRRILFSGSIHYPRSTPDMWEDLILKAKEGGLDVVETYVFWNVHEPSPGNYNFEGRYDLVRFVKTIQKAGLYAHLRIGPYVCAEWNFGGFPVWLKYVPGISFRTDNEPFKTAMQGFTEKIVGMMKSERLFESQGGPIILSQIENEYGAQSKLQGDAGQNYVNWAAKMAVEMGTGVPWVMCKEDDAPDPVINTCNGFYCDKFTPNRPYKPMIWTEAWSGWFTEFGGPIHKRPVQDLAFAVARFIIRGGSFVNYYMYHGGTNFGRTAGGPFIATSYDYDAPLDEYGLIRQPKYGHLKELHRAIKMCERALVSTDPIITSLGESQQAHVYTTESGDCAAFLSNYDSKSSARVMFNNMHYNLPPWSVSILPDCRNVVFNTAKVGVQTSQMQMLPTNTQLFSWESFDEDVYSVDDSSAIMAPGLLEQINVTKDASDYLWYITSVDIGSSESFLRGGELPTLIVQSRGHAVHVFINGQLSGSAYGTREYRRFMYTGKVNLRAGINRIALLSVAIGLPNVGEHFESWSTGILGPVALHGLDQGKWDLSGQKWTYQVGLKGEAMDLASPNGISSVAWMQSAIVVQRNQPLTWHKTHFDAPEGDEPLALDMEGMGKGQIWINGQSIGRYWTTFATGNCNDCNYAGSFRPPKCQLGCGQPTQRWYHVPRSWLKPTQNLLVIFEELGGNPSKISLVKRSVSSVCADVSEYHPNIKNWHIESYGKSEEFHPPKVHLHCSPGQTISSIKFASFGTPLGTCGNYEQGACHSPASYAILEKRCIGKPRCTVTVSNSNFGQDPCPKVLKRLSVEAVCAPTAANWRG

SEQ ID NO: 168669 - protein, 92 aa, Glycine max
  Coding DNA Sequence Number=SeqID_76984
MVVHGTWVHAIQRGITNGLSRVSEIIQPIVKTYPTVSIKTLIAEIKMFMNYTPSYKNTWLAKQRALEMIYGNWEESYVGSSGLGIINKGRLN

SEQ ID NO: 168670 - protein, 130 aa, Glycine max
  Coding DNA Sequence Number=SeqID_76985
MAPRKLASKRSRKDKAAEGTSSAPEYDSHRFRSAVHQQRFEAIKGWSFLRERRVQLRDDEYTDFQKEIDAIGQLLGYPLVLEEGQECEYVQRRNRSDGSMRRPSPSCYVYRGKILPGLLPGDGCGSCAPT

SEQ ID NO: 168671 - protein, 153 aa, Glycine max
  Coding DNA Sequence Number=SeqID_76986
  Subcellular localization annotation: CTP_CleavageSite=28; ConfidenceScore=5.46e-01
MATQMNQAQSQNSDKLPSQTVQNPKNVSAITLRSANQIQVPPPVGAPTPEPVKLHSTPEKEDEIVAQKRKLPDHEGANKNFHADGPSSSNFDLQQPSVPLPFPPRAIPNKKMEEVDKEILNTSARWHQANSKICQVSKGVVHPQKEAQRQWKD

SEQ ID NO: 168672 - protein, 148 aa, Glycine max
  Coding DNA Sequence Number=SeqID_76987
  Subcellular localization annotation: CTP_CleavageSite=41; ConfidenceScore=5.08e-01
MNCVFVHVSSTFEFGAMRSDCLVQFSILNPFRSPMNCVFVHASSTFEFGAMFHDCLSADPQGNPPFSTYFSEPHECHCLALFMCPPLSSAKPLAVVSGGSNLAHLGELSSPGPAGPRRFRNVSVSNYTKILDRSSTFIVRSSFSSVFN

SEQ ID NO: 168673 - protein, 125 aa, Glycine max
  Coding DNA Sequence Number=SeqID_76988
  Subcellular localization annotation: CTP_CleavageSite=27; ConfidenceScore=5.22e-01
MVQLWWKDPVDRSVLPTNLFRSPMNCVFVHVPSTFEFGAMRSDCLVQFSILNPFLEPMNCVFVHASSTFEFGAMRSDCLVQFSILNLFRSPMNCVFVHVSSTFEFGAMRSDCLVQFSILNLFGFP

SEQ ID NO: 168674 - protein, 108 aa, Glycine max
  Coding DNA Sequence Number=SeqID_76989
  Subcellular localization annotation: CTP_CleavageSite=41; ConfidenceScore=5.52e-01
MVLAPLQQSFQSLPRLTQRFVRSLVSQPTFRREGDARGSPGASSKGGKWRGSRHQRLFGRKRQKNRRKPGHEEYSRFREVYLRLEEGRTKSGGSCSYVPSIEEEIKPT

SEQ ID NO: 168675 - protein, 360 aa, Glycine max
  Coding DNA Sequence Number=SeqID_76990
  Homolog annotation: Hit_ID=Q6WAY6; Match level="QueryCoverage=95%, HitCoverage=60%, E-value=1e-40, Identity=33%"; Hit description =Putative uncharacterized protein
MGSSQTPSLKKKFYQVKVKSLRITSLKELGQLMGQLQWQAFRKAYGKIWDLAMVEVSTEAIASLAQYYDQPLRCFTFGDFQLSPMVEEFEEILGCPLGGRRPYLFSGFYPSLARIYKIVQISAQELDHRKQVENGVVGIPRKYLEEKARILAGKGEWAPFIDILALLIFGGVLFLNVDGLVDLAAIDAFLVYHDHKESPVVAMLANLYDTFDRSSLCLVGFAPFSSRIKACLPARSHCSCTDKGGANWDQLLANKEGASINWFPRRKEGRIRVLISCGGFPNVPLMGTRGCISYNLVLAIRQLGYPMRGPPLEEEIAPVISRGFNKTNVETLQKVRKAWEVVRKKDKELRGSNNGLIGGY

SEQ ID NO: 168676 - protein, 97 aa, Glycine max
  Coding DNA Sequence Number=SeqID_76991
MGGRVVMVAVRCCAIGAVVVAETLGDLRDSSVGVVVRADNRSRMTSSLAVWLESGVGVLAGEEEGKGSHGRQPWAAGRTKLLGTKAKLHYANYTNRY

SEQ ID NO: 168677 - protein, 59 aa, Glycine max
  Coding DNA Sequence Number=SeqID_76992
MPPTNRAFIKKYCVPRQAQGETPQQPGDGWQRATDAPPSPLEFTSAHPQKGNGRTHLGN

SEQ ID NO: 168678 - protein, 93 aa, Glycine max
  Coding DNA Sequence Number=SeqID_76993
SNTITERALRHPYRTRSKTRVMGDVDEVQEQMKADMVALKDQMTSMMEVMLSMKRLIESNVATTIAASVAAEADPTLPSAMNQAHQPAPNMRG

SEQ ID NO: 168679 - protein, 123 aa, Glycine max
  Coding DNA Sequence Number=SeqID_76994
EEFEARLSQARFDAASSVGESQLTPLNPPEEQRLRSRCWIAAARPKHKGRLHGTGDLDHTYKCGSDSFMQHMQGSSSRIVLSIEGVFLLLPEFVFVTNWAALPSLQPHCRVGVCGVRVCASIE

SEQ ID NO: 168680 - protein, 99 aa, Glycine max
  Coding DNA Sequence Number=SeqID_76995
MTNYYPPDLPPSIGVPRGSQGAVLKKVLHRIAVQSSNFLDPGIKFPPQRHYFMTREKKVGCRFNLTLAEGADVILKDNLPPNKVFLRWKPIPEKSPSKS

SEQ ID NO: 168681 - protein, 292 aa, Glycine max
  Coding DNA Sequence Number=SeqID_76996
  Homolog annotation: Hit_ID=UPI00006A2939; Match level="QueryCoverage =52%, HitCoverage=80%, E-value=3e-07, Identity=28%"; Hit description =UPI00006A2939 related cluster
  Subcellular localization annotation: CTP_CleavageSite=35; ConfidenceScore=5.39e-01
RITGRRFQKTTRPPLQRATRPRPQRTTHPTLQRTRCAHHQRDTLPRFQTTSCPPLQPTTRPPLKRAISPRHQWTTRPCLHWTTRPLVQRATCPLLQRNTRPHHQRTTRPRHKRTTHRHLQRTTRPPLQRTARTPFLRTTRAHLQRATHLRLHRTSCPPVKWTTRLHVLTIRGLHVLAFRGLHDLTFRGLHVLAFRGLHDLTFRGLHVLAFRGLHVLAFRGLHILAFRGIDVLNFRDLHGCTSSPSEHYTFSPLESYTPSPSEDYTSSPSENYMSLPSEDYTSSPLEHYTSSP

SEQ ID NO: 168682 - protein, 38 aa, Glycine max
  Coding DNA Sequence Number=SeqID_76997
MTRPARDLNALSASPILSSISSRKPSMAMSVANPLARA

SEQ ID NO: 168683 - protein, 141 aa, Glycine max
  Coding DNA Sequence Number=SeqID_76998
  Gene Ontology: Mol. function=helicase activity; Biological process =viral genome replication
  Homolog annotation: Hit_ID=Q2A9E0; Match level="QueryCoverage=95%, HitCoverage=9%, E-value=2e-27, Identity=44%"; Hit description =Putative uncharacterized protein
MSSTNEPTINREGYSDPGDQLMQCAHCNANMWYDERISKRVRTTNPRFSLCCGGGKVELPLLQYPPKYLHKLLYDHDTSDSKNYQQNIRTYNMMFAFTSTGIKFDKSINHSRGPPTIRIQGQPCHRIGNMLPMPGKEPKFA

SEQ ID NO: 168684 - protein, 63 aa, Glycine max
  Coding DNA Sequence Number=SeqID_76999
MEREEKRFVYRICCSSDENNDPEGMEEGIGVYCDPECRWLRLEVQGCIVIDYTNMVIDYQRAT

SEQ ID NO: 168685 - protein, 121 aa, Glycine max
  Coding DNA Sequence Number=SeqID_77000
MNIMVRIRGLGQTLSRVIGKASVREISGDANEGPQRQRPTASARRQRETAFVAEDPEEATADDVVTDAEGFLGGPYDILVLMDYVHHMAMIVWNGELSSYGRKVEKFGRPAPAIEGLVVVT

SEQ ID NO: 168686 - protein, 161 aa, Glycine max
  Coding DNA Sequence Number=SeqID_77001
MGAYAKDEELLIHFFQENLTGVAVTWGTDLSKNMPKGGETWQLKWHLNDGEKMITMIVSTLPVFYYEKMVGYTPSSFADLVFTDERIKVGMKRGKFNHLAWTNEKTGANEEGENEGETHAVTAIPIRPSFPPTQQCHYSANNNPSPYPPPSYPQRPSLNQL

SEQ ID NO: 168687 - protein, 68 aa, Glycine max
  Coding DNA Sequence Number=SeqID_77002
  Homolog annotation: Hit_ID=A0PAV3; Match level="QueryCoverage=55%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVKRNGKSTAHNTLLVT

SEQ ID NO: 168688 - protein, 50 aa, Glycine max
  Coding DNA Sequence Number=SeqID_77003
MDKSLKVGEDEWRERERRSTKFCASNELWFIPLVQDSPLSVLRCHEACKA

SEQ ID NO: 168689 - protein, 210 aa, Glycine max
  Coding DNA Sequence Number=SeqID_77004
  Gene Ontology: Mol. function=RNA-directed DNA polymerase activity; Biological process=RNA-dependent DNA replication
  Homolog annotation: Hit_ID=A2Q533; Match level="QueryCoverage=91%, HitCoverage=61%, E-value=2e-13, Identity=30%"; Hit description =Putative uncharacterized protein
MGNFSQNNWSWDLKWRRHLFEYEEGVAVTFMEEISAYPIQRHLKDNLLWKADPSGLYSTRLIKDRLPTRANLHRRNVDLQEYVCPLCHIEQEEAGHLFFHCNQTIGLWWESLRWIQAIGALPSSPASHFSLFCDDFVVGRNHSRWCGWWIALTFAIWKHRNLLIFQGISSVSSKVMDDALFLAWSWSKARDKDFNIPFNHWSSNLMEAFA

SEQ ID NO: 168690 - protein, 72 aa, Glycine max
  Coding DNA Sequence Number=SeqID_77005
MEQSHHSPLIGCPDVLEPKGHRLIAEHPSQGDEGGLLHILWHHLYLIVVGEIVHEGKQSKIGRIIHEDIDVR

SEQ ID NO: 168691 - protein, 149 aa, Glycine max
  Coding DNA Sequence Number=SeqID_77006
  Homolog annotation: Hit_ID=A5BSZ8; Match level="QueryCoverage=47%, HitCoverage=7%, E-value=9e-14, Identity=56%"; Hit description =Putative uncharacterized protein
MLEEKFVIIIDASSNEEKAQFKAWERSDRLSLMLMRMTVANSIKTTLPKIESTKKFMGLVGERSQSADKSVAGTLMVQEETRFKNQGSHLVHYVSHRGNQGARKRFMKKHDKGKRPLKINGGPVQIQKKHQRAIIVNFVGNQDISRRIA

SEQ ID NO: 168692 - protein, 95 aa, Glycine max
  Coding DNA Sequence Number=SeqID_77007
MDSIDEQDPRPTSFTWSYVIDGFGILLSSGEIVGHFLESEGVSKVEERLGFGNGNFEIVKALDLLHQWSPLLLEDEWQRNGEGRKMIGDATSRRR

SEQ ID NO: 168693 - protein, 161 aa, Glycine max
  Coding DNA Sequence Number=SeqID_77008
MKQELKQAIKVELTQMPFIGTFIAWPRHIVKPISHEDSKNLPNKVYEPVESLSMGVGDDPLGDFIKNLSDVYPKPVEFLWDVTKFRISNSTRLGHGLMYGFLEPRPIHNAKDRCVECQLSYPNFVRGPSVVGMRPLFDHFEIFNRSSTFFVRSSSFFGLQP

SEQ ID NO: 168694 - protein, 239 aa, Glycine max
  Coding DNA Sequence Number=SeqID_77009
MASNPSRAQKIAKTSKKKIPKYLDLECFSQQGFNFPNLLEVQGLSKLLVKIFYTCARADLEGNLLSNVNGVDMVIDATVWKEVVGLDMGGVHKFDEMPDGFNKMWTYREMLLDSARNLRNCLGVGGMTARDRMLVYLITYILTPRSSNHAQMLESLYMVDYEFPYVVFAPRFIDYFNVNVLNEIMDFTKASSEITERHLKKLGMRFVDHEWIMTREAVVGNIEQVEEDAEVEAPSIESF

SEQ ID NO: 168695 - protein, 375 aa, Glycine max
  Coding DNA Sequence Number=SeqID_77010
MAVTGGQWWWRRSLGVLGEGLREEKEEENGSFMLLDVFVACNTRQALMRSFNGDFPPWRCSGRQRRRGERRRDPLGNKPWKKELHHQDEPWLRSLEGCFNGGKERGRERERKWRSICGHAGSPTRLITVKPHLEFSSLDNALSLVVPTATIHCHHQKVIIVTKKNECTLRHPYRTRAKARVMSEIEEVQEQMKADMEATKDQMTTMMEAMISMRKMMEVNVAAVATTSVATEVDPTHPSGVNQVSHPVLDMVSQGGEALGSTGGPHFAQVQSKHPFTLYGLPPNYAPPNVVHVSMRTLTTLLLYPLRDNNLSLRMHMSLNPWGRHMKYPETTLWPTSSLTSDMQLKDKHLVAYPSRTPWKTLSIVHNRNYNPYIF

SEQ ID NO: 168696 - protein, 65 aa, Glycine max
  Coding DNA Sequence Number=SeqID_77011
MMLSMMISGPRQPGNNIDVYLAQRGVIQSYPARALDRRLQEDWTRDAREGPRVLMSLRVDFGPMG

SEQ ID NO: 168697 - protein, 58 aa, Glycine max
  Coding DNA Sequence Number=SeqID_77012
MGHQYRAGPKKGWEDGTEGYGKDNLHYSMGNLLLQGDVIWAEERWGNVPADGDVIPMT

SEQ ID NO: 168698 - protein, 175 aa, Glycine max
  Coding DNA Sequence Number=SeqID_77013
MPREGHRRGGSSVAPQVEIEFDGHHFQSEEHQRHFEVIKDWFFLKERWVQLEEGEYTEFQVEVAKRQWTQLTEPMAKYDPKIVMEFYANAWPIEEGVMDKRSWVRGQWIPYDEDAINQFLGHPLILEEGQRFEYAERRSQVSGFDEEATGQLLCSPRHYFAWSVTGRRCGSCALA

SEQ ID NO: 168699 - protein, 35 aa, Glycine max
  Coding DNA Sequence Number=SeqID_77014
MEKASPVNDGRSCWTSGLRYLNNGVELRYHRLFPN

SEQ ID NO: 168700 - protein, 53 aa, Glycine max
  Coding DNA Sequence Number=SeqID_77015
DSFEEQASQGSFVPHRQHPGRVRAAGAGVTIMKYFGSAPRMSHSSSSLPPEEL

SEQ ID NO: 168701 - protein, 120 aa, Glycine max
  Coding DNA Sequence Number=SeqID_77016
MAMKKLSTKRSRRDAAAEGAKHQQRFKAIKGWLFHRERHVQLREDEYTNFQEEIAHRRWTSLVTPMAKFDPEIVLEFYANAWPTEEGVRDMRSWVRGQWIPFDVDALSQFLGDSLVLEEG

SEQ ID NO: 168702 - protein, 132 aa, Glycine max
  Coding DNA Sequence Number=SeqID_77017
  Gene Ontology: Mol. function=helicase activity; Biological process =viral genome replication
  Homolog annotation: Hit_ID=Q9C8B0; Match level="QueryCoverage=96%, HitCoverage=7%, E-value=5e-28, Identity=43%"; Hit description =Putative uncharacterized protein F10O5.11
MSQKLNYVRQHQQQLKVDKYINLSTSNDHPQTLGRDKGKKIILPSSFVGGQRYMEQLYFDGMTICGHLGFPDLFLTLTCNPTWSEIQRKVTQSNLTPHNCPDIITRVFKIKLNQLMNDLKHGNIFGNIIGCK

SEQ ID NO: 168703 - protein, 87 aa, Glycine max
  Coding DNA Sequence Number=SeqID_77018
MAEYEVKSKEKKLPTASFSLHVAFLPSSSPPLLPPLKLQIPLHFYPKSQGKAIFGVLELTSTSWGFKFQNVDRKLVERMGRVNLELN

SEQ ID NO: 168704 - protein, 198 aa, Glycine max
  Coding DNA Sequence Number=SeqID_77019
MSNLEEVQEHMKVDMSAFKEQMTSMMEAMLGMKQLMESNAATATATSTAAEADPALPTAAHHPVPNMVGRERSTSGHISNPHPGYNRGAYPYSLPPNYTPPAMHEDMDHVSPLILKGEPPRHPNTVHENPREHAQGDVDSYSPFPAEGPAPNALPQPNIRGEPRNHLTQPMFLSVGGPPLAVEGKGKLNLIKERLRAV

SEQ ID NO: 168705 - protein, 121 aa, Glycine max
  Coding DNA Sequence Number=SeqID_77020
MARTRGLGRAIGRLVGRDRHDDHDAADVPERRRPTASARRQRVHQMTTEGRDMAEDVADMTDDVPDLAAEAPEMRGDIQGVDDAQGSDADDATEGFPGGPRDPSVLASFVDHVAHAVWSGQ

SEQ ID NO: 168706 - protein, 108 aa, Glycine max
  Coding DNA Sequence Number=SeqID_77021
  Subcellular localization annotation: CTP_CleavageSite=27; ConfidenceScore=5.30e-01
MHALLGSFNSGNWSDSKVLDNAGLSCRAFTRNRGAISQLNSLYTCSYSHLLLHTRRLSAEIACQITQVPRVFDTRFLPFYTTCAIRYTCRKPNKFSAPLPGNFLLFGK

SEQ ID NO: 168707 - protein, 217 aa, Glycine max
  Coding DNA Sequence Number=SeqID_77022
MGDPISRLSFPGRRIVFHSKSICWNICLFAKACLHFSGENTETFSSLTSYPELRRSEFLIGGYVGARASLLSTTPPFVAMTQELIRGDTLWLFAPFCHPEAAGPMTSRDQVWSFCTHDTRRYLTVIRTPLPFRHSRVRWHAETKFGHSAPHDTRRYLTVIRTPLPFRHSRVRWHAETKFGHSAPMIRGDTLRLSAPLCHSHSRVPMTQRPSLVILHP

SEQ ID NO: 168708 - protein, 60 aa, Glycine max
  Coding DNA Sequence Number=SeqID_77023
MLVTLAERGVSPWDRLVALVRERDRFATPDWSRISGFLGGHIPGEVYHQRFEFNGAFFVR

SEQ ID NO: 168709 - protein, 74 aa, Glycine max
  Coding DNA Sequence Number=SeqID_77024
MPQSTSVIRAGRIGVVPSRERRLVDPSGGHHCQLVGDYEWANSGSFFMGGFLLGLEIGLGLKSSAGRGLVGAGA

SEQ ID NO: 168710 - protein, 61 aa, Glycine max
  Coding DNA Sequence Number=SeqID_77025
MACTHIPDSQAILASPHQLDLALYALRSYSAHWNSPGLLHDKHTLRSSRILGKMEVVAFLN

SEQ ID NO: 168711 - protein, 141 aa, Glycine max
  Coding DNA Sequence Number=SeqID_77026
  Gene Ontology: Biological process=transposition, DNA-mediated
  Homolog annotation: Hit_ID=Q1J7G7; Match level="QueryCoverage=26%, HitCoverage=67%, E-value=7e-11, Identity=72%"; Hit description =Transposase
LAQASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLNSINLEDLPENARNYVRRVSELVGVRISTFSVGP

SEQ ID NO: 168712 - protein, 122 aa, Glycine max
  Coding DNA Sequence Number=SeqID_77027
MKTPDEAMDLIESMAASDIAILRDRAHIPTKKSLSELTSQDDLLAQNKLLSEQLETLIKALSCQLCFILHKLHILLFCRLQDVQFMVELMNLDVVSLMKSKLHMKSIIWGISPEEISIQVDF

SEQ ID NO: 168713 - protein, 134 aa, Glycine max
  Coding DNA Sequence Number=SeqID_77028
  Homolog annotation: Hit_ID=A5BEV8; Match level="QueryCoverage=64%, HitCoverage=11%, E-value=7e-11, Identity=42%"; Hit description =Putative uncharacterized protein
MDVKADDNCGYRAIVTLLGMGEDSWSLVCNHLLKELGKWSDDYIKLFGGTNTFEELRRSLLVDGLSMVTMDNWMDITKMGYVIASRYNATPHQKGNVPMLLLVPLGPQGYVSPHMCHPASQVDVWPDQQVLLVT

SEQ ID NO: 168714 - protein, 85 aa, Glycine max
  Coding DNA Sequence Number=SeqID_77029
  Homolog annotation: Hit_ID=A5C0F5; Match level="QueryCoverage=88%, HitCoverage=12%, E-value=6e-08, Identity=37%"; Hit description =Putative uncharacterized protein
MEATTLLWKQDCHRASKMQNMDVALQLGIRVDGRPITGATYYDWEEMCEQYLGVVLPKGEAIVGSAIKLKWLQDNMPLLPSESTQ

SEQ ID NO: 168715 - protein, 157 aa, Glycine max
  Coding DNA Sequence Number=SeqID_77030
MENCTSNHYAWLQIVGGGINRENNKDHISQSRGSALDGGGHMNSARQSIHGAPNKRREWRIALGNHYAWLQLVGGGINRENNKDHISQSRGSALDGGGHMNSARQSIHGAPNKRREWRIALGNHYAWLQTRWWRNQSENNKDHISQSRGSHLTVEDT

SEQ ID NO: 168716 - protein, 390 aa, Glycine max
  Coding DNA Sequence Number=SeqID_77031
  Homolog annotation: Hit_ID=UPI00006A2D9E; Match level="QueryCoverage =80%, HitCoverage=100%, E-value=2e-09, Identity=15%"; Hit description= UPI00006A2D9E related cluster
  Subcellular localization annotation: CTP_CleavageSite=62; ConfidenceScore=5.75e-01
MTTRSHLQRATRPHLQRTTRPRFQMTTRPHLYTTTRPRLQRTTHPRLQRTTRPRLQRTTRLRLERATRPHLQRTTHPHLQRTTRLHALAFRGLHTLAFKGLHTVALRGIHVLAFKERHVLAFSGLNVLVFRGLHVLTSRGLHALAFRGLHALAFRGRHVLAFRGLQALAFRGLSSLPSEDYTIARPGLQRTARPRLQRATHPHLQRATRPRLYRATCRPFRGLHALAFGGLHALAFRALHALAFIGLHVLAYRGRDALVFRGLHVLAFMGLHALAFRGLHALAFRGLHTLALRGLHVFAIIGGYVLAFKGLHILIFRGLHVVTFRGLHALAFRGLHDLAFRGRLVLAFRGLHALAFRGLHVLAFRGLHVLIFRGLHVLTFRWLHPIAFTR

SEQ ID NO: 168717 - protein, 47 aa, Glycine max
  Coding DNA Sequence Number=SeqID_77032
MGEGCCTQCKEAVSGFEPITNKSPRHNFTAAPGLALYQKIYFEGPSS

SEQ ID NO: 168718 - protein, 146 aa, Glycine max
  Coding DNA Sequence Number=SeqID_77033
MDDSSTIEESEVNFESEEVLEAFNEMQEEAQRLAVLNKKLKNDLKLHITKLTSTQSELDELRKENERLVSSFIATGCVCTSTSLNMDDYKSLQTEFENFKKDHYADHMKLQTELFYLTYLFRKLNKGKNDLNHSLSVQKHTSDKTG

SEQ ID NO: 168719 - protein, 154 aa, Glycine max
  Coding DNA Sequence Number=SeqID_77034
LHEFCTKSGIEELVCEFLGLESFVSHLDGTLTSSVGPIVDLWCVFDLIVNTGVWGLLDLELTLLRVDFLPGLEPPDVGFTSSTFPLALILFKDPSSSSICISLTHPMGRAMRAPTALINRLTAIQRKFLWGGSFAGKKIASVAWRQLSASRDLG

SEQ ID NO: 168720 - protein, 63 aa, Glycine max
  Coding DNA Sequence Number=SeqID_77035
MVKVGTSYVPINVSFSPKVGPGLPGIYSAQSASGDAAKLTDLVYDGVFEVLQVASVSNQAVPP

SEQ ID NO: 168721 - protein, 45 aa, Glycine max
  Coding DNA Sequence Number=SeqID_77036
MASVKGVERMGGDINMEEIKNYIKIYRSLLDNFFPKRIPCTIKLE

SEQ ID NO: 168722 - protein, 353 aa, Glycine max
  Coding DNA Sequence Number=SeqID_77037
  Homolog annotation: Hit_ID=A7P7T4; Match level="QueryCoverage=94%, HitCoverage=88%, E-value=2e-88, Identity=51%"; Hit description =Chromosome chr9 scaffold_7, whole genome shotgun sequence
  Pfam annotation: Domain name=Kelch_1; Domain location=121-172; Score =22.7; E_value=0.0014; Accession=PF01344.16; Description=Kelch motif
TRWLEQDQFARIGTNVSKAYPIATTTSSWFLALPIRNHRPYCYAHNPVIDKWHQLSLPIPSIRPIGPIGSLLLLRVTNSTTLQLGLCNPFTREFRHLPRLHVARTNPAVGVVTTSESSNPNRDDDDVRFPSFKVYVAGGMSEAAQGGGATYETKVEMYDSRFDTWRIVGSTPVEFAVRLTVWTPNENVCIGETLYWVTSARVYSVMGFDVGRNRWRELGVPMAEKLEFATLVPRNGALGLVGGTCGGSACIWELNEGDKWCLVDKVPLELGLRLLGEKRIWESVKCVGNEDAICLYRDIGYGMVICKKVVGEIMGRWEWVWVDGCGYTKGKQVHNCPIRGALVHPSLASSLIF

SEQ ID NO: 168723 - protein, 95 aa, Glycine max
  Coding DNA Sequence Number=SeqID_77038
  Homolog annotation: Hit_ID=Q2HVV6; Match level="QueryCoverage=45%, HitCoverage=44%, E-value=3e-10, Identity=76%"; Hit description =Putative uncharacterized protein
MTVEDNHDLIIGAMVTTWHRERLIGGLAEQLAEHEKEENKKEANNSQSQKKKLERMPTEDINASAEAFIKNFRHHLLLQRLQSIENHKLMLAREK

SEQ ID NO: 168724 - protein, 213 aa, Glycine max
  Coding DNA Sequence Number=SeqID_77039
  Gene Ontology: Mol. function=nucleoside-triphosphatase activity; Cellular component=integral to membrane; Biological process=defense response
  Homolog annotation: Hit_ID=A2ZV99; Match level="QueryCoverage=84%, HitCoverage=13%, E-value=2e-50, Identity=53%"; Hit description =Putative uncharacterized protein
  Pfam annotation: Domain name=ABC2_membrane; Domain location=2-210; Score=63.8; E_value=5.8e-16; Accession=PF01061.15; Description=ABC-2 type transporter
MPSLLMETKLVILAQSARHCSEPVSFLSTTVISVWFGTMFWDLGGKYSSRQDLFNAMGSIYNAVLFVGVQNSASVQPVVAIERTAFYRERAAGMYSALPYALAQVIIELPYVFVQAKSYSVIVYAMMGFEWTLHKFFCCGFCILGNLEPLFKVCHCTTRIQFNGCLYDDPPFFIFDYVAFLKQNIPVWWRWYYWACPVAWVLYTGRLPHSLGI

SEQ ID NO: 168725 - protein, 152 aa, Glycine max
  Coding DNA Sequence Number=SeqID_77040
MAAQPGEKAAIIAKHCNNCLEYGISAGDTGMIIDFLSCHPKVLVNVPSESSEGQMAYVYLVQILKVVKSCAVLKIIDSWVLGNADLHSRALKELRRQEILARERLHLGRCCVKGNKKELQDAEADLHKVRHQKKDLLEERAALHILITHFST

SEQ ID NO: 168726 - protein, 58 aa, Glycine max
  Coding DNA Sequence Number=SeqID_77041
MRATSRSEFLRASVEVPPPHTPSPPQGHKPSHGRTLWPNTTALNIVPDGALKLSCGVG

SEQ ID NO: 168727 - protein, 524 aa, Glycine max
  Coding DNA Sequence Number=SeqID_77042
  Homolog annotation: Hit_ID=A2WT83; Match level="QueryCoverage=76%, HitCoverage=66%, E-value=2e-49, Identity=33%"; Hit description =Putative uncharacterized protein
  Pfam annotation: Domain name=WD40; Domain location=121-159; Score =12.4; E_value=0.93; Accession=PF00400.23; Description=WD domain, G -beta repeat
  Pfam annotation: Domain name=WD40; Domain location=161-231; Score =4.9; E_value=7.8; Accession=PF00400.23; Description=WD domain, G -beta repeat
  Pfam module annotation: Pfam domain module=WD40::WD40; Domain location=121-159::161-231
MVKDKLKKHVLTAFTPNGDYVAILSANEVAKSGSHQMEIMIFVILVLHVVSLGKRKEQGTCLLALGTIDGSVLAVDVSTGERKLTTSHPGGICGLSFANKGRLLRIVGHNGVAYGVNTETGELLKEFKITKKSITSLAFSNDEKYLAIVSSRPRVISWEIGEEILKFPNDLGNVEHISISSDAKNLVTSDFEGPTLPIRHPPLVLDCHSGCNKEDVVVLAVTGRGSAYIWNLSASSKDQIQPTKLTTETKIVETDKENGVSSKKRHTLIIASRLQPVEENKQMKALVTYGSVDHPQFSILNISNSGENIVLYVGDETDSVQQHDSPSGKAIPMESKKAKKRQATSDPDLPTTTNEVDLAFNVDQHEAAKGVLLDDDLNEPTMGEKLASLSVLDGNKSRSDTEQESSVPAKPPSADSVHVLLKQALNADDRTLLLDCLFTQDEKLIESRVSTFKSAIQLSSCLDTLRIGAIDEEEDEGEMVPVIYEDKDTDDDEESDDAMEDNTDEQQPEEQFHAARYIDANEDR

SEQ ID NO: 168728 - protein, 61 aa, Glycine max
  Coding DNA Sequence Number=SeqID_77043
MAYSVVHDVSSHLFSFIFHYISMGLSATMHHQKRKTLDEASLLSSELGTQHDHRSTSTPYG

SEQ ID NO: 168729 - protein, 206 aa, Glycine max
  Coding DNA Sequence Number=SeqID_77044
  Homolog annotation: Hit_ID=Q9AVH2; Match level="QueryCoverage=22%, HitCoverage=16%, E-value=8e-20, Identity=97%"; Hit description =Putative senescence-associated protein
MCPVVGFGPWLGLGKPLVEILPPGQLRGFCPLLAWLGSAVLGYGPVLSFGLVGPLLPPVISFVARILPTLACAPLAKSVPRWGGTNQATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 168730 - protein, 277 aa, Glycine max
  Coding DNA Sequence Number=SeqID_77045
  Homolog annotation: Hit_ID=Q9AVH2; Match level="QueryCoverage=72%, HitCoverage=100%, E-value=3e-63, Identity=51%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGTKGSIGHAFTVRIRTGNQNQTSFYPFVPHEISVLVELILGHLRYLLTDVPPQPNSPPDNVFRPDRPAEADLGSKKRGSAPLPIHGIRSSFPADSAKPVPLAVVSLDSRQGQWESR

SEQ ID NO: 168731 - protein, 82 aa, Glycine max
  Coding DNA Sequence Number=SeqID_77046
MEQHLRHLVRQQAANHRAHSLGFASFSCPTPDQFRAEVAWPGDWPEAQAGEAPPEAPGDREEAHEDEEMTNLLDFLGGSGAT

SEQ ID NO: 168732 - protein, 42 aa, Glycine max
  Coding DNA Sequence Number=SeqID_77047
MEAKAQKWWPKGCSPKRANPVLFFLQRKYALSIGQCSLTRKP

SEQ ID NO: 168733 - protein, 79 aa, Glycine max
  Coding DNA Sequence Number=SeqID_77048
MITFKNEFKIESRTLQGSRANLISRIKIQDSRIKNNQDQDSRLKIQQSREDLIKINALAKPADWLSEKVKNNTFQSLPN

SEQ ID NO: 168734 - protein, 356 aa, Glycine max
  Coding DNA Sequence Number=SeqID_77049
VDSRGSHHFFQHVLEEGDGAVFHVEQVREHAPFADRLQRRIDGAQLRIRSNRSSRVARHIDFRNHLDVQLRGIGDHFADLVLGVEAAVRMLLAADRINAAVTGRQPAAAHFGQLRVALDLHAPALVVGQVPVEGVELVRGHRVEHALDLVQALEVTGGVEHEAAPAEARRVLDLHCGQHAVAAAGGELGEGGRAVEQAGFVASLHQHALCGAFQRVALTAVAEGGHDLEADAAGLGADFALGQCQARATAAGQQVGELVGDALRGFAFGLQHGIGAHGDAAALAALHGGRGGNQHQAAGAQLRAGCFSGRRGVGGKCRQRRQRGEQAAQQHCAAHPGAGRLDHRYDSLERCDERYT

SEQ ID NO: 168735 - protein, 40 aa, Glycine max
  Coding DNA Sequence Number=SeqID_77050
MAGCGRDQNRDVLDRITAVLETLVQERDVEPAEYRGLMAF

SEQ ID NO: 168736 - protein, 137 aa, Glycine max
  Coding DNA Sequence Number=SeqID_77051
EELATQLAQASKVASSRSNILLEEESGRPNGGMMLLLKVFPIKESSNNDPSQRHDDSNAASDHVYNILTSDVALIDGVAPPDTVFATSIGVPKENEVELLLPDPPYNITNLNLEATILQVIVPRPLIPPPPPKKPSK

SEQ ID NO: 168737 - protein, 161 aa, Glycine max
  Coding DNA Sequence Number=SeqID_77052
  Pfam annotation: Domain name=G-patch; Domain location=64-108; Score =17.0; E_value=0.0017; Accession=PF01585.14; Description=G-patch domain
  Subcellular localization annotation: CTP_CleavageSite=47; ConfidenceScore=5.16e-01
MAKVLIDNGFSLNVMAKATLDKLPFNASHLRPSSMVVRLYRDALEVVSNAYVESPPVQPCPSGAALMVARVMLGHGYEPGMGFGQNDNGMASLVEFTGKRGRFALGYKPTRADVRSIVLERKGRSMGQPQGLQVKKGSLVSHQRELCQRGLDVRGIGRHDT

SEQ ID NO: 168738 - protein, 263 aa, Glycine max
  Coding DNA Sequence Number=SeqID_77053
MYKAKLALLAKPLFEIKIASKKRKSTASRPTTQYDTRRFQSLEAWNRYTNNILGRNILPERNVKIYHTEFDEFKVELERRNLHKCLTKLQDGSIDVAVVKEFYANLYSPEVQASKQARVRGHLINIDVDNLNEFLQTPVVLEEGKSLPTYSRCCRLRSNPQEIEVRLYIPRKGFVLNVEGQPWKLLRKDMTTLAQTWSVFSYSNLAPTSYTSDLNMDRARLVYGLVTHMDMNIGALILGQISSIAQSNSSKLGFSALITTFCR

SEQ ID NO: 168739 - protein, 54 aa, Glycine max
  Coding DNA Sequence Number=SeqID_77054
MGCSNKDDDKGDDKKLKGQSKNVKDQASKNQDQDSRLNRRLNQDKYEKVFSETE

SEQ ID NO: 168740 - protein, 163 aa, Glycine max
  Coding DNA Sequence Number=SeqID_77055
  Subcellular localization annotation: CTP_CleavageSite=16; ConfidenceScore=5.06e-01
GRWLPPSSPRRAQLAQASQVASSKSNSLLEEYSGGPKWAWVLFAPQFLLISFDVRLLQPTIQRGCEAKRKARSSPREKMRGIATNVYSRKTLEKPKRDLQILKIRVWKLFMHGKVDKGVALALTYPRVIYETIDRLKFTLQEEKRLLMIKEGDEDAQNNKEGP

SEQ ID NO: 168741 - protein, 190 aa, Glycine max
  Coding DNA Sequence Number=SeqID_77056
  Homolog annotation: Hit_ID=A4PP05; Match level="QueryCoverage=65%, HitCoverage=33%, E-value=2e-09, Identity=35%"; Hit description=IMP dehydrogenase/GMP reductase, putative
ALCGVSQIGRYAWGVAALVNMYDRLNDASISTSRQLGGYITLLQCWIYEYFPSVAKSIADPDYDEDSPRACRCLLDPKWGAPTDPRLPYDFMLFRSPTLGVVAVYYRLERVMRKFGYTQTIPAPPVDSWVSYDDLHDRWMHYSDHMVAAGEVCAVPVATPDPDIDIRPITEPTAPSTSARSDVAEPRHAM

SEQ ID NO: 168742 - protein, 85 aa, Glycine max
  Coding DNA Sequence Number=SeqID_77057
MGSSQMPSLKKRFYQVKVKSLGITSLRELGQLMGQLQRQAFLKDYSKIWDLAMVEVSTEAIASLAQYYDHPLRCFTKGDFQLSPM

SEQ ID NO: 168743 - protein, 213 aa, Glycine max
  Coding DNA Sequence Number=SeqID_77058
  Homolog annotation: Hit_ID=A7QL10; Match level="QueryCoverage=24%, HitCoverage=18%, E-value=1e-09, Identity=71%"; Hit description =Chromosome undetermined scaffold_116, whole genome shotgun sequence
MANLKSHLQTLYAQSFRITLASSVYAAAGTELADAYSPDTVIASSPGKEVHDPPSVADHPLGPATDHRLGKLLPHQLANQTRAPPRADSSFCSSAYGVLAAVSSCCSPPKGRFLRVTHPSATGNTTSRPTCMYKADSEFSSIPRHNLYPGASYSTGVRSQKYSPPTPRVIPRASYPFSIIIRSRHTNRKTYIGFRDNQARTDNFHHVKVTLYR

SEQ ID NO: 168744 - protein, 123 aa, Glycine max
  Coding DNA Sequence Number=SeqID_77059
  Subcellular localization annotation: CTP_CleavageSite=69; ConfidenceScore=5.35e-01
MTMQNMQFQQETRASIQSLTNQMGQLATQLNQQQSQNFDRLPSQSVQNPKNVSVIALRSGKQCQGPQPVASSSSANEPAQLHSTPEKDDDKNLTKAAYPSSIPSKSNFQQKNGRGREGDLGNI

SEQ ID NO: 168745 - protein, 185 aa, Glycine max
  Coding DNA Sequence Number=SeqID_77060
MSIHVAQLIADAIYIFAGMAPTRHPLDPDKSNRALGFPALITGLCQSFGVPVTPSKVIRPPITRAFIEKYCTQRQVQGDVPQAADAPPPHQAGPVGLFDTEQYLRHLVRQQAANHRAHSQGFTSFPCPTPDQFRAEVAWPGDWPEAQAGEAPAGAPAEAPDEADEAREDEEMTDLLDFLGGSGAA

SEQ ID NO: 168746 - protein, 77 aa, Glycine max
  Coding DNA Sequence Number=SeqID_77061
MTTGGHHKLPLLTARPPHGEEHFNQSKILRIHLKDSVENKLPILSFIVSELCVWTNEREQERSLSDAERSLRRAHDR

SEQ ID NO: 168747 - protein, 143 aa, Glycine max
  Coding DNA Sequence Number=SeqID_77062
MKNTISRQNSTQTTLETFSPPPTTTDGHHEPPLLTARPQHREEHFNQSKILKIHLKDLVEKKLPILSFVVSLRLDNVNDETQVDHHGGRGELPVYDRGKLPGNHITNETSKRVGLRPQKETTPEKLVFHRFKQKTQMKHEAET

SEQ ID NO: 168748 - protein, 89 aa, Glycine max
  Coding DNA Sequence Number=SeqID_77063
MDKETFEFIDSDKKIKKLEAKEKKSNPKTCASSKKKELDNEETEEPLKRKRVDEVEATTESDEPKAPLAQVVQQPKRIKTLESLNISFP

SEQ ID NO: 168749 - protein, 255 aa, Glycine max
  Coding DNA Sequence Number=SeqID_77064
MARLDNVGLEHHSILAFEFILLRVWTVGVGEVRGKVKRNGEGGCQGKGGLLGLGCGLSGKEEKCYESGHTLIVSAEWSMVTGPKSFNHCTPKTMKSMSVDRNGDVKAHRGAIQHGAITNHNAHHGRRGGRKVEEVSQAGLEEVVSDSAVDAKRVERGAGGIEEDSSSSSFVMMANSSVERCLIEGFGFGGKVVLRPAEGIGVETPALRGGVRGRSEMKQLSKEGGARLTMRFARHLNSVRYSFTELCCWSLNKVH

SEQ ID NO: 168750 - protein, 278 aa, Glycine max
  Coding DNA Sequence Number=SeqID_77065
MATKGWSFVGASMVEGRRREWQPAINRLDTWFTDEGKKSDYKLIYAVKNVRVPKYLDLEWFSQQEFNFPNLLEVHKLTKLVQMKGTFYPKLVKVFYTYAHVDLKGNLFSTVNGVDMIINATVWKEVTGLDMGGVRKFDETIDGYNKMQIYRGMFLDPDKMLVYLITYILTPRSSNHAQVLDDDLQIVYGMKSGIKMNWVDVFDEIVDFTKASSEITERHLKTLGIRYVDHEWIMAVEPAAGNTEDARLPQIPIERKLAQCEGLRSVPKVDFCLVRRAR

SEQ ID NO: 168751 - protein, 162 aa, Glycine max
  Coding DNA Sequence Number=SeqID_77066
LGGIDGDPVLRGTRIRATWEYVSSVEGGEEVGKGETSYFYSLTTEWYLEICRGGQETLGTSVISGIWPLVIDYQGPRNGIKNVRRLLIVMAAQFIHDRVEMECLEGAWETLEGNARCRFCGTIRLTATSLVHPEEPARTLQRIVEWILPTPTPYICNSLKSH

SEQ ID NO: 168752 - protein, 354 aa, Glycine max
  Coding DNA Sequence Number=SeqID_77067
  Gene Ontology: Mol. function=amino acid transmembrane transporter activity; Cellular component=integral to membrane; Biological process=amino acid transport
  Homolog annotation: Hit_ID=A7P3E9; Match level="QueryCoverage=65%, HitCoverage=47%, E-value=8e-78, Identity=59%"; Hit description =Chromosome chr1 scaffold_5, whole genome shotgun sequence
  Pfam annotation: Domain name=NTF2; Domain location=6-109; Score=51.6; E_value=2.7e-12; Accession=PF02136.11; Description=Nuclear transport factor 2 (NTF2) domain
MDPDMLAKAIVEHYYSTFDTNQSSLANLHQEGSMLTFEGQKIQGVSSIQCHHSISTINCQPSGINVSMLVFVSGNLQLVGEQHILKFNELSLVAFGLKLKFILINGSLITKYTISNAATSVNFSLAQLIQVIILLCTSGKNGGGYEASKYEVIAFNGGIMFLHGRINSVPISVISFLRQLGVIWNVLGVFVLMILIPSVATKRASLKFAFTHFNTKNEDGIKSKPNIFLLGLLMSQYTLIGYDASAHMTEETKGADRNRPKGIASEVGIFIIVGWGYILGISFAVTNIPYFLRESNDAEKIPQWNWGHYLLGSCFYGLTSITSNSRMAYAFSRDRVMPLSSLWHKVNKKLYKKS

SEQ ID NO: 168753 - protein, 90 aa, Glycine max
  Coding DNA Sequence Number=SeqID_77068
MVNITTVMPSWEEGEHKFVTSKDLFPIWCMSHELRSNVGSHNSQSLNRNNSLNDTVSGILQYITWRRGLNIKSSLSKPSILPPQCTALTS

SEQ ID NO: 168754 - protein, 300 aa, Glycine max
  Coding DNA Sequence Number=SeqID_77069
  Pfam annotation: Domain name=Peptidase_C48; Domain location=85-282; Score=-26.1; E_value=0.018; Accession=PF02902.10; Description=Ulp1 protease family, C-terminal catalytic domain
  Subcellular localization annotation: CTP_CleavageSite=51; ConfidenceScore=5.65e-01
MAPRKLSFPQHSYRTSKKPKIEQHSKHLNAKKMQQTRGSSSGNMTNNNQSRMFHRSRTTSNRGYTHTIPKDMPCCFKPIVDMNLTFEETQIILFMCLKVAYSQLYRTRSVWCMPPAFAVDVINGSPVETLIEHYGKDWMPPFSDLKLIYIPIIQNSAHWYLMVIDMNDRNIYHLDCDLTSQAAYQRKDTIKIMANVMLSVLEIVFPTQEFVIGFDGMDCWDIIEARGIPNCGSSEKSTLWVLEWMQMEESFVSLLYGVLEEKAVRMKVAMILLLGTHNQCRGELITNAERNWHDSIHGKH

SEQ ID NO: 168755 - protein, 91 aa, Glycine max
  Coding DNA Sequence Number=SeqID_77070
  Gene Ontology: Mol. function=helicase activity; Biological process =protein amino acid phosphorylation
  Homolog annotation: Hit_ID=Q9C925; Match level="QueryCoverage=93%, HitCoverage=8%, E-value=1e-19, Identity=54%"; Hit description =Putative uncharacterized protein F14G24.23
  Pfam annotation: Domain name=DUF889; Domain location=1-91; Score= -60.6; E_value=2.3e-07; Accession=PF05970.5; Description=Eukaryotic protein of unknown function (DUF889)
MEYLSSDSLDKSETSENSYFQSITTEFLNSLKTSGLPTHSIKLKIGSPIMLLRNLDQNQGLCNGTRLVVTKMAEHVIAAEIISDNSIDFKY

SEQ ID NO: 168756 - protein, 81 aa, Glycine max
  Coding DNA Sequence Number=SeqID_77071
MTSPQKTLLRSLGITSASLTTLRTRLIFHKGNEETEEPLKRKRVDEVEATTKSDEPKAPLAQVVQQPKRIKTLESLNISFP

SEQ ID NO: 168757 - protein, 140 aa, Glycine max
  Coding DNA Sequence Number=SeqID_77072
  Homolog annotation: Hit_ID=A5AYU6; Match level="QueryCoverage=84%, HitCoverage=21%, E-value=5e-15, Identity=43%"; Hit description =Putative uncharacterized protein
MKNGETISELETRFIHIVNHLLGLGKTFEDDELNIKILNCLTRTWESKITMIKESKDLASMWMEALFGKFLEYEHGLIRQSHVEDTKKKRKGIELKDESLTIEETEVNSEFEKLLEAFNEMHEETQRLAISNNKLRSDLK

SEQ ID NO: 168758 - protein, 75 aa, Glycine max
  Coding DNA Sequence Number=SeqID_77073
MGKALIDLGAIINLMPFMLIASCIVDMGRKKLELGFEDQKIDFDLFVEDKPAPEQNVCLQVMEVGKEVLEVRTKT

SEQ ID NO: 168759 - protein, 79 aa, Glycine max
  Coding DNA Sequence Number=SeqID_77074
PSAPSDLSDSKWRLLSLAQIAYSGWSFASLTPLRKVEEGPQLLIVFVVDVVAAATLEEEHMACLNQKHFGKEGQAVVVV

SEQ ID NO: 168760 - protein, 79 aa, Glycine max
  Coding DNA Sequence Number=SeqID_77075
MTKARQKGVRKENEGGACHPSSPRRARLLPPEGTAFWGNFLEGPNMSRNFTNCLMMGAKYLKVVIRGAHPNKWMVLGRN

SEQ ID NO: 168761 - protein, 82 aa, Glycine max
  Coding DNA Sequence Number=SeqID_77076
MASYGCELLLEVASPIIFLPSPLPYHDLKEAKDSIYEEDPRPTSSTLSYIMWYQEHLRLGSIIFQSYYSCAEPLHLNFIPRY

SEQ ID NO: 168762 - protein, 31 aa, Glycine max
  Coding DNA Sequence Number=SeqID_77077
MARTCSRLKVRACSPLQARACSPLKIDCPFE

SEQ ID NO: 168763 - protein, 241 aa, Glycine max
  Coding DNA Sequence Number=SeqID_77078
  Homolog annotation: Hit_ID=Q8GYR6; Match level="QueryCoverage=90%, HitCoverage=81%, E-value=1e-14, Identity=25%"; Hit description =Putative uncharacterized protein At4g02550/T10P11_16
MERVLADVLRDQRNLGNKGDGGWKRSALNAAAAVLSTSFIVNVTSYNVKNRIKLWRSWYGIVSDILGQSGFDWDGTKHMITVENENAWNEYCTSHKSAKPFRFKVLQIWDDIVDFCAKDRATGATAIDLEEPSSNTRGKRQGSTSSGTHPHKRKMGEKEGIAASLDKIANSFNRMVEKMDGKVDDENIQEVLREAALIPDLNRQQWAKAIKWLADDPKQLAIVKALPIHQKTDYVLTHLGE

SEQ ID NO: 168764 - protein, 75 aa, Glycine max
  Coding DNA Sequence Number=SeqID_77079
MMTKVMNKKLKRSKNNSSESKNISSESRTSQEFKNQEEFKTQEKSLQTRIKIQDSRSRFKTQDSRIKKGLNQDKY

SEQ ID NO: 168765 - protein, 177 aa, Glycine max
  Coding DNA Sequence Number=SeqID_77080
  Gene Ontology: Mol. function=methyltransferase activity
  Homolog annotation: Hit_ID=Q2HRW2; Match level="QueryCoverage=91%, HitCoverage=58%, E-value=3e-30, Identity=42%"; Hit description=Beta -ketoacyl synthase; SAM dependent carboxyl methyltransferase
  Pfam annotation: Domain name=Methyltransf_7; Domain location=2-175; Score=-160.6; E_value=2e-05; Accession=PF03492.6; Description=SAM dependent carboxyl methyltransferase
  Subcellular localization annotation: CTP_CleavageSite=42; ConfidenceScore=5.16e-01
MAISYIVLTYTQKAAPKTSSNIAKPLNKRNVYITRTSPPSVYEAYFEHFEKGFQTFSKITLRVTKVAWYYEVISMVLNDKVQERQDWTSLIYVDIVIVLKKLDKWLKQKDANLQEDVDDFILNSKMRGELITKTIRAVFEPLLSAEFGEGIIDELFLRYAKLVAQLIEVETLEHTNG

SEQ ID NO: 168766 - protein, 149 aa, Glycine max
  Coding DNA Sequence Number=SeqID_77081
MNESRWEQELSPDNRYEEERTPNLESVFEKFMAYHASSKANQNSMKNHEIHFGKSYSIENFQGGPKLQPYYQNEAERGSNLDNLLMQFKQTTKSTQRELQSVEIQVGELAEEVTQFMSRREKYFIEVEAQEENHVKEHELKEKDEEKDE

SEQ ID NO: 168767 - protein, 102 aa, Glycine max
  Coding DNA Sequence Number=SeqID_77082
  Subcellular localization annotation: CTP_CleavageSite=68; ConfidenceScore=5.47e-01
MRGYLMVTRTFAQQGANEPVGARRLTSSSAPFSVLTRESSDMRGYHMVTRTFGQQGANEPVGARRLTSSSAPFVVLTREVRLHAGLPYGYPYLSSTRGKRAR

SEQ ID NO: 168768 - protein, 315 aa, Glycine max
  Coding DNA Sequence Number=SeqID_77083
  Homolog annotation: Hit_ID=UPI00006A2D9E; Match level="QueryCoverage =56%, HitCoverage=85%, E-value=4e-15, Identity=16%"; Hit description =UPI00006A2D9E related cluster
  Subcellular localization annotation: CTP_CleavageSite=36; ConfidenceScore=5.30e-01
RATGPRLLRTARPCLSRTARPCLSRTTRLCLQRNTRCRLQRAARSHFQRTTHPLHHRTTRPHLQRATRPRLEDYTSSPSEDYTSSPSEGYTVSPSEGSTPSPLEDYMSSPSEGFTPSPLEDYTSSPSEEYIIRGLHALTYRGLDALTFRGLHVLAIRGLHALVFRGLHVLTFRGLHALVFGGLHVLTFRGLHALAFRELHVIAFRGLHVLAIRGIHALAFRGQDVLVFGGLDVLAFRGLHTLTFRGLHLLAFRGLHALAFRGLHALAFRGLHVLAFRGLHALAFRELHVLSMIGLQVLTFRGLHALGVRTTRPYL

SEQ ID NO: 168769 - protein, 157 aa, Glycine max
  Coding DNA Sequence Number=SeqID_77084
  Gene Ontology: Mol. function=phosphonate transmembrane transporter activity; Cellular component=integral to plasma membrane; Biological process=phosphonate transport
  Homolog annotation: Hit_ID=UPI00005F8646; Match level="QueryCoverage =68%, HitCoverage=35%, E-value=1e-27, Identity=57%"; Hit description =COG3639: ABC-type phosphate/phosphonate transport system, permease component
MTNHQTGSLRSGQHDAAADHRGGVAAGYAIRLAAPPCGRRRRKMIALAPDVAKLKQQHAALFAAQNRYLRRIALIALALVLYYLFFFSVFGIDWQRFVIGCQQLGRYFLRMFVWQDFVNWPFGYYFSQVGITLAIVFAGTLTATVIALPVSFRAARN

SEQ ID NO: 168770 - protein, 119 aa, Glycine max
  Coding DNA Sequence Number=SeqID_77085
MEAFLWAYMVMLEGKRSYMLRFKHCCACTATATTIFRLTLIHLSNNMPLCYNMYSNEIGLIKKLMPLCEVQHTLHEGNQCADMLAKLGANSLSPLDALHDPPVAGRCTEGCLPKAVIHF

SEQ ID NO: 168771 - protein, 80 aa, Glycine max
  Coding DNA Sequence Number=SeqID_77086
MKAQVEKDEGPSGEGRSPRVEKDEFRSKDFAFDVSMMPYDHDVLMPYENALLKFNSRKKFKNTRYNIKKISSVFRKGIPN

SEQ ID NO: 168772 - protein, 86 aa, Glycine max
  Coding DNA Sequence Number=SeqID_77087
  Gene Ontology: Mol. function=structural constituent of ribosome; Cellular component=ribonucleoprotein complex; Biological process =translation
  Homolog annotation: Hit_ID=Q06FM3; Match level="QueryCoverage=62%, HitCoverage=19%, E-value=7e-23, Identity=94%"; Hit description =Chloroplast 50S ribosomal protein L2
MAIHLYKTSTPSTRNGAVDSQVKSNPRNHLIYGQHRCGKGRNARGIITAGHRGGRFTAKPRNRSLIQLEYLYRIDLNRKLKSNGSK

SEQ ID NO: 168773 - protein, 163 aa, Glycine max
  Coding DNA Sequence Number=SeqID_77088
MASNSQQFSARSDAIVIRGVHEVATNSSSSVETKKLEDSVVYAPLSTTTQTFALLCNNLKQLNSLKLMLQTSTTNLLNLSNKISPNRTIMTSPATGTIPGGGIIPTLDGRILHNSSNNNSLIFRMLLAQVDHTFLLQSSSNHNNSPRNNKQLRLLRNLPLKSL

SEQ ID NO: 168774 - protein, 162 aa, Glycine max
  Coding DNA Sequence Number=SeqID_77089
PEAYAANIYNRPPQPQQQNQPQQNNYDLSSNRYNPEWRNHPNLRWSSPQPQQQQPAPSFQNAAGPSRPYVPPPVQQQQQQQQHQQRQQSTTEAPPQPSLEELVRQMTIQNMQFQQETRASIQSESFTGNSDLQQQHILLPFPPRAISNKKNGRGREGYRGNI

SEQ ID NO: 168775 - protein, 162 aa, Glycine max
  Coding DNA Sequence Number=SeqID_77090
MSLATLFGKLQEHEMELMRLNQHEENDKKNKGIALKASSSTQEGSDKEDSIEIDEDDDLSLFKRIEKSEKKVFNEKKAKKAYITWDDNDMDSSKDSENEVVNLSLMAKNYESDEEVTSSNNNLSILFDELQDTFADLHKESVKLAKLVSSSKKTISNLEKEV

SEQ ID NO: 168776 - protein, 185 aa, Glycine max
  Coding DNA Sequence Number=SeqID_77091
  Homolog annotation: Hit_ID=A1FXK3; Match level="QueryCoverage=76%, HitCoverage=21%, E-value=2e-12, Identity=34%"; Hit description=Three- deoxy-D-manno-octulosonic-acid transferase-like
LSIWQAARHERHDRRPSHARQDKGSGGRGGVFHGEERREHAALRPIIVIRRVPQDFALFQVADHAFDIFTIEHEFIRAQPAAGLYPLHQPVVVRAMHADAGVLHAENARAQFQRQKMQTDQQNAFAALTRQPHVFHAAHLEPAGDAPVGPEPGHADFEQAHTDGLKIFDDQRLALGGGHCGEAEL

SEQ ID NO: 168777 - protein, 103 aa, Glycine max
  Coding DNA Sequence Number=SeqID_77092
  Homolog annotation: Hit_ID=A8GGC1; Match level="QueryCoverage=100%, HitCoverage=79%, E-value=9e-49, Identity=91%"; Hit description =Putative uncharacterized protein
  Pfam annotation: Domain name=DUF937; Domain location=7-89; Score =86.6; E_value=8.2e-23; Accession=PF06078.2; Description=Bacterial protein of unknown function (DUF937)
MQWVELQGGLQAILDKFRQGQFGDIVGSWLGNGENQPITGDHVQQALGSDAINQLAEKLGIDPAQASSTIAQFLPTVTDAASPNGEVQQDSNELGDMVGKLFK

SEQ ID NO: 168778 - protein, 189 aa, Glycine max
  Coding DNA Sequence Number=SeqID_77093
MTGRMLAGSLALESRTLHYLIVHILLPRSSNLAQVSEEDRIVMWAFHTGRQIGWAHLVRYCMHKALQLNAPLPYPHLVTLFLQHFNILLDFEPYVPIKRSFLIGAVVVASFGYRKERDGSWVKKGTQPNDDEGQLSVEGDSSLLQSILDRFDGLQTYVGERFEALVHSIPQCLFWEKSPRSNEEEQLAH

SEQ ID NO: 168779 - protein, 75 aa, Glycine max
  Coding DNA Sequence Number=SeqID_77094
MITKDDDKGDDKKLKGQSKNEFKIFKIKSRTLQDLRGKLISRIKISRDQDSRLKIQESIEGLIKISMKRFFSKIE

SEQ ID NO: 168780 - protein, 39 aa, Glycine max
  Coding DNA Sequence Number=SeqID_77095
MEVAITTGYVASGSGEKPLVLLDFNNMASNAGYLWCRRK

SEQ ID NO: 168781 - protein, 281 aa, Glycine max
  Coding DNA Sequence Number=SeqID_77096
  Gene Ontology: Mol. function=motor activity; Cellular component=cell projection
  Homolog annotation: Hit_ID=UPI00016621D1; Match level="QueryCoverage =56%, HitCoverage=40%, E-value=5e-17, Identity=35%"; Hit description =UPI00016621D1 related cluster
LHILTFKGLQSLTFRELHALTFRGLHVLAFRGLHALALRGLHVLCFRGLHILAFRGLHVLTFKGLHALTFRGLHVITFRGQHVLTFRGLHVLAFRGLHVLTLRGLHALTFRALHVLTVRGLHDLTFRGLHALSFRGLHVLTFRGLHALAFRGLHISTFRELKGDQLCEHNQRGRLSHNYYAYRGKIAPVPLQRDEHPVDPKKSNRVLGFLALIMGLCQFYRVPVAPSKTGAEQDTIAAWGWPTTGNRRTAATSRAPQLIYKGWSVAYDLWPISRRPSPKPK

SEQ ID NO: 168782 - protein, 129 aa, Glycine max
  Coding DNA Sequence Number=SeqID_77097
MVGYTPSSFADLVFADERIEVKRGKFNHPAWTNEKTRANEEDEKEGETHAVTAIPIRPSSPPAQHHHYSANISHSHYPPPIYPQRPSLNQQQNPPTTQPMLKHKPKHQPRNEFCSEKACRIHPNSGVLC

SEQ ID NO: 168783 - protein, 187 aa, Glycine max
  Coding DNA Sequence Number=SeqID_77098
  Homolog annotation: Hit_ID=Q2HST2; Match level="QueryCoverage=29%, HitCoverage=11%, E-value=1e-07, Identity=44%"; Hit description =Peptidase aspartic, active site
  Pfam annotation: Domain name=G-patch; Domain location=95-130; Score =9.6; E_value=0.013; Accession=PF01585.14; Description=G-patch domain
HVAQDISVEGFEGIVNNITANNHLTFAEEEIPIKGQGHNRAIHVSVKCMDHIMAKLPIGPIVDPLGWGGPFDTPSKAEVRGRGTLSHRFRGGGYSRHGNEPEMGLGKNSDGMANLVEIKENRRKFGLGYKPMWADMRRSALERRNRGMGSQLRLQVGEAPPCHINKSFISAGLRRKEQVAKVHDEAP

SEQ ID NO: 168784 - protein, 131 aa, Glycine max
  Coding DNA Sequence Number=SeqID_77099
MKADMSALKDQMASMMEAMLSMRRLIESNAATATAASIVAEADSALPSATNLAHQLASDMDLPLNFTPPTMNENMDHAVPFTFEGQPPQPVGGACEEPRERTLGDIDLYPLFTTEGPTPNALPQPNIAGVS

SEQ ID NO: 168785 - protein, 126 aa, Glycine max
  Coding DNA Sequence Number=SeqID_77100
MEEEAGHMFFHCSKVIPIWWETLSWVKKSTALPYDPRHHFLHHESILNEGTRDNRWKCWWLAVTWTIWQQRNKTIFSNESNESFDSNKVMEDAAFLLWTWLRHLEKDFSMHFNQWTCNLRAGILYQ

SEQ ID NO: 168786 - protein, 95 aa, Glycine max
  Coding DNA Sequence Number=SeqID_77101
MASYETKKSIDEEDPRPTSSNGAYIILEYLTFQDGSITVVVEGFGKVRKQRDGKLLGKGSSKSLNLTSLQNEVRVGVLRASGYSGSDVSYMAQSF

SEQ ID NO: 168787 - protein, 216 aa, Glycine max
  Coding DNA Sequence Number=SeqID_77102
  Gene Ontology: Mol. function=metal ion binding; Cellular component =integral to membrane
  Homolog annotation: Hit_ID=Q06A77; Match level="QueryCoverage=28%, HitCoverage=25%, E-value=8e-29, Identity=98%"; Hit description=PHD3
  Pfam annotation: Domain name=2OG-FeII_Oxy; Domain location=148-215; Score=25.9; E_value=0.00015; Accession=PF03171.11; Description=2OG -Fe(II) oxygenase superfamily
MIVVVALTGYSLFSAVIVAMPCPSTMPRAWTFFLLDQEVNLPVEELPSELPEPVLGINFARDGMQEKDWLSLVVVHSDTWLLALAFYFGARFGFDKTHRNRLFSMINELPTIFEVVTSAAKKQVKEKSSVSNNSGSKSKSRSNLYDFISWKHQFRIYPDLELTLGLPMHTDFNVLIIVLQSQVSGLQVIKDGKCIAVPVIPNAFVINLGDQIQRKG

SEQ ID NO: 168788 - protein, 205 aa, Glycine max
  Coding DNA Sequence Number=SeqID_77103
  Gene Ontology: Mol. function=protein serine/threonine kinase activity; Cellular component=nucleus; Biological process=protein amino acid phosphorylation
  Homolog annotation: Hit_ID=A2XUW1; Match level="QueryCoverage=29%, HitCoverage=8%, E-value=3e-19, Identity=78%"; Hit description=Cyclin- dependent kinase G-2
  Subcellular localization annotation: CTP_CleavageSite=30; ConfidenceScore=5.18e-01
MTLINPIRLTELVNLVPKPTRRRLRRSKSRISMTSEVRIRGKKTLRHLPFLPPTKPSACNHTSSRKSNAASTLPSSTAPTTSLLPTCSSCIALLSWIVLKNTSTRLKSLSLTLSVLFLRSVCEFEMIKKINKGTYGVVYKARDKKTGELVALKKVMNIERDGFPMSSLREINILLSFNHPSIVNVEEVVVDDFDGTFYGNGAHEV

SEQ ID NO: 168789 - protein, 547 aa, Glycine max
  Coding DNA Sequence Number=SeqID_77104
  Homolog annotation: Hit_ID=Q2HW90; Match level="QueryCoverage=86%, HitCoverage=98%, E-value=1e-112, Identity=45%"; Hit description =Putative uncharacterized protein
  Pfam annotation: Domain name=DUF1723; Domain location=115-164; Score =16.9; E_value=0.0053; Accession=PF08330.1; Description=Protein of unknown function (DUF1723)
MEDVVRWLIKSSLELVDTRYYTQTRLSYEHCWTGSSPVIRQYSEVVNDFGNLVEPVIQTSFVVNIVGMNFTKRNTQKYNFKDPDLTNLRKLGSLVVSPDDFRKRYGNLLSILKTNVEEGILNTLVQFYDPLYHCFTFPDYQLVPTLEEYSYLVGLPVSDKLPFSGLEPTPKPLTIAAALHLKTSDITSNLTTKGGFQGLTPSFLYQKAYTFAEATSTGAFEATLALLIYGLILFPNIDDFIDINTIQIFISGNPVPTLLADTYHSIHHRTQKKCGVITCCAPLLYKWFTLHLPQTHLFKTNPEKTRWPQRIMSLTPIDILWYQPASNIGVIIDSCGEFPNVPLISTRGGITYNPTLARRQFGYPMKEKPNNLSLTGEFYLNHEDHAGMRLRFVRAWHTVRRLDRNQLGRRTGFVHGSYTQWVIDRASILGLPYPLPRHVSSTVPSPSLPVPFDNKEECNEQLIQMRLERDTWKKKYQELERENETLKGKLAQKDHELFVQNQRIIEKDDLLRRKDALLRQDSKRRRRFMDSLSSAHPDFEDPSTPGV

SEQ ID NO: 168790 - protein, 162 aa, Glycine max
  Coding DNA Sequence Number=SeqID_77105
  Subcellular localization annotation: CTP_CleavageSite=43; ConfidenceScore=5.25e-01
MAPTKLFVSLTLVLSLSHSLTSRCYNSHSFSRPLTLTLLAEPLVAEKEGIWMVLTETLEDAKARHLAAVLVWVIMKEPLTEVHMPGLAGSAVEQPALQHRQLLFMACHDDAKGVRDLLNEGLRRDLHPWKRVFGESTILRISLAMAVEDKWCMVIEGRGFAA

SEQ ID NO: 168791 - protein, 84 aa, Glycine max
  Coding DNA Sequence Number=SeqID_77106
MTLQFVDGSKKKALWKEVNMTIKEDQQVPIILGISFMRTAHVTIDVRKGVYTLREGKKHMFYYIQGIEDFPNESAHQQHHHATP

SEQ ID NO: 168792 - protein, 147 aa, Glycine max
  Coding DNA Sequence Number=SeqID_77107
  Gene Ontology: Mol. function=protein dimerization activity; Cellular component=nucleus; Biological process=regulation of transcription, DNA-dependent
  Homolog annotation: Hit_ID=A7NSY4; Match level="QueryCoverage=72%, HitCoverage=12%, E-value=9e-38, Identity=73%"; Hit description =Chromosome chr18 scaffold_1, whole genome shotgun sequence
MASMEEKIKIGGGMIVGAQTLAAEMKLLKEMQEHSGVRKTLNSELWHACARPLVSLPQVGSLVFYFPQGHSEQVEASTRRTTTSHIPNYPNLPYQLMCQVQNAILHLPFQYLYREDKLLEHAKALKVNTGIEPDIELGPVISKQICL

SEQ ID NO: 168793 - protein, 114 aa, Glycine max
  Coding DNA Sequence Number=SeqID_77108
  Subcellular localization annotation: CTP_CleavageSite=41; ConfidenceScore=5.21e-01
MSKGWDPGSANAGCTGKSSHLATHVPYDWPPVGRPNVAYMRASGAQSSTREPRWTLRMEADVEVVVVHLRLAADGPINGRLDKLCGCNRHPIELAETRDQGQKSQCSIGLLRVH

SEQ ID NO: 168794 - protein, 59 aa, Glycine max
  Coding DNA Sequence Number=SeqID_77109
MDTKEALGGEGGSSGQLADFEPLAKPILWHSEPFAKRNSSWLSAMTDAKPEVTDAQDFG

SEQ ID NO: 168795 - protein, 716 aa, Glycine max
  Coding DNA Sequence Number=SeqID_77110
  Gene Ontology: Mol. function=small conjugating protein ligase activity; Cellular component=cellular_component; Biological process =regulation of protein metabolic process
  Homolog annotation: Hit_ID=A7P1M3; Match level="QueryCoverage=23%, HitCoverage=59%, E-value=4e-55, Identity=54%"; Hit description =Chromosome chr19 scaffold_4, whole genome shotgun sequence
  Pfam annotation: Domain name=UQ_con; Domain location=572-678; Score =1.7; E_value=2.6e-05; Accession=PF00179.17; Description=Ubiquitin -conjugating enzyme
MDPNVIEIPPPTTNNNNTCNSIKQKEAIFHHEVINTDKDNDSTKLILFGQKVGKGKAIQTTHQNMEVCEDVIGKSRWTYGHSSSSESSNDEEDDDNCFDFFSKDYMTSQSSLSLEPTIKDPPGVQYSQTPLSKKKSNGSQQRRRKLKLPWEMGSSKSFESEKKPNICYSSNHKFVNNFEAKKLPLAGGTPHWGLPPADGALDWGLLFVGGALEWEFSHVGGIPYWGLLPAGAVSGTPLETPQWGLSPAGGGTPKWRLSHVGGTPHWGLQPAGSRAPKWGLSHIGGTSHWGLPPAGGIGGTPLETPQWGLPPVGGGTSEWGLSHVGGTPHWGLQPVRSGAPEWGLPHIGGTSHWGLPPAGGGTQKWELSHVGGTQHWGLLHASGVGGTPPAGGAPEWGLSHISGTPHWGLSPTSGVGGTPLAGGAPNWGQAGVSMMTVYNPYHSNFVGPSYHHPGSESINQMWSTNAYNLQAFPNYNYYYPYDYNYTAPFAHHFHVPPGPLIHNSWVYNSVGDGNNEATANNTVATISDEARGEILRKFQSFKQFDVIEDVSDHHFVHANSSMEQHSKHWAKRIQGEWKSLEKDLPDSIFVRVYESRIDLLRAVIIGAKGTPYHDGLFFFDVFFSSGYPHVPPVLVSIQGLILVAKPFFNEPEYAHLSNSQYGEISSLKYNEDTFILSLRTMIYIMRRPPKNFKDFVAGNFAAELMIFWWHARHTLM

SEQ ID NO: 168796 - protein, 128 aa, Glycine max
  Coding DNA Sequence Number=SeqID_77111
  Gene Ontology: Mol. function=alpha-mannosidase activity; Biological process=carbohydrate metabolic process
  Homolog annotation: Hit_ID=A7PPB9; Match level="QueryCoverage=43%, HitCoverage=12%, E-value=7e-12, Identity=60%"; Hit description =Chromosome chr8 scaffold_23, whole genome shotgun sequence
MGCKSRGIKLCGALAPAGMIVAWTSKCLPNYQREKYVVVTIVDCRTLLDPVLPSNHAGCVLRLNLEIYTKDKESEFSMLVDRATGGASIKDGEVELMLHSINTMFTTQGVFSMMIVEVLGNHLMNKFA

SEQ ID NO: 168797 - protein, 684 aa, Glycine max
  Coding DNA Sequence Number=SeqID_77112
  Gene Ontology: Mol. function=small conjugating protein ligase activity; Cellular component=proteinaceous extracellular matrix; Biological process=regulation of protein metabolic process
  Homolog annotation: Hit_ID=A7P1M3; Match level="QueryCoverage=33%, HitCoverage=78%, E-value=2e-78, Identity=54%"; Hit description =Chromosome chr19 scaffold_4, whole genome shotgun sequence
  Pfam annotation: Domain name=UQ_con; Domain location=440-570; Score= -6.1; E_value=9.6e-05; Accession=PF00179.17; Description=Ubiquitin -conjugating enzyme
MEVCEDVMGKSRWTYGHSSSSESSNDEENDDNCFDFFSKDYMTSQPSFSLEPTIKDPSGVQYSQTPLSKKKSNGSQQRRRKLKLPWEMGSSKSFESEKKPNICYSSNHEFVNNFEAKKLPLAGGTPHWGLPPADGAPDKGLLFVGGAPEWEFSHVGGIPYWGLLPAGGASGTPLETPQWGLSPAGGGTPKWRLSHVGGTPHWGLQPAGSRAPKWGLSHIGGRSHWGLPPAGGIGGTPLETPQWGLPPAGGGTSEWGLSHVGGTPHWGLQPVRSGAPEWGLPHIGGTSHWGLPPAGGGTPKWELSHVGGTQHWGLLHASGVDGTPPAGGAPEWGLSHISGTPHWGLSPASGVGGTPLAAPFAHHFHVPPGPLIHNSWVYNSVGDGNNEATANNTIATISDEARGEILRKFRSFKQFDVIEDVSDHHFVHANSSMEQHWAKRIQGEWKSLEKDLPDSIFVRVYESRIDLLRAVIIGAEGTPYHDGLFFFDVFFPSGYSHVPPGLILVAKPFFNEPGYAHLSNSQYGEISSLKYNEDTFILSLRTMIYIMRRPPKNFKDFVAGNFCSRAHDILVACKAYIDGAQVGCVVKGGAQDVDQGGSSSSVQFRTSLAAFVNMLVNEFTQVGAKDCDKVFPLTAVGNSSNEMLKTVGNPSGVKLTAVGNMSGEMVAAVGNASDEMLVAAAAIP

SEQ ID NO: 168798 - protein, 100 aa, Glycine max
  Coding DNA Sequence Number=SeqID_77113
MHGYLFYIHIHNKCSTRVSHHLGAKKTIMVQHPPNAGPKGIFIQHALIFMYSHTQKFKLGSLGLSLILASTNCSHTEKWKPICINSFHKQNFSKIMRKCH

SEQ ID NO: 168799 - protein, 152 aa, Glycine max
  Coding DNA Sequence Number=SeqID_77114
MLSATITLSTFIFSVELSVELAKRGYALTKWLPVREKHQLQCPRLGMNLRVRGHLIKFDADTLNTFRKTPVVIEEGESLPAYSRFANMTTDPQELAACLCIPRRGFELNADGLPLKILRKKLTTLAQTFLSFSNLAPTSHTSDITLDRAKLI

SEQ ID NO: 168800 - protein, 125 aa, Glycine max
  Coding DNA Sequence Number=SeqID_77115
MPSLVTDVWGDNTFPVRKYNSRTFHLSVGCDSACIPFMEHAPASHASLSHRRVGIPPARHSVDPEKSNRVLGLPALIMGLCQFYGVPVTPSKVIKPPTNRAFIKKYCAPRQAQGETPQQPADGRL

SEQ ID NO: 168801 - protein, 70 aa, Glycine max
  Coding DNA Sequence Number=SeqID_77116
MGKVEEVQEKLKADMQAMKEQMATMMEAMMSMRKIMEANAVVVAATSTVAKVKSMPPSGLNQMNHPTSAM

SEQ ID NO: 168802 - protein, 110 aa, Glycine max
  Coding DNA Sequence Number=SeqID_77117
RTTRPPLEDYTSSPSEDYTSSPSEGYTPSPIEDYTSSPSEDYMSSPSEDYTPSPSEGYTPSPSEDYTSSPSEVARPRHHRATCSHLQRTTRPHLHRAARPRPHRATRPHL

SEQ ID NO: 168803 - protein, 102 aa, Glycine max
  Coding DNA Sequence Number=SeqID_77118
IPEHKGWVVPMWFRLCNGFYKDSGNLKPQGPTLIGGKNKLKVDKCFTTPGMAPNLGKLVGLGSSSSMDSFASWKINGSGMEKEEREKMPLQGEDKSRRSSPP

SEQ ID NO: 168804 - protein, 101 aa, Glycine max
  Coding DNA Sequence Number=SeqID_77119
  Homolog annotation: Hit_ID=A0ST23; Match level="QueryCoverage=24%, HitCoverage=51%, E-value=3e-07, Identity=100%"; Hit description =Putative reverse transcriptase
MARSNLLVPVDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 168805 - protein, 156 aa, Glycine max
  Coding DNA Sequence Number=SeqID_77120
  Subcellular localization annotation: CTP_CleavageSite=33; ConfidenceScore=5.87e-01
MTRSTDCAASKLRPSSPSPASNVLAPRPVNNVSSNERKTTSSSTMSIFLPISGFSILSPCVPDISIVVHKTPLRLSELAEVTTPVNEQLIICYGPAVIVHPFFSPRRPCLPQWPLQPDESPALKSADKKAESAHPADRLPYGYVSGDFPIPGLTLT

SEQ ID NO: 168806 - protein, 487 aa, Glycine max
  Coding DNA Sequence Number=SeqID_77121
  Gene Ontology: Mol. function=oxidoreductase activity, acting on the CH-OH group of donors, NAD or NADP as acceptor; Cellular component =cytoplasm; Biological process=electron transport
  Homolog annotation: Hit_ID=Q4GY29; Match level="QueryCoverage=88%, HitCoverage=96%, E-value=0.0, Identity=91%"; Hit description=UDP -glucose dehydrogenase
  Pfam annotation: Domain name=UDPG_MGDP_dh; Domain location=244-339; Score=182.6; E_value=1e-51; Accession=PF00984.10; Description=UDP -glucoseGDP-mannose dehydrogenase family, central domain
  Pfam annotation: Domain name=UDPG_MGDP_dh_C; Domain location=361-465; Score=126.1; E_value=1e-34; Accession=PF03720.6; Description=UDP -glucoseGDP-mannose dehydrogenase family, UDP binding domain
  Pfam annotation: Domain name=UDPG_MGDP_dh_N; Domain location=57-234; Score=223.4; E_value=5.4e-64; Accession=PF03721.5; Description=UDP -glucoseGDP-mannose dehydrogenase family, NAD binding domain
  Pfam module annotation: Pfam domain module=UDPG_MGDP_dh::UDPG_MGDP_dh_ C::UDPG_MGDP_dh_N; Domain location=244-339::361-465::57-234
MLMEKETVEAYHLTGVSHDCGNKLGYMQAFVEVWRASSGAGQRFRSVARRRCRQQKAAVLAEVGHDVLCIDVDEKKVENLKKGIIPIFEPGLTPLVMSNYEAGRLKFSTNAEEGVNHGVMQFIAVGTPPDEDGSADLKYVTAVARTIAQHMNDHKVVIDKSTVPVGTADRVRAVMSETLKQRDANIAFDVVSNPEFLKEGAAVNDCMRPERIVVGTDNDEVVELLRELYEPFNRNHDRMILMDIRSAELTKYAANCMLATKISFMNEISNLAERLGADVEKVRQGIGSDSRIGYHFIYPGCGYGGSCFPKDVQALIRTAESIGYTPRLLQAVEDVNDSQKNKLPTFIKRHFGDDLRGKTFALWGLAFKPNTDDMREASSRVLMEALWQAGATVQAFDPEAMEEAQRIYGHRDDLKLCGTKEAALQGADGLVICTEWQNFRAPDFDVIKSSLKQPVIFDGRNLYDPERISKRGFVYYAIGRGASIQIV

SEQ ID NO: 168807 - protein, 133 aa, Glycine max
  Coding DNA Sequence Number=SeqID_77122
MTLNLRVSTGLSAAIDEGRRRRHAKKNVYTDNHSGISARQRDSNVNMTDLCQRACRSRLTKGAEDDVSLCVLSGFSSFRQQKEVYTDNHSGISARQRDSKVSMTDLVSAEDDVNLRVSTGLSASIDKGRRRRR

SEQ ID NO: 168808 - protein, 125 aa, Glycine max
  Coding DNA Sequence Number=SeqID_77123
  Gene Ontology: Mol. function=alkanesulfonate monooxygenase activity
  Homolog annotation: Hit_ID=Q87ZG3; Match level="QueryCoverage=62%, HitCoverage=20%, E-value=1e-25, Identity=71%"; Hit description =Alkanesulfonate monooxygenase
MHANQAAVTIQLMGGLAVADCCVGHVYSTAQYQSAAIDAGIAQAADRLGYGGVLVPSGRSCEDAWVISSALINETNQLKFLVATRPGFISPVVSARMASTLDRISGGRLLINVVAGGDPAEQQAE

SEQ ID NO: 168809 - protein, 30 aa, Glycine max
  Coding DNA Sequence Number=SeqID_77124
MAEYEACALGVQAAIDFNVKLLNVYGDSVL

SEQ ID NO: 168810 - protein, 75 aa, Glycine max
  Coding DNA Sequence Number=SeqID_77125
MSKLPAPAIFFQAWHIDCLGLTFNLPMYVELTKVRGVTSIGVGKKNLSEETLGLGNVGVPSSFVASQWLEEKAGW

SEQ ID NO: 168811 - protein, 182 aa, Glycine max
  Coding DNA Sequence Number=SeqID_77126
  Gene Ontology: Biological process=transposition, DNA-mediated
  Homolog annotation: Hit_ID=Q1J7G7; Match level="QueryCoverage=20%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLEKGNQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 168812 - protein, 17 aa, Glycine max
  Coding DNA Sequence Number=SeqID_77127
MADRQATKSKAKGSKIP

SEQ ID NO: 168813 - protein, 50 aa, Glycine max
  Coding DNA Sequence Number=SeqID_77128
MGEVVATQLAQASSAHPDELDCLTMGVKFLEAVKRRLHAIKQWSPDEIRV

SEQ ID NO: 168814 - protein, 206 aa, Glycine max
  Coding DNA Sequence Number=SeqID_77129
MQYLLQRIPPAFADAVSDQLIHGQMTLKAADACQVHWQLTLPAADIAEAQALLQAEPAKQIMLAAQGYQIPEQGSVEADFAVDPATLQPRHQEILQTAPLGKLRASVELMYALLTQARTSGGQAAQTPWTQAELQSAQVSCQQQFRADDSEKACACYSHGLAEKYSARQVKYNRYLMTNPYAFATGNGGDFKQLDKSLQATCGLAI

SEQ ID NO: 168815 - protein, 651 aa, Glycine max
  Coding DNA Sequence Number=SeqID_77130
  Gene Ontology: Mol. function=sulfuric ester hydrolase activity; Cellular component=membrane; Biological process=metabolic process
  Homolog annotation: Hit_ID=Q1H1H0; Match level="QueryCoverage=98%, HitCoverage=96%, E-value=0.0, Identity=58%"; Hit description =Sulfatase
  Pfam annotation: Domain name=Sulfatase; Domain location=288-583; Score=186.5; E_value=6.8e-53; Accession=PF00884.14; Description =Sulfatase
MQSSYFGKPRSSSKLWAIGHWFGPYAPLIVMFISGLVFLSLTRLGLVVWKWERVQATGELCQILLQGVRVDVIQLGLLAIIPVLLSPVLATRKFFNVWRGFTFWWVLLSLVLLVFLEAATPGFILEYDVRPNRIFVEYLKYPHEVFGMLWQGFKPELFFGLLMTMIAFAMVARLLKPWREAEAKWASPAVWLVWPLILVLTVFGIRSTLTHRPANPALFAITQDSMVNSLILNSTYSVFYAAYSLQHEAKSSAIYGKLPREKIFALTGAKDGDIPTLTTLVPSVKRDKPLNLVILLQESLGAGFVESLGGKPVTPNLEKLKDEGIWFTHLYATGTRSVRGIEAVVTGFQPTPSDSTVKLDLSQKNFFTLAALLSKRGYLTEFIYGGESHFDNMRSFFMGNGFQQITDQPDFKNPVFVASWGASDEDLLNKTHDQLMAHHASGKPFFTLAFSSSNHAPFEFPDGRITLYEQPKATDNNAVKYADYAIGEFIKKAKASPYWNDTVFLIVADHDIRVRGDSLVPIEHFHIPALILGGAVQPKTVDAIASQIDLPVTVLSLMGIEAQHPMTGHDLSNLGADYRGRAMMQYNYNFGWMQQMGTGVAENEVVVLREGKPPAFGHYDPVSKQLQNTPAPADANDLAERALANSLLPAL

SEQ ID NO: 168816 - protein, 422 aa, Glycine max
  Coding DNA Sequence Number=SeqID_77131
  Gene Ontology: Mol. function=acyltransferase activity; Cellular component=integral to membrane; Biological process=metabolic process
  Homolog annotation: Hit_ID=Q4IZT1; Match level="QueryCoverage=75%, HitCoverage=45%, E-value=1e-109, Identity=60%"; Hit description=AMP -dependent synthetase and ligase:Phospholipid/glycerol acyltransferase
  Pfam annotation: Domain name=AMP-binding; Domain location=1-263; Score=45.6; E_value=1.8e-10; Accession=PF00501.19; Description=AMP -binding enzyme
DPRSEGKPKGVVHSHKSILANTHQILAMLDFSPSDKFMMALPLFHAFGFTGALLPLLNGIPLLLFPSPLQYKLIPEVIYDKGCTVFFSTSTFLSNYAKYAHPYDFYKLRVVFAGAEKLNEEVRKIYHEKFGIRILEGYGTTECAPVLAANTPMANRNGSVGQFFPGIQYKLTPVPGIEKGGLLHVKGDNIMQGYYLFDNPGVLVAPQDGWYETGDVVEVDAEGFIHIKGRVKRFAKVAGEMVSLEVVEKIASTAAPDQQHAATTVADASRGESIVLFTTDSKLKREDLQIVAKNLGSPEIAIARKIIVVEQIPVLGTGKTDYGLGAFNDNVFKTALITQVAFNTASLTQLDGATLATLLPGLFILPFFLFSASAGQLADKYEKSQIIRLPDDAGFSLVFNGRAFDLVWAGEIFLFAPAFTAK

SEQ ID NO: 168817 - protein, 159 aa, Glycine max
  Coding DNA Sequence Number=SeqID_77132
MSVAPSFLSLGGSCDLGEMYHQRFRLSKTFLICGLHAYMLLFTPLIADFQLALVYHLSTDKPSGGRHVLQRFGPARPTLLDSINSSPSMIGKWVALGLYHFGKGGWWILPGDITAIWLVMRDGKRGKFLIALEPMPKWAFPAGSRRRELRSSGDAAHID

SEQ ID NO: 168818 - protein, 85 aa, Glycine max
  Coding DNA Sequence Number=SeqID_77133
MHCVIDYMVMGTSFVVQVEGTSTWVVVTENKRGYISCGSVQVEGTSTWLFKENKGGYIPCGSLLVKDFTRLKRNLKNRWLLGDWM

SEQ ID NO: 168819 - protein, 71 aa, Glycine max
  Coding DNA Sequence Number=SeqID_77134
MTKARQKGENGGDACHPARPSEQGDFLQKQPPFGGPKWVWFLFAPPFLLGDSFFIKLRKLTNFVTIPVFFS

SEQ ID NO: 168820 - protein, 56 aa, Glycine max
  Coding DNA Sequence Number=SeqID_77135
MRKLIKVRMENKVVNFVGESSRFVVLGIKWMNGMNKGEDERKERITLSSEGNTQRL

SEQ ID NO: 168821 - protein, 68 aa, Glycine max
  Coding DNA Sequence Number=SeqID_77136
SATRRQPRIGYKEAPCKVVQEGHHRRGFQCGPHKLTQALTNTDSRAWNINSISRPSKDGYSSDRDMGS

SEQ ID NO: 168822 - protein, 72 aa, Glycine max
  Coding DNA Sequence Number=SeqID_77137
MVEGSDAKANFAPEAKDFKWFTFTLNGSQELPRLLAKAKAMADVYSAPEEVHGLFDYCQHMIELMSHIIRNC

SEQ ID NO: 168823 - protein, 146 aa, Glycine max
  Coding DNA Sequence Number=SeqID_77138
  Gene Ontology: Mol. function=transporter activity; Biological process= transport
  Homolog annotation: Hit_ID=A3M541; Match level="QueryCoverage=67%, HitCoverage=18%, E-value=4e-48, Identity=94%"; Hit description=Heme -binding protein A
MNLKLKFFKLAILSLAITSVPCAYAITPAQPNKILHVAYEAPDDGFDMVKTTNFYSANIAEAIFEPLLKYDYLARPLQLAPYTVESLPKVEQDGKVYTFKIKPGIYFTNDPAFKGKRRELVAEDYVYTIKRILDPKNRAPSVSFID

SEQ ID NO: 168824 - protein, 132 aa, Glycine max
  Coding DNA Sequence Number=SeqID_77139
MSSGLPPRDNKMCRRRCKSLRVNGLICPWLTKDVDNHTETTLVSARQQARSPLVTKDADNHTETTLVSACQQALSLTDSKRVCAGYRIRHLRVPTDSRVTIAKGGAVNKSEAFAPTYPQFVIRNSDLRSSFL

SEQ ID NO: 168825 - protein, 135 aa, Glycine max
  Coding DNA Sequence Number=SeqID_77140
MTKSKGKDPLEGLGGPMTRARARKAKEALQKVLSILFEYKPKFQGEKSKGPIGNLGISLLGDQMVADLLAVGVIQEHPGCIKGLSQPLCVALAGKSDSFLPFIFTLVLSNHNSRKSTSAQNYLVAITPILRTQIK

SEQ ID NO: 168826 - protein, 157 aa, Glycine max
  Coding DNA Sequence Number=SeqID_77141
MKLFGGPGEPDTSLGEMESRKIKKKTLLPPYLLMEVGWGKSVNTSVCAIGCYFMTIHIEFSIIHHRPPPLSMPTMQPSLTALSAPLPMPALYLPDLDRVRAATFFDNLFNIVLCYGHVAAPHDKPWENRDMTLFEMGPESYRATMVARKRQPATFVL

SEQ ID NO: 168827 - protein, 129 aa, Glycine max
  Coding DNA Sequence Number=SeqID_77142
MGAYSRDEKLLMHFFQDSLAGVAVICKPRMVPTNTHNITEFFGPCRKLFLLTARPAKDVRVSTKRDPQTLAPAQPHLAGNANPGMGSNMGRNPPTKKAPEFAPIPMSYGDLLPSLIANQLAVVMLGNIY

SEQ ID NO: 168828 - protein, 51 aa, Glycine max
  Coding DNA Sequence Number=SeqID_77143
MVNTALNVRQRETKVVGNGLRPKLYSEKFGHATLPSFPCYSCLNTCPPSAR

SEQ ID NO: 168829 - protein, 170 aa, Glycine max
  Coding DNA Sequence Number=SeqID_77144
MPNSLSWWNRDAILLRRGPIARAITRRLQEDWARDAGEGPRVLMSLRGGYPISLGYPSNVGFFSPCILGHLDKTPLMKKIQGLQALHGATLNHHFQRESKRANNRTGPKSWAKAFVSKGENERSRHQRLFEENVRKIKKIKGVSLAPTYPQIDFNCEQKSFKALDLETIS

SEQ ID NO: 168830 - protein, 409 aa, Glycine max
  Coding DNA Sequence Number=SeqID_77145
  Subcellular localization annotation: CTP_CleavageSite=36; ConfidenceScore=5.20e-01
MDCSRFASGKSRRPLLPDFACKVAIPGKLTFQMFFSQEMAPKKLSTKRSRKDPTGESSSAASGFDRHRFQSAEHQQRFEAIKGWSFHRERRVQLREDEYPDFQEEVTRRRWAPLVTPMAKFNPEIVMEFYANAWPTEEGVQDMRLWVRGFLLDRCRKTGVDHAHQYDHPDSDMDDVAAKQHPAQRSQLRPPPTEVSAGVCHTGTDENGAYEAPFGPGEVQQGPGFYGVSVAPSKVIGRLSPEPSSRSTAPQGRHRVRHHINLERISSRQQTHRHHLRSPPQLTCRGWSTIYDMWPANKRPTTGDRCGCMSIFTSTPSASRARVPPLTYVLLRSSLGLRSHGLETGPILRQGQDLQGPPEMRMEPRKMRIWLTCSTSWEGAEPHDRDRQTCDFSSSNITAFSYFVISIVT

SEQ ID NO: 168831 - protein, 389 aa, Glycine max
  Coding DNA Sequence Number=SeqID_77146
MVIADVSGWHVLESETRFNSRRIESTQTLRTWNREDIYATFHRQNLEAPSTVDGSRRGRSATMVFWPDLPIFIVIFINGGVDGDVTVALIRGRVALIVFSMNVVAEGDEVEGGRVIVRAFGIKVSGDADEAPRRRRLTAFARRQWVAAPVAKDVEHVDHVADEVHDQPQEAVVDDVVIDAQGFPGEPHDTSILMDYERPELKLSSHQRKVEKFERPGLQIEGIAISIALGQCALEYTEWLYFISHPFMSPTQPRDPPRYPPVVHDDTFTKPGSPQQSVTTAAMPQPQPPTLANVDIPQNAVSCQAIAERLERLINLRVDTEGTKAYTVTEECLRISRGVTVQENNPNRATRRRALESTRNTTTANGECLSEYIEVRYELLTLEDYNEHV

SEQ ID NO: 168832 - protein, 99 aa, Glycine max
  Coding DNA Sequence Number=SeqID_77147
  Homolog annotation: Hit_ID=A7PNI1; Match level="QueryCoverage=54%, HitCoverage=7%, E-value=3e-08, Identity=59%"; Hit description =Chromosome chr1 scaffold_22, whole genome shotgun sequence
MFRLLRLENSYERSTSSIMFSGKVILRKETTSIDSLTTNRLSPNALTSVCVDRLTKIMCAILESYASEDRRHVDYVAISKCEEFRRFRELDGKDTGNWV

SEQ ID NO: 168833 - protein, 167 aa, Glycine max
  Coding DNA Sequence Number=SeqID_77148
  Homolog annotation: Hit_ID=A5AGG9; Match level="QueryCoverage=45%, HitCoverage=9%, E-value=1e-11, Identity=50%"; Hit description =Putative uncharacterized protein
  Subcellular localization annotation: CTP_CleavageSite=56; ConfidenceScore=5.45e-01
LPSLGTDVWGANTFPVRKYNSRTFHLKVRRSRLFRFFRHFSQINVGGDSARIPFVEHASRESRIALPPKGTFGVVVLEIVSGHKVVDFRQPKVLLVNKVDELEVRKRPLEALADMGLNGEYNLKELMRLVGNASSHDLKERRNGFGLEVLVFCASYSEIGLVEWLIG

SEQ ID NO: 168834 - protein, 126 aa, Glycine max
  Coding DNA Sequence Number=SeqID_77149
  Gene Ontology: Mol. function=ubiquitin-protein ligase activity; Cellular component=ubiquitin ligase complex; Biological process =protein ubiquitination
  Homolog annotation: Hit_ID=A5C882; Match level="QueryCoverage=71%, HitCoverage=36%, E-value=2e-21, Identity=55%"; Hit description =Putative uncharacterized protein
MEGKNMSKVIKLVNEIASISEYKPPVKKQYCNLARRLKLSTPMFEEIRDMKKDALPEDTSNAVLTFKEALQSARELLKFGSEGSKLYLVMTCRPRSDLLMNLPTLRKLDSMLLVSVGSYFHCVLVE

SEQ ID NO: 168835 - protein, 66 aa, Glycine max
  Coding DNA Sequence Number=SeqID_77150
MSSVVYKDWVFTDQALPNDLVKRRFLQKAVASGGSNPARLGELGGKHLPYFAINRGGSEEEKGSAP

SEQ ID NO: 168836 - protein, 86 aa, Glycine max
  Coding DNA Sequence Number=SeqID_77151
MTLRSANMHSSSFFQILPRTQLRCVALSGWLAKPEDWLSERNHYFFSTIIMGVFLNGRVMDYVKAFDYVDRLASEHLHGVVFAYSA

SEQ ID NO: 168837 - protein, 195 aa, Glycine max
  Coding DNA Sequence Number=SeqID_77152
GYIYLGLTENKRGYISCGSVLVEGTSTRFKENKGGALGFPALITGLCQSFGVPVTPSKVIRPPITRAFIEKYCTPRQAQGDAPQVADAPPLPHQADPAGSLGMKRYLQHLVRLQAANHVGQVQIHECLYQLSLSQQGQGFIPFACPTPDKFRTEVAWPEAQAGEAPAEAPSDAEEARMNEEMTDLLGFLGGSGAT

SEQ ID NO: 168838 - protein, 87 aa, Glycine max
  Coding DNA Sequence Number=SeqID_77153
MEAWGAAIPTVSMSNGVLEGCSPRRANPVHFFLKKIRALYGSVFAYSKPLGILGCLLVALLDPPELDAGQRSVDHGPSVYSCPSPST

SEQ ID NO: 168839 - protein, 184 aa, Glycine max
  Coding DNA Sequence Number=SeqID_77154
  Subcellular localization annotation: CTP_CleavageSite=36; ConfidenceScore=5.11e-01
MPNSLPLSYTFAIPFPKKELKQHNKSKTSSNLREPPVELIKSLISLVGSWASNSSNWLMIASTTKSSMLLLRNTILSLSNSPITSPSMPLVVVEGVWGIESLKGLAHTLWGVLEGLGVKKEEETRNLGFGKSIGFRAVEERREEWHCRKTTEEKKNKAEQRECLSNESNSFYLNRRERVCNICS

SEQ ID NO: 168840 - protein, 95 aa, Glycine max
  Coding DNA Sequence Number=SeqID_77155
MADFRGGFSKKRHRIAVAWRVWDGSAIAAAIAMAVVARPSHAAVIQNSLPTKIEPPLRPSRTQPQPRHLQSARARSREPATPLTRRRRSRKNGSA

SEQ ID NO: 168841 - protein, 71 aa, Glycine max
  Coding DNA Sequence Number=SeqID_77156
MEGRHMLHSVVIANEVVDEAISPIDKFFPQRGLRQRGPLEFLRSVKNLLLFPGQVALCNQILDAVIVANQL

SEQ ID NO: 168842 - protein, 60 aa, Glycine max
  Coding DNA Sequence Number=SeqID_77157
MMQYYPLRILDRKLQEDWARAAEEDPRVLMNLRWMTPPLTSSPLSSTATPWIKITIEGPY

SEQ ID NO: 168843 - protein, 83 aa, Glycine max
  Coding DNA Sequence Number=SeqID_77158
MAKGDCNCLGRKILESSAKAAVATYPSAGGRRVTRGKRVPRKEYARSRHQRLFEENVGKTGKDAIYELLSERFGSCIYARGRY

SEQ ID NO: 168844 - protein, 117 aa, Glycine max
  Coding DNA Sequence Number=SeqID_77159
MDPEEPNRALGFPALVMSLYQSYRMPIPQARSCHREIGIALARHPMDPEKSNREYCNLPLPSGDNQLRWHSPFVIQTQSSLTACRDKYGHLRPSPKTPMSFDQDYCSLPLPFEDNQL

SEQ ID NO: 168845 - protein, 53 aa, Glycine max
  Coding DNA Sequence Number=SeqID_77160
MGETHEIPYHNLANFEPCLGYATEGQAVGGIPLQNTLEGPQYHPQPHLLHSTA

SEQ ID NO: 168846 - protein, 76 aa, Glycine max
  Coding DNA Sequence Number=SeqID_77161
MGALSKGGKMREVATNVYMWKTSEKPKETGQNENSKFGSCIYVDKSGAIAPMYPPSKRKSDLRSSFLRVNQAILFT

SEQ ID NO: 168847 - protein, 282 aa, Glycine max
  Coding DNA Sequence Number=SeqID_77162
  Homolog annotation: Hit_ID=A8XZZ5; Match level="QueryCoverage=64%, HitCoverage=58%, E-value=3e-14, Identity=27%"; Hit description =Putative uncharacterized protein
  Subcellular localization annotation: CTP_CleavageSite=27; ConfidenceScore=5.51e-01
MSSTLEGYTPRLQRATRPCLQRTTCPRLQRAARPRLQRTTRPHLQRTTRPRLQRAARPRLQRTTHPHLQRTTRPCLQRATRPRLQRTTCPRLQRASRPRLQRTTRPCLQRASRPRLQRTTHPHLQRATHPHLQRTARPHLQRNLGPRLQRATHPRFQRLHIRTFRELKGDEYGSCAPPQLRSPPAKVSVGLCRHDIWITPTRHPVDPEKSNRALGFPALVTGLWIVPIRHPVDPEKSNRALGFPALVTGLCQSYRVPVTPSKVIRPLITRPFVKKYYAPRQA

SEQ ID NO: 168848 - protein, 170 aa, Glycine max
  Coding DNA Sequence Number=SeqID_77163
MNAGGMPYTCKSDGKWCFQWRTATLGLRHGPDSYGRQQWGIFRNGRKPDGAMPREGRRPTASANSVPAAAVRQRMQALSGMIGRKASVGGFLSSPSNPRAQPWTGGGKLPSWSTVGAEGIFRWSGEMRRDRKEHPTAKALCWADTDTERTKARGAMGLDTPVVLAVNDGY

SEQ ID NO: 168849 - protein, 22 aa, Glycine max
  Coding DNA Sequence Number=SeqID_77164
MGKGWVRAAEEGPGPRVLMNLR

SEQ ID NO: 168850 - protein, 486 aa, Glycine max
  Coding DNA Sequence Number=SeqID_77165
  Gene Ontology: Mol. function=motor activity; Cellular component=cell projection
  Homolog annotation: Hit_ID=P15305; Match level="QueryCoverage=99%, HitCoverage=93%, E-value=2e-25, Identity=20%"; Hit description =Dynein heavy chain
HALTFRGLHVLAFRGLHVLTIRGLHALTFKRQHVLPFRRLHVVAFIGLHAFPFRGLHVLTFRRLHAHAFRGLHVLAFRGLHALAFRGLHVLPFRGLRALAFSGLHVLAIRGLRVLTIRGLHVLALRALHALTFRGLHVFAFRGLHILTFGGLHVLTIRGQHVLTFRGLHAHPSRGLHVLAFIGLHALAFRGLQLLTIRGLHALAFRGLQVLVFRGLHDLAFRGLNVLAIRGLHVLAFRGLHALAFKGLHVFAFKGLHILNFRGLHVLTFRGLHVLTFRGLHVLAFRELHVLVFRGQHALAFRGLHVLTFRRLHALTFKGLQILTFRWLHALAFRGLYILTFRGLHVLAFRGLHTLALRGLHVLTFREVHTLTGRGPRVLPFRWLHALTFRGLHVLAFRGLHALAFRGLHAFTFRGLRVLTFRGLHDFVFRGLHVLTFKRLHVLVFRGLHILVFKGRHSLAFRGLHILAFRGLHALAFRGLHALTSK

SEQ ID NO: 168851 - protein, 98 aa, Glycine max
  Coding DNA Sequence Number=SeqID_77166
  Homolog annotation: Hit_ID=A0ST23; Match level="QueryCoverage=27%, HitCoverage=55%, E-value=2e-08, Identity=100%"; Hit description =Putative reverse transcriptase
LRKPTDCPKTPLFDFCHITEFHGLRKPASFRIKLIDTVDLEGGPVGKPVVPAALMNRPTRGERRFAYWALAECILAYYVGTDEGVSEVLHVAGEKRLH

SEQ ID NO: 168852 - protein, 145 aa, Glycine max
  Coding DNA Sequence Number=SeqID_77167
  Gene Ontology: Mol. function=extracellular matrix structural constituent; Cellular component=cytoplasm; Biological process =phosphate transport
  Homolog annotation: Hit_ID=Q6P4U1; Match level="QueryCoverage=88%, HitCoverage=8%, E-value=7e-68, Identity=90%"; Hit description =Collagen, type I, alpha 1
  Pfam annotation: Domain name=COLFI; Domain location=6-142; Score =164.6; E_value=2.7e-46; Accession=PF01410.9; Description=Fibrillar collagen C-terminal domain
MPGNSAITAGGTKKNPARTCRDLKMCHPDWKSGEYWIDPDQGCNQDAIKVYCNMENGETCVYPSQSDVPKKSWYTSKNIKEKKHVWFGEAMIDGFQFEYGSEGSKPEDVNIQLTFLRLMSTEASQNITYHCKKQHFLHGSGHRQP

SEQ ID NO: 168853 - protein, 67 aa, Glycine max
  Coding DNA Sequence Number=SeqID_77168
VLMTTKDDDKGDEQKDQRSKNISSESRTSQEFKNQEEFKTQEESLQSRFKIQDLKNQDQDSRLKIQE

SEQ ID NO: 168854 - protein, 241 aa, Glycine max
  Coding DNA Sequence Number=SeqID_77169
RLGHRSGHEHAILHVGGQSHVQREHAVALEVHQFRFDHRAVQHAQYGGVQHARGDLRVRSFAQLAQVPGPAKRTLHPVQRIAESGLLHFGQHLGVGGGIAAQHDLHGLAQALILGQLDERVDHHRAQVVYRRVALLGGGAFQFLHEGQVHALDDGGQHLALVLEVPVDRATGIAGAGADHLQRGTGHAVFMETGFGGVKDAFPGCLGVLFGLAGHGWAVAGCFSPPVSVDMLARSACISAF

SEQ ID NO: 168855 - protein, 86 aa, Glycine max
  Coding DNA Sequence Number=SeqID_77170
MDQAGEERKLQLSELDEIRLEAYENAKFYKEKTKKLGLMSVEIKSDSTNKSFKVNGHRLKPFLTNPSLVDVVVEETSLLPPTLPPP

SEQ ID NO: 168856 - protein, 60 aa, Glycine max
  Coding DNA Sequence Number=SeqID_77171
MERIQKSTSSDNSQGTISNNALLKEETLDEASLSLSELDTQHDHRSTSTPYGSHRPGYMA

SEQ ID NO: 168857 - protein, 212 aa, Glycine max
  Coding DNA Sequence Number=SeqID_77172
  Homolog annotation: Hit_ID=Q2PEW8; Match level="QueryCoverage=98%, HitCoverage=57%, E-value=1e-59, Identity=46%"; Hit description =Putative uncharacterized protein
  Pfam annotation: Domain name=SURNod19; Domain location=2-212; Score =35.1; E_value=2.1e-14; Accession=PF07712.3; Description=Stress up -regulated Nod 19
MVIDTRGAQDKKACTQCRCDHMNLPKDFYNVTRDIHNQKLTTNYKGGLFCCQDNLQCKQIEGFQGPRRMVSLRYKISWVDWNIYQIPIKAEYTIPATGGGGDSPHVQKENIPMEKGGYLIYGTAHMHSGVVNATLYGQDGRTLCTSTPKYGTGKEAGNEKAYLIGMSICYPQPGPIKIHDGEILTLESRYKNEFRTGAMGHFYIYLAEELPQ

SEQ ID NO: 168858 - protein, 107 aa, Glycine max
  Coding DNA Sequence Number=SeqID_77173
  Subcellular localization annotation: CTP_CleavageSite=51; ConfidenceScore=5.21e-01
MHTRSFTNPQFLKIGLTHKNSPQWSLQLLQRALLRACEARLTGALSKGGKSAESPPTFICGKRQKNRRKPVKMKILSSGVVFTFEEGRQKRGFCSYVPSVKEEIRPT

SEQ ID NO: 168859 - protein, 62 aa, Glycine max
  Coding DNA Sequence Number=SeqID_77174
MNRQAICRSFPPGQCRPFGGHHDLKNQISSHQQWCPQKRLRNYPEFLNLNKRHELVQIVGKF

SEQ ID NO: 168860 - protein, 80 aa, Glycine max
  Coding DNA Sequence Number=SeqID_77175
VLLKGDIILKFRSRQCERGSVKISHRLNCSSLCGDPTASKSGSWQSLVVSVVEEKLGGVGGGFRGREGGRRWFFYAVGRI

SEQ ID NO: 168861 - protein, 108 aa, Glycine max
  Coding DNA Sequence Number=SeqID_77176
  Subcellular localization annotation: CTP_CleavageSite=44; ConfidenceScore=5.15e-01
MEKDFLTRLFTPYFVFTFTRGKARSSLLLTTINVLTLHNHGFLCGALRGNVTSPKTFEAFNVPSPFLGLVLGGGFLYGLTLIFLGFEGATPKVPWLGPSLIRVKAIRF

SEQ ID NO: 168862 - protein, 182 aa, Glycine max [sequence omitted]

SEQ ID NO: 168863 - protein, 102 aa, Glycine max
  Coding DNA Sequence Number=SeqID_77178
MLWKLGRIDGDPVLRETRIWATWEYVSSVGGGQQGMVGLCAHCGCGKTCCAPSPDRHLVPHVMEWYLEICRGGQETLGTSGGVLLPKTKLDQSRPNPGIVGQ

SEQ ID NO: 168864 - protein, 78 aa, Glycine max
  Coding DNA Sequence Number=SeqID_77179
MGLRIRFVGGGCTNNARQSIRGAPNSMAINLWGSGLDGGGCMNGNQFMGLRIRFVGEGCTNSARQSIRGAPDSMVEDA

SEQ ID NO: 168865 - protein, 28 aa, Glycine max
  Coding DNA Sequence Number=SeqID_77180
MMVARVMLGHGYEPGMGMGKNNGGRTSL

SEQ ID NO: 168866 - protein, 91 aa, Glycine max
  Coding DNA Sequence Number=SeqID_77181
MVAPPDSIPSVEQFNEMKTDQTQEAATTYEKSLEATSEPSKPVADIASLQQEADPSTPKDQTTPVLSPNTSPTATPVLHVTDEEDVQTQDT

SEQ ID NO: 168867 - protein, 57 aa, Glycine max
  Coding DNA Sequence Number=SeqID_77182
MEKSEKKLKKAYITWDDNDMESSEDSENEVINLCLMAKSYESDEERINQTCKVSFIF

SEQ ID NO: 168868 - protein, 49 aa, Glycine max
  Coding DNA Sequence Number=SeqID_77183
MEDAPVSLAALAHKRVAPTGLSKKGPYTRVHGNLRSGGGSMVMLGLRLA

SEQ ID NO: 168869 - protein, 159 aa, Glycine max
  Coding DNA Sequence Number=SeqID_77184
  Subcellular localization annotation: CTP_CleavageSite=24; ConfidenceScore=5.09e-01
MAYSLVDGASSHLFSFVFRYISMMASRKRKSIGARPTTQYDTRRFHSLDAWNRYTDNILGRSILPERKVEIYHIEFDDFKTELERRNLHKRLTNLADGTIDVSLVKEFYANLYSSEDPSPKQARVRGHLVKIDADNLNTFLETLVVLEEGETLPIYSRY

SEQ ID NO: 168870 - protein, 87 aa, Glycine max
  Coding DNA Sequence Number=SeqID_77185
MGVQIAPRPIWALQKAVASGGSNPARLGELGGNHLPYFAINRGGNEEGRAEALPKRFRNVFREESRKGLNRSSTFFIRSSSFFDLQR

SEQ ID NO: 168871 - protein, 1167 aa, Glycine max
  Coding DNA Sequence Number=SeqID_77186
  Gene Ontology: Mol. function=transmembrane receptor activity; Cellular component=intrinsic to membrane; Biological process=innate immune response
  Homolog annotation: Hit_ID=A5B6G5; Match level="QueryCoverage=84%, HitCoverage=88%, E-value=1e-155, Identity=35%"; Hit description =Putative uncharacterized protein
  Pfam annotation: Domain name=AAA; Domain location=215-403; Score= -40.2; E_value=0.069; Accession=PF00004.20; Description=ATPase family associated with various cellular activities (AAA)
  Pfam annotation: Domain name=LRR_1; Domain location=631-652; Score =9.9; E_value=4.5; Accession=PF00560.24; Description=Leucine Rich Repeat
  Pfam annotation: Domain name=LRR_1; Domain location=654-676; Score =12.2; E_value=1.7; Accession=PF00560.24; Description=Leucine Rich Repeat
  Pfam annotation: Domain name=LRR_1; Domain location=678-699; Score =3.6; E_value=65; Accession=PF00560.24; Description=Leucine Rich Repeat
  Pfam annotation: Domain name=LRR_1; Domain location=701-720; Score =1.4; E_value=1.7e+02; Accession=PF00560.24; Description=Leucine Rich Repeat
  Pfam annotation: Domain name=LRR_1; Domain location=722-743; Score =10.8; E_value=3.1; Accession=PF00560.24; Description=Leucine Rich Repeat
  Pfam annotation: Domain name=LRR_1; Domain location=745-766; Score =5.0; E_value=36; Accession=PF00560.24; Description=Leucine Rich Repeat
  Pfam annotation: Domain name=LRR_1; Domain location=768-793; Score =1.1; E_value=1.9e+02; Accession=PF00560.24; Description=Leucine Rich Repeat
  Pfam annotation: Domain name=LRR_1; Domain location=795-817; Score =10.2; E_value=4; Accession=PF00560.24; Description=Leucine Rich Repeat
  Pfam annotation: Domain name=LRR_1; Domain location=819-840; Score =9.9; E_value=4.5; Accession=PF00560.24; Description=Leucine Rich Repeat
  Pfam annotation: Domain name=LRR_1; Domain location=842-863; Score =13.6; E_value=0.75; Accession=PF00560.24; Description=Leucine Rich Repeat
  Pfam annotation: Domain name=LRR_3; Domain location=608-627; Score =29.7; E_value=1.1e-05; Accession=PF07725.3; Description=Leucine Rich Repeat
  Pfam annotation: Domain name=NACHT; Domain location=214-366; Score= -6.3; E_value=0.00018; Accession=PF05729.3; Description=NACHT domain
  Pfam annotation: Domain name=NB-ARC; Domain location=171-469; Score =126.0; E_value=1.1e-34; Accession=PF00931.13; Description=NB-ARC domain
  Pfam annotation: Domain name=TIR; Domain location=16-144; Score =154.2; E_value=3.7e-43; Accession=PF01582.11; Description=TIR domain
  Pfam module annotation: Pfam domain module=AAA::LRR_1::LRR_1::LRR _1::LRR_1::LRR_1::LRR_1::LRR_1::LRR_1::LRR_1::LRR_1::LRR_3::NACHT::NB- ARC::TIR; Domain location=215-403::631-652::654-676::678-699::701 -720::722-743::...
  Pfam module annotation: Domain location=745-766::768-793::795 -817::819-840::842-863::608-627::214-366::171-469::16-144
MAKHVMSSSCPKKYDIFISFRGEDIRTTFIGHLRSALSGPNIKAYADDHDLQKGQEIWPSLCQAIQDSHFAIVVFSENYAESKWCLKELVQILHCRKTQGLVVIPVFYQVDPSHIRKCTGTYGEAIAKHKDNQSVQDWKAALTEAANISGWDTRSRDNKNESQLIEKIVLDVSEKLRSPFKLKEVEDFVQIEKHCGEVKLLLSKNQDQLQKNVHVIGIWGMGGIGKTTIAKALFSQLFPQYDAVCFLPNVREESQRMGLTSLCDKLLSKLLKEGHHEYNLAGSEDLTRRLGNKKVLIVLDDVDSFSQLDTLYQPCKYVGPGSKLIITTRDRHLLRRRVDVTHVYEVKTWSIAESLELFSVHAFNERRPKKGYEDLSNRAVNCARGVPLALEVLGSNLYSRTTEFWDDELNKLENYRNDNIQDVLQVSYDGLDDLEKEIFLDIAFFFKGEHKKDVVRILDACDFYPTRGLKVLEDKALITISHSGMIEMHDLIEEMGLNIVRGESKDPRNRSRLSDIKEVSDVLANKKGSDLIEGIKLDLSSIEDLHLNADTLNMMTNLRILRLYVPSGKISRNVHHSGVPSKLSGKLRYLEWNGFHLKSLPVTFCAKMLVEIRMPHSHVTELWQGVQDVANLVRIDLSECKHLKNLPDLSKASKLKWVNLSGCESLCDIHPSLFSFDTLETLMLDGCKKLKGLKSEKHLTSLRKISVDGCTSLKEFSLSSDSITSLDLSSTRIGMLDSTFERLTSLESLSVHGLRYGNIPDEIFSLKDLRELKICNSRVAIDKEKLHVLFDGSRYLRLLHLKDCCNLCELPDNIGGLSKLNELRLDGSCVKTLPASIEHLRKLKTLSLENCRELGSLPKLPPFITEFNAANCWSLTTVSSLNSSALGLKGKGKFISFKNCGWLDEPSLHCIMEGALELTELASCQNEIVKIVDEANTKNCNNKSVKVCFPGSKVPSQFKHRTTDSSITIGLPCYRNGRVGLTLCVVLSRSRVAAKIWCQCYLADGTKLEPATTWYHEAVTELNSDHVFIWCDSSLFNSIFESGTPLVFFEFFVTNDKGKRVTIDTPECGVCVMFDSKALMEAEDDNIEIVTITRQCRACLIFEAENFVRISSRSVDAAASGFGLESKATETYDMMGTIAMTNNNHEPDLSEHCSCSWDYLFGMEFTT

SEQ ID NO: 168872 - protein, 333 aa, Glycine max
  Coding DNA Sequence Number=SeqID_77187
  Gene Ontology: Mol. function=nucleic acid binding; Cellular component= mitochondrion
  Homolog annotation: Hit_ID=A9PHD1; Match level="QueryCoverage=67%, HitCoverage=90%, E-value=2e-67, Identity=61%"; Hit description =Putative uncharacterized protein
  Subcellular localization annotation: CTP_CleavageSite=68; ConfidenceScore=5.76e-01
MARAVSSSCARLTMRLFSTTTTTTTTTAAFAVTLPKPSSLSVSTRRFLFPLSHAIVPPSTRVAGIRCRVNRAGDSAYSPLNSASSSSSSFSDRPPTEMAPLFPGCDYNHWLIVMDHPGGEGATKQQMIDCYIQTLAKVLGSEEEAKKKIYNVSCERYFGFGCEIDEETSNKLEGLPGVLFVLPDSYVDPENKDYGAELFVNGEIVQRSPERQRRVEPQPQRHQDRPRYNDRTSGQGEEKSKIVFSEHDVGLSDIENRLPGHCFWYCERCWIQIVCGKRLTADTQNLTLFSASGKTTKKNVMKPNEVGNRKTKRKPYDLDDIQLDALSLGKLKF

SEQ ID NO: 168873 - protein, 135 aa, Glycine max
  Coding DNA Sequence Number=SeqID_77188
MEQIEESHIQASLPTNSMSPPKLDELIHRIIVLDALSIPLTHTSIFFLYKDIPHTRTLILTLPLPPPPMLTLLPMPTSPPHPTLIPKHPAPLSALFTSRDDTIGKVVAPFHPTLPLESGNNIHCDTRLPLNGLSI

SEQ ID NO: 168874 - protein, 666 aa, Glycine max
  Coding DNA Sequence Number=SeqID_77189
  Homolog annotation: Hit_ID=A8C977; Match level="QueryCoverage=99%, HitCoverage=96%, E-value=0.0, Identity=63%"; Hit description=Forisome
MAQLSNGTSSTTLISKSGTTSIPHRASLPNPFDLTDDQILDIVYLAHLNDDETCDTDKLYNLVSNIVLRSQSPISAASFKPDFLTLKLISCQMISTRSAAHCVHQTTMWILQHLKCYSWDAKALIAIAALSLEYGSFVHLTQFQTNDVLGNSLRQLNQVQNRNASAVGELVMYVVQVFQHINEWATYAADGYDPEDVPDLTEAFQAILVVVYWSIASTVASTGNLIGVSNYKLSEYTFRLSTAVNKLTMHLTKVKEQIANVRDYITIRNIFDRPKDIVDLLKALIYPQQKGAENPKIFEGTNLVTKGIEVFRQKHVLLFISGLDSIEDEISLLNSIYERLQEDPREAKGFKKEDFKILWIPIVVKWSQSSREQFKALKSGTKFYAVEYFFELPGLKIIKDTERLNYEIQPIAPLFSSKGTLLNGNALEVIFEWGIEAFPFRKIDGDELTQKWKWLWDLILKATPGLQVKENRYIFIYGGANNTWVQNFTQELSKIKMNQSIQRADIIIENYQLGKGKGELNNSVPSFWIGVERKKQNKKHQEAVDCEIQKIVKCLFCLKRDPQGWAILSKGHNIKHLCHGQAVYQTVAEFQNWKEKVFEREGFDIAFKEYYDAKEKEISDTQPCEDYTSASSVIATIACPNPTCGRVMEVSSVNYKCCHRDDALNC

SEQ ID NO: 168875 - protein, 72 aa, Glycine max
  Coding DNA Sequence Number=SeqID_77190
MNARRREYMLGVLPKRRILMRHVKSQGKSGYGGVYHHTRPQHSVNGVRHDSGPPRRRAPLHRVMDSNGCSPE

SEQ ID NO: 168876 - protein, 139 aa, Glycine max
  Coding DNA Sequence Number=SeqID_77191
MDGPKRRILKGENNSTVVKKKCEIACEIETAGGDIKLGPTAVLEALHVPNRPPKRFGVGCFPVSDAAEILDRQDDLPWWNIAKEASAGEDEGLVIMWQGGFGGKDWGAASYMGLEGRSGVRRGSLMPEIETTEARVSSK

SEQ ID NO: 168877 - protein, 1023 aa, Glycine max
  Coding DNA Sequence Number=SeqID_77192
  Gene Ontology: Mol. function=transmembrane receptor activity; Cellular component=intrinsic to membrane; Biological process=innate immune response
  Homolog annotation: Hit_ID=A2Q1X9; Match level="QueryCoverage=84%, HitCoverage=68%, E-value=1e-170, Identity=41%"; Hit description=TIR
  Pfam annotation: Domain name=AAA; Domain location=223-401; Score= -41.8; E_value=0.096; Accession=PF00004.20; Description=ATPase family associated with various cellular activities (AAA)
  Pfam annotation: Domain name=LRR_1; Domain location=584-606; Score =6.0; E_value=24; Accession=PF00560.24; Description=Leucine Rich Repeat
  Pfam annotation: Domain name=LRR_1; Domain location=629-650; Score =9.0; E_value=6.6; Accession=PF00560.24; Description=Leucine Rich Repeat
  Pfam annotation: Domain name=LRR_1; Domain location=652-674; Score =11.2; E_value=2.5; Accession=PF00560.24; Description=Leucine Rich Repeat
  Pfam annotation: Domain name=LRR_1; Domain location=720-741; Score =6.9; E_value=16; Accession=PF00560.24; Description=Leucine Rich Repeat
  Pfam annotation: Domain name=LRR_1; Domain location=766-791; Score =3.6; E_value=68; Accession=PF00560.24; Description=Leucine Rich Repeat
  Pfam annotation: Domain name=LRR_1; Domain location=793-815; Score =14.1; E_value=0.53; Accession=PF00560.24; Description=Leucine Rich Repeat
  Pfam annotation: Domain name=LRR_1; Domain location=817-838; Score =10.0; E_value=4.3; Accession=PF00560.24; Description=Leucine Rich Repeat
  Pfam annotation: Domain name=LRR_1; Domain location=840-861; Score =9.0; E_value=6.5; Accession=PF00560.24; Description=Leucine Rich Repeat
  Pfam annotation: Domain name=LRR_3; Domain location=606-625; Score =28.0; E_value=3.4e-05; Accession=PF07725.3; Description=Leucine Rich Repeat
  Pfam annotation: Domain name=LRR_3; Domain location=817-836; Score =2.0; E_value=17; Accession=PF07725.3; Description=Leucine Rich Repeat
  Pfam annotation: Domain name=NACHT; Domain location=222-364; Score =8.5; E_value=1.3e-05; Accession=PF05729.3; Description=NACHT domain
  Pfam annotation: Domain name=NB-ARC; Domain location=180-467; Score =101.0; E_value=3.7e-27; Accession=PF00931.13; Description=NB-ARC domain
  Pfam annotation: Domain name=TIR; Domain location=17-151; Score =177.5; E_value=3.4e-50; Accession=PF01582.11; Description=TIR domain
  Pfam module annotation: Pfam domain module=AAA::LRR_1::LRR_1::LRR _1::LRR_1::LRR_1::LRR_1::LRR_1::LRR_1::LRR_3::LRR_3::NACHT::NB -ARC::TIR; Domain location=223-401::584-606::629-650::652-674::720 -741::766-791::793-815::...
  Pfam module annotation: Domain location=817-838::840-861::606 -625::817-836::222-364::180-467::17-151
MAKQGMLSSLCPRKYQVFISFRGEDVRTSFISHLRSALSRDNIKAYMDDHNLQKGDELWPSLCQAIQDSELAIVVFSEHYAASKWCLNELVEILHCRKSQGLAVIPVFYEVDPSHIRKYDGTCGEAISKYETYFGDKDNESIQKWKAALAEAAHISGWDSHSREYKNDSQLIEKIVVDVSEKLSQGTPFKLKVEDFVQIEKHCGEVKLLLSKNQDQLQKNVHVIGIWGMGGIGKTTIAKALFSQLFPQYDAVCFLPNVREESRRIGLTSLRHKLLSDLLKEGHHERRLSNKKVLIVLDDVDSFDQLDELCEPCNYVGPDSKVIITTRNRHLLRGRVDDRHVYEVKTWSFAESLELFSLHAFNERRPKKGYEDLSNRAVNCARGVPLALKVLGSNLYSRSIKFWDGELSKLENYRNDSIQDVLQVSYDGLHDLEKKIFLDIAFFFKGEHKDDVIRILDACDFYATSGIEVLEDKALVTLSNSGMIQMHDLIQEMGLNIVRGGSEDPRNRSRLRDIEEVSDVLENKNGSDLIEGIKLDLSSIEDLHLNADTFDRMTNLRILRLYVPSGKRSGNVHHSGVLSKLSSKLRYLEWNGCRLKSLPKSFCGKMLVEICMPHSHVTELWQGVQDLANLVRIDLSECKHLKNVPDLSKASKLKWVNLSGCESLCDIHPSVFSLDTLETSTLDGCKNVKSLKSEKHLRSLKEISVIGCTSLKEFWVSSDSIKGLDLSSTGIEMLDSSIGRLTKLRSLNVEGLRHGNLPNELFSLKCLRELRICNCRLAIDKEKLHVLFDGSRSLRVLHLKDCCNLSELPENIWGLSKLHELRLDGSRVKTLPTTIKHLKRLNTLSLKNCRMLESLPKLPPNVLEFIATNCRSLRTVSISTLADFALRTGKGIIVSLQNCSNLLESPSLHCIMEDAHLATKSIVLKNMFLKELFRGTNTRIDNYDYVKRQFKYQTTPYSLVIVDLPSSKSDFVGFVRNDMLLSPSQEMKNLCVGGVKIWCQCYMVDDARLGPPQPHGITKLSLG

SEQ ID NO: 168878 - protein, 94 aa, Glycine max
  Coding DNA Sequence Number=SeqID_77193
MMTTKDDDKIDEQKAQVNQRTSISRFKIQVQESRIIQDSRRKPTNKDSRSQESRSRFKISRIKIKIQESRIKTQDFKNQDQDSRMKKRLNQDKY

SEQ ID NO: 168879 - protein, 75 aa, Glycine max
  Coding DNA Sequence Number=SeqID_77194
MLVATLRIFLLWRRTREPHLARPQKDRLRQLATPLGTVFVRSPTCLIIVKPRLELSLYIMYCRWYSIPPQYYYLE

SEQ ID NO: 168880 - protein, 56 aa, Glycine max
  Coding DNA Sequence Number=SeqID_77195
  Gene Ontology: Mol. function=structural constituent of ribosome; Cellular component=large ribosomal subunit; Biological process =translation
  Homolog annotation: Hit_ID=Q5ZDK4; Match level="QueryCoverage=69%, HitCoverage=14%, E-value=1e-08, Identity=76%"; Hit description=50S ribosomal protein L22-like
SPKKVNLVAALVRGMLVKDASMQLESTIKRAAKTVYQVVTLGNSDLKLSTAMQRNS

SEQ ID NO: 168881 - protein, 73 aa, Glycine max
  Coding DNA Sequence Number=SeqID_77196
AFSRGALVLTNMDGEELPSPGQDHLELPSGVRTKHGQQKPIKEWMQVGIGSRSTDRCPLSALDKQRTSLQGSP

SEQ ID NO: 168882 - protein, 158 aa, Glycine max
  Coding DNA Sequence Number=SeqID_77197
  Subcellular localization annotation: CTP_CleavageSite=91; ConfidenceScore=5.38e-01
PVINLAYIRKNCWNPKDLTVSIRRATRVKARPAEFPSTSATPYSSIHFSSPFSPSSDLQVVAPPGSIHSIEKFLERVAWPGTQPSLLSWLRLREVTSDPPTPVVDLSSPQHAADPSTPILEIPEDPTTPVLTLNTSPPAIPVLHLTDKEDVQTQDTHD

SEQ ID NO: 168883 - protein, 215 aa, Glycine max
  Coding DNA Sequence Number=SeqID_77198
  Homolog annotation: Hit_ID=A5C753; Match level="QueryCoverage=36%, HitCoverage=22%, E-value=1e-09, Identity=42%"; Hit description =Putative uncharacterized protein
MRTLGLFCIYGPIFLESPSHGSGDGSPPWEDCINSFSKMGSKQITFKEGASLNRPTLFEGEHFSFWQKRMEMFIHSIDPDAWNSIFKGPFIPTKDLNGELVPKEWDEMKDDEKRKVQDDKKAKDILTFGEKLRRRYGKCLKSLMNVEARLHDECDSKMMTKVMNKKLKDQRTTKVNQRTIQEFKNQEEFKTQGESLESRIKIQDSRSQESRSRFK

SEQ ID NO: 168884 - protein, 385 aa, Glycine max
  Coding DNA Sequence Number=SeqID_77199
  Gene Ontology: Mol. function=excinuclease ABC activity; Cellular component=excinuclease repair complex; Biological process=response to DNA damage stimulus
  Homolog annotation: Hit_ID=A1FSR9; Match level="QueryCoverage=47%, HitCoverage=27%, E-value=4e-99, Identity=100%"; Hit description =UvrABC system protein B
  Pfam annotation: Domain name=ResIII; Domain location=211-354; Score= -14.2; E_value=0.00075; Accession=PF04851.6; Description=Type III restriction enzyme, res subunit
MAFQFSAGDRPARALAPDPPGDADDDAAVLLSIHAQHDGLVGAGIAAVGPEPDVGPMIAGAQVDMTPACPVHAEFPCGAGRAVGRFDLHPPALAPCLVTSHAIRRTADRHTAAFGDGGVACHRQAGDQFGAQRFRLEVPQPRSDGGRGGAGQGEDEGTCLQPRSVLAHSPSANAAAACPETPQPAVTACPVYSPFPGTGNTMSDRFELVSPYSPAGDQPDAIAKLTSNFEAGIAKQTLLGVTGSGKTYTIANVIQNVQKPTLIMAPNKTLAAQLYGEFKAFFPHNAVEYFVSYYDYYQPEAYVPSSDTFIEKDSSINEHIEQMRLAATKTLLSRPDAIVVATVSAIYGLGAPEDYLSLRLILSKGERIDQRDLINHLTQLQYTRN

SEQ ID NO: 168885 - protein, 181 aa, Glycine max
  Coding DNA Sequence Number=SeqID_77200
MLISPYRCIGWDRAQKTPSGPEEVQQGPGVSSSGYGPLLVLQGARSPSEESHPQRHPVDPEKSNRALGFPALVTGLCSPTGCTFPPARSRHHRDRACKTQRNPTGSWSCQALITGLCQFYGVPVTSSRGIRPLTNRAFIKKYYVPRQAQGETPQQPGDGQQRATDASPSPLEFSSAHPQKG

SEQ ID NO: 168886 - protein, 124 aa, Glycine max
  Coding DNA Sequence Number=SeqID_77201
  Homolog annotation: Hit_ID=UPI00006A17C9; Match level="QueryCoverage =83%, HitCoverage=58%, E-value=2e-07, Identity=32%"; Hit description =UPI00006A17C9 related cluster
  Subcellular localization annotation: CTP_CleavageSite=12; ConfidenceScore=5.29e-01
MLVRVIRTRLFAAARVKSCPGMHSSCVIASLSGCARTVGRPPISGGGPGTVWMSSTLKMRTHSPLKVRACIPLKARRCSPLEVRACSPLKARTCSPLEVRACSPLMVRTCSPLKARTCSPLNGE

SEQ ID NO: 168887 - protein, 33 aa, Glycine max
  Coding DNA Sequence Number=SeqID_77202
MSEIGRFGGLGMEVLRKEEGAAQEILKTPFFLV

SEQ ID NO: 168888 - protein, 102 aa, Glycine max
  Coding DNA Sequence Number=SeqID_77203
MTIICLCMSSGSPPLDDKRAHNDHHLSLCAIGHNRIWMAKGVWNDHNLSPHVIGLTASGTKGRRMTIICLCVPSDTIVSEWRKGVRNDHNLSLHFIGLTASG

SEQ ID NO: 168889 - protein, 74 aa, Glycine max
  Coding DNA Sequence Number=SeqID_77204
MALTFLGSGQIEKSFASQVLQGKVVEEPQLFVVYGAVVVVIVGLVEERRVCLGQQYSENKDVIVVATAVKDLTI

SEQ ID NO: 168890 - protein, 61 aa, Glycine max
  Coding DNA Sequence Number=SeqID_77205
  Subcellular localization annotation: CTP_CleavageSite=38; ConfidenceScore=5.35e-01
MGVQIAPRPTWALRNIPPEGAEALPKRFRNVSVTFSVRNFAKISTVLRRSSFVLHRSSIFN

SEQ ID NO: 168891 - protein, 95 aa, Glycine max
  Coding DNA Sequence Number=SeqID_77206
MPSTSQGPKKGRMSSSKGPRTKLGYDSVQAEDTMGVRGSGNGGAKAKGVEGATEEEEVEEEEEEKGKQKHDDGLEEEGKEDELHKEGDYGWKGSR

SEQ ID NO: 168892 - protein, 145 aa, Glycine max
  Coding DNA Sequence Number=SeqID_77207
  Homolog annotation: Hit_ID=Q8GEG1; Match level="QueryCoverage=75%, HitCoverage=85%, E-value=2e-28, Identity=60%"; Hit description =Putative uncharacterized protein
MAYERGGDFLEDARKILNREVRGPRQSRFSIGSAPLTSITKSDAQISGGETRQDYKDTRRFPLGGSLVRSPVPAFRFTGVIPLLWPRLSHSTPDTQFRGRQFAPSWTVCTNPPFSPTAAPYPVTIVLSPTPERHAKAPLAAATGN

SEQ ID NO: 168893 - protein, 387 aa, Glycine max
  Coding DNA Sequence Number=SeqID_77208
  Gene Ontology: Mol. function=two-component response regulator activity; Cellular component=intracellular; Biological process=two -component signal transduction system (phosphorelay)
  Homolog annotation: Hit_ID=Q47I71; Match level="QueryCoverage=56%, HitCoverage=96%, E-value=2e-60, Identity=55%"; Hit description =Response regulator receiver:Transcriptional regulatory protein, C- terminal
  Pfam annotation: Domain name=HAMP; Domain location=289-361; Score =37.9; E_value=3.7e-08; Accession=PF00672.16; Description=HAMP domain
  Pfam annotation: Domain name=Response_reg; Domain location=2-113; Score=135.3; E_value=1.8e-37; Accession=PF00072.15; Description =Response regulator receiver domain
  Pfam annotation: Domain name=Trans_reg_C; Domain location=147-223; Score=43.2; E_value=9e-10; Accession=PF00486.19; Description =Transcriptional regulatory protein, C t
  Pfam module annotation: Pfam domain module=HAMP::Response_reg::Trans _reg_C; Domain location=289-361::2-113::147-223
MSKLLLIDDDVELANMLKEFLTQEGFTVTTAHDGLTGEQYVLAGKFDLVILDVMMPGQDGLQTLRNVRQHSDIPVLMLTAKDDNEGRIEGLEGGADDYVQKPCLPRELVARIRAILRRQTADMPKGNDIVVGQLVVSSERRKVFWADKPIVFTSTEFSLIEILAKHAGTIVSKEDLSVKALGRPLVKYDRSIDVHLSSIRQKISEVSGGVNVIQTIYRVALFLALISTVITVGNIVQWELNQKALHHSELSQPCTAPATCPPPVVENHHETRLGTWRVLNYAQLLLHFPLSALLFCILSSAIFAGILAWSISHPVKLLLDHLKNAAKGDLLIGVSPKITASHDEFSELGEALDLMTLRIDNMIKSQSKMLHHVSHELRSPLARIQMA

SEQ ID NO: 168894 - protein, 170 aa, Glycine max
  Coding DNA Sequence Number=SeqID_77209
MMVDTLPVFYYEKLMGYMPSSFADLVFAGERIEVGLKRGKFDYVSSTGTNARRNGATGAKRKEGDTYAVTSAPARTKPSQISHGTHQYAQHHPSFLARAGDSSNSAPVQTWVPTPIQRETPQATAPTPTCPASNAHFGVGPNTIRNFPPRPTFTPIPMMYEDLLPSFVAN

SEQ ID NO: 168895 - protein, 151 aa, Glycine max
  Coding DNA Sequence Number=SeqID_77210
  Gene Ontology: Biological process=transposition, DNA-mediated
  Homolog annotation: Hit_ID=Q1J7G7; Match level="QueryCoverage=25%, HitCoverage=67%, E-value=7e-11, Identity=72%"; Hit description =Transposase
MVKVGTSYVPINVSFSPKSWPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLNSIKGNVKIKVTFAHSIKGCRPLGR

SEQ ID NO: 168896 - protein, 74 aa, Glycine max
  Coding DNA Sequence Number=SeqID_77211
MAQLIFDAIHYLHGSRPQDTQWTRMSPIGPWGFQLWLLASVSPTRCPSPLARSCHRDIGIAPARHPMDPEKSNR

SEQ ID NO: 168897 - protein, 48 aa, Glycine max
  Coding DNA Sequence Number=SeqID_77212
MLMPNPPIWALQKIPPEGGCFWRKQPCSPGRAELAWASWAASISPILL

SEQ ID NO: 168898 - protein, 129 aa, Glycine max
  Coding DNA Sequence Number=SeqID_77213
MKENKVKFDVLSTRTSMCDRGKLSLASSSSAFALPGNTWDLEAHLSILPSNYPFQLWGKPYIFVFFILRPTHFLLEIDGRVPGISTFTGLIVGSVSYKRVPPPANSLVGSREGMAVPKSISSGSSHRIL

SEQ ID NO: 168899 - protein, 286 aa, Glycine max
  Coding DNA Sequence Number=SeqID_77214
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMIAIVGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 168900 - protein, 100 aa, Glycine max
  Coding DNA Sequence Number=SeqID_77215
  Homolog annotation: Hit_ID=Q8LNP1; Match level="QueryCoverage=41%, HitCoverage=11%, E-value=2e-07, Identity=63%"; Hit description =Putative uncharacterized protein T18N24.41
MDQASEERKLQLRELDEIYLEAYENAKFYKEKSKKFHDSMIIKKDFMHSSSSENLFNNASTSCIKVKSPQELLILSLVLNNISNAHDWTSRVLSQTYCYI

SEQ ID NO: 168901 - protein, 105 aa, Glycine max
  Coding DNA Sequence Number=SeqID_77216
GKEENRGKEEGGCRPARPGELGCFHQKAPPSVGTSWKAQVNVAKLCGLPNDGCQVPLSGHAKSFMRRNTCTWEHVTQFGTPLRLRLITIGEELSVNDRVTSTLAA

SEQ ID NO: 168902 - protein, 132 aa, Glycine max
  Coding DNA Sequence Number=SeqID_77217
  Gene Ontology: Mol. function=nucleic acid binding; Biological process= DNA integration
  Homolog annotation: Hit_ID=Q69FA7; Match level="QueryCoverage=99%, HitCoverage=55%, E-value=5e-13, Identity=25%"; Hit description =Retrovirus-related pol polyprotein
MEDQDLEMILLASLPPSYENFYLILLKGRRRTQAKVARRAKLILKTSTITVKKLGHWKQDCPKKDYVVALVQNNSSSKRDLVLAIGEQLQQNFKQWVLDLGCSYHMCPYRHCFVTYEKKSSGNVHIGNDAPC

SEQ ID NO: 168903 - protein, 163 aa, Glycine max
  Coding DNA Sequence Number=SeqID_77218
MMHEMEERFVQIEQKLAKVDALSYMVEAISNQLHQLTCKRYYASINLGHGYRERHHHTCHQDRLKDLMFLQQHGTLAEFNNAFDVISCKLHLSEDYLVDAYLAEIKLRQHDKRKMATKNMSYMAPRSSDTTESTQDNWKSSKNALVESESQPKEKSVNHNQLL

SEQ ID NO: 168904 - protein, 93 aa, Glycine max
  Coding DNA Sequence Number=SeqID_77219
MVAPAATMVADYMVKLTRETNTMVVVDVVESDWREIWRTVRLPEKMVTGTDGGLWRQKKQATMNCGGETTKWDHTCFATMLKSWTTILNYRSA

SEQ ID NO: 168905 - protein, 116 aa, Glycine max
  Coding DNA Sequence Number=SeqID_77220
MPASCRASKINLLEDDNKSLYDIGIGVNFGSFFTGGFLPALEFMPGLASPGLLVMGWTPFAGRAPSWGSSRRGPKSSGGVEYTSEYYEGFAGIPAKQEPRGDIVKLPSIAFTTGPS

SEQ ID NO: 168906 - protein, 69 aa, Glycine max
  Coding DNA Sequence Number=SeqID_77221
  Subcellular localization annotation: CTP_CleavageSite=28; ConfidenceScore=5.28e-01
MGFAVFPALSHHCRNMPFCGRAKARLTSALSKGGKMRGVATNVYLGKTSGKPKETGQNENSKFGSCIYA

SEQ ID NO: 168907 - protein, 35 aa, Glycine max
  Coding DNA Sequence Number=SeqID_77222
MPMSSHRLGGSSPELHFLHPATVILLPRTMFVIIT

SEQ ID NO: 168908 - protein, 581 aa, Glycine max
  Coding DNA Sequence Number=SeqID_77223
  Gene Ontology: Mol. function=protein binding; Cellular component=GPI -anchor transamidase complex; Biological process=regulation of protein metabolic process
  Homolog annotation: Hit_ID=A7PU42; Match level="QueryCoverage=99%, HitCoverage=86%, E-value=0.0, Identity=61%"; Hit description =Chromosome chr7 scaffold_31, whole genome shotgun sequence
  Pfam annotation: Domain name=Gpi16; Domain location=1-537; Score =527.1; E_value=2e-155; Accession=PF04113.5; Description=Gpi16 subunit, GPI transamidase component
MELSFTQGRWNYERWGGFDSISSHNAKPPGVELWAVFDVPLHQVDASWKNLTHSLSGLFCASINFLESSTSYSDPEWAFQSALGSLRYGTLPREAVCTENLTPWLKLLPCRDKAGLSSLMDRPSIYKSFYHSQQLHLTMSTDPSDGSRSGIILEQTLTVVLQPNDQKAGMSHLSKTKIQPSWSLSSIFGRKISGRCVLAKLSNVYLHAERSLVNQLENLQKNTVKFAANDTGLEDFRRNAGFELSVTPERVHAELEKSSSILYEYPIKEYTDTEQFDLGLTWVHPIVWSSPHAPLYASRFLMGSGNERGAIAISLKSTEMTQGLVAAYNVEERCKLQVNVLQIVPWYVKVYYHTLQLLVDERPQALTDFVEIMRVSPSEDKVSPGVMELVLQFPCEMKSAVLSIEFDKGFLHIDEYPPDANQGFDIPSAIISFPDFHAGLQFSDKSQSKSPLLSKLQERSPVLSYTEVLLVPLTTPDFSMPYNVITITCTVFALYFGSLLNVLRRRVGEEERLLKNKDANKTVFFRRELAKLSAKLRGRPLELTLPCPSSSSSSSSFVSPKLILRVLLVAGIAVVWQYYSQ

SEQ ID NO: 168909 - protein, 65 aa, Glycine max
  Coding DNA Sequence Number=SeqID_77224
MFNGGEAVISTDGPRPVQNQLREQGRQHVCMQSTDRESPAKPKPLVIHFTKDVASQKPRGSRPIS

SEQ ID NO: 168910 - protein, 115 aa, Glycine max
  Coding DNA Sequence Number=SeqID_77225
CPLCGKLEWLKDLSISEGMLRHFNFIHGHVLDGAHGKIEWLKDLSISEGMLRHFNFIHGHVLDGALVHTSYVVYVHGGVPYAEEYLYKGVCHSVWNSLETQADHRGGGGELPCAT

SEQ ID NO: 168911 - protein, 145 aa, Glycine max
  Coding DNA Sequence Number=SeqID_77226
  Subcellular localization annotation: CTP_CleavageSite=48; ConfidenceScore=5.06e-01
MGSFPNYFQHGAVIYVKTMHAGPKPPEPVASLVSLSKLPAPMAIRACREETASPNGDMLSALGTASQTSEFHGCVAAGYVLPWQCSWVSAGETASTIGGLPCTGIAKKLLLPLAGCLGCALFHSWCTISLLFILREFSVLGLVRM

SEQ ID NO: 168912 - protein, 363 aa, Glycine max
  Coding DNA Sequence Number=SeqID_77227
  Gene Ontology: Mol. function=zinc ion binding
  Homolog annotation: Hit_ID=A3BKS5; Match level="QueryCoverage=74%, HitCoverage=66%, E-value=1e-13, Identity=26%"; Hit description =Putative uncharacterized protein
  Pfam annotation: Domain name=SWIM; Domain location=150-186; Score =18.8; E_value=0.0037; Accession=PF04434.8; Description=SWIM zinc finger
MHGLILLFEYYQHMSKVMKERLHNKESNALSHVRDKHVLKWLKKLMLGDFEVVEFEEKWKEMVATFELEDNTWIAELVVVADYSSIYGNEVLQTTLRSLERSGDELFTKEMFKIFQSYLCRTIKLRVVDCKEMVTFSVYTVVKYCSGSVWRVSYCPSTVDFTCTCMRMQSIGLPCDHILAMLVSLNFMKLPSSLVLNKWSKVATKQMKDKYPNSTTYWDSQLMAMYATLVEVSRQVCVAAYRDEEEYDKMLHFLSNEARRLKSKQNSEHCADDNQLQQQDVKDADRSEWMNVADKEESKSVANVVELATSSVLAPTVLEMEMVVFHPPNKVTVMMTISFFLMFDRMQQSQTQTFVGGSSRVGP

SEQ ID NO: 168913 - protein, 206 aa, Glycine max
  Coding DNA Sequence Number=SeqID_77228
MEFISISDHTPLVVTTELVVPRDVWKQNIHGCSMFKVCKKLKALKAPLKNLFKQEFSNISNRVELAEAEYNSVLNSLKQNPQDPSLLALANRTRGQTIMLRKAESMKFAQLIKNKYLLQADKCSKFFHALIKRNRHSRFIAAIRLEDGHNTSSQDEIALAFVNHFRNLFSAHELTQTPSISICNRGPKKEKKKKRMLCASFVLHPN

SEQ ID NO: 168914 - protein, 59 aa, Glycine max
  Coding DNA Sequence Number=SeqID_77229
MNEDQWMYDSIMTEEVDMDDENEQECGVFATRDDFLQWARSVAHENGFVVVIIRSDTNT

SEQ ID NO: 168915 - protein, 198 aa, Glycine max
  Coding DNA Sequence Number=SeqID_77230
  Subcellular localization annotation: CTP_CleavageSite=88; ConfidenceScore=5.46e-01
MGKNKGRQSHSVAKQIMVKGTTSGSGKSQTSATSGLAGCLDVVQANQNAYTASQDNLVGKVLVKKTGTSSAKTDDVAHQVFDNLSECSAESESSPELDDNKAPTPWVNLFKDNRSPSKGFGMKFSPPPFDDEVLLEETDLQPLEEAWGHSLIGYVAGRFPGKKALLDCCQKWGVKFSYSAHESGWLVFKFESEDDLNQ

SEQ ID NO: 168916 - protein, 81 aa, Glycine max
  Coding DNA Sequence Number=SeqID_77231
MYRQKPQDANDESKVVVVSVDWDGESELMVVSVSVEWDDECFLLLGGSSVFFFRNLMGNEWGVDVKEDEWSGEVRESQRIS

SEQ ID NO: 168917 - protein, 107 aa, Glycine max
  Coding DNA Sequence Number=SeqID_77232
  Pfam annotation: Domain name=zf-GRF; Domain location=16-51; Score =15.1; E_value=0.00046; Accession=PF06839.3; Description=GRF zinc finger
MERSSSSYTSEARSRVFCPCNIEAPLVTSWTEENPGRRFYGCGLYKWLDPIGNNRQKKIIVGLMKEVDELKLREKGLQSRISDMKMKEKCLWIVLVVCWLKHFMNTT

SEQ ID NO: 168918 - protein, 145 aa, Glycine max
  Coding DNA Sequence Number=SeqID_77233
MPRQTKGTNVVGPKKFWVAKSYIIPIEDILGRKRSRLELVLGQWLLMAHDERKEKLFPLEAWAKKRFFSVKSTYALACNSQYALEIKLFKLIHKWCGPKRIRSSLWKLANESILTNAKRLSVRQMASIILRRNELIFTNKLLTPF

SEQ ID NO: 168919 - protein, 47 aa, Glycine max
  Coding DNA Sequence Number=SeqID_77234
MQVGFNPSIQIWLESGQLHLQCFMEALSESGRLEEAEKMFYSMEDYV

SEQ ID NO: 168920 - protein, 559 aa, Glycine max
  Coding DNA Sequence Number=SeqID_77235
  Gene Ontology: Mol. function=histone-lysine N-methyltransferase activity; Cellular component=chromosome, pericentric region; Biological process=DNA mediated transformation
  Homolog annotation: Hit_ID=A7NXK6; Match level="QueryCoverage=91%, HitCoverage=67%, E-value=1e-141, Identity=53%"; Hit description =Chromosome chr5 scaffold_2, whole genome shotgun sequence
  Pfam annotation: Domain name=Pre-SET; Domain location=423-521; Score =128.7; E_value=1.7e-35; Accession=PF05033.7; Description=Pre-SET motif
  Pfam annotation: Domain name=YDG_SRA; Domain location=237-396; Score =278.9; E_value=1e-80; Accession=PF02182.8; Description=YDGSRA domain
  Pfam module annotation: Pfam domain module=Pre-SET::YDG_SRA; Domain location=423-521::237-396
  Subcellular localization annotation: CTP_CleavageSite=15; ConfidenceScore=5.01e-01
MDSVLPDTSTNAIASSTPTSHPHSQPSLPQTLLVPKPEPFWDTHIETSDELDLYSEFNRVTELFHFAFGATNVVDPFGATNVACPEQTPLVPVPQELDSAAQPDPNSPSEDVLRAIVPVPPEQQDGAVATATVPRRKQSRQKELVRVMDLSPRDEAHLRETVRRTRLIYDSLRVLTSVEEEKRVASVAAAAVAAAAAVTTLEGCLPVDGSTGKLRRLRGDLRAASLMRERGLWLNRDKRIVGAIPGIMVGDLFLFRMELCVVGLHGQIQAGIDFLPASMSSTGEPIATSVIVSGGYEDDMDDGEVIVYTGHGGQEKNSSRQISHQKLESGNLALERSMHYGVEVRVIRGMKYEGSAAGSGKVYVYDGVYRIVDCWFDVGRSGFGVYKFKLWRIEGQAKMGSAILKEARNVRRSELDLNPTSADMANRKENVAVRLFNDFDDDRGPLCYEYLVRTCFPKFVFHQSGKATGCDCVDGCGDGCFCAMKNGGEFPYTLQGHLVRGKPLIFECGPFCSCPPHCRNRVAQKGLKYRLEVFRSKQTSWGVRGCFDQGASSTLNNEW

SEQ ID NO: 168921 - protein, 57 aa, Glycine max
  Coding DNA Sequence Number=SeqID_77236
MCGVATNVYSRKTSKKPERCGVRTLRVKGSGVIFTHGEGCFPCSYVFLNCDEEIRPT

SEQ ID NO: 168922 - protein, 93 aa, Glycine max
  Coding DNA Sequence Number=SeqID_77237
MSVKNLVGCLGGDQSGSRYFAKNAPTIWDQHRLKGALKSGVFTPKAYTLKSLLGPLPPDSGPTCHILISFGDHYLLACDLRLTASKCLTPIVM

SEQ ID NO: 168923 - protein, 78 aa, Glycine max
  Coding DNA Sequence Number=SeqID_77238
MAWNFLFKGKKWLRGSFPQRDIGRTLWPKGLAPLPSSIAIISEALSTSSILKPSRDGPSTERDASSSGTTSIQISRRR

SEQ ID NO: 168924 - protein, 145 aa, Glycine max
  Coding DNA Sequence Number=SeqID_77239
MGDLEEVQEQTKANMSALKEQMAFKMDVMLGMKQLMESNAATAATVSSAAEADPTLPTAAHHPILNMVGRERRTPGHISNPHPGYNRGAYPYDLPTNYTPPVIRDDAGHVPPLILEGEPPRHSDEVHEDHREHAHGDADSYSPFP

SEQ ID NO: 168925 - protein, 278 aa, Glycine max
  Coding DNA Sequence Number=SeqID_77240
MRFYQVKVKSLRTTNLKELGQLMGQLQRQAFRKAYGKIWDLAMLSPMVEEFEEILGCPLGGRNPTSSQGEWAPFIDILALLIFGGVLFPNVDGLVAYHNHKESPVVAMLADLYDTFDRRCEKSSHRSWTEKGGANWDQLLANKEEASTNWFPRWKEGRTGVLISCRGFLNVPMMGMRGAPLEEEIAPIISRGFNKTNVETLQKVRKAWEMVRKKDKELRGSNNGPIDGYRKWLRAHVLGLDWLPSLRTTKREEVEAPDEDEEVQALRAELKQAQTVKE

SEQ ID NO: 168926 - protein, 70 aa, Glycine max
  Coding DNA Sequence Number=SeqID_77241
MARSVSASCPYSRDLYERELTRLLVIIPKVVISLLMVSRGIILFEKHIAAVGTTSNNMLSKRKTLDEGSL

SEQ ID NO: 168927 - protein, 182 aa, Glycine max
  Coding DNA Sequence Number=SeqID_77242
  Gene Ontology: Mol. function=aspartic-type endopeptidase activity; Cellular component=chromatin; Biological process=RNA-dependent DNA replication
  Homolog annotation: Hit_ID=A5B326; Match level="QueryCoverage=92%, HitCoverage=11%, E-value=2e-18, Identity=34%"; Hit description =Putative uncharacterized protein
  Pfam annotation: Domain name=Retrotrans_gag; Domain location=4-86; Score=6.8; E_value=0.012; Accession=PF03732.8; Description =Retrotransposon gag protein
MDGKAFAWQRHYMQNVNSKHKTWQQILQDAGSRFDIGAFDDPVAKLVRLKQEDSLIEYLERFDTLLARIAISEELALSFFLSGLTVELEKSVRVHRPSSIQEAVKIARLQDKVLHEMTKKFSPTKLIQADSQAKYSRNWFVPSQHHRTIPITTLHQQKTQNPTQPTHPIDSKVSTANNNSRK

SEQ ID NO: 168928 - protein, 142 aa, Glycine max
  Coding DNA Sequence Number=SeqID_77243
MGSNQTPLLKRRFYQVKIKSLEVTSLRELGQLMGQLQRQAFCKTYGKIWDLAMLVLTVEELEEILGCPLGGRKPYLFLGFYPSMARVAKGKTKTLADQGEWASFIDAFALLIFGVVLFPNMEGLVDLAAMDAFLAITIARKA

SEQ ID NO: 168929 - protein, 189 aa, Glycine max
  Coding DNA Sequence Number=SeqID_77244
MKREKHVSYSSHNSCKSLSEELRDYYEGRHRSHLRPHSHRRENERKPQEVNIKLPYFHGKDNVEANLDWEIRVEQQLKRKSTSKSYGSHSYPKKDQGQGILGGHITSQCPTKKTMIMRGQDIYSSQDEATTSPSSSKSEEAKGEESSEEIYPQEEGQPLMVKEECKETLVSIATSLRLEFIPQVKGVVG

SEQ ID NO: 168930 - protein, 90 aa, Glycine max
  Coding DNA Sequence Number=SeqID_77245
MDGLVDLAAIDAFLAYCDHRESPVVAMLADLYDTFDRRWTRGCISYNPVLAIRQLGYPMRRAPLEEELVPVISRGFNKTNGETLQKVRKA

SEQ ID NO: 168931 - protein, 130 aa, Glycine max
  Coding DNA Sequence Number=SeqID_77246
  Subcellular localization annotation: CTP_CleavageSite=50; ConfidenceScore=5.57e-01
TEKSRARRSEAPSSSAAPAPSTSTPSTSALSLPLAAPILPGPSTQSLEPSLSMLHSLHQGQLLIMQSLQDVVQQWPVMSVEEFLQKVAWPGVQPSHLGGGEASIAQEPQSDQEDDILEASKPTPPEPFIF

SEQ ID NO: 168932 - protein, 42 aa, Glycine max
  Coding DNA Sequence Number=SeqID_77247
MVSLNISLAAEWKRKKDDWRHHFKEKISQEEAHHHRKSWIRA

SEQ ID NO: 168933 - protein, 91 aa, Glycine max
  Coding DNA Sequence Number=SeqID_77248
VTPARHPVDPEKSNRVLGSLALIMGLCQFYEVFVAPSKVIRPPTNRTFIKKYCTPKQVQGVTPQQPEVGRQRAIGAPPPPLEFTSVHPQKG

SEQ ID NO: 168934 - protein, 44 aa, Glycine max
  Coding DNA Sequence Number=SeqID_77249
GQDRLELPSGVGTEYGQQKPIKVLRNGCKWGWSHDRLIVALSLR

SEQ ID NO: 168935 - protein, 77 aa, Glycine max
  Coding DNA Sequence Number=SeqID_77250
MGCYRHEGCSSYEGFPSGPRDPSILTDFAEHAAHSIWSGQERPDPKLVSHGRKVDKIGRPTPEIEGLIADTGLSPLI

SEQ ID NO: 168936 - protein, 118 aa, Glycine max
  Coding DNA Sequence Number=SeqID_77251
  Homolog annotation: Hit_ID=A2Q624; Match level="QueryCoverage=65%, HitCoverage=32%, E-value=9e-12, Identity=40%"; Hit description =Ribonuclease H
MDEKSITTQEFEYGETVVPSQPAKFEQLDQFVLWDPVALTSVHAELLAIYHDLKIARDKGIGRLICESDSKLALDLITGEINLFHQYFPTILLIHSLKQMDWEVTFVHVYCEGNKCAD

SEQ ID NO: 168937 - protein, 92 aa, Glycine max
  Coding DNA Sequence Number=SeqID_77252
MTGIQSDIRVKSYCRLNWFRASTFNFERLDILRDSIRHPKLQHSISSVSLYAKGLNQTSPSKKILSPFELAQSFNIQFRASRYMTGLNQTSE

SEQ ID NO: 168938 - protein, 82 aa, Glycine max
  Coding DNA Sequence Number=SeqID_77253
MARTQGLDRAIVDVPERRRPTALARRQRVHQMTADAPDMAEDVPDMAEDVPDMAEDAPKMTANVQGDDGAERSHVDDAEGFP

SEQ ID NO: 168939 - protein, 130 aa, Glycine max
  Coding DNA Sequence Number=SeqID_77254
MSNHKSTESALKNLEVQMGQLAKQIDDKSSNNFGANTENNPKEEWKAVMTRSKRKLEITMPFGEALQQIPLYSKFLKDMLTRKHRDHPLLGCDPRLTTSRYLAPIIRRFVKFRDMPEVKRKHCSTIREIP

SEQ ID NO: 168940 - protein, 338 aa, Glycine max
  Coding DNA Sequence Number=SeqID_77255
  Homolog annotation: Hit_ID=UPI00016621D1; Match level="QueryCoverage =45%, HitCoverage=40%, E-value=2e-11, Identity=32%"; Hit description =UPI00016621D1 related cluster
MTGPLDESISCFLIRLDPWVLVPITFRGLYALTVRGLHVLAFRGLHVLTFRGLHAFAFIGLDVLKFRGLHVLAIRGLHVLAFKGLYALTFRGLHVLTFRGLHALTFRGLHPLIFRGLHVLTLRGLHALAFRGPNILIFRGPNILIFRGLHVLIFTGLRVLAIRGLHIHTIRELKFLFISFWATPDIGGRPTVQAQPEREAITQLLCIPGQDFTRTAAKRQVWIMRTNMTTLTQIWMMLLLSKHFVQRPQCRSPPAKVSGLRPQDTQQTRRSPTGPWGVQLWLRASVSPTGCPFPPARDRARKTPSGPGEVQQGPGVSSSDYEPLARHHSSIAMAGSGQ

SEQ ID NO: 168941 - protein, 57 aa, Glycine max
  Coding DNA Sequence Number=SeqID_77256
MMITKDVQEEIKNKFKTQEEKLKNTSRFKKKDEFKNQDSRIKLQESRSRFKIQDSRI

SEQ ID NO: 168942 - protein, 136 aa, Glycine max
  Coding DNA Sequence Number=SeqID_77257
  Homolog annotation: Hit_ID=A5B3J2; Match level="QueryCoverage=36%, HitCoverage=11%, E-value=1e-07, Identity=54%"; Hit description =Putative uncharacterized protein
MLRRNRAERRRKLLQDRTVASILEEEAHFSDSTSSDSPSSRKSVTYLLEAVIMADEHQQRVTLEDYSNSSVPQFFTSIARPEGNLFQGLLNEGPYAHLATFIEICNTVKIAGMPDEAIRLNLFSFSLAGEEKRWLH

SEQ ID NO: 168943 - protein, 299 aa, Glycine max
  Coding DNA Sequence Number=SeqID_77258
  Gene Ontology: Mol. function=transition metal ion binding; Cellular component=endoplasmic reticulum; Biological process=electron transport
  Homolog annotation: Hit_ID=A5B9D6; Match level="QueryCoverage=36%, HitCoverage=76%, E-value=3e-33, Identity=66%"; Hit description =Putative uncharacterized protein
  Pfam annotation: Domain name=Cyt-b5; Domain location=177-240; Score =30.9; E_value=4.8e-06; Accession=PF00173.19; Description=Cytochrome b5-like HemeSteroid binding
MVITTFNGTGVGFGFGIGCGFGIGWGFGGGGCGVGVGLGWGFGAAFGSKYRSSRVTFQGVDFDRKEKVNSTELSKPSTEVREACGDSNCDFRVSIIVLSNRSTTVLVAALISWIMVALGKQFDMHASFGAREISGNRDEIGNGVFDVIFRSCFRVSSHVESKMVSKLLMVGRLSSDSIKKSDRQAMEGVLDVTKFLEEHPGGEEVILEVAGKDATKEFDVIGHSKAAQNMVLKYQVGVLQGATVQEVDLKDVVDKESNTKEMSAFVIKEGARSKSLAFYEFFVPLLVAGLYFGYRCLTY

SEQ ID NO: 168944 - protein, 217 aa, Glycine max
  Coding DNA Sequence Number=SeqID_77259
  Homolog annotation: Hit_ID=A7NU79; Match level="QueryCoverage=70%, HitCoverage=70%, E-value=2e-39, Identity=55%"; Hit description =Chromosome chr18 scaffold_1, whole genome shotgun sequence
  Pfam annotation: Domain name=DUF260; Domain location=51-156; Score =91.8; E_value=2.2e-24; Accession=PF03195.5; Description=Protein of unknown function DUF260
MAGPRKEGKFYCKLTWAEKVGSIDDDLFIDVVMVFLYDKDSPRQQKRKSMSCNGCRVLRKRCSERCSLRSSLNWIDCPHAQAHATLFLAKFFGRSDLMFFISSVPLNNRPALFQSLLFEACGRTVNPVNGAVGLLLSGNWHVCQAAVHTVLAGGVLRPLSEVVAPSESMFSHQFQSLASDSLKRSSDATAPVMSTMVSGESEICSSDDGKKLLNLFV

SEQ ID NO: 168945 - protein, 349 aa, Glycine max
  Coding DNA Sequence Number=SeqID_77260
  Gene Ontology: Mol. function=protein binding; Cellular component =membrane; Biological process=vesicle-mediated transport
  Homolog annotation: Hit_ID=Q2HRK3; Match level="QueryCoverage=94%, HitCoverage=97%, E-value=1e-105, Identity=62%"; Hit description=T -snare
  Pfam annotation: Domain name=Syntaxin-6_N; Domain location=11-103; Score=122.6; E_value=1.2e-33; Accession=PF09177.2; Description =Syntaxin 6, N-terminal
MASSFDRWEKDPFFNAAEEVQESADRMESTYRTWIHAMRDASSPWNCDELRRDLQTTLGTAKWQLEEFERAARSSYSKVSSEDARNRHRDFIHAIGGKIKKVEHSLQESVHSGSKASLPWMRLDEGERDELASFLSGIPAAGGKGLIECVGRDCESLQTNYSSNLLVSSGWGSSEAAPEKSHGHRRAASADADIGNWKITVSDDVQQSSSSNGSSGPTPMHKVASLSGFFGSMETISKLKWPKNGYRKLKAVNPCEEVDKALLAPAGLNGGIKAYYERSKSCLDNGDECYDKQLQGWYGALHRQLQRSQYQMQYNRPVQMAVWAVILLCFIGRLLILVCVSVSAEMRAL

SEQ ID NO: 168946 - protein, 367 aa, Glycine max
  Coding DNA Sequence Number=SeqID_77261
  Gene Ontology: Mol. function=metal ion binding
  Homolog annotation: Hit_ID=Q2HRJ4; Match level="QueryCoverage=95%, HitCoverage=86%, E-value=5e-88, Identity=49%"; Hit description=Zinc finger, RING-type
  Pfam annotation: Domain name=zf-C3HC4; Domain location=307-346; Score= 18.2; E_value=0.00076; Accession=PF00097.16; Description=Zinc finger, C3HC4 type (RING finger)
SITLRYGYYGDSCILLGPASSRLMKTSSVFVKQLQVSNEDNNQVILHAFNEEPELSSQTNWTVSNFFLVEAYKSKGSTIRMRWEAHTTSSLDQLHGMVIKGEKKFELLQPKQTSFLNAIALRKTVNGKEAEYNVEEDNIYHIGVLNMNSRNIILTMKVNVLAKVYDTTKGKKMCSTANGFCRLSFVFPNTQYVILTATGKVDGGSYVEISFLARVLTYILLLGALMIVIYLVLKFLEVHEGGDQNSHAAVDVTYRTSNVVARQTETQPLMQVETNRLTYGTNAKDDEEEDSGASSSSSEELYDEKLCCICYDEQRSSFFVPCGHCATCYDCAQRILDEESIVCPICRRLIHKGNELLILWLGQSSSN

SEQ ID NO: 168947 - protein, 49 aa, Glycine max
  Coding DNA Sequence Number=SeqID_77262
MGGLVGKQGWMMGNGADDKERNECVSILWPSLHVPIRLLFILTTGESIN

SEQ ID NO: 168948 - protein, 182 aa, Glycine max
  Coding DNA Sequence Number=SeqID_77263
  Gene Ontology: Mol. function=protein serine/threonine kinase activity; Cellular component=cellulose and pectin-containing cell wall; Biological process=recognition or rejection of self pollen
  Homolog annotation: Hit_ID=A5C1U1; Match level="QueryCoverage=96%, HitCoverage=22%, E-value=2e-56, Identity=61%"; Hit description =Putative uncharacterized protein
  Pfam annotation: Domain name=B_lectin; Domain location=38-148; Score =81.9; E_value=2e-21; Accession=PF01453.15; Description=D-mannose binding lectin
  Subcellular localization annotation: CTP_CleavageSite=42; ConfidenceScore=5.07e-01
MSCSHKKNGMFSAGFYAVGQNAYSFAVWFSEPYGQTRNATVVWMANRDQPVNGKDSKISLLRNGNLALNDVDESLVWYTNTASLSSSVRLFFDNTGNLLLHETQATGVVLWQSFDFPTDTLLPQQVFTRHSKLVSSRSETNMSSGFYALFFDNDNIFRLLYDGPEVSGLYWPDPWLASWNAG

SEQ ID NO: 168949 - protein, 302 aa, Glycine max
  Coding DNA Sequence Number=SeqID_77264
  Gene Ontology: Mol. function=hydrolase activity; Biological process =metabolic process
  Homolog annotation: Hit_ID=Q0WNN6; Match level="QueryCoverage=85%, HitCoverage=86%, E-value=2e-78, Identity=56%"; Hit description =Putative uncharacterized protein At3g53010
  Pfam annotation: Domain name=DUF303; Domain location=94-190; Score =96.8; E_value=7e-26; Accession=PF03629.9; Description=Domain of unknown function (DUF303)
MPCLLLLVFLIQSWAVKAQQVYDRNIFILAGQSNMAGRGGVLNNTGTGIATWDGVVPPQSRPNPSVLKLDAHLTWVEAREPLDADIDSRKTNGVGPGMAFANSVLEKHPDFGLIGLVPCAIGGSNISEWERGKELYFQMIKRAKASLRDGGTIRALLWYQGETDTVNLHDAQSYQRRVHKFFLDVRDDLQSPLLPIIQVALASGSGPHIEIVRQAQLGIDLLNLRTVDAHGLPLQPDGLHLSTPAQAHLGQMMANAFLQFVPSSNEEDATRTKKDMGDAVTEAVEENVFTVRRWFGVGDGRR

SEQ ID NO: 168950 - protein, 706 aa, Glycine max
  Coding DNA Sequence Number=SeqID_77265
  Gene Ontology: Mol. function=protein binding; Biological process =ubiquitin cycle
  Homolog annotation: Hit_ID=A7NU15; Match level="QueryCoverage=98%, HitCoverage=78%, E-value=2e-68, Identity=40%"; Hit description =Chromosome chr18 scaffold_1, whole genome shotgun sequence
  Pfam annotation: Domain name=F-box; Domain location=357-403; Score =25.8; E_value=0.00016; Accession=PF00646.24; Description=F-box domain
  Pfam annotation: Domain name=F-box; Domain location=5-51; Score=21.8; E_value=0.0025; Accession=PF00646.24; Description=F-box domain
  Pfam annotation: Domain name=LRR_2; Domain location=196-221; Score =16.6; E_value=0.097; Accession=PF07723.4; Description=Leucine Rich Repeat
  Pfam annotation: Domain name=LRR_2; Domain location=626-650; Score =6.9; E_value=2; Accession=PF07723.4; Description=Leucine Rich Repeat
  Pfam module annotation: Pfam domain module=F-box::F-box::LRR_2::LRR _2; Domain location=357-403::5-51::196-221::626-650
MGKAVSIDEIPDECLGCIFQLFSPGERKMFSLVCSRWLKIEGQTYQRLSLTADGLLSIPCTFSRFSSLTELTLINSLSKSIGDEALTLLTHRCCPNLTFFTLHSSIHSDACLENFAMNHKGLKKFSAVSCIFTYKGLKAFMDHCVSLEELRLKYLNSNPNIANADEDGFVTSSSLKALYLEGVDFSILKAISKRSSLEVLHLEMIGMCSDEGLVAVLEGCNLLRELRIRRSYCWEANLMGDKVLIAIVECCPNLQELVLDGLNPSTKASLEMLAFKCRSIGRLALRGKSSISYSDLASILAKLFQSDGYMQSADAMGFFGVRKGTEDNTERVSRFLFVPSPRVHISNPELQYSNIITRIDDIPDNCLASIFQLFPPVDHKNFSLVCRRCLKVQGQTHHRLCLTLPYSKFLASIFTRFDSVTELTLQCLNLMSMCDGNLVVISDLCPNLSYVGLEVLARSCERLKKFSCTSCTFGLNAIDALIHHCSSLEELSMEHSSVKTDGAEFVNFYPLIRAKNLTTVKIVQSSVEEYWDRFFHSLASQVTSLLEVRLDGFGVSDNGLKAISKFPNLETLHLVKTPKCTDAGLVEVAEGCNKSLRKLGIEESLQKGPNKIGNNGLRAVAKCCANLQELVLIGMNPSKANLEILVSNCQSLKHLGLWGSNKFGDTEIRCIAGKCVALKELHVEGCPRVSDRDMETLAAKSEGFQV

SEQ ID NO: 168951 - protein, 65 aa, Glycine max
  Coding DNA Sequence Number=SeqID_77266
MSAWKVSKYMDCDGGDIGRRKREVKKEEWKMGDEITQFPTVMGLSLRWYSPTLPVVARYPFISID

SEQ ID NO: 168952 - protein, 65 aa, Glycine max
  Coding DNA Sequence Number=SeqID_77267
FRHDIEIPNGENARNSVANMILKFHDDPTVNGFEIVIFLRLDDRTWGLDFMISETFNEGAMDSKT

SEQ ID NO: 168953 - protein, 461 aa, Glycine max
  Coding DNA Sequence Number=SeqID_77268
  Gene Ontology: Mol. function=nucleic acid binding; Cellular component= nucleus; Biological process=metabolic process
  Homolog annotation: Hit_ID=Q00M75; Match level="QueryCoverage=94%, HitCoverage=85%, E-value=0.0, Identity=50%"; Hit description=PPR -repeat containing protein
  Pfam annotation: Domain name=GTP_cyclohydroI; Domain location=55-145; Score=-23.9; E_value=0.052; Accession=PF01227.13; Description=GTP cyclohydrolase I
  Pfam annotation: Domain name=PPR; Domain location=193-227; Score =43.2; E_value=9.3e-10; Accession=PF01535.11; Description=PPR repeat
  Pfam annotation: Domain name=PPR; Domain location=228-262; Score =13.1; E_value=0.22; Accession=PF01535.11; Description=PPR repeat
  Pfam annotation: Domain name=PPR; Domain location=263-297; Score =14.5; E_value=0.15; Accession=PF01535.11; Description=PPR repeat
  Pfam annotation: Domain name=PPR; Domain location=347-381; Score=5.4; E_value=1.8; Accession=PF01535.11; Description=PPR repeat
  Pfam annotation: Domain name=PPR; Domain location=383-417; Score=2.9; E_value=3.5; Accession=PF01535.11; Description=PPR repeat
  Pfam annotation: Domain name=PPR; Domain location=7-41; Score=45.5; E_ value=1.9e-10; Accession=PF01535.11; Description=PPR repeat
  Pfam annotation: Domain name=PPR; Domain location=92-126; Score=11.7; E_value=0.32; Accession=PF01535.11; Description=PPR repeat
  Pfam module annotation: Pfam domain module=GTP_cyclohydroI::PPR::PPR:: PPR::PPR::PPR::PPR::PPR; Domain location=55-145::193-227::228 -262::263-297::347-381::383-417::7-41::92-126
MGEKNVISWNTMIGAYGQNGFEDKAVLCFKEMLKEGLLPSPVTMMKLMSADAVAETVHCYIIKCGFTSDASVQGFTDMAKLIYEYYPTKDLISLTGIISSYSEKGEVESVVQGFIQTVQLDIKPDAVALIRVLHGISDPSHFAIGCAFHGYGLKSGLNNDCLVANGLISTYSRFDEIQAALSLFFDRREKPLITWNSVISGCVQAGNSSDAMELFFQMNMCGQKPDAITITSLLSGCCQLGYLQIGETLHGYILRNNLKVEDFTVTALIDMYTKCGRLDYAEKVFYSINDPRASPGAAVKLCLGDLLVMGSNPETASLHMQGLYGLEHKAFSCFSKLQEQGLEPDKITFLGVLAACTHGGLVYAGMEYFRIMREEYGLMPTLQHYACLVGLLGRAGLFKEAIDIINNMEIRPDSAVWVALLSACWIQQEVKLGQKFVFIELQKRWILCINVKSLCDCWEVG

SEQ ID NO: 168954 - protein, 401 aa, Glycine max
  Coding DNA Sequence Number=SeqID_77269
  Gene Ontology: Mol. function=protein dimerization activity; Cellular component=nucleus; Biological process=regulation of transcription, DNA-dependent
  Homolog annotation: Hit_ID=Q00M78; Match level="QueryCoverage=90%, HitCoverage=87%, E-value=1e-167, Identity=85%"; Hit description=Bzip transcription factor
  Pfam annotation: Domain name=bZIP_1; Domain location=334-398; Score =45.9; E_value=1.4e-10; Accession=PF00170.12; Description=bZIP transcription factor
  Pfam annotation: Domain name=bZIP_2; Domain location=335-389; Score =42.2; E_value=1.8e-09; Accession=PF07716.6; Description=Basic region leucine zipper
  Pfam module annotation: Pfam domain module=bZIP_1::bZIP_2; Domain location=334-398::335-389
  Subcellular localization annotation: CTP_CleavageSite=39; ConfidenceScore=5.13e-01
MNFKSFGNEAGGGGGRQAGNFSLTRQPSVYSLTFDEFMNSMGGSGKDFGSMNMDELLKNIWTAEEVQTMASAGVAADDGGAGVSHLQRQGSLTLPRTLSQKTVDEVWKDISKDHGGPNLAQTQREPTLGEVTLEEFLVRAGVVREDAKPNESVFVDLSRVGNNSGLGLGFQQRNKVAAATGLMGNRLNNDPLVGLQPSANLPLNVNGVRTSNQQPQMQSPQSQHQHQHQHQQQQQQIFPKQSAMSYAAAQMPQGMVRGGVVGLGDQGLSVQGGGIGMVGLAPGSVHVATGSPAANQLSSGDRIGKSNGDSSSVSPVPYVFNGSLRGRKNGGAVEKVIERRQRRMIKNRESAARSRARKQAYTMELEAEVAKLKEENQELQKKQVTLAIATCDIQMQALTCT

SEQ ID NO: 168955 - protein, 296 aa, Glycine max
  Coding DNA Sequence Number=SeqID_77270
  Gene Ontology: Mol. function=magnesium ion binding; Cellular component=chloroplast; Biological process=photosynthesis, light harvesting
  Homolog annotation: Hit_ID=A7NTV5; Match level="QueryCoverage=61%, HitCoverage=71%, E-value=1e-52, Identity=58%"; Hit description =Chromosome chr18 scaffold_1, whole genome shotgun sequence
  Pfam annotation: Domain name=Chloroa_b-bind; Domain location=57-192; Score=107.0; E_value=5.6e-29; Accession=PF00504.12; Description =Chlorophyll A-B binding protein
  Subcellular localization annotation: CTP_CleavageSite=24; ConfidenceScore=5.10e-01
MAVAIGRSFSIQPRSFFNSKSLDRASPAGRLSWLGHAAAAATPYYRQTCVAAQHFNEDNNYMLFSLAGDFGFDPLGLAEDPASLRWYVQAELVHCRFAMLGVFGILVTDLLRVTGINKIPVWFEAGAVKYDFANTKTLFLVQLLLMGFVETKRYMDFVSPGSQAKEGSFFGLEASLKGLEPGVESTMKIHHPHLLDFTAPYHRTTKTHAQNHRTAADLRPFPNHNQSASSPIPISPAIGLTALTAPSTSHAPSVAVAPPAQSRFRNSRSSAQYMSESGRGAMGDSGRESAEKKGGR

SEQ ID NO: 168956 - protein, 186 aa, Glycine max
  Coding DNA Sequence Number=SeqID_77271
  Subcellular localization annotation: CTP_CleavageSite=68; ConfidenceScore=5.51e-01
MFMTEAIPSRSTSTSSDTKQRCCSDSTFSGTNLGRKLRGNMPRNQIGLQVMRLAAEHEGTPSQVMAVSQSREGEDRRKGESKSEVPQREREWMTYIPGTTTKANFYDSYSKTFRNEHVAKSKHIFDFSRVLAESLLGPIPHPKQYNNPTQAIRFNNTTRTLDSSSQTLIPNFDSNSNEIPSNTAEP

SEQ ID NO: 168957 - protein, 38 aa, Glycine max
  Coding DNA Sequence Number=SeqID_77272
MGGNWEWEGVVEDGEERPPMEVGEGKGIGRGDAGKVPV

SEQ ID NO: 168958 - protein, 424 aa, Glycine max
  Coding DNA Sequence Number=SeqID_77273
  Homolog annotation: Hit_ID=A7NTU0; Match level="QueryCoverage=92%, HitCoverage=86%, E-value=8e-59, Identity=61%"; Hit description =Chromosome chr18 scaffold_1, whole genome shotgun sequence
MARGKWVCSYKKTTLLVCFFNIAVALYALHSLYSSLYIYSGNVSRNVALYSPDQIRKMELSIQIRGEFKPVELIKWALEGEFSSETVAVELPRHLKQNIIDEILQRLRSLNFSRTDIAKERGVYKVLGSPTTTTNFCGVALQDFDQLELEPFAMSLSCKLAARACWDVRIQLQGMGLELHIGSMGILVRSLYKALGSPTTTTSLCGVALLRGLELFGCLGCKSTAENVLVALEVVESWRKEKLEEVKSALVKGTSNSTIPHEEAGMLVRALESNWAVLCEEIGLWIPAQVSNEEHDDKPEGAEEFEDEILPGRPVSPECHAELHTDYDGAAVRWGLTFHKDSAADCCQACLDHAKHAKEGEKKCNIWVYCPSEFGEMNWGAENFPNGHLGLGFGQNEVFDRLTSDLRAKDFPPRSGLTPRKCDF

SEQ ID NO: 168959 - protein, 361 aa, Glycine max
  Coding DNA Sequence Number=SeqID_77274
  Gene Ontology: Mol. function=nucleic acid binding; Cellular component= cytosol; Biological process=regulation of mRNA stability
  Homolog annotation: Hit_ID=A7NTR1; Match level="QueryCoverage=79%, HitCoverage=79%, E-value=1e-132, Identity=56%"; Hit description =Chromosome chr18 scaffold_1, whole genome shotgun sequence
  Pfam annotation: Domain name=MPPN; Domain location=269-360; Score= -4.1; E_value=0.00039; Accession=PF05172.4; Description=MPPN (rrm -like) domain
  Pfam annotation: Domain name=RRM_1; Domain location=175-247; Score =68.6; E_value=2.1e-17; Accession=PF00076.13; Description=RNA recognition motif. (a.k.a. RRM, RB
  Pfam annotation: Domain name=RRM_1; Domain location=280-345; Score =80.3; E_value=6.1e-21; Accession=PF00076.13; Description=RNA recognition motif. (a.k.a. RRM, RB
  Pfam annotation: Domain name=RRM_1; Domain location=82-153; Score =45.3; E_value=2.1e-10; Accession=PF00076.13; Description=RNA recognition motif. (a.k.a. RRM, RB
  Pfam module annotation: Pfam domain module=MPPN::RRM_1::RRM_1::RRM_1; Domain location=269-360::175-247::280-345::82-153
MQPTSNGSDSKATEQRTPPPQPVAVPPQWMPMQYPAAAMVMQHHMMPPQHYAPPQPYMAYHQYQQQVPQAHHLGSSAENKTVWVGDLHHWMDENYLHRCFASTGEISSIKVIRNKQTGLSEGYGFVEFYSHGTADKVLQNYAGILMPNTEQPFRLNWATFSTGDKRSDNVPDLSIFVGDLAADVTDSMLHETFTNRYPSVKAAKVVFDANTGRSKGYGFVRFGDDNERSQAMTEMNGVYCSSRPMRIGAATPRKTSGYQQGSQSNGTSSQSEADSTNTTIFVGGLDPNVTAEDLKQPFSQYGEIVSVKIPVGKGCGFVQFANRNNAEEALQKLNGTTIGKQMVRLSWGRSPANKQVYSLHS

SEQ ID NO: 168960 - protein, 691 aa, Glycine max
  Coding DNA Sequence Number=SeqID_77275
  Gene Ontology: Mol. function=hydrolase activity; Biological process =intracellular signaling cascade
  Homolog annotation: Hit_ID=A7NTQ7; Match level="QueryCoverage=79%, HitCoverage=99%, E-value=1e-140, Identity=51%"; Hit description =Chromosome chr18 scaffold_1, whole genome shotgun sequence
  Pfam annotation: Domain name=DUF547; Domain location=465-613; Score =267.6; E_value=2.7e-77; Accession=PF04784.5; Description=Protein of unknown function, DUF547
MNSGRIRKNLNGKRIMVHHDDMRLSPLWLKPSTQVTVPASILGCTSECFLDEKKLTIEFPLSSGRYIHAVAADLEEVQKMNTSVRPRLQHRKAPTPTTVSHEKRESSQSHPKLWLQFLMINDPRNSENLILTSKALNEKAEMRGSSRGGANNAVKGGKTSSKDRKLALQQDVDRLKKKLKREENIHRALERAFNRPLGALPRLPPYLPPYTLGLLAEVAVLEEEIVRLEEQVVHFRQDLYQEAVYMSSSKMKLEQSARVNNASPNSSPKLGKLKSLSQTMDDAATSETRPTTTLPKDRHGKENQSCTNSFKSNKQSTCKGQTTKSPIKKLPIDNKSLQKRRDPPKKQQELRLKDQPIAEVRNLRENPQGDESPNIISENILKCLSSIILRMSAAKNLDSTADVPPLRTPKSKNCVEGIEFWDPYSICLEFGKRDIGPYKQLRSIETKSFDPKRTAKSLFLLHRLKLLLRKLACVNIENLNHQEKLAFWINIYNSCMMNAYIENGIPESPEMVAALMQKATINVGGHLLSATTIEHCILRLPYHWKFKIISFLQLNSKQTLSKGGKNHETYGLELSEPLVTFALSCGTWSSPAVRIYTASQVENELEMAKREYLQAAVGISISKFLIPKLLDWYLLDFAKDLESLLDWICLQLPSDVGKEAIKFLEKRKTGPLSQFVHIMPYEFNFRYLLCT

SEQ ID NO: 168961 - protein, 118 aa, Glycine max
  Coding DNA Sequence Number=SeqID_77276
  Homolog annotation: Hit_ID=A5AWI6; Match level="QueryCoverage=59%, HitCoverage=4%, E-value=4e-16, Identity=60%"; Hit description =Putative uncharacterized protein
MPMYQQQEQPPPMISVTQQSSHESIGPLIGVLVVVIVLGVIAVMIGRLCSGRRIMGHGQYDVESWAERKCSSCIDGRINLSLPTRVSESSNSVPATPIHACQETKRPEQSSQTSPPNL

SEQ ID NO: 168962 - protein, 93 aa, Glycine max
  Coding DNA Sequence Number=SeqID_77277
MMTCKGAFLQWRCAKEGDGRTSSLSSWVKEVSLWNEYACEGGVIMGVVVVISLREVLGTEGDVAGIGYSHVVMGTRFQGRLRTVQGESREDVT

SEQ ID NO: 168963 - protein, 63 aa, Glycine max
  Coding DNA Sequence Number=SeqID_77278
MRKSLTSYETVIVVTSESNTQCKWYENEENSYKPTFYRKKTFLKFKETALQQQKETDDPGSKL

SEQ ID NO: 168964 - protein, 117 aa, Glycine max
  Coding DNA Sequence Number=SeqID_77279
MANDGDKSDSNSSYSLHHFDHPEMVSSAHGNGASPPAAPKENNVNFSSGLSAPKLIIDSGATNHITSSPSLLVNSKKKQFFTTNFYAKWRSSSNYFYWKFTFESYYFFEECTWGTIL

SEQ ID NO: 168965 - protein, 191 aa, Glycine max
  Coding DNA Sequence Number=SeqID_77280
  Homolog annotation: Hit_ID=A7NTL1; Match level="QueryCoverage=56%, HitCoverage=35%, E-value=2e-23, Identity=55%"; Hit description =Chromosome chr18 scaffold_1, whole genome shotgun sequence
  Subcellular localization annotation: CTP_CleavageSite=50; ConfidenceScore=5.27e-01
MELQTLCCALPSQPLHSSNHRILSSPAFGIRAPFTNQRQRFHFGNASKCMGAAFSGLKWVIKEPSLLGLSKFQRLLVHSSDSNLNGGLEVHPKQSSSVPVTTFNGAEPFHGKSGSVSFCGLTHQSVEEGKLESSPFEGKGGSFLWVLAPAAFIASLILPQFFVDNVVEAFLNNVILIGMEWIQLCAFSYCL

SEQ ID NO: 168966 - protein, 236 aa, Glycine max
  Coding DNA Sequence Number=SeqID_77281
  Homolog annotation: Hit_ID=A7NTL1; Match level="QueryCoverage=78%, HitCoverage=60%, E-value=3e-72, Identity=70%"; Hit description =Chromosome chr18 scaffold_1, whole genome shotgun sequence
MSKNSDILCEKKFLDKSTKDVEKMTMSHAIAFPLHFAVFLEVIGGVDVGLNIVTIFSHEVLFYIGLATFLHVTDCVQRPYLQYSSKRWGLITGLRGYLFSAFFTMGLKIIAPLILLFVTWSAIRIAAFVAITPFLVGCVAQIAFEKALDNRGSSCWPLVPVIFEVYRLYQLTKAANFAEKLLFSMKGLPAGPELVERSGALFAMLITFQVLGIVCLWSLMTFLLRLFPSRPVADHY

SEQ ID NO: 168967 - protein, 265 aa, Glycine max
  Coding DNA Sequence Number=SeqID_77282
  Gene Ontology: Mol. function=metal ion binding; Cellular component =integral to membrane; Biological process=ubiquitin cycle
  Homolog annotation: Hit_ID=A5BLE6; Match level="QueryCoverage=80%, HitCoverage=91%, E-value=3e-81, Identity=69%"; Hit description =Putative uncharacterized protein
  Pfam annotation: Domain name=zf-C3HC4; Domain location=32-72; Score =32.5; E_value=1.5e-06; Accession=PF00097.16; Description=Zinc finger, C3HC4 type (RING finger)
MASGFGESTGRSPPSPSYFNNNNNNDAANFECNICFELAQDPIITLCGHLFCWPCLYKWLHFHSQSRECPVCKALVEEEKLVPLYGRGKSSTDPRSKSIPGDNIPHRPAGQRPETAPPPETNHFHQHGFGFMGGLGGFAPPPMATTRFGNFALSAAFGGFIPSLFNFQLHGFHDAAMYGGGAGFPHGFANTFHGVHAHGFPLRTHQGQQDYYLKKLLLFVVLLDTISSILFFVIALWFPWYPCAKDIKHESNAPIVRNKDLGTGP

SEQ ID NO: 168968 - protein, 531 aa, Glycine max
  Coding DNA Sequence Number=SeqID_77283
  Gene Ontology: Mol. function=metalloendopeptidase activity; Cellular component=membrane; Biological process=cell adhesion
  Homolog annotation: Hit_ID=Q67ZD0; Match level="QueryCoverage=99%, HitCoverage=62%, E-value=0.0, Identity=77%"; Hit description=Major surface like glycoprotein
  Pfam annotation: Domain name=Peptidase_M8; Domain location=18-530; Score=3.1; E_value=5.6e-13; Accession=PF01457.7; Description =Leishmanolysin
MELTVRCTSCALSRFHCKLRFAVVVFEIILILAWVEAHNAKPQEHQLQWGGLERNTENIASHSCIHDQILDQRKRPGRKVYSITPQVYEPVRLKHLQHKGRTLLDVPTSSRPQEDAKKPIRIYLNYDAVGHSPDRDCRAIGNIVKLGEPPMTSPGFPSCDPHGNPPILGDCWYNCTSEDISGDDKKRRLRKALGQTADWFRRALAVEPVKGNLRLSGYSACGQDGGVQLPRGYIEEGVSDADLVLLVTTRPTTGSTLAWAVACERDQWGRAIAGHVNVAPRHLTAEAETLLSATLIHEVMHVLGFDPHAFAHFRDERKRRRNQVTEQVMDEKLGRMVTRVVLPRVVMHSRYHYAAFSGNFSGLELEDGGGRGTSGSHWEKRLLMNEIMTGSVDTKSVVSKMTLALLEDSGWYKANYSMADHLDWGRNQGTEFVTSPCNLWKGAYRCNTTLFSGCTYNREAEGYCPILTYSGDLPQWARYFPQANKGGQSSLADYCTYFVAYSDGSCTDTNSARAPDRMLGEVRGSNSRSDL

SEQ ID NO: 168969 - protein, 166 aa, Glycine max
  Coding DNA Sequence Number=SeqID_77284
MACASTTSSKCDRNYDWFFALLKDWNGGDIDSAGGDNGDNNGEMVVMHNDNHDNNNGDERMVAKAKYNDNGDGGGMIETIVVVVVEWAEEEEMLMFLQSHQDTKPWRNKRIEEFERDNMGKSEDELVPLSKEQEPELENDGGCGGDILIDHICNILRQASNIISCQ

SEQ ID NO: 168970 - protein, 157 aa, Glycine max
  Coding DNA Sequence Number=SeqID_77285
MARKKYFHDETCFDKLLMPLRRLPPLTTMGNNVEEDEAEPNERRKRIWDPLLLWLTGGPGCSAFSGLVFEIGNECQTRISTDNHHVDQKFYANLLGHTLIYFGGVACPLTFKNEEYNGSLPNLTLKPQSWTKVELAWKFLDELDHILIDDIDFICCS

SEQ ID NO: 168971 - protein, 213 aa, Glycine max
  Coding DNA Sequence Number=SeqID_77286
  Homolog annotation: Hit_ID=A5C0N4; Match level="QueryCoverage=69%, HitCoverage=70%, E-value=3e-15, Identity=38%"; Hit description =Putative uncharacterized protein
MDISSSQYNSAGESGWTHYLDHSSLSESYFQMRGGIEDHGGKGARVEEEEEDLSMISDASSGPQHYHEDDGQHYCVNWYPSTSHYTKESEKKKNNNKKAKEYGNNQHPSPLDDTASSPVLNCPKASQKAIKKASFSGNGAVENALDFPPCFSGTKIKKKSKFQKHFSFFERSLGGKQASEEPAFASAVERKTRSRGCQSRCCSMTKRTPLILF

SEQ ID NO: 168972 - protein, 199 aa, Glycine max
  Coding DNA Sequence Number=SeqID_77287
MASQLTLQLQLQSRGLVPDLVRFGAFLKHVFALPSLAFKKQISCIRKKKKRNKFQNTGNFKNSEQLSEVLNRRRTKGYIERDTEDMLGILRPGYQTTIEVSSSLSRFMNHEQQWKGCQTMHQSVPILTLEGNLNPAPPLLNLSPPDFLISPNYTFHIIPFLIFVLTPPLISFNFTTPERLARHAGVFHNSKTKLLKYLF

SEQ ID NO: 168973 - protein, 126 aa, Glycine max
  Coding DNA Sequence Number=SeqID_77288
MGNVNGHPKFIEWDPVAQKSVPAAVGVGQPLDFARDDKIGISAAREEEEEKQTCPHNVCPVTWEQKLSNQYTTLPSGLERLMQPETLVSTFKEIICNQILGRCCKETRNEYDEGDIGEHKRKMVVQ

SEQ ID NO: 168974 - protein, 500 aa, Glycine max
  Coding DNA Sequence Number=SeqID_77289
  Gene Ontology: Mol. function=heat shock protein binding; Cellular component=cytoplasm; Biological process=chloroplast accumulation movement
  Homolog annotation: Hit_ID=Q9C9Q4; Match level="QueryCoverage=75%, HitCoverage=55%, E-value=1e-18, Identity=29%"; Hit description =Putative uncharacterized protein F9E10.5
MERFYSSQRESILLGYSNDNNNSLIQGSNLEVDFTDVFGGPPRRSSVNEVRQSVGEFSEEERGWCRWPPEREKPVFGEDSGNRRRNHSDFFDDIFGGEESASVCSTPKKRVGDAFALSRVSSPLPPAADPVFGSLPATFRSRNLLNNINDGIVASNGLKPYRQSLLSQEFSNSSTFDKTDKGSIMKQDISISEVLPSASNGQFHFSIYKWASKGVPMVMPLRTERNSRNKDKAKLERCSGAKEWIVSEITTQNPIEYNRKQDSNQIVEQIVSAKTQLDTSTSPQTVSKDVPASSISRDTREVESSIRSTSDKKLEPKPLQFLFKESDKKQDNDEMITREREENRMMKSTKKSSAVFDVTVNPMKQEEKAVPLRDVGRSKATSQGSVSLGENLGKGLVKGKVKEFARIFNQEAVNKPKVDSKSQPQGSTYKKRDALRTKNEVEAGPEQPKKDNSVTETTNISANNLFHQDDISEPEIPDISFTVIGDKDESFPGSFMVFHY

SEQ ID NO: 168975 - protein, 165 aa, Glycine max
  Coding DNA Sequence Number=SeqID_77290
  Homolog annotation: Hit_ID=A7NTE0; Match level="QueryCoverage=56%, HitCoverage=55%, E-value=4e-20, Identity=56%"; Hit description =Chromosome chr18 scaffold_1, whole genome shotgun sequence
  Pfam annotation: Domain name=DUF1195; Domain location=1-139; Score =155.6; E_value=1.3e-43; Accession=PF06708.2; Description=Protein of unknown function (DUF1195)
MRKRGSHEYDGDSGNTNSKRHLLLWILAAVILIALWSMFAGSVTLKWSLSNNDDLDSTILEDLDVLEVEEREKVVRHMWDLYSHTNTKSVGLPKFWWEAFEAAYQQLVSDVPAVRDAAVSEIAKMSLRSLPIQIQSHSVFSFHDEHVQSITASRKIKQAKSRTGQ

SEQ ID NO: 168976 - protein, 473 aa, Glycine max
  Coding DNA Sequence Number=SeqID_77291
  Gene Ontology: Mol. function=nucleic acid binding; Cellular component= intracellular; Biological process=regulation of transcription
  Homolog annotation: Hit_ID=Q10QG1; Match level="QueryCoverage=31%, HitCoverage=27%, E-value=4e-81, Identity=90%"; Hit description=Zinc finger, C2H2 type family protein, expressed
  Pfam annotation: Domain name=RS4NT; Domain location=117-154; Score =12.8; E_value=0.049; Accession=PF08071.3; Description=RS4NT (NUC023) domain
  Pfam annotation: Domain name=zf-C2H2; Domain location=132-154; Score =22.2; E_value=0.0019; Accession=PF00096.17; Description=Zinc finger, C2H2 type
  Pfam annotation: Domain name=zf-C2H2; Domain location=159-180; Score =15.8; E_value=0.17; Accession=PF00096.17; Description=Zinc finger, C2H2 type
  Pfam annotation: Domain name=zf-C2H2; Domain location=56-78; Score =26.4; E_value=0.0001; Accession=PF00096.17; Description=Zinc finger, C2H2 type
  Pfam module annotation: Pfam domain module=RS4NT::zf-C2H2::zf -C2H2::zf-C2H2; Domain location=117-154::132-154::159-180::56-78
MTEPQNPSPLTHSPALEITPQPLLPPKRKRSLPGMPDPDAEVIALSPKTLLATNRFVCEICNKGFQRDQNLQLHRRGHNLPWKLRQRGSTEPRKKAYVCPEPSCVHHNPARALGDLTGIKKHFCRKHGEKKWQCERCSKKYAVHSDWKAHMKTCGSREYRCDCGTLFSRRDSFITHRAFCDVLAQESARAQAQAQGQGGSNSKVVEASSPPTPPLTPSASVVPPTLSIQSSEIPENPSTKLSPTSPNATACFVTSSSSTPSNSTTCTTVFASVLAPSPTTPSTPQSPSNSTSSFTNLISNLARSQNPNTIMRESTSLSLSTPLYLSNNDPLHYTASPQPALSATALLQKAAQMGASNASLLRGLGLATTTSSSSSFGKDEGFNINATTTLQWNGQVKQENHPVVDNLGLGLLCGSGSVPDVMMAPSTPFVGQPMTRDLLGLSIGGGGSRGGLSALLTSFGGNFDSPGEGGVHR

SEQ ID NO: 168977 - protein, 459 aa, Glycine max
  Coding DNA Sequence Number=SeqID_77292
  Gene Ontology: Mol. function=protein binding; Cellular component =integral to membrane; Biological process=mitochondrion organization and biogenesis
  Homolog annotation: Hit_ID=A7NTC6; Match level="QueryCoverage=92%, HitCoverage=87%, E-value=1e-155, Identity=64%"; Hit description =Chromosome chr18 scaffold_1, whole genome shotgun sequence
  Pfam annotation: Domain name=CBS; Domain location=245-384; Score=9.0; E_value=0.0062; Accession=PF00571.19; Description=CBS domain
  Pfam annotation: Domain name=DUF21; Domain location=14-191; Score =169.5; E_value=8.6e-48; Accession=PF01595.11; Description=Domain of unknown function DUF21
  Pfam module annotation: Pfam domain module=CBS::DUF21; Domain location=245-384::14-191
MAAEIPCCGTKFSLYVLVIIGLVCFAGLMAGLTLGLMSLGLVDLEVLIKSGRPQDRIHASKIYPVVKNQHLLLCTLLIGNSLAMEALPIFLDSLVHPAAAILISVTLILMFGEILPQAICTRYGLTVGATLAPLVRVLLIVFFPLSYPISKVLDWMLGKGHAALLKRAELKTFVNFHGNEAGKGGDLTHDETTIITGALDLTEKTAKDAMTPISKAFSLDLDATLNLWVKNLFMVDSKAAVPLRKMLIRKIPRVSENMPLYDILNEFQKGHSHIAVVYRDLNDKNEAPKKVKDGELLDLKDKRKNKGEKTSLDKGEKLESHYSLTTDGAQQAKKSPPATPAFKKRHRGCSYCILDLDNSPLPVFPPNEVVVGVITMEDVIEELLQEEILDETDEYVNIHNKIKVNMNASKEKAPDANMLLPSQAVQGHTPTNSISTATSATGSPTTIDLISESESLRNR

SEQ ID NO: 168978 - protein, 721 aa, Glycine max
  Coding DNA Sequence Number=SeqID_77293
  Homolog annotation: Hit_ID=A7NTE6; Match level="QueryCoverage=87%, HitCoverage=83%, E-value=1e-112, Identity=41%"; Hit description =Chromosome chr18 scaffold_1, whole genome shotgun sequence
MESDDDFELLPPSPVQERKLKRLKKAARVPEPSHPPISPPNFSVSGNGEEHLTEPNGESGPEFETLTPSPSPSPSPSPNPNPQSDTPKGVTVDDDGLGAKRVLDFDSFGEELGKVVEETEEVRDLKTYEEIRDLNTDEVERKRRGLDDLPEKNEKKKRINDDGDSSEKKPKVSATNKRKAEKERRDTLKQLQAESQRLLRETRDAAFKPAPLVQKPISSILEKIRQRKLEILKKSADNVEKAEPEETPASCHAATKCNLGTSHIGEESNDAAANSNSESIPSPMAKDSESEHAFRAPIGDTQELYTDSERSDTKDEAVNDKSNNPSEEVFAPSMLAMNLKLDSAPPDDDVSSNEEEEDNDKENIEPHVHVSVDLTLSPDGDPVRAFVDEEAEEEDDSDNDLQRFQDDEGEDDDDIEEDDMIATQYEEKPDDREKREQLHQQWHEQRDAAGVDNLRQKFYGGSKLNETPSTEEEDEESRETENDDEVEEYAAPSESLKTTLKKVKQMIPQMFSDKDDKYVSSDDEETEDKLARQSLYYKTEEKAKFFSPAEDENSREVFSLIKKLNVPDTKRKGKTTSIFAMPSIGQNINISSKSSFVGRASDRFMPTSQKQGSCKVRSYIFGRDDSNSRSSILISEDSLDTIQTESQPPKAASAKFQRNTQNKNTTMNSASKESNVSLLDILRKSSHHADHSFQNANVQPKTSIFDAFKLMKKPTKAEARV

SEQ ID NO: 168979 - protein, 108 aa, Glycine max
  Coding DNA Sequence Number=SeqID_77294
  Gene Ontology: Mol. function=DNA binding; Cellular component=nucleus; Biological process=regulation of transcription
  Homolog annotation: Hit_ID=A7NTB5; Match level="QueryCoverage=59%, HitCoverage=62%, E-value=5e-17, Identity=57%"; Hit description =Chromosome chr18 scaffold_1, whole genome shotgun sequence
  Pfam annotation: Domain name=Myb_DNA-binding; Domain location=1-49; Score=18.1; E_value=0.033; Accession=PF00249.22; Description=Myb -like DNA-binding domain
MGWTREENRRFEDALAVHGPNDPNRWQHVANAVGGKSVQEVKMHYEILQEDVIRIERDQIPLPSYRGAAININARQNIDNEQSFIAFTMITTSCPRIYMLFLVSLQSN

SEQ ID NO: 168980 - protein, 66 aa, Glycine max
  Coding DNA Sequence Number=SeqID_77295
MAEGSEHAGAGGRGGGNSQSQVIQVPEPEPHPVMEQLPDVHYCINSPPPWRQYLIVFLFMAKQIEN

SEQ ID NO: 168981 - protein, 567 aa, Glycine max
  Coding DNA Sequence Number=SeqID_77296
  Gene Ontology: Mol. function=cytokinin dehydrogenase activity; Cellular component=extracellular region; Biological process =cytokinin metabolic process
  Homolog annotation: Hit_ID=A7NT55; Match level="QueryCoverage=58%, HitCoverage=66%, E-value=1e-146, Identity=74%"; Hit description =Chromosome chr18 scaffold_1, whole genome shotgun sequence
  Pfam annotation: Domain name=Cytokin-bind; Domain location=380-562; Score=205.9; E_value=9.7e-59; Accession=PF09265.1; Description =Cytokinin dehydrogenase 1, FAD and cyto
  Pfam annotation: Domain name=FAD_binding_4; Domain location=209-348; Score=49.4; E_value=1.3e-11; Accession=PF01565.14; Description=FAD binding domain
  Pfam module annotation: Pfam domain module=Cytokin-bind::FAD_binding _4; Domain location=380-562::209-348
MAVNNNKLVLLTFAICRLIVTVGLTVVPELLDVGLQGRLSVDTLELEAASVDFGRLSRGEPSELRCHTSRPVPLISSVVRATVTSSAVPPRRSHLIPKRAARPARFPPWASPHFRSVVSAIQEAGEAYLVGLFEDTHLTKRESGIKKNKAELGFYIAHSVVAAAELVSVAASPTVATMIIPEKNRKEICKYLFQGDSAVTVMDTVVVHAGLIFQDVARVVKAAFESPFAVSARGHGHSINGQAMIKEKKGVVIEMGKSDSGEDGSSIRVSEKGMYVDVWGGKLWIDVLSATLEYGLAPMSWTDYLYLSVGGTLSNAGISGQTFNHGPQITNVYELDVVTGKGELVTCSEDRNSELFHAVLGGLGQFGIITRARIALEPAPHREYLISLHGKAARERFDYVEGFVIVDEGLINNWRSSFFSASNPVKITSLNADGGVLYCLEITKNYDQGNADSVDEEIQALLKKLNFIPTSVFTTDLPYVDFLDRVHKAELKLRSKGLWDVPHPWLNLFVPKSRIGDFDKGVFKGILGNKTSGPILIYPMNKNKHAHISSYINHMSAADSLISTVSV

SEQ ID NO: 168982 - protein, 191 aa, Glycine max
  Coding DNA Sequence Number=SeqID_77297
MESLDGYTVCKEYSLTQLLDVKELFDNPKVAVSRATAVWVRDVDDVSVEVRHLCRVLRVIRLAELHDVVFPVGFFIDELVDLVVEIAEVVLAKTLVLDLSNFSADLLYDLLSPLVASIRRSCYEPSSDKETLTTRCSGIAPPCAAAGWVVGVCVGIFLLDVVIDGGNTGWTAVVVVSNGGREEGDDVVITC

SEQ ID NO: 168983 - protein, 481 aa, Glycine max
  Coding DNA Sequence Number=SeqID_77298
  Gene Ontology: Mol. function=hydrolase activity; Cellular component =membrane; Biological process=proton transport
  Homolog annotation: Hit_ID=Q8GSP7; Match level="QueryCoverage=100%, HitCoverage=99%, E-value=1e-83, Identity=46%"; Hit description =Putative uncharacterized protein
  Pfam annotation: Domain name=V_ATPase_I; Domain location=1-473; Score= -189.9; E_value=1.7e-07; Accession=PF01496.10; Description=V-type ATPase 116kDa subunit family
MARRLRLFKEQMTKAGVSPSMWSTRDDHFDLEHLEVKLEELEAELLEINANNEKLQHTYNELLEYKLVLEKVGELFSSAKNKAVAHQKELEFQTTVEGSIDSPLLLEQEETTTKQIKLGFIGGLVHREKSIPFERIIFRAARGNLFLKQGVIEHPVLDPLSGEMNEFFSVPFELFGPSAYGCRDPSCRDASTTGFIKVRSTYPFGVDPKCHGTRSELPFLNSLKMKMSILLGADLYHLMIYTFLSPTDDLGENQLFVGQKLLQLVLLLLAVVAVPWMLLPKPFLLKKQHQERHQGQSYDLLCGTDDTLESESQSIAHDHDEFDFSEEYNLGFLINLQLVDGKNLGHARCTQQHCWCTQQLEKPSSGEVTGRSSSEPSSGNFSEEGSSGKRFFRLAHSELSSVFYDKVLLLAWGYNNTIVLIIGIFVFICATVGVLLLMESPSAFLHALRLHWVEYQNKFYEGDGYKFFPFSFTLLTDEDEL

SEQ ID NO: 168984 - protein, 378 aa, Glycine max
  Coding DNA Sequence Number=SeqID_77299
  Gene Ontology: Cellular component=integral to membrane
  Homolog annotation: Hit_ID=A7NT25; Match level="QueryCoverage=87%, HitCoverage=88%, E-value=4e-71, Identity=48%"; Hit description =Chromosome chr18 scaffold_1, whole genome shotgun sequence
  Pfam annotation: Domain name=C4dic_mal_tran; Domain location=45-295; Score=182.7; E_value=9.7e-52; Accession=PF03595.8; Description=C4 -dicarboxylate transportermalic acid transport protein
MATQASRSEIEVVVDTTTSNDNNNEEPTSLSLTSSLNSILTKFHAGYFRISLSLGGQALLWKTLIESSSSPTHDTSAALRRVLCTLPSAAAILALWSLALFALVLLSLLYLLRCLFYFKMVKAEFLHPVGVNYLFAPWISWLLLLQSAPFVAPTTATYLVLWWVFAVPVVVLDVKIYGQWFTKGKRFLSTVANPTSQMSVIGNLVGAQAAANMGWKESAVCLFSLGMVHYLVLFVTLYQRLSGGDRLPVLLRPVFFLFFAAPSVASLAWESIVGTFDTASKMLFFLSLFLFTSLANPVQEIYEKVQCCLVGLFLSYYSTCSGFSGLCTGSQRNIFAHPNALSVSPFSSCLPCSNVVLLLNSKMLLPDNDPIIASLLIS

SEQ ID NO: 168985 - protein, 833 aa, Glycine max
  Coding DNA Sequence Number=SeqID_77300
  Gene Ontology: Mol. function=protein binding; Cellular component =nucleoplasm; Biological process=protein modification process
  Homolog annotation: Hit_ID=A5AN29; Match level="QueryCoverage=97%, HitCoverage=87%, E-value=1e-87, Identity=32%"; Hit description =Putative uncharacterized protein
  Pfam annotation: Domain name=FHA; Domain location=741-814; Score =36.6; E_value=8.7e-08; Accession=PF00498.17; Description=FHA domain
MGALTSFASWIPEDDLLLKNAVEAGASLESLAKGAVQFSRKYSLKEIQDRWYSLLYDPVISAEAAAGMTNFELSASPLPSKFYRFGHLKERKVVSATRKSESVRNLYYARCKRIRNSMLTSMDLSFLVDSENGNYAVHGSDPLSGNCMPEGGTSNHFSSLDPAQYAFPENLMDDNVASDRVAAGVFCHGVDNAVEENFPVELKSVLKEEPQIFEDNVPLDGVVEDLDVPNELAIDGWIGDDGLERMPLSTLDHINNDPGNMCPEFDENNVFDSELECGTSFNLSSLHEMPVWRTDESIQEHNLPCDGFNDPIACGDAYLEELSNSLLHFSSEEEQILMDVDGDEGIDKSYFDGLTSLLQNSTNDINSDQISKKDETESLMASQAHVINQSVSCHKELDDNSGSSSRGLQVVHKLEFQMSSSVSTTDPQFPELINESMPCSINTEHQEIPENDDVFLPFDVPPVIFPPSSKLIFKVSNKPISSSVIKHRASERGKTLMHVEKKNPAAPYVSFQMMESPCFPGPVGGSKVKCELPANHAAHTVSRSSVIVSGGLGGNDAANTTDALLHANKKEEATSICLAKDPSNHVANSFMKKSAADSKDFRNHPQPNGSSMKNEQDLPLPLQDHQLQRAELGSSDVLESELVANPPALDEEEQYIESDDELPSYSDVEAMVLDMDLDPHDHQDSYYNEEVSRYQHVESKRAIMRLEQGSHSCIQRAIDSHGAFAILYSRHSKHYIKKPEVLLGRATESVPVDIDLGKGGHGNAISRRQAIIKMAKDGTFYIKNFGKSSILVNSKEVHTGQSQRLHSNCLVEEMFVSLSLPDKNKGSADACNL

SEQ ID NO: 168986 - protein, 309 aa, Glycine max
  Coding DNA Sequence Number=SeqID_77301
  Homolog annotation: Hit_ID=A7QE27; Match level="QueryCoverage=21%, HitCoverage=9%, E-value=5e-14, Identity=60%"; Hit description =Chromosome chr4 scaffold_83, whole genome shotgun sequence
MNDTTPTADSPSCGHGQKTRSQDDVCEIMESSARFEQPFGGGDPYRLRQENDSSLCTIQGRAMMLATMKQWSLWLLFSVMNSVSKEGAKEEESVGSETSWDKWKRGGIIGVAAVTGRTIMVITGGLTAPAIAHGLGALAPTLGGIVPAIGGGFAAAATATGSAGGSVVVAASFGDNSKILVKPGNIARKGERMPINLSKSKPAGVEAIGENRGGEIIAGSVAEKDVVRTGERHARKKGVRPETSLGSRQNTAGGWPKNDVEFVAKSVVTEKVTGKGAASRRVHWNAENKGKKFVGKGAANMNIKFHQEQ

SEQ ID NO: 168987 - protein, 119 aa, Glycine max
  Coding DNA Sequence Number=SeqID_77302
MFLNLREAKKEEHSRKKKEVREATCEVQKTIASFKPLPPSVSVRLTAVAASPASSPSYPTEKKILHSQKFRDRPSPQRARDIPIVPLLKFHDFLSSSSWVCCSLISWLVTAISSTSCSP

SEQ ID NO: 168988 - protein, 162 aa, Glycine max
  Coding DNA Sequence Number=SeqID_77303
  Gene Ontology: Mol. function=metal ion binding; Cellular component =cell junction; Biological process=muscle contraction
  Homolog annotation: Hit_ID=Q59HI2; Match level="QueryCoverage=93%, HitCoverage=96%, E-value=7e-71, Identity=69%"; Hit description =Transcription factor lim1
  Pfam annotation: Domain name=LIM; Domain location=75-131; Score=80.7; E_value=4.7e-21; Accession=PF00412.13; Description=LIM domain
MAIISVPLCLLLSNYNSFEGVLYCRPHFDQLFKRTGSLDKSFEGTPKIAKPEKTGEEKPAATKVSSMFGGTRDKCAGCQKTVYPTEKVTVNGTPYHKSCFKCTHGGCVISPSNYIAHEGKLYCKHHHIQLIKEKGNLSQLEGDHEKSTEEEKINGEVVAAET

SEQ ID NO: 168989 - protein, 1068 aa, Glycine max
  Coding DNA Sequence Number=SeqID_77304
  Gene Ontology: Mol. function=nucleic acid binding; Cellular component= proteinaceous extracellular matrix; Biological process=multicellular organismal development
  Homolog annotation: Hit_ID=A7NSY9; Match level="QueryCoverage=38%, HitCoverage=98%, E-value=1e-120, Identity=59%"; Hit description =Chromosome chr18 scaffold_1, whole genome shotgun sequence
GNENLMTKSNVNYTSIEKLLSNNRFASQLLESTPKNKPIHFKCDPSKSDSAWKWLERWMSVSSKDIAECKEISSLIEQSRESKDSTPMFQFEMGIPSEPFPQAVDSKLTVEDSLLPSEDEEKLITCDADDFEFQASYSTSSIVKDDLVQVPPEEKIAYDAKVASDDADSFQNEKSASDASAPSELNSIHKGPEIAPPSELNSVHKGPEIAPPSEHNSLQKGTDIAPPSEHNSLQKGTDIAPPSEHNSLQKGTDIAPPSEHNSLQKGTDIAPPLEHNSLHKGPETAPPSELNSFNQKPEIDGEQGKQSMKRFASDQLEAEGKKPVNGSRKVSNPAFIAAQSKFEELSSIENSGRTSSLSYQDSAVESQGDTSSVGNDTAYRSKEFAFENPAAYLSRFAGSECGTELSISSTLDSPDISEPGAMENERDAKDLMEGIGNLENTINHDDEANDNVSRVIPASNLATSVLDKSEIVDDISANLGHSVVAVDSEEPAIKTEKNAPDLQRELPESVLQDLRSSPEASPRSHLTVPESQGTPSSEVSVKPKDSTINKTRSGNKRRSLSLSNKSPTNPNHDSGSKDSREQLPKDQQNGKRRNSFGSVKPDNIDQESRDNSTNNNSLPHFMQATESARAKVNANNSPRSSPDVHEGDIEVKKRHSLPGATGRQVSPRIQRSTSKAQQSAKGNNVHPPQEESPSQVGLNSQDNLQAKTSLSLRPGGAGSDDILPPGFEGTHASSQFEIKPSQIPVIKWITPQKIVLNVTWRVVSGEESKEAEDQCQREMRVLEAIYPRISSIPLNPSVSMDVEEFHCIDGQTTLIPITPVEDEDAAAETLSYSLEPFHVSQSLQLASGVLKDSNSATSMQLACGLASDVAVAASVALTNLVKSNEHGNFVDHELLNNILNNPEVIEKLVGDYGAINNSQYVHNAGSSLAAFSNPPIPIQGQTTTPSSVVFSTTSSYTPPIGGQAEPVTTQWPPRPAVSSAIVSSPIEVPPARDVNYYKSLIQQHGGHKETLPYSSKRQIPQAATNYETTSYNHRVLEDVGMELTVPTSMMHHFSHGVILCQGYKVQRG

SEQ ID NO: 168990 - protein, 115 aa, Glycine max
  Coding DNA Sequence Number=SeqID_77305
MTVLLLLMNGYLARRVVPERGNDASMHSSLSLCILEGELLQTSLVVPGECLQCSVCEIGLEIRAALRNVAKSIFFGDFSENGLMLEERAITFPPSPLNKFTEHGSPLHWDISPAM

SEQ ID NO: 168991 - protein, 73 aa, Glycine max
  Coding DNA Sequence Number=SeqID_77306
  Homolog annotation: Hit_ID=A6FJQ2; Match level="QueryCoverage=52%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLAEKHRAHLVEAYAING

SEQ ID NO: 168992 - protein, 544 aa, Glycine max
  Coding DNA Sequence Number=SeqID_77307
  Gene Ontology: Mol. function=hydrolase activity, hydrolyzing O -glycosyl compounds; Cellular component=extracellular region; Biological process=cell wall organization and biogenesis
  Homolog annotation: Hit_ID=A7NSX3; Match level="QueryCoverage=96%, HitCoverage=96%, E-value=0.0, Identity=69%"; Hit description =Chromosome chr18 scaffold_1, whole genome shotgun sequence
  Pfam annotation: Domain name=Glyco_hydro_9; Domain location=57-531; Score=650.7; E_value=1.2e-192; Accession=PF00759.10; Description =Glycosyl hydrolase family 9
MGEKSRSKGGCCGWFIAFIILALVVGAIVFTVKKKFSHSGSDKPAPVPGPPGAVDQKYSTALKTAMQFFDIQKSGKLVDNKISWRGNSALKDGSQAKLDLTKGMYDAGDNMKFGFPMAFTATVLSWSILEYGDQMDHVGQLDAAQDSLKWITDYLINAHPSENVLYIQVGDPVADHKCWEKPEAITEERPLIQVNASCPGSDVAAETAAAMASASLVFKKTDPTYSSTLLKHAKQLFTFADKNRGSYSENIPEVQTYYNSTGYGDELLWAASWLYHATGDDSYLQFVTGQDGEDYAQWGSPTWFSWDNKLAGTQAKDISNSYSSGLHSYRKTAEAVMCGLLPDSPTATKSRTDALISSTCFSDASTLKSILLNDIRQEDGLIWVSQWNSLQHPVASAFLAAVYSDYMLTSQTPKLKCGSDSFTPSDLRDFAKSQADYVLGKNPMHMSFLVGYGDKYPQFVHHRGASIPADAKTGCKDGFQWLESSDPNPNVATGALVGGPFLNETFIDSRNNSMQTEPSTYNSAVIVGLLSSLVTTSSAVQSFT

SEQ ID NO: 168993 - protein, 266 aa, Glycine max
  Coding DNA Sequence Number=SeqID_77308
  Homolog annotation: Hit_ID=A5ANS1; Match level="QueryCoverage=93%, HitCoverage=91%, E-value=1e-19, Identity=32%"; Hit description =Putative uncharacterized protein
MMKQGSGSCTMRENEVAEILVNLPSLIWEFECGCGILQPSWGCKRKRSAIGVDPKARQASSPATPLSFSPSESDENPSTLIRTRTRNVSLKRKREHYVKILQDLTKHNDLIRGEIKNVKRHNEKLKEYNLKLKARKQERSHGPSQGGLVHKQPQQQFQFSGMAHHPPLILNQTAGPAQIRGGEGVVGPAHATTSLGSNDVGPIGIPDLNLPLDESMTMTMEFCDINVSLANKDLSRTMAAQARQNMLQKYRFKNPIGISKPRYSCR

SEQ ID NO: 168994 - protein, 153 aa, Glycine max
  Coding DNA Sequence Number=SeqID_77309
MTRDNPDDLQPFDPERDRTFHRLVWHSVHPDHSVHFKHFEYSIAGDSEYSDFEHSTTNFHTENMVQPPPRERTLREMAAPDFTYESLCNQYHHEGVPYVLKNGLIHFLPKFHGLAAPDVQEDHIFLKGFSSFFGGSGKRLAVLPCSQIHLQLG

SEQ ID NO: 168995 - protein, 158 aa, Glycine max
  Coding DNA Sequence Number=SeqID_77310
  Subcellular localization annotation: CTP_CleavageSite=13; ConfidenceScore=5.02e-01
KWFFRKNSGRTTSSGNLKGHPEEPFFRKNTSSGILSEELLLPESFRKRCSGRLPEEVFFRKTFGCFRKNTSSGMFPEVSEELLTGLPKASTVSPLSPFFSASSTLVFYPKQWGVRETNLEGSFAEKKKKLGSRCHGGVAGIGRRKEAGNGLPGRGARF

SEQ ID NO: 168996 - protein, 34 aa, Glycine max
  Coding DNA Sequence Number=SeqID_77311
MKSSIGRSVPDAYLYWEMKIQHAFSYNDYPEEQK

SEQ ID NO: 168997 - protein, 82 aa, Glycine max
  Coding DNA Sequence Number=SeqID_77312
MMITKDDDKGDDKKLKEEIKSKFKTQEEKLKNTSRFKKKDEFKNQDSRIKLQESRSRFKIQDSRFKTRLNQDKYEKHFSKSE

SEQ ID NO: 168998 - protein, 142 aa, Glycine max
  Coding DNA Sequence Number=SeqID_77313
MASMMDAMLGMRQLMENNATTAAAVSSAAEADPTLPATAHHPIPNVSYVTTRVMSLPPSLKGNLLGSRTRSTRIVENMLRETSIPTPRSPPRDQHPTRYRRPTSRQNLETARHSQSFCPQGATPGSRRKGETRSHRRVIEGH

SEQ ID NO: 168999 - protein, 93 aa, Glycine max
  Coding DNA Sequence Number=SeqID_77314
MASEISLNHMHTYLCRDNTDQLILPQEEIGIAVAGQNVAKEQHHPYLLARVKSCPSMHSSSTAASSSGCARTVGHPPTSGGGPGTDKRKLLAP

SEQ ID NO: 169000 - protein, 178 aa, Glycine max
  Coding DNA Sequence Number=SeqID_77315
MWAIIDQYKEKLSLAATYEQRLEDEYTKAVNTITKHALRNPYQTCSKTRVMGDIEEVQEQMKADMEALKDQVASVMEAMLSMKRMMESNPTAVAVASTAAEADPTHPSAINQANQPIPDVVGQGGEVLGNTSGPHMGYNRNAYPYGLPPNYTPPTMHMPNDNVNHAIPLPLRVNNPSL

SEQ ID NO: 169001 - protein, 275 aa, Glycine max
  Coding DNA Sequence Number=SeqID_77316
MEGRVNLGLKSENGRDMSEKLGGIDGNPVLRGTRIRGYVGSTCTIVRSPPSTTYDREVPGDMSQGSGDLGDASSWQSTDKRTKTTKQGGLCGGWPAMDLELKNEDRKLRWSLVIDYQGLRNGDSMLRRPLIAMTAQLIHDRVEMECLEGVWETLEGNARCRFRGTIQLTATSLVHPEEPARTLQRTVEWILPTPTPYRLVEPVQVIEVPSSKEDLEEDPEELPPEPAVDAIDFPEGDEDPLPDVDSLEDVMSASEADSTEESGPGGIVTSGDSLS

SEQ ID NO: 169002 - protein, 39 aa, Glycine max
  Coding DNA Sequence Number=SeqID_77317
MGPMTRSRTKQSVDTLQQMVAGILSKAQVEKHEGPSGEG

SEQ ID NO: 169003 - protein, 189 aa, Glycine max
  Coding DNA Sequence Number=SeqID_77318
MLVQQGMAKRGKAKPRYLNDLNPCGEYALGVVALAYLYNQLSYANFYDNKLIGGYMTLLMAWVFEHLQTIPYCEKPKTSDHKKSLAARWKPLRGSGTTNLTRAIRTLEDKTYYFGYIKVGIDMCPYLPKRVLSQFGYYKGFLFCHSPSYMRIIMAHEGLCSLFGKPNRNVYRVTQCSYAEKLPKPRSLE

SEQ ID NO: 169004 - protein, 68 aa, Glycine max
  Coding DNA Sequence Number=SeqID_77319
MEASRKLIHTHPPPAIPRSPQAPALWYTPNDEDGGHDAFRPTCRGHSPGLLFVCIRKLLALLLECFGP

SEQ ID NO: 169005 - protein, 329 aa, Glycine max
  Coding DNA Sequence Number=SeqID_77320
MRIDPQEFAARLCIPGRGFVLNAEGRPWKLLRKDLTTLSQTWSVLTYSNLTLTSYTSDLNMDRARLVYHLVIGMDMNIEAIISGQISNIAQSNSSRLGFLALISALCRARGVTSNSLNPTINLAYIKKNCWNVDDLIVNFRGARKSLQVVAPLGSILSVEQFIEKVSWPGTVSSSMRESEGPSAQATIPRAFDFSGAGVEMRPDEAVFLEPIVLVIHEIVEAGESQLRQEAATLERTPQTPEDPPAPGMELSFAQQVADPPTPVHKRLVDPSTPILEIPEDPTAPALTLNTTPPATPELQFSDEDGGRITTPPGTPVLHFDNEEQDRDK

SEQ ID NO: 169006 - protein, 76 aa, Glycine max
  Coding DNA Sequence Number=SeqID_77321
  Homolog annotation: Hit_ID=A5AZ88; Match level="QueryCoverage=90%, HitCoverage=6%, E-value=6e-08, Identity=34%"; Hit description =Putative uncharacterized protein
MVFPADFVVMDVDEDHEVRIILGCPFMLTASYVVDMGRKKLEMGFEDQRINFDLFEENKSVPDQNVCLQVMEGDKE

SEQ ID NO: 169007 - protein, 94 aa, Glycine max
  Coding DNA Sequence Number=SeqID_77322
MTGPLNESVSCFLIRVDPWVLEPIAFKGVHVLAFRGLHALAFRGLHVLSFRGLHILAIRGLHALTFRGLHVFTFGGLYVLALRGLHTLTFRGLH

SEQ ID NO: 169008 - protein, 58 aa, Glycine max
  Coding DNA Sequence Number=SeqID_77323
MDTSEPYTRAMRDTVHEPQANLEANQNFSPGVEPNPKDTSNALKVLTQCNPQTPFEPF

SEQ ID NO: 169009 - protein, 90 aa, Glycine max
  Coding DNA Sequence Number=SeqID_77324
MTARGAEAKTITLTFLVLLILQHNFGSMAASRKNIHIHPPHAIPRSPQPPSVHWYTPNDDENDGGGGDAFRPTSPGHSPGVGHQTPPSKA

SEQ ID NO: 169010 - protein, 100 aa, Glycine max
  Coding DNA Sequence Number=SeqID_77325
MKTLSKTKYLEGLKKMNGEERISQEASTKQKGFKRHEIIVTVPRNQMSPPFKEEAYSLARGLDKPHRPVDVTSPFDVTTPDIGQTLVHAWGLNKLVTLTG

SEQ ID NO: 169011 - protein, 95 aa, Glycine max
  Coding DNA Sequence Number=SeqID_77326
MKNTIVVNRKITTSYAPNNILRVNSCPQRDRAGDKLDLVPFEIYVLDQKSHLPSLVTLYNSHFSSSMLSPSFAAVGAPPYITIIAMGCHWRMKMK

SEQ ID NO: 169012 - protein, 47 aa, Glycine max
  Coding DNA Sequence Number=SeqID_77327
MRKERKNAQCTTLVRERMQRTEALSELERRLVSQSGSLSGTSHLAQV

SEQ ID NO: 169013 - protein, 123 aa, Glycine max
  Coding DNA Sequence Number=SeqID_77328
  Homolog annotation: Hit_ID=Q9M571; Match level="QueryCoverage=33%, HitCoverage=8%, E-value=4e-08, Identity=65%"; Hit description =Phosphoethanolamine N-methyltransferase
MDWGKSSERRKSQEWGQRDRGREDAEDAGFNDAIAEDRTDQFVNTLQPELEALENKKDDFIGDFSKMGLLHSDYDFILTYVLIRQVSEVLILICSLSQSAALASHPLSAPLLRLSARKNLEEG

SEQ ID NO: 169014 - protein, 153 aa, Glycine max
  Coding DNA Sequence Number=SeqID_77329
MTRGNPSDLQPFDPEIDRTFHRLVRHSVHPGHSVHCEHFEHSLEGDSEYFDFEHSTTNFYTENMAQPPPRGRTLREMAAPDFTYESLCIQYPDKGVPYVLKTGLIHLLPKFHGLAAAGCPRISYLSKGFSSFSGGSGKRLAILPCPQVYFQLG

SEQ ID NO: 169015 - protein, 165 aa, Glycine max
  Coding DNA Sequence Number=SeqID_77330
  Gene Ontology: Mol. function=hydrolase activity, hydrolyzing O -glycosyl compounds; Biological process=carbohydrate metabolic process
  Homolog annotation: Hit_ID=UPI0000196E3D; Match level="QueryCoverage =59%, HitCoverage=16%, E-value=2e-24, Identity=47%"; Hit description =glycosyl hydrolase family protein 27 / alpha-galactosidase family protein / melibiase family protein
MDFLLWFLGVKLDCVFGEDLDLDEIIFLLEFFNGLEHPIVFSLLPGVSATPLMANSISSLVNTYRVTGDDWDEWSAILAHFNVARGKGLKGKSWPDLDMLPFGWLTDPAPCGACRPWIFFINGVLYFLKIMEAEWRRKKDDWRSYFKEKMSQEEAHHHRKPWIRD

SEQ ID NO: 169016 - protein, 167 aa, Glycine max
  Coding DNA Sequence Number=SeqID_77331
MSYLLWRKANEYDELPSSQERFKRCGRTRVGPDGRTSPRRIRIRTKKRYDLWNECAQAHKDHKDLKISKHGLWIKCENQKKYAKFLNDKLLKNKDLKGQPQDVENLNEEIDTLKTTIVKFVRGTECLDKLLRYSKCHMDKFGHRFEGKYMFMMRILLFVISMAKSGI

SEQ ID NO: 169017 - protein, 47 aa, Glycine max
  Coding DNA Sequence Number=SeqID_77332
MDKSLKVGKDEWREKDKRSTKFCVSKEGVGLHHILRMRALGGGGYLT

SEQ ID NO: 169018 - protein, 78 aa, Glycine max
  Coding DNA Sequence Number=SeqID_77333
MSQNFTDYATIPSLASRMLWNFTDCAIMFPFDSRHVAELHGLLNDGCQVPRSGQAKVACHQTNGYHLLLVIRVAVEAL

SEQ ID NO: 169019 - protein, 50 aa, Glycine max
  Coding DNA Sequence Number=SeqID_77334
DWNTSSKVSQKVCVRFCARKKRTTYISMKFSRFKKLGLGFDMLMKDRDTG

SEQ ID NO: 169020 - protein, 69 aa, Glycine max
  Coding DNA Sequence Number=SeqID_77335
MASYGVASPFIFLLLHSAAIRPQEAKESIDEEDPRPTSSTWSYIMWYEEPLHLGDVLLLPLSFCSVNSL

SEQ ID NO: 169021 - protein, 321 aa, Glycine max
  Coding DNA Sequence Number=SeqID_77336
  Homolog annotation: Hit_ID=Q6WAY6; Match level="QueryCoverage=99%, HitCoverage=64%, E-value=7e-20, Identity=25%"; Hit description =Putative uncharacterized protein
MARIAKVVKISAEELDRAKQNRNGVVGIPRKHLEEKAKALADEGEWASFIDVSALLVFGVVLFPNVDGLVDLATIDAFLAYHHSKESPVVPVLANAYDTFDRRCEKSGARIVCYTPALYGFSNVPLMGTRGSINYNPVLAIRELGYPMRGAPSEEIITHFIARGFSDPNARILQGVHKAWGTMQIKDKELRGSNNGIVGGYHKWLKAWTQELDWVPKLKTSNEEEAETPEESEEVQALKVKLERAQAVKEKFKTMTIKRDQPSVEGMILEIKLKAYQRSKRSLSEQLSKTEENMWAIIDQYKEKLSLAATYEQRIEGEYAK

SEQ ID NO: 169022 - protein, 94 aa, Glycine max
  Coding DNA Sequence Number=SeqID_77337
MSVFVCYQAFRLTDSKKNVYTDNHSGISVRQRDSNVSMTDHVSAEDDVNLRVSTGLSAAIDEGYRRRHLVCAEDDVNLRVSTGLSAAIDQGCRR

SEQ ID NO: 169023 - protein, 85 aa, Glycine max
  Coding DNA Sequence Number=SeqID_77338
FNEIVIPDSLTVGSSSNFVWISLRYVFGLPLSEKGVLSVIPTEGNCSERPKAALSPIPIERKCAERPEGALSLNPCAKCKKWASA

SEQ ID NO: 169024 - protein, 86 aa, Glycine max
  Coding DNA Sequence Number=SeqID_77339
  Gene Ontology: Mol. function=RNA-directed DNA polymerase activity
  Homolog annotation: Hit_ID=Q2HSQ4; Match level="QueryCoverage=68%, HitCoverage=56%, E-value=8e-13, Identity=64%"; Hit description=RNA -directed DNA polymerase ; Zinc finger, CCHC-type; Peptidase aspartic, catalytic, putative
MEKMRGMKRMGQDGGMRGIGREEVIEDMEVGKERKGLMEDQIEKSQEATMSRFLHGLNREIQDIVESHQYASLEDLIHQAIKVEQQ

SEQ ID NO: 169025 - protein, 75 aa, Glycine max
  Coding DNA Sequence Number=SeqID_77340
MKKQQWRRRIASSPPPWKTKKTMIMRGQDIYSSQDEATTSPFSSESEEAKGEESSEEIYPQEEGQPLMVKEECKE

SEQ ID NO: 169026 - protein, 183 aa, Glycine max
  Coding DNA Sequence Number=SeqID_77341
  Gene Ontology: Mol. function=nucleic acid binding; Biological process= DNA integration
  Homolog annotation: Hit_ID=Q2R3E8; Match level="QueryCoverage=28%, HitCoverage=6%, E-value=2e-09, Identity=55%"; Hit description =Retrotransposon protein, putative, Ty3-gypsy subclass
DPHGLPPSRGIEHQVDLLPGASLPNKPTYNNKPQETQHKDAQVKVEYVKRLYDEVGNDENPEIGQIQAKGPSGEGRRPKWRRIKPPSNPCGVYPDLSSFTGSGIIQTSIACIKRSAPTQVHIKSLPRQITSSSQCQEGIASSQSKKDLDLWQEGLDDENDQGGWEMEAYSLSLSKALFKLLNN

SEQ ID NO: 169027 - protein, 60 aa, Glycine max
  Coding DNA Sequence Number=SeqID_77342
MWRSIDIVRERLTFMALPYMDAAIAFHGEPVITRSQDLPSHSMPIGVRSKRTLVDFLDHV

SEQ ID NO: 169028 - protein, 440 aa, Glycine max
  Coding DNA Sequence Number=SeqID_77343
  Gene Ontology: Mol. function=N-acetyltransferase activity; Cellular component=integral to membrane; Biological process=metabolic process
  Homolog annotation: Hit_ID=Q1ICE2; Match level="QueryCoverage=26%, HitCoverage=84%, E-value=3e-34, Identity=60%"; Hit description =Putative acetyltransferase, GNAT family
  Pfam annotation: Domain name=Acetyltransf_1; Domain location=342-418; Score=62.6; E_value=1.4e-15; Accession=PF00583.15; Description =Acetyltransferase (GNAT) family
HHLLTIFRVPVRDVIGGLALILYKYSSGIFSNTTLIRLIIIHKDRDMKITHSGYKTGAATLLAVMLALALTGCAKSTVPSQTVPANKGVDDLFANLGEPKTPVPGKEKEQYFAQLLAVIQSHLKDAEAYSGRSCTLRIKLAPDGLLISVRAEQGEPQLCQAAIKAIVNARLPKPPTAAVYEAVNNGTLHGICCQYLPIHHCAHALASIFKTVAAHRDHVIAVVVFLRVLAHQLFGKQAAEGDGGDEGQPFHFVGADLLRSADIRRREHGFVELAARQQQGKQQGGGDLRGSAVIHTNEGLNMLVRLAAETDAAALIALDSVAQNAPQRAAQIRAWCAQGICFLAEEQGMVMGYGVLHYHFFGCGFIEMLMVGERYRRRGVGQALIAALKSHCRQPKLFTSTNRSNLPMQRLLLNAGFVASGRIDNLDDGDPEQVFFIPAR

SEQ ID NO: 169029 - protein, 151 aa, Glycine max
  Coding DNA Sequence Number=SeqID_77344
MAPRKLASKRSRKDKVAEGTSSALEYDSHRFRSAEHQQRFEAIKGWSFLRERRVQLRDDEYTDFQEEIVRRWWASLWIPFDADALSQFLGYPLVLEEGQECEYGQRRNRSDRFDEEAITQLLCIPGQDFARTVAGRRVRIMRTNMTTLTQI

SEQ ID NO: 169030 - protein, 115 aa, Glycine max
  Coding DNA Sequence Number=SeqID_77345
  Homolog annotation: Hit_ID=A6FJQ2; Match level="QueryCoverage=33%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARVFPVTTLDKYSLVSTTETGAWITPLPAGDEDREKNSNNEDQEWKPGISWGVGSKEYSPLPYSRPT

SEQ ID NO: 169031 - protein, 124 aa, Glycine max
  Coding DNA Sequence Number=SeqID_77346
MWVLWLRHGCLPPFSFPYLFQSSYCRHLLKWCNRICPFLGLLRFFRLQILDPQNLRACIPPSSHSRTRRASAKCNTQWLSTRKNPEEDELYRFVECTSPGHQAHCFSSSAKREKCAKPKFTDVR

SEQ ID NO: 169032 - protein, 53 aa, Glycine max
  Coding DNA Sequence Number=SeqID_77347
MSNEELKLQDPRCRIQCPDILPENTEVAVQCKIKIKVKCRSEAAGSTMSDTMS

SEQ ID NO: 169033 - protein, 42 aa, Glycine max
  Coding DNA Sequence Number=SeqID_77348
MDMSLKVEEDEWRKRERRSTKFCASNEPTNPRSSPRFSTKCA

SEQ ID NO: 169034 - protein, 165 aa, Glycine max
  Coding DNA Sequence Number=SeqID_77349
  Homolog annotation: Hit_ID=Q2HW90; Match level="QueryCoverage=92%, HitCoverage=30%, E-value=8e-07, Identity=25%"; Hit description =Putative uncharacterized protein
MVEEFEEILGCPLGGRKPYLFSGFYPSLARISKKVQISAQELDRQRQVENGVVGIPRKYLEVKARILADKGEWTPFIDILTLLIFEGVLFPNVDGLVDLAAIDVLLAYHNHKESPVVAMLADLYDTFDRRCEESNARIVCCTPALYVGLVSHLFLQEGRPVYPLQ

SEQ ID NO: 169035 - protein, 122 aa, Glycine max
  Coding DNA Sequence Number=SeqID_77350
GDAPQAADAPPPPHQAAPAGSLGMKWYLQHLVRQQAANHRGQVQIHECLYQLSLSQQGQGFAPFACPTPDQFRAEVTWPGDWPEAQAGEASAGAPDDAEEARMDEEMTDLLGFLGGSGATWP

SEQ ID NO: 169036 - protein, 35 aa, Glycine max
  Coding DNA Sequence Number=SeqID_77351
MSLNSTDFLTMGVKYLEAVKQRLHATKQWSPDEIR

SEQ ID NO: 169037 - protein, 109 aa, Glycine max
  Coding DNA Sequence Number=SeqID_77352
SGAVFHDCLREDPQGNPPFSSFSGATWMFLLRAVHVSSTLEFGAAFNDCLSADPQGNPPYSTFVRSTMNIGSFAKYKEKEEVEMRVVITKRAGRTKSVSYLCFPLIFDE

SEQ ID NO: 169038 - protein, 45 aa, Glycine max
  Coding DNA Sequence Number=SeqID_77353
MEFGVFLEEASACTRIRPRLEAFACLGSSRERKRCEFEAKAILRT

SEQ ID NO: 169039 - protein, 159 aa, Glycine max
  Coding DNA Sequence Number=SeqID_77354
  Homolog annotation: Hit_ID=A9PIX1; Match level="QueryCoverage=49%, HitCoverage=90%, E-value=4e-19, Identity=65%"; Hit description =Putative uncharacterized protein
MSSAQKAWIVATSVGVVEALKDQGICRWNYALRSAQKQVKSHVGSLSQAKKLPSSAMVSTSCGLKGQKQSEESLRTVILVQTQFSSNKRDKEFFSRPRAKRILLGLAIMTVITEYDDDHALSARCASTSLGFFVDLPLSLSGSLSQTSAKSVFPPPLFV

SEQ ID NO: 169040 - protein, 484 aa, Glycine max
  Coding DNA Sequence Number=SeqID_77355
  Gene Ontology: Mol. function=diacylglycerol kinase activity; Cellular component=cytoplasm; Biological process=activation of protein kinase C
  Homolog annotation: Hit_ID=A7Q396; Match level="QueryCoverage=98%, HitCoverage=98%, E-value=0.0, Identity=72%"; Hit description =Chromosome chr12 scaffold_47, whole genome shotgun sequence
  Pfam annotation: Domain name=DAGK_acc; Domain location=231-403; Score= 61.7; E_value=2.5e-15; Accession=PF00609.10; Description =Diacylglycerol kinase accessory domain
  Pfam annotation: Domain name=DAGK_cat; Domain location=36-179; Score =104.3; E_value=3.7e-28; Accession=PF00781.15; Description =Diacylglycerol kinase catalytic domain (pres
  Pfam module annotation: Pfam domain module=DAGK_acc::DAGK_cat; Domain location=231-403::36-179
MASHQFLDNFIIPDHILVPGSSDSDVENVGDVPHCPVLVFVNSKSGGQLGGHLLKTYRDLLNPKQVFDLGEHAPDKVLRTVYANLEGLNVRGYQFADKIKERLKLIVAGGDGTAGWLLGVVCDLKLSHPPPIATVPLGTGNNLPFAFGWGKKNPATDQRSIEAFLDQVMKATKMKIDNWHILMRMRAPKEGPCDPIPPLELPHSLHAFHRVSESDEFNMEGCHTFRGGFWNYFSMGMDAQVSYAFHSERKKNPEKFKNQLINQTTYAKLGCSQGWFFASMSHPADRNIAQLAKVKFMKRHGEWQDLDIPPSIRSIVCLNLPSFSGGFNPWGTPNRRKQSDRDLTPPFVDDGLLEIVGFRNAWHGLVLLAPKGHGTRLAQAHRIQFEFRKGAADHTFMRIDGEPWKQPLPVDDDTVMVEISHHGQVNMLSTHNCKSKSVYDPSSPHHEDEEDDSDEEDSVAEEFRKFGAADTFRIPDEVDVSHLS

SEQ ID NO: 169041 - protein, 109 aa, Glycine max
  Coding DNA Sequence Number=SeqID_77356
MVMTMLVVVLHWCGLDFDRGRCCCNCDTNAVERQRYYEIFTFVKWMQLKLVITIQLVLKMSKSQQFSTSICWNPPRNSQYKLYCDGSVKLNSSQAVADDGVFRDHKGSV

SEQ ID NO: 169042 - protein, 291 aa, Glycine max
  Coding DNA Sequence Number=SeqID_77357
  Gene Ontology: Mol. function=protein binding; Cellular component =integral to membrane; Biological process=G-protein coupled receptor protein signaling pathway
  Homolog annotation: Hit_ID=A7Q395; Match level="QueryCoverage=86%, HitCoverage=85%, E-value=1e-104, Identity=76%"; Hit description =Chromosome chr12 scaffold_47, whole genome shotgun sequence
  Subcellular localization annotation: CTP_CleavageSite=57; ConfidenceScore=5.92e-01
MATVTSSFSFSTLTQSSSPRNLSTLSSNSPTFRIRVGFSCHYVGVRASNSASKIVVRCSSAVAEPPTVSETKLNFLKAYKRPIPSIYNTVLQELIVQQHLMRYKRSYRYDAVFALGFVTVYEQLMEGYPSDEDRDAIFQAYIQALKEDPEQYRVDAKKLEEWARAQNPTSLVDFSSREGEVEGILKDIAERAGGKGDFSYSRFFAIGLFRLLELANAMEPTILEKLCAVLNVDKRSVDRDLDVYRNLLSKLVQAKELLKEYVDREKKKREERAEPQKSNEAITQQQQFSSL

SEQ ID NO: 169043 - protein, 490 aa, Glycine max
  Coding DNA Sequence Number=SeqID_77358
  Gene Ontology: Mol. function=nucleoside transmembrane transporter activity; Cellular component=membrane; Biological process=transport
  Homolog annotation: Hit_ID=A5AZ51; Match level="QueryCoverage=74%, HitCoverage=90%, E-value=1e-150, Identity=73%"; Hit description =Putative uncharacterized protein
  Pfam annotation: Domain name=Nucleoside_tran; Domain location=117 -412; Score=65.5; E_value=1.7e-16; Accession=PF01733.9; Description =Nucleoside transporter
MENNEPPRRLEGKYAAMVVCWLLGNGCLFAWNSMLTIEDYYVHLFPKYHPSRVLTLVYQPFAVGTLAILAYKEDRINTRIRNLFGYTLFFISTLSILIGKAAYNIPPPYLRIAKSLWAMGGAFGIADAHTQGGMVGDLSYMLPEFIQSFLAGLAASGVLTSALRLITKAAFEKTKNGLRKGAIMFFAISTFFELLCVLLYSFVFPKLAIVKYYRSKAASEGSKTVSADLAAGGIQIPSGGANQYEKEIDRKGNKKLLLENIDYALDLFLIYALTLSIFPGFLSEDTGSHSLGTWYALVLIAMYNVCDLIGRYIPLLKFLKVESRKKLTTAIVSRLLFVPAFYFTAKYGTQGWMIMLTCFLGLSNGYFTVCVLTSAPKGYKGPEQNALGNLLVLFLLGGIFAGGVLQVPMTKHPISPGLATTLRSFASTTSDTAVVVSGSRVQCVSPWAGGTMHECVLPKLTQCYVAGGASGTLCTAAGPGEIGCFMTKHP

SEQ ID NO: 169044 - protein, 16 aa, Glycine max
  Coding DNA Sequence Number=SeqID_77359
MEQLKEKAQGNQVIVE

SEQ ID NO: 169045 - protein, 477 aa, Glycine max
  Coding DNA Sequence Number=SeqID_77360
  Gene Ontology: Mol. function=acetylglucosaminyltransferase activity; Cellular component=membrane; Biological process=isopeptide cross -linking via N6-(L-isoglutamyl)-L-lysine
  Homolog annotation: Hit_ID=A9PDW8; Match level="QueryCoverage=99%, HitCoverage=97%, E-value=0.0, Identity=66%"; Hit description =Putative uncharacterized protein
  Pfam annotation: Domain name=Branch; Domain location=88-358; Score =350.0; E_value=4.2e-102; Accession=PF02485.12; Description=Core-2I -Branching enzyme
MRKNVGSHSGRMFSDRKWILPFFASLIISMSLVLTAILGLLSSDGGGEQSPFEIISFKRSEDSSGYFVESDIQRSLNVSVVKREAPRFAYLISGTKGDSRRMMRTLEAVYHPRNQYILHLDLEAPPRERLELANAVKADPIFREVENVRVMSQSNLVTYKGPTMIACTLQAIAILLKESSEWDWFINLSASDYPLMTQDGSPTLPDLNSRVAAYISVGQLHLVPIGFKLKSNGDGSLCNIVTSFDLLHVFSNLSRNINFIEHTRIAGWKLNQRARPIIIDPALYLSKKSDLALTTQRRTLPTSFKLFTGSAWVVLTRSFVEYCIWGWDNFPRTMLMYYTNFISSPEGYFHTVVCNTEEFRHTAVNHDLHYIAWDTPPKQHPISLTMKDFDKMVKSKALFARKFAKEDPVLDKIDKELLGRTHRFSPGAWCDGNTDGGADPCSVRGNDTMFRSGPGAERLRELLQVLLSKESLSKQCL

SEQ ID NO: 169046 - protein, 97 aa, Glycine max
  Coding DNA Sequence Number=SeqID_77361
  Gene Ontology: Cellular component=integral to membrane
  Homolog annotation: Hit_ID=A2XBE6; Match level="QueryCoverage=38%, HitCoverage=3%, E-value=3e-08, Identity=72%"; Hit description =Putative uncharacterized protein
YVLVMQYAMPPAMNISTMAQLFEVGNEEHSVILLWTYSAAAIALTAWLTFLLWLFLKKMSSAQRAWIVAASVGVVEALKDQGAKNLLSFSSSMVSTS

SEQ ID NO: 169047 - protein, 112 aa, Glycine max
  Coding DNA Sequence Number=SeqID_77362
  Homolog annotation: Hit_ID=Q9SBR5; Match level="QueryCoverage=76%, HitCoverage=98%, E-value=4e-32, Identity=76%"; Hit description =Putative wound-induced protein
MEIEEWLRKPAMERGQQELDHHHNNKMSSGIRAWSVAASVGVVEALKDQGICRWNHALRSAQHHLKNHVGSFSQANKLSSSAMISTTLKHEKAKQSEESFRTVMYLSCWGPN

SEQ ID NO: 169048 - protein, 38 aa, Glycine max
  Coding DNA Sequence Number=SeqID_77363
MEIVELGCKVNSKLSSSKCYWDLEDGHEHKFLGLGYCN

SEQ ID NO: 169049 - protein, 50 aa, Glycine max
  Coding DNA Sequence Number=SeqID_77364
MIYWFLTSFPPPFVGTLLVTVNINCTGSVKLNSSQAVADDGVFRDHKGSV

SEQ ID NO: 169050 - protein, 172 aa, Glycine max
  Coding DNA Sequence Number=SeqID_77365
MSRDFANYLTMDVKYLEAVKRRLQAIKQWSPNEIRAHELGHCIPIKEHTQEVHYMGNQQRQGYNQGGFSGFQQGPYNQQGQWRSHPGNQFNKDQGGLSNRPPQQGPNIFQMTTKLEETLAQFMQLTMSNHKSIESALKNLEIQVGQLAKQLAEKSSSSFGANIEKNPKEECK

SEQ ID NO: 169051 - protein, 135 aa, Glycine max
  Coding DNA Sequence Number=SeqID_77366
MSTTGRGRHSVLRIFKGRRGRTGHHATCEKITLSGAPADVSGLPNVAVSRHVPICTDDRSARARALGFAATAAPSYSSGLGPCPDGRVSAQLGTVTQLPVHPASPVLLTKNGPLGALDSMARLNRAAAPSYLFKV

SEQ ID NO: 169052 - protein, 92 aa, Glycine max
  Coding DNA Sequence Number=SeqID_77367
  Subcellular localization annotation: CTP_CleavageSite=40; ConfidenceScore=5.52e-01
MPISPCKSISWSMSSRHGDRTHKTPSGPGKVQQGPGVSSRASISPTGCPYPPPPGKFYGVPVTSSKGIRPPTNQAFIKKYCAPRRAHGETPQ

SEQ ID NO: 169053 - protein, 126 aa, Glycine max
  Coding DNA Sequence Number=SeqID_77368
  Gene Ontology: Mol. function=DNA-directed DNA polymerase activity; Cellular component=cytoplasm; Biological process=DNA replication
  Homolog annotation: Hit_ID=P14567; Match level="QueryCoverage=98%, HitCoverage=10%, E-value=2e-56, Identity=83%"; Hit description=DNA polymerase III subunit alpha
  Pfam annotation: Domain name=PHP; Domain location=7-126; Score=46.0; E_value=1.3e-10; Accession=PF02811.10; Description=PHP domain
MAEPRFIHLRVHSDYSMVDGLAKTGPLVKKAAALGMPAIAITDYINLCGLVRFYGSAHSAGIKPIVGADFQVASDLMGDELTQLTVLAANNTGYQNLTLLISRAYQRGYGIAGPIIDRDWLLELGD

SEQ ID NO: 169054 - protein, 451 aa, Glycine max
  Coding DNA Sequence Number=SeqID_77369
  Gene Ontology: Mol. function=lysine decarboxylase activity; Cellular component=cytoplasm; Biological process=amino acid metabolic process
  Homolog annotation: Hit_ID=A7MEM5; Match level="QueryCoverage=45%, HitCoverage=28%, E-value=4e-97, Identity=84%"; Hit description =Putative uncharacterized protein
  Pfam annotation: Domain name=ATP_bind_3; Domain location=327-447; Score=-77.5; E_value=0.0017; Accession=PF01171.11; Description=PP -loop family
  Pfam annotation: Domain name=Glyoxalase; Domain location=236-329; Score=2.4; E_value=0.056; Accession=PF00903.16; Description =GlyoxalaseBleomycin resistance proteinDioxygenase superfamily
  Pfam annotation: Domain name=OKR_DC_1_C; Domain location=63-197; Score=279.9; E_value=5e-81; Accession=PF03711.6; Description =OrnLysArg decarboxylase, C-terminal domain
  Pfam module annotation: Pfam domain module=ATP_bind_3::Glyoxalase::OKR _DC_1_C; Domain location=327-447::236-329::63-197
GIPAALVAKFLDQRGIVVEKTGPYNLLFLFSIGIDKTKAMSVLRGLTEFKRAYDLNLRVKNMLPDLYAEDPDFYRNMRIQTLAQGIHQLILQHDLPRLMLRAFDVLPEMKMTPHQAFQRQVQGQVETVDIRELVGRISANMILPYPPGVPLVMPGEMITEQSRAVLDFLLMLCTIGRHYPGFETDIHGATLTDDGRYLVRVLRDEPVALTSDNCLFSASRRALRRFTATCWALSYWVNTIALSAIHGKATLALMASIPLSCSQFPAPPPRVSGPEACGLRHLAFCVDDVEQSVAALADKGVVCEPIRIDALTGKACTFFPDPDGLPLELYQARCPLRAGIQRRARFQRPAASVSELATPAAAAARARITCASWFKPQRRSLGGALPAAVDARAGGIEAAARTARYQALFTHLQPGEYLLTAQHLDDQAETLLLALNAAVVRLVWRRCRSSG

SEQ ID NO: 169055 - protein, 310 aa, Glycine max
  Coding DNA Sequence Number=SeqID_77370
  Gene Ontology: Mol. function=unspecific monooxygenase activity
  Homolog annotation: Hit_ID=Q5CEG7; Match level="QueryCoverage=33%, HitCoverage=99%, E-value=5e-44, Identity=84%"; Hit description =Senescence-associated protein
  Subcellular localization annotation: CTP_CleavageSite=52; ConfidenceScore=5.26e-01
MIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGISKITLKVVYFTFAVSSSHLSYTLKSFHKVGLESSSTGSSFPLIPPSPFPWLCRIPLVRTSSELTVRRPGKRPRRARSQSVPRPARDDPLSPRKQLEQSTDSRRVRDWDPRAQPSEPILFPRGCSPWRPDAVMSTTGRGRHSVLRIFKGRRGRTGHHATCGALPAAGPYLRLSRFQGGQAVKQKR

SEQ ID NO: 169056 - protein, 127 aa, Glycine max
  Coding DNA Sequence Number=SeqID_77371
MARAGDNGGIYHQLDEYQRLFLDAWTTQMQRLLNRNKEEPYRRIAKSSSFALKPLSPREVCDGQIRMREKREQEKENSEAPQRNMKKKSDTPEEKSDTQERESDNSNQTLKMSFPTRFLMDCHLQEA

SEQ ID NO: 169057 - protein, 147 aa, Glycine max
  Coding DNA Sequence Number=SeqID_77372
MESRKRARTEDIPSSSTPTPLRQELAHNRPIISMEHFLEQVAWPEAQLPLVRPNEAALPEPTPVQVNSEPANPQSPVVNPPFSPELEAVPPSPPLIVIFDASSDEAAAPPDSPAAEIVDPSVSPIGGIANLSNSSSGKAIALTDSPF

SEQ ID NO: 169058 - protein, 54 aa, Glycine max
  Coding DNA Sequence Number=SeqID_77373
MGRRQHTNFFMDELRGFGGGGGAFVARCRPFPGYYGVSPCACLGAQYFLMKARL

SEQ ID NO: 169059 - protein, 60 aa, Glycine max
  Coding DNA Sequence Number=SeqID_77374
MSLDTASSERKIDDLSAGRRFAAPSGLSGQLTGNSVGHTAMCPRATIMKSQQCRRAVCPG

SEQ ID NO: 169060 - protein, 131 aa, Glycine max
  Coding DNA Sequence Number=SeqID_77375
  Homolog annotation: Hit_ID=B0HC01; Match level="QueryCoverage=25%, HitCoverage=72%, E-value=1e-11, Identity=100%"; Hit description =Putative uncharacterized protein
GAGAYGKTPATRPFYGSWPFAGLLLTCSFLRYPLILWITVLPPLSELIPLAAAERPSAASHWHDRFPDWKAGSERNAINETAMTMITNSSSVPELAKRAFDANRVHQYSLYISALTALTSSSFKDEHSSSC

SEQ ID NO: 169061 - protein, 38 aa, Glycine max
  Coding DNA Sequence Number=SeqID_77376
MASEGFTMRRKVKERKGARSARHPLAQRACCRLSTCLC

SEQ ID NO: 169062 - protein, 135 aa, Glycine max
  Coding DNA Sequence Number=SeqID_77377
MALVKEFYANLYSFEGPSPKQARIRGHLVKIDADSLNTFLETPMVLAEGETLPTYSRYYRLPSDPREIEAALCIPGQGFILNAEGHPGRILRKDLTTLAQPKSNSSRLGFPALITALCRARGVVSNSLTFERLSP

SEQ ID NO: 169063 - protein, 80 aa, Glycine max
  Coding DNA Sequence Number=SeqID_77378
MTMSMMLRRCPTWPIPIPSCPIRVSSSKIPPFIHFVNEGVPPEGGEDPNMPVILYPGWKSCGYEYIGAICDGSWVNTGGV

SEQ ID NO: 169064 - protein, 119 aa, Glycine max
  Coding DNA Sequence Number=SeqID_77379
MEVMKEQMATMMEAMMSMKKIMEANAVAVAATSAVAKVNPMPPSGLNQMNHPTSARVGKDLESTSDPHYVQIQNKHAFPPYGWPPNYTPLNVAYIPHEDVNNSTPILIESRQTHHAHVS

SEQ ID NO: 169065 - protein, 209 aa, Glycine max
  Coding DNA Sequence Number=SeqID_77380
MRNRGRRRGVALRTELKQAQTVKERFKSAALKIRKENAELRDVNMATTKELEQETKRACREEHGRNKFRGALWGSNSELKLRREERDQSSKRSLSQRLCETETNMLAIITKYQEELSLATAHEHRVADEYAQLYAEKEARGRVIDSLHQEVTMWMDRFAFTLNGSQELPRLLAKAKAMADIYSAPEEIHGLLSYCQHMIDLMAHIIRNR

SEQ ID NO: 169066 - protein, 112 aa, Glycine max
  Coding DNA Sequence Number=SeqID_77381
MHNILDRLDGLHTFIGERFDSLDSRIDAIDARFAGMDTHITQLEEDMSYDCHHQKGGDCGSNAFQVYFDDAKDSSQESRVKQVSRIKESFNQSKFQESKSFNQSKFQESRLK

SEQ ID NO: 169067 - protein, 447 aa, Glycine max
  Coding DNA Sequence Number=SeqID_77382
  Homolog annotation: Hit_ID=A1FU10; Match level="QueryCoverage=13%, HitCoverage=27%, E-value=2e-29, Identity=96%"; Hit description =Putative uncharacterized protein precursor
PYNTSYVLNEDSYYCSDFIERAFRAHHVFALQPMNFRNPQTGEISQHWIDLYRGMGMDVPQAYRHAGISKAPHRAGLRRSRCTRNAVILLRRGRPAAGSGCASAVPAAVAAAGRGHGPAADPAGSAGPAASGSGSGSAEPCPISKATRGMRIHAGSACAHAVIGVARIHGARSRKHALNEAGFPAHAGKPTLHSGHHRRHVRQGHPQQPQQAQHQRNVHQQLDEGEADDVACLQPQHAQQRQHPERIDQVRQRFGGVVDLHRPAQVRLQFVGGLHHVRRLDDPLATTGGHEEAQHGRIDTHHQREGIGAGHVHEQARQPVRQRLPIAASGVGEDHRDAAVQRELDQHAGGAGHRLGHRVKEAARSPVQQQAQRNEQEVVGVEVGDGGDHRLVGELVEQPAERQQREQHGQQRAVFQPLARARALLQWLRLGLRGAGEVFSGAGTAGG

SEQ ID NO: 169068 - protein, 119 aa, Glycine max
  Coding DNA Sequence Number=SeqID_77383
MDKFDIFVPHPLTNASLLIQLSPKCGCKPLVCLLKRPALLSLDFQDRSIKNYSCYTFDEGAVKRQGQPFPCVQESPTTRDPQSLNPFSEIRRREEEISLKRDRLYNEDQSKFLIEYASG

SEQ ID NO: 169069 - protein, 67 aa, Glycine max
  Coding DNA Sequence Number=SeqID_77384
MTEWIVIIKKGEIVQAMSSKVILMMPKNQELRKVSSKDSRIKFQDSRFKNNQDQDSRIKRRLNQDKY

SEQ ID NO: 169070 - protein, 218 aa, Glycine max
  Coding DNA Sequence Number=SeqID_77385
  Homolog annotation: Hit_ID=A5BZH4; Match level="QueryCoverage=38%, HitCoverage=13%, E-value=4e-08, Identity=39%"; Hit description =Putative uncharacterized protein
  Pfam annotation: Domain name=zf-CCHC; Domain location=107-124; Score =21.5; E_value=0.00084; Accession=PF00098.14; Description=Zinc knuckle
MKEGIGHILDLTPIGEKRKESLKRLTLTSPYFHGKDNVEANIVWEIRVEQQLKRKSTSKSYGSHSYQRKYQGQGILGVSSSKPKDDKGKTIEKQPLKASMQEKTSSMKCFKCLGRGHITSQCPTKKTMIMRGQDIYKAKGEESSEEIYPQEEGQSLMVKEECKEVSVSSKRLAKKERHFEIKTNIKEISLLRQPPHFLLCKKTLVSIATSLRLEFIPQ

SEQ ID NO: 169071 - protein, 16 aa, Glycine max
  Coding DNA Sequence Number=SeqID_77386
MVETSQNNTKRGVKDK

SEQ ID NO: 169072 - protein, 100 aa, Glycine max
  Coding DNA Sequence Number=SeqID_77387
MGERNGVELNCHHQKGRDCRSKDFDFDVLMMPYDHDVLMPYENALLKFNSRQKSKNTRYNIKNISSDLGREFQIETAKGLAKKFKLKCLFQEIYSLVTDY

SEQ ID NO: 169073 - protein, 66 aa, Glycine max
  Coding DNA Sequence Number=SeqID_77388
MTDLVSAEDDVNLRVSTGLSAAIDERRIMTIICLCVPSDTTVSKWQKGVRNDNNLSPHVIGPAASG

SEQ ID NO: 169074 - protein, 81 aa, Glycine max
  Coding DNA Sequence Number=SeqID_77389
  Subcellular localization annotation: CTP_CleavageSite=32; ConfidenceScore=5.24e-01
MMKEVIHSHNSAAPRLRFSSSSSSSTFFYLVSGETRPSELELAQASCLLRADEQLEEKIEESQELARDAVITVRRHMSPLR

SEQ ID NO: 169075 - protein, 354 aa, Glycine max
  Coding DNA Sequence Number=SeqID_77390
MALKKLLSKRARKDAAGEGSSATPQVGMEFDGHRFRSEEHQCHFEVIKGWFFLKERRVQLREGEYAEFQEEGVRDKRSWVRGQWIPFDEDAINKFLGHPLVLEEGQHCEFSQRRSQALGFDEEAISWQLCVPGQDFTRSVTGRRVQIMRTSMTTLTQILMTLLLNNILPSDHNSNLPLRMCQLVYAIFTQVNVHVAQLILDAIYQFAGITPQTPSGPGEVQQSTGVSSLDHEPLPEDQQQPAVDAPSLPLRQPPSLESISAHLWRMELLMHAYMQHVTDQQAVNHRGQVQLNESFYQYTLHQQSQDPSPFPWPTPEQFGATVAWHGKRPSFQAGAGPAGSPKMKMELKKMMTWL

SEQ ID NO: 169076 - protein, 64 aa, Glycine max
  Coding DNA Sequence Number=SeqID_77391
MEGKRLFGSFFSDPWLVQASLWLAWTPKRLRGEVLARLGEQGLSFSSHLRIRRSKDNALVDPEK

SEQ ID NO: 169077 - protein, 57 aa, Glycine max
  Coding DNA Sequence Number=SeqID_77392
MDTLDFANVCREKNTLERMTKERDQALNANIESIFDNSNLKADIKKFEDQEALRGQK

SEQ ID NO: 169078 - protein, 321 aa, Glycine max
  Coding DNA Sequence Number=SeqID_77393
MEGRVNLGLKSENGGEMSGKLGGIDGDPVLRGTRIRATWEYVSSVEGGQLGMVDLCVICGCGESTCTIARSPPSTTYDGVVPGDMSRGSGDLGDVRRAPGSQPIKEQRPQSKEACVVAGQLWILSDIWNMASDNRLPREVEMASGFHVLKLCNSSLASGNRLPMLCNRLPEEKTLEIAMAAQLIHDRVEMECLEGVWETLEGNVRCRFWGTIRFTATSLVRPEEPARMLQRTVEWILPTPTPYRLVEPVQVIEVSSSEEDPEEDPEELPPEPVVYAIDFPEGDEDPLPDVDSPEDVKSASEADSTEESGPGGIVTNGDSSS

SEQ ID NO: 169079 - protein, 130 aa, Glycine max
  Coding DNA Sequence Number=SeqID_77394
MDILRRLKTVVVCDDDRLLVSPVLELTRDYDGHGDRTVVDIILFYDGCLLRIVVEWSTILTRLPDSPVVEVTKDYDGHGDSTVVDIILFYDGCLLRTVVEWSYYYNGVLLRTTVVRDGVNNTTVTIQHRR

SEQ ID NO: 169080 - protein, 309 aa, Glycine max
  Coding DNA Sequence Number=SeqID_77395
MEVILCIPGKGFVLNIEGQPWKLLIKDLTTLAQTWSVFSYSNLAPTSHTSNLNIDRARLVYGLVTGITIMAQFNSSCLGFPALIKVLCRSRGVGSDALTAYKSLRLVIILAYIKRKCWNVNDQIVNFPRARKTRSRAAGVPSSPVSTTPSAQSSQTSDAKLQSLFEGQILIMQSLQELAHQRPIMSVEQFIEQVAWPRAQPSFVSDYGSYTAQAPQQQKPEPKDHQSSKATVPRAFDVAEVPVPANPPSPMVDPSSPAPEAALPSTPILIFDDPTVRTPEWIPTPPPTSFTGTGTPVLHLDDEEQDRDE

SEQ ID NO: 169081 - protein, 142 aa, Glycine max
  Coding DNA Sequence Number=SeqID_77396
MFCTDTCGVIQRRSLLGPVVVSQIVSRLRHVLVTFSYFGASYHFFAPFFDYLPLLWRPSYTELLLRQRASSPTNSISCPLPLVPFAAAVDKGPLLLLVVIIVVYIVVFKEDKWGLKSKDELRERPAAILHQWCHPMPHYQFR

SEQ ID NO: 169082 - protein, 91 aa, Glycine max
  Coding DNA Sequence Number=SeqID_77397
MDMALRPELGRSCQNLQVKKAEEQMIKSITKTCVLEKEKNGPKRLEDQHCPKDSYLFSDVDKQLDGSSSYEYQSFMDAYSGYNQIPLHPND

SEQ ID NO: 169083 - protein, 63 aa, Glycine max
  Coding DNA Sequence Number=SeqID_77398
MAGAGDNGGVYHQLDGSQRLLLDTMTTQMQRLLNRNNEELYRRIKGLEHQMNPNAGRPNGGNR

SEQ ID NO: 169084 - protein, 159 aa, Glycine max
  Coding DNA Sequence Number=SeqID_77399
MNRLEETTSIKTTTQVNTIIEDLEASERIVETNWSNSPKGMYELNAQDNLLALQQKMQVQIEAMTKTIQQFLQQLQGVISNKPQQAFMCEKCGGDHQTSKCTEVPTEEENPKGYCKAIISTIECDMGGEEEKEVEESTLVEEEMKAQANPFNPRYETLT

SEQ ID NO: 169085 - protein, 252 aa, Glycine max
  Coding DNA Sequence Number=SeqID_77400
  Subcellular localization annotation: CTP_CleavageSite=51; ConfidenceScore=5.30e-01
MEEPSKKQKGVLTSSAVIGTRSQGASKAQTTQIPPSISSPTLFSSEEQRIRYNSLFSSRSIIDPKFIDLAFFDDEVFDCFQAFQNSGLIQFISMKLPFYPKLVRAFYSNLEIQEDSLISEVYGIKMVIDQSFFFELTQLSSDGVPFEVKRYFSIDANVVSSLGYRKERDGSLVKKDALAPPPPQRDDSSSLMHNILDRLDGLHTFVGKCFDSLDSRIDAIDARFVGMDTRITQLEKDMSYVRQCFDLPPPSS

SEQ ID NO: 169086 - protein, 65 aa, Glycine max
  Coding DNA Sequence Number=SeqID_77401
MKVDGEITNESKISEEDEEEEELEEEAMLVSKLNLDTKPHPRPYRLQWLSEDEEPKVLNLNPSLV

SEQ ID NO: 169087 - protein, 135 aa, Glycine max
  Coding DNA Sequence Number=SeqID_77402
MAESMKKRKGSSSTTAPAGHRRHGPSKAPTALDGILYSEVENIPIVINQSLFFSLTKLLNQGVPFEGTIVNDWKFDYSSHDACSIVCNDQADMIGRLLAGSLTFDCRIMHYIIVRILLPHSSNLAQASEEDLILM

SEQ ID NO: 169088 - protein, 54 aa, Glycine max
  Coding DNA Sequence Number=SeqID_77403
MEVKLTPLELVGLGSSSSMDPFASWKMNGSGMEKEEREEMPLQGEDESRRSSPP

SEQ ID NO: 169089 - protein, 119 aa, Glycine max
  Coding DNA Sequence Number=SeqID_77404
MGSEGVPSMVVEVMLVAAVELTDASSWWHEIDDSLAWQDCISYTLVVLYGIVAAVALGLCTLFNFAVRMWLDSHLYSLTAFACVCRLFNTSCLTCRVLLSLQHMHFWSCSRLRFITRLV

SEQ ID NO: 169090 - protein, 200 aa, Glycine max
  Coding DNA Sequence Number=SeqID_77405
  Gene Ontology: Cellular component=nucleus; Biological process =regulation of transcription
  Homolog annotation: Hit_ID=A5AQK0; Match level="QueryCoverage=27%, HitCoverage=11%, E-value=2e-16, Identity=79%"; Hit description =Putative uncharacterized protein
MLLISSILSYALYNPVLTEEAEKLDIPFQFNPMLSKFENLDFYKLRVKNGEARAISSILQLHSLLALDEDASRRKSSLLSKNSNAIHLECKQRTALSPAKSVLRFSDDSRSVWRGIVAMKPRSKGGTMRSVYSMAMKKRSPNANKHDIQWCVATWIASAMVHFMNDMPQECLEEDGFAMAPFATFMPLAPSTGVAGSRAH

SEQ ID NO: 169091 - protein, 131 aa, Glycine max
  Coding DNA Sequence Number=SeqID_77406
  Gene Ontology: Mol. function=metal ion binding; Biological process =metal ion transport
  Homolog annotation: Hit_ID=Q9SE03; Match level="QueryCoverage=77%, HitCoverage=77%, E-value=6e-50, Identity=100%"; Hit description =Copper chaperone homolog CCH
PNSNSSPKLINSVWMLLVLQIGLPEVIFQVGVESFDIDLKEQKVTVKGNVEPDEVLQAVSKSGKKTAFWVDEAPQSKNKPLESAPVASENKPSEAATVASAEPENKPSEAAIVDSAEPENKPSDTVVETVA

SEQ ID NO: 169092 - protein, 261 aa, Glycine max
  Coding DNA Sequence Number=SeqID_77407
IEELMHWRLIKNIEGELAEVTNTVDGDDTTEEEAGVPSSKDVAGLEEGNKKFPETKVALAAGLDFKEQIEQGLKLTFVRTRAQWNLKAVGRGALTTYKDIPNLATAFEEGPQVKAMDTLWLGPEHPTVLKTKMKGQKRRFEQTTMVTNNGEGNARAGTIKLPIPKTGTKICPKETTKLLKLGLADEVTGGGPATFRRLEGNAWLSRTETGANLRRHVEAHGWDSGQATCKDGDGWRPAVAKDGGDVGDNQNGIVPTLIPSC

SEQ ID NO: 169093 - protein, 50 aa, Glycine max
  Coding DNA Sequence Number=SeqID_77408
MGCYMKCPKFPIHYLYALDTSSLNGIELEERNHTCKAFDAKDQSGGVRQF

SEQ ID NO: 169094 - protein, 83 aa, Glycine max
  Coding DNA Sequence Number=SeqID_77409
MYPPLELIHKRYDDKGDDKKLKDQSKSTQINQRSIKNNSRVQDKNQEEFKTQEESLETRIKIQGSRSQESRSRFKNEEKTQSR

SEQ ID NO: 169095 - protein, 94 aa, Glycine max
  Coding DNA Sequence Number=SeqID_77410
  Subcellular localization annotation: CTP_CleavageSite=51; ConfidenceScore=5.61e-01
MATPPSSPPPPPPTGAASQSPSSLKRTRKATRLRPLMTRLVGAERLLVHVDLATRKADDPHRKKLRTYLGIFTCDKAEFDIPEASDQRTKKIII

SEQ ID NO: 169096 - protein, 161 aa, Glycine max
  Coding DNA Sequence Number=SeqID_77411
MAPTRHPLDPDKSNRALGFPALITGLCQSFGVPVAPTKVIRPPITRAFIEKYCTQRQGQGDAPQAAGAPPPPHQAGQAGAFDMEQYLRHLVRQQAANHRAHGFAPFSCPTPDQFRAEVAWPGDWPEAQAGGTPPEAPGDGEEAHEDEEMADLLDFLGGSGD

SEQ ID NO: 169097 - protein, 83 aa, Glycine max
  Coding DNA Sequence Number=SeqID_77412
MASYGVASPLSLPFSIPLPFIFQEAKESIDEEDPRPTSSNGACITSTQTYLPSREVASTLTYLPSPESGVIQIFVACIKRSTP

SEQ ID NO: 169098 - protein, 58 aa, Glycine max
  Coding DNA Sequence Number=SeqID_77413
MITKDDDKGDDKKLKDRIKNTSRFKRKVDFKNQESRFKRSRFQESRFKRSRFKTQEKA

SEQ ID NO: 169099 - protein, 85 aa, Glycine max
  Coding DNA Sequence Number=SeqID_77414
MDLRLLVLTLVSHLAGQDHLGLPSGVETKHERQKPIKVLKDERNRGWDHDRPIVALLCAKQAGNVAARQPRILCILQLSFTICLF

SEQ ID NO: 169100 - protein, 197 aa, Glycine max
  Coding DNA Sequence Number=SeqID_77415
  Homolog annotation: Hit_ID=A2Q6B4; Match level="QueryCoverage=48%, HitCoverage=39%, E-value=3e-08, Identity=30%"; Hit description =Ribosomal protein L33; Nucleic acid-binding, OB-fold
  Pfam annotation: Domain name=DUF223; Domain location=1-95; Score= -7.0; E_value=0.013; Accession=PF02721.5; Description=Domain of unknown function DUF223
MVFVDSEGDQIHAICKSDNLKSWKADLKENCTYVMHNFKVVKNNGQFRVCEHEYKLFFIGVTVVREADLHELPFKEFRFVEFANVVAGNFVSSLLVGSYPASVSNSFKASKLLINDPILEIQEFKDRLLDLGVEVSRVSLPGDQASSQVPGGSQLSSKDSFLSKAEAKTILEINAISEVDLLSVFILYSLQLEVEFG

SEQ ID NO: 169101 - protein, 57 aa, Glycine max
  Coding DNA Sequence Number=SeqID_77416
MTCDHSLVLVSCVAPIIRQFVKFRDMPEIQKNIDAQSGSVTLRKENKYRYEIGNPQF

SEQ ID NO: 169102 - protein, 56 aa, Glycine max
  Coding DNA Sequence Number=SeqID_77417
MENWRTPLRNTFAGLQTRRWRTHEKRWAMTFKALGNDIHGSPKKVENGELANSATQ

SEQ ID NO: 169103 - protein, 111 aa, Glycine max
  Coding DNA Sequence Number=SeqID_77418
  Subcellular localization annotation: CTP_CleavageSite=36; ConfidenceScore=5.00e-01
MSSRTRCMFFSSFVMGSQKVHITFLTAHMEHCTPKCASTVATYPSAGGRCGAHGCVFHERKMREVTTNVNSRKTSEKPERCGLRTLSVKGSGVVFTHGEGSFPCSYVFLNL

SEQ ID NO: 169104 - protein, 266 aa, Glycine max
  Coding DNA Sequence Number=SeqID_77419
  Homolog annotation: Hit_ID=UPI00006A2D9E; Match level="QueryCoverage =53%, HitCoverage=73%, E-value=2e-07, Identity=14%"; Hit description =UPI00006A2D9E related cluster
  Subcellular localization annotation: CTP_CleavageSite=49; ConfidenceScore=5.62e-01
RTTRSRLQRTTPPRLQRTTRPPHQRTARPRHQRTTRPRLQRTTRPRIHRAAHPRPQRTTRPRLLRTTPPHLHRTTHPHLPTATRPCLQRTTRPHIKRTTRLCLQRTKRLLALTIRGLLALTIRGLHVLTFRGLHVLAFIGLHALAFRGLHVHAFRGLHVLAFRGLHVLTFRGLLALTIRGLHVLMFRGLHVLAFIGLHALALRGLHVHAFRGLRLLAFRGLHVLPIRELHVLAIRELHALAYRGLHVLAFIGLHALALKGLHVLAF

SEQ ID NO: 169105 - protein, 46 aa, Glycine max
  Coding DNA Sequence Number=SeqID_77420
MDTLEPYTGAMKGTVHEPQVPSYKVMTKDNNWYLKALHWGNEGHRA

SEQ ID NO: 169106 - protein, 101 aa, Glycine max
  Coding DNA Sequence Number=SeqID_77421
YKPVWKIINERWDHQLHMPLHVAAYYLILICIMNLLLDMMTLRKSIALPFDEIESDDEWITEEGYNDEDEQPQGEGDGGNVELVGDVGGSSNDLVLDVFDL

SEQ ID NO: 169107 - protein, 83 aa, Glycine max
  Coding DNA Sequence Number=SeqID_77422
MIVAEYATKFEELERYFPHYQGRDGEKSKCVKFLNGLIWDEDSQDWVAYYRSTGPMKNKKNGAPHRGKPYSTPPKQYGNCPNN

SEQ ID NO: 169108 - protein, 217 aa, Glycine max
  Coding DNA Sequence Number=SeqID_77423
MAKFDPDIVLEFYANAWPTVEGVRDMRSWGQECEYGQRRNRADGFDEEAIAQLLCIPGQDFAQTAAGRRGMAPTRHPLDPDKSNRALGFPALITGTLPVAADAPPPHQAGPAKSFDTEQYLRHLVRQQAANHRAHVQTHDCLYQMSLSLQSQRFTSFPCPTPDQFRAEVAWPGDWPEAWAGEAPAEAPAEAPDEADEAREDEEMTDLLDFLGGSGTT

SEQ ID NO: 169109 - protein, 76 aa, Glycine max
  Coding DNA Sequence Number=SeqID_77424
MAAEWKRKRERRRHFKEKMSLEEAHHHRRPWIRVWRKKEMNEGRGREEHEILCSKRALKSEPTNPRSIPRFSIKCA

SEQ ID NO: 169110 - protein, 101 aa, Glycine max
  Coding DNA Sequence Number=SeqID_77425
  Pfam annotation: Domain name=G-patch; Domain location=1-37; Score =4.0; E_value=0.062; Accession=PF01585.14; Description=G-patch domain
MVAQVMLGHGYEPGMGLGKNNGGRTSLADIRKNISERKNKGQGPRSGQRAKETPSCHISRSFVSVGLRREGQVAAICDEDSPRRSDLVQACSPGFQLGNWQ

SEQ ID NO: 169111 - protein, 80 aa, Glycine max
  Coding DNA Sequence Number=SeqID_77426
MATKGGVVDKSEALAPTYPPMRNSDLRSSGHLGSLNDEVRITVRCLRGLPALELWRQRRCGRQKRGSCSYVSSNEELRPT

SEQ ID NO: 169112 - protein, 141 aa, Glycine max
  Coding DNA Sequence Number=SeqID_77427
MSPKKELIFELQGKDVNGGEQPLSDKDLLTLEQFKKENRELKERLQRKEEDILGEVLHALQHEKDRCKSLETQLIDAEKKLEELNNEQETLIDVFAEERDRRDAEEKKLRNKLEEASNTIKELLEKIRKLERKSSSGKLDR

SEQ ID NO: 169113 - protein, 104 aa, Glycine max
  Coding DNA Sequence Number=SeqID_77428
  Gene Ontology: Mol. function=ARF GTPase activator activity; Cellular component=cytoplasm; Biological process=regulation of ARF GTPase activity
  Homolog annotation: Hit_ID=A2YXJ0; Match level="QueryCoverage=44%, HitCoverage=6%, E-value=1e-11, Identity=69%"; Hit description =Putative uncharacterized protein
MQLAGDLEAEKVDLTAGVGRNEALEHWARSLVTTTGRQNLTCVAVLGKIGVQRKQVEHIFNDQLLPIVDVDIHEVKEARKRFDKASLVYDQVKMKYRIRDEIHA

SEQ ID NO: 169114 - protein, 314 aa, Glycine max
  Coding DNA Sequence Number=SeqID_77429
  Gene Ontology: Mol. function=transcription regulator activity; Cellular component=nucleus; Biological process=regulation of transcription
  Homolog annotation: Hit_ID=A8TLW5; Match level="QueryCoverage=90%, HitCoverage=77%, E-value=4e-51, Identity=48%"; Hit description=BHLH transcription factor Upa20
  Pfam annotation: Domain name=HLH; Domain location=163-213; Score =35.6; E_value=1.8e-07; Accession=PF00010.17; Description=Helix-loop -helix DNA-binding domain
MAAFSSQYYHSFVVDSACFSITPPIINTSSNFLPSPHYLHNNNIQETSYSVTDNKETSCFEQSSKVTISDIELSVVKNHSPETSMVVDKLEKGEQVTQKVVTRMEKKRRARNGSSSSDPLSKESTEGGKKKQKKPKEVTKDKKIGAEDPPTGYIHVRARRGQATDSHSLAERVRREKISKRMTTLQRLVPGCDKVTGKALVLDEIINYVQSLQNQVEFLSMKLASVNPMFFDSAMDLDTLMVRPDQKLSNIASPSPLPCVAQFRPHQAIAFADTITTPTTTTNSFPTANNDGYLLDYSSSLFLQGHRPNIFEVC

SEQ ID NO: 169115 - protein, 865 aa, Glycine max
  Coding DNA Sequence Number=SeqID_77430
  Gene Ontology: Mol. function=protein dimerization activity; Cellular component=nucleus; Biological process=regulation of transcription, DNA-dependent
  Homolog annotation: Hit_ID=A7PHQ5; Match level="QueryCoverage=99%, HitCoverage=98%, E-value=0.0, Identity=66%"; Hit description =Chromosome chr17 scaffold_16, whole genome shotgun sequence
  Pfam annotation: Domain name=AUX_IAA; Domain location=666-833; Score=- 83.5; E_value=0.0018; Accession=PF02309.7; Description=AUXIAA family
  Pfam annotation: Domain name=Auxin_resp; Domain location=293-375; Score=197.7; E_value=2.8e-56; Accession=PF06507.4; Description=Auxin response factor
  Pfam annotation: Domain name=B3; Domain location=159-271; Score =101.7; E_value=2.2e-27; Accession=PF02362.12; Description=B3 DNA binding domain
  Pfam module annotation: Pfam domain module=AUX_IAA::Auxin_resp::B3; Domain location=666-833::293-375::159-271
  Subcellular localization annotation: CTP_CleavageSite=51; ConfidenceScore=5.16e-01
MATSEVSIKGNSVNGKGDNSSGGYTNDVRNGSGGGEARNSSSSSSSARDAEAALYRELWHACAGPLVTVPREGERVFYFPQGHIEQVEASTNQVAEQHMPVYDLPPKILCRVINVMLKAEPDTDEVFAQVTLLPEPNQDENAVEKEGPPAAPPRFHVHSFCKTLTASDTSTHGGFSVLRRHADECLPPLDMTKQPPTQELVAKDLHGNEWRFRHIFRGQPRRHLLQSGWSVFVSSKRLVAGDAFIFLRLILETFRGENGELRVGVRRAMRQQGNVPSSVISSHSMHLGVLATAWHAILTGTMFTVYYKPRTSPAEFIVPYDQYMESLKNNYTIGMRFKMRFEGEEAPEQRFTGTIVGIEDADTKRWPKSKWRSLKVRWDETSNIPRPERVSQWKIEPALAPPALNPLPMPRPKRPRSNVVPSSPDSSVLTREASSKVSVDPLPTSGFQRVLQGQELSTLRGNFAESNESDTVEKSAVWPPVADDEKIDVSTSRRYGSDSWMSMGRHELTYPDLLSGFGTHGDHSSHPSFVDQNGPVANVGRKHLLDCEGKHNVLSPWSGVPSSLSLNLLDSNTKGSAQGGDTTYQVRGNLRYSSAFGEYPMLHGHKVEHSHGNFLMPPPPSTPYESPRSRELLPKPISGKPCEVSKPKDSDCKLFGISLLSSPIAPEPSVSQRNVPSEPVGHMHTTSHQQRAFDNDQKSEHSRGGSKPADGLLIDDHEKVLQTSQTHLKDIQAKSHSGSARSCTKVHKKGIALGRSVDLTKFSDYGELIAELDQLFEFGGLLTSPQKDWLIVYTDNEGDMMLVGDDPWQEFVAMVRKIYIYPKEEIQKMSPGTLSSKNEENQSASEGATDTQEIKCQLNNSASDT

SEQ ID NO: 169116 - protein, 90 aa, Glycine max
  Coding DNA Sequence Number=SeqID_77431
  Pfam annotation: Domain name=GRP; Domain location=14-90; Score=-29.5; E_value=0.082; Accession=PF07172.2; Description=Glycine rich protein family
MTTSTATMIVVITMAVIVVTTMTTVAITVVVAMVTTALIGCSDGSGSDSDSGSGDCHNSGNDNNRSGGGGSSGRGGDDNDKSGGGNGERE

SEQ ID NO: 169117 - protein, 72 aa, Glycine max
  Coding DNA Sequence Number=SeqID_77432
MTSTLLSSSALPCFTTIVGEGEDDVEHDDNLLMWRTTRLVMRAGELKRQRRKRKLEWERCVEFGGKRKRREL

SEQ ID NO: 169118 - protein, 544 aa, Glycine max
  Coding DNA Sequence Number=SeqID_77433
  Gene Ontology: Mol. function=ATP binding
  Homolog annotation: Hit_ID=A7PHM9; Match level="QueryCoverage=99%, HitCoverage=50%, E-value=3e-94, Identity=34%"; Hit description =Chromosome chr17 scaffold_16, whole genome shotgun sequence
NFKEELQLLGVVVGFSRKVVTEHLKSRSYLKSLTAEAVVLMLECIHFADVSHKLVNALKRTNCLKTYIGFEIPSECFLLDPVWGCILNVFNDFPVIDHKFYGDKILTYKIELRKTGVVIDFEEAIKAFGHTRVGDYRSSKKCILFGPDWESFSAITRLPFIGDSDNCYGKFVHEYKEELKSTGVITEIKHGLNFVTTFLRFPSDPSSITRESVFSLLECIRCLNKNDWKPENKATKRIWIPKAVDNGEWVSPEQRVNHDMGDLFGSRSMPSLDDYIEIWKEWESSGEQLSHDKCCNFWAYVLQHESKRTVKNIAESLTKLPITSGSDLILLLDKRDVFVADNLHLQNLFEQERVFVWYPESSLASLPRSELLDLYKKIGVSIISESVLKEESSLLDGVEVRQVDPSNIFIGKGLVKLVLSFLACSSIKIEAEKRHEAVQGLIELTVHETIEPVTVCYSLSLSSGKTITKKWRYKHAKNMPHISQAISAGVLRENVDNVLALSELIKLGFLVKFNEEAVDFLMESKDLQIFLEDEEFLRSAFPFV

SEQ ID NO: 169119 - protein, 284 aa, Glycine max
  Coding DNA Sequence Number=SeqID_77434
MGIGNSKSNAAEGERLPPKIRPMLVSRFEEFRKRRNGETTLSKKNLLNEEDDNSQSSHRTEEENKVSSSKEIEPPKEETVERVITAEKLSRVVPVPNSECENVEETHPNKDNIEQVIKYMDPSQDVFNRAVEMAEAEVKTEEEKTAELVEETKEEKKQKVDAKGDDHHEDSGDEDESEKVGRFLCPGSPSFRIYCIEAEKRNEEECNGPTIVLQKSRSVDSVETAESTNSNEVLQELESTSKRKGHKKKFGAMKTLLKVKSLYHPMCTCTGDDKSHIFTAKATK

SEQ ID NO: 169120 - protein, 280 aa, Glycine max
  Coding DNA Sequence Number=SeqID_77435
  Gene Ontology: Mol. function=zinc ion binding; Cellular component =integral to membrane; Biological process=positive regulation of gene expression, epigenetic
  Homolog annotation: Hit_ID=A7PHL8; Match level="QueryCoverage=84%, HitCoverage=94%, E-value=2e-65, Identity=49%"; Hit description =Chromosome chr17 scaffold_16, whole genome shotgun sequence
  Pfam annotation: Domain name=MtN3_slv; Domain location=121-207; Score= 129.6; E_value=8.8e-36; Accession=PF03083.7; Description=MtN3saliva family
  Pfam annotation: Domain name=MtN3_slv; Domain location=9-86; Score =99.6; E_value=9.9e-27; Accession=PF03083.7; Description=MtN3saliva family
  Pfam module annotation: Pfam domain module=MtN3_slv::MtN3_slv; Domain location=121-207::9-86
MAHANPMIFVVGILAPVPTFYRVCKKKTTEGFQSLPYVAALFTSMLWIFYAYIKTGEILLITINAFGCFIETVYLVIYIIYCPKKARFFTFKMIFLFNVGVIFLVVLLTHVLAKERTARIELLGWICVVLSTSVFAAPLSIIKVVIRTKSVEFMPITLSLLLTVSATMWMAYGILLRDIYVTLPNFVGITFGTIQIVLYLIYRKSKPVKDQKLPEHKNHVVNDENASTAVSGENQGPNTTGFVDIEIGEKKQVQEQAEKKQDQQFVNARDQTEHNKTRES

SEQ ID NO: 169121 - protein, 113 aa, Glycine max
  Coding DNA Sequence Number=SeqID_77436
MENGGLRTFKLCGFGLRRRNDRSGSKKRQIRSSCFDKCKKKKKTGASEEDKKEGETYAVTAILIRPSFLPTQQCHYSANNNPSHYPPPSHPQRPSLKSTTKPTYLTSNDKHHL

SEQ ID NO: 169122 - protein, 59 aa, Glycine max
  Coding DNA Sequence Number=SeqID_77437
SQHSGNQKKHYCGIPKDLQHSGSEKEHCCIIRKVPQHSRGQKEYHCIIREVSRCFEKKP

SEQ ID NO: 169123 - protein, 498 aa, Glycine max
  Coding DNA Sequence Number=SeqID_77438
  Gene Ontology: Mol. function=nucleoside-triphosphatase activity; Cellular component=chloroplast
  Homolog annotation: Hit_ID=Q2PMM5; Match level="QueryCoverage=100%, HitCoverage=25%, E-value=0.0, Identity=79%"; Hit description=Protein ycf2
  Pfam annotation: Domain name=AAA; Domain location=77-284; Score= -31.0; E_value=0.011; Accession=PF00004.20; Description=ATPase family associated with various cellular activities (AAA)
MIEQPGAIYLRYLVDIHKKYLMIYEFNTSCLAERRIFLANYQTITYSQTLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLDVNESNYLSLGLLVNYLSRDCERCSTRNILVIASTHIPQKGIHLEKKMSHTNGFGSTTMGSNVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRVTLLLRSEPRNPLNMIQNGSYSIVDQRFLYEKYESEFEEGGGVLDPQQIEEDFFNHIVWAPRIWSPWGFLFYCIERPNELGFPYWARSFRDKRIIYDEEDELQENDSEFLQGGTM

SEQ ID NO: 169124 - protein, 125 aa, Glycine max
  Coding DNA Sequence Number=SeqID_77439
  Homolog annotation: Hit_ID=Q2HVN2; Match level="QueryCoverage=83%, HitCoverage=31%, E-value=9e-09, Identity=29%"; Hit description =Putative uncharacterized protein
MSKYGGWSDLSNGRDKAWHSQWWKDLRKLYQQPEFTLIHQQMVWKVGEGKKIKCWKDKWLGDDCQLEQQYNQLLLISGQQNSTISNMGSFSQGNWCWGLKWRRNLFDYEQHIVVAFMEAITDIQI

SEQ ID NO: 169125 - protein, 113 aa, Glycine max
  Coding DNA Sequence Number=SeqID_77440
  Subcellular localization annotation: CTP_CleavageSite=25; ConfidenceScore=5.53e-01
MEAQTRTQQCGCSHGSAAQFATNTNSGRRRNNNNALGVPFSGLFPFLLFFDLRNHGSAGQFDTKTISGKRRKKKNDRVQARGLCNFRSLIYNDNNIGFLKITDVNINSITSVL

SEQ ID NO: 169126 - protein, 95 aa, Glycine max
  Coding DNA Sequence Number=SeqID_77441
MSKNQELSKFKRFKNLVSRIKIQESRFKNNRAQDSRLKIQESREDSIKIIQVEGTSTWFFKENKGGYIPCGSLACKGFYKVERNLKNRRLLGDWM

SEQ ID NO: 169127 - protein, 64 aa, Glycine max
  Coding DNA Sequence Number=SeqID_77442
LRMTASRNLTPIVRQSVKFHDMPGVERKHYCAIRKQFKSRPFQNILEVGFLKEEATGWQAPPRF

SEQ ID NO: 169128 - protein, 102 aa, Glycine max
  Coding DNA Sequence Number=SeqID_77443
MTEHDVYGRDCGSNDFRDYFDDAKESRVKQVPKNQESKSFQNQVSKNQDSRIIKFQDSIKFQESRFKNNQNPDSRLKIQEQSRSRFKTQDSRIKRRLNQDKY

SEQ ID NO: 169129 - protein, 71 aa, Glycine max
  Coding DNA Sequence Number=SeqID_77444
MPISPCRCISWDRAHKTPSGPEEVQQGPGVSSSGYGPLSVLQGARPPSEGSCPQDAQWTRRSPTGPWGFQL

SEQ ID NO: 169130 - protein, 96 aa, Glycine max
  Coding DNA Sequence Number=SeqID_77445
MTLLLSNILPSDRNANLPLQKCQLGSHPQRHPVDLKKSNRALGSPALVTGLCRPYRAPVPPSKFMSSWHRDCARKKPGGPEEGQQGLGGPSSKYGS

SEQ ID NO: 169131 - protein, 67 aa, Glycine max
  Coding DNA Sequence Number=SeqID_77446
MAKMPLPLAECSGVASAISDLAMQGQARARLSKLFRFQMAVLFSNGRALDGVNGYSKWCWRDHAIWI

SEQ ID NO: 169132 - protein, 165 aa, Glycine max
  Coding DNA Sequence Number=SeqID_77447
MKLTDLNEKAPITDCHADASQWFNTHGEISGNTEKGIEGEHEKALPLEVSMPHNNILNITNPSMVYAASGQHDLKVASEEMGQQTCGPTLFAPKLEKSIVDFNPTSKTDPSPSLHEDSIELQCALFKEMGLTYGEDDNKVKGLLLDMENKYNMMAAEKGIKIQQL

SEQ ID NO: 169133 - protein, 155 aa, Glycine max
  Coding DNA Sequence Number=SeqID_77448
  Gene Ontology: Biological process=transposition, DNA-mediated
  Homolog annotation: Hit_ID=Q1J7G7; Match level="QueryCoverage=20%, HitCoverage=45%, E-value=3e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPSHDVVKRRPVNCNTTHYRANWSSTAVAAALELVDPPGCRNSMARNLHLQIPQKECFKSALSKGTFHSVS

SEQ ID NO: 169134 - protein, 255 aa, Glycine max
  Coding DNA Sequence Number=SeqID_77449
MAKPSKKRKGTSIKAFYSNFEIQEGTLMPEVYGIKMVIDQSLFYDLTQLPSEGVPFEGALIDDWKFDFSVHNARRLVCTNQADMTGRLLACSLAFESYILHYLIVRILLPRSSNLAQVSEEDLIVMWAFHKGLQIDWALLVRYRRHKALRLNAPLPYPHLVTLFLQHFNIPLDSEPYVPIKRSFLIGASVIASFGYQKEHDGSWLKKGARHIGEEGHDGEDSSLLSKILDRFDGLQTFVGERFDTLELQVDMHFH

SEQ ID NO: 169135 - protein, 112 aa, Glycine max
  Coding DNA Sequence Number=SeqID_77450
MRTLDTLKFVMLMEKTTRSSWLTRLMPLKSLSVKVPFLGLAGLSSIGKAANDGVYYTSNMLDRFQIWWRLLLMPLLLVSLSASVFCSSSVCLLVPMLLLLMSSGSWSCLVVV

SEQ ID NO: 169136 - protein, 75 aa, Glycine max
  Coding DNA Sequence Number=SeqID_77451
VLEATIKATTEKKMELERLIKRLSESGIDDGEAAEQEDEAAEEEVEAAEEEEEAAEEEEDTAEDTESDDDSEATP

SEQ ID NO: 169137 - protein, 114 aa, Glycine max
  Coding DNA Sequence Number=SeqID_77452
ANWSSTAVAAALELVDPPGCRNSIVYQAYRYRRPRGGARYQLLFPLVRVNFELGVIMEKKGCTGASAEYVIQDIFRLSSLTDSLTLGVRLRRRKWLYNGGGDFLEMPGRYLNRE

SEQ ID NO: 169138 - protein, 140 aa, Glycine max
  Coding DNA Sequence Number=SeqID_77453
  Homolog annotation: Hit_ID=O52175; Match level="QueryCoverage=58%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLKSCAR

SEQ ID NO: 169139 - protein, 161 aa, Glycine max
  Coding DNA Sequence Number=SeqID_77454
  Homolog annotation: Hit_ID=A5AKC3; Match level="QueryCoverage=82%, HitCoverage=13%, E-value=5e-08, Identity=32%"; Hit description =Putative uncharacterized protein
KPYVPPPIQQQQQQQRQQPTEAPPQPSLEELVRQMTIQNMQFQQETRASIQSLTNQMGQMATQLNQTQPQNSDKLPSQTVQNPKNLSDITLRSSKKTEVPPPIAAPTPEPVKLHSTPGKRDKIVAQKRKLPNKFSYRKVKVNIPLLDAIKQIPRYAKFLKE

SEQ ID NO: 169140 - protein, 99 aa, Glycine max
  Coding DNA Sequence Number=SeqID_77455
MFANSPFAKRKPRAKHIFGHALSLESLASEARLTGASSKGGKCTESPPTFICGKHRKNRRKPVIKNIPDSGVVFTFEEGRKKRDSCSYVPSIEEEIRPT

SEQ ID NO: 169141 - protein, 38 aa, Glycine max
  Coding DNA Sequence Number=SeqID_77456
MAPYRILGCLAATFSACSAPGRNDDLSVVTLSSICIRP

SEQ ID NO: 169142 - protein, 85 aa, Glycine max
  Coding DNA Sequence Number=SeqID_77457
  Subcellular localization annotation: CTP_CleavageSite=27; ConfidenceScore=5.18e-01
MVYNNGINLKIPTSHNNSFQNCPMVIQCSMKCPRVPPRYAHVAFESYPQKMEAFSLQNSFLVGVFGFARGGVRHWKCGRQTLWLI

SEQ ID NO: 169143 - protein, 55 aa, Glycine max
  Coding DNA Sequence Number=SeqID_77458
MTTGVEDDVGLFASTGTFAPWLTKGAGNHKITTWGISPCPLTSRVSADRGSLRGR

SEQ ID NO: 169144 - protein, 223 aa, Glycine max
  Coding DNA Sequence Number=SeqID_77459
  Homolog annotation: Hit_ID=Q2HST2; Match level="QueryCoverage=74%, HitCoverage=34%, E-value=2e-07, Identity=29%"; Hit description =Peptidase aspartic, active site
MPKTTLDKLPFNASHMRLSSIVVWAFNGSRRDVKGEIDLPIQIGPHLLVRPTLDPFGWGGSVNAALEIKVYGGGATGYSVKRGRHIEAAEESLETSFQALEIMSSAYVESPSVMPRLSGATLMVARVMLRNRYEPEMGLGRSGDGTTSLVVFAENRGRFMLGYEPTHADKRRIALERKERSLAHLQGRRLQAERVPICHIDKSFVSAGWMCEGQSTMIDKETP

SEQ ID NO: 169145 - protein, 76 aa, Glycine max
  Coding DNA Sequence Number=SeqID_77460
MEKKESYEDNTNGGFNPFSVSPTFGNSIGAVEGKNWRNLKEPLEMLLSLAEDTELYFFDESVDVPMRNAVRLIVLM

SEQ ID NO: 169146 - protein, 118 aa, Glycine max
  Coding DNA Sequence Number=SeqID_77461
MFSKKEGMMRIMKLAKYRLKAQVEKDKGLSGEGQSPRVEKDEGPSNHCGVYPDLSSFTGSGVYPDLSSFTGSGVYPDLSSFTGSGVIQKLYSLYQVIRPVRFTSPLIIITLKIQALQL

SEQ ID NO: 169147 - protein, 420 aa, Glycine max
  Coding DNA Sequence Number=SeqID_77462
MMRAEMDELDRVQFVVELTIEILSIDDAKRQEKMEAIIVLEDMDLAEKGDLEEAMLQSVIEASLAKIKDDIVETDTGTVLVRPRLVFDANEQLIDVVQSNKIDGNIHRHLEEIYRAPKSVSIEVMIEHLEQRKIMPSIQKEPDVTIHPSLNIRLYNGLRGYIVLKWQTCNKVWKEKDDIGSHILHPEMQQLELDKLNLTKLWKEGFLQLSFIGNHRPTERKIYPPCVVVWRSKQAELFWDALLHSTRSSTTLRSNVDDEYGVSTGSYILMLFKHKLESLKQKIEHTSMDCVYHAVRRYYHTLNHLCFTEEISFNMVCPWTREFHVVSDRSFSFVMFYPYSRFTFTHHVKPIIQEVDFDVDTTIDPDALAIEVYDPPPLREYVHLVEVELLNKREALSQALEDRAYVEKEARKWFLIGDYF

SEQ ID NO: 169148 - protein, 276 aa, Glycine max
  Coding DNA Sequence Number=SeqID_77463
  Gene Ontology: Mol. function=pectinesterase activity; Cellular component=extracellular region; Biological process=electron transport
  Homolog annotation: Hit_ID=O23170; Match level="QueryCoverage=97%, HitCoverage=52%, E-value=8e-82, Identity=58%"; Hit description =Pectinesterase like protein
  Pfam annotation: Domain name=Cu-oxidase; Domain location=7-124; Score= 57.8; E_value=3.7e-14; Accession=PF00394.13; Description=Multicopper oxidase
TIRNCLKQLLQNKFWSNSRGVLRRLLDAGTSLPYPDALLINGQQDAVVFIGEAGKTYKFSVSNVGLSTSFNFRIQAHALKLIEVEVTVLVTLSAPISDYTIVASSRFTDPIVLTTTATLRYSGSNSKAPIPLPSGPATNDVEWSIKQARTIRLNLTANAARPNPQGSFHYGTIPILRTLVLANSKAIINGKLRYAVNGISHINPNTPLKLADWFNIPGVFDLNTIKDVPPPPGTPAKLGTSVIGFTFHDFAEIIFQNNENYIQSWHMDGSSFYVVG

SEQ ID NO: 169149 - protein, 198 aa, Glycine max
  Coding DNA Sequence Number=SeqID_77464
MKITILSEEQERIIEPVSHGPASERQFPIQEFHILQSSIETQGIGRRREAVEAEEYSQQMAERGYGMYYMPQTFAQYPTQMYQYPFQGHHIDTSTSEHLFGGVAETHPHFSWLTMTPSQQYHGPIPTPNAPLGTQWNVPGPIPNVGDLLGVDLRHEFSAEANQVEAGRHQGRRNPDRQARRWDRPCGTSSRHHGHQNE

SEQ ID NO: 169150 - protein, 98 aa, Glycine max
  Coding DNA Sequence Number=SeqID_77465
MGPKSTLRLIRTLGSSLASLALGGTLGDYAYQQGSKHYNNIFIPPFSNKGVGNVHDVSSIGACRPRIFFINGFLCFLEDEWQRNGKGRERGDATSRRR

SEQ ID NO: 169151 - protein, 59 aa, Glycine max
  Coding DNA Sequence Number=SeqID_77466
IARQLTVRNTPQQNGVAKRMMQSYPAMALDRRLQEHWAKDAREGLRVLMSLRVDFGPMG

SEQ ID NO: 169152 - protein, 64 aa, Glycine max
  Coding DNA Sequence Number=SeqID_77467
MKMLLIPHDMNGSGMEKGERRRHFKEKMSLEEAHHHRRPWIRTWRKKEMNEGRGREEHGSLCSQ

SEQ ID NO: 169153 - protein, 79 aa, Glycine max
  Coding DNA Sequence Number=SeqID_77468
MDWEKAHIRHMHIWGCVTEARCSNPTSAPDHASSIKRLILIKNRPQIPLVGLNSTRTTLRQTYKHLGYRTLIPRDNMIN

SEQ ID NO: 169154 - protein, 85 aa, Glycine max
  Coding DNA Sequence Number=SeqID_77469
MIWNVLPVYMKFMEFLAKRRNCKEDVFYVIPFAKRKPRAKRIFVHALSRESQALSTQPLHLRLIWSAELAKAELSQLQFDLDLAK

SEQ ID NO: 169155 - protein, 350 aa, Glycine max
  Coding DNA Sequence Number=SeqID_77470
  Homolog annotation: Hit_ID=Q5ZBF2; Match level="QueryCoverage=73%, HitCoverage=39%, E-value=3e-09, Identity=26%"; Hit description =Hydroxyproline-rich glycoprotein-like
  Pfam annotation: Domain name=Transposase_23; Domain location=185-255; Score=-11.7; E_value=0.023; Accession=PF03017.5; Description =TNP1ENSPM transposase
DVQKKAQAIQKQNTAPYVLSRGGYEYLEQKLMAAQSGSTEGVIDPPSLIRRHVKWKLARTKKTGQMTSEAAKEIAEKIGSFVPHRRQDVLTIAIGRLEHHGCVRAAGASVTIKQYFGSAPRTSYSSSSMPPEDLQQLTQQIRDQLEELITKKGLALPPEPEVGPSGACVSTNESCVAPSGNDPETGDSDKYGLYIEENPSRLVALGRLYEGSTAIHNIPLLHGQAKVGVEEVKDAEALVPVPTDEVTSVGQTLNTFLAWPTHLVKRISEHAAVSPAKPPKSPDHEVDDLLYLMTLTIPQLFLKHLQVMWDATMFEVFNQNFPLYIKHKDLSEIAHGGQCLSISIIQLWIL

SEQ ID NO: 169156 - protein, 41 aa, Glycine max
  Coding DNA Sequence Number=SeqID_77471
MHRKGITDEYRRMINASAGGYYANGTTTKVKKPIEDVAMKE

SEQ ID NO: 169157 - protein, 288 aa, Glycine max
  Coding DNA Sequence Number=SeqID_77472
  Gene Ontology: Mol. function=protein serine/threonine kinase activity; Cellular component=integral to membrane; Biological process=protein amino acid phosphorylation
  Homolog annotation: Hit_ID=A3R789; Match level="QueryCoverage=67%, HitCoverage=34%, E-value=3e-55, Identity=55%"; Hit description =Somatic embryogenesis receptor-like kinase 1
MEMGAEYKPDWNSDCTLLMINIGPQISKDSRLNDTSLTGLIPMPLSNITTLQMLDLSNNQLSGVVPDSGSFSLFTPISFNNNLDLCGPVTGHPCPGSPPFSPPPPFVPPSPISTPEGNSATSAIAGGVAAGVALLFAAPAIVFAWWRRRKPQEFFFDVPNTFNNKNILGRVGFGKVYKGCLTDGSLVGVKRLKEERMPGGELQFQTEVEMISMVVHRNLLHLQKKPSVPKKSSKHIEREQPSTSTASIKSKGKDTDVARKCFEPSEVKKWAIDDLNKIIQWLQSQEEK

SEQ ID NO: 169158 - protein, 82 aa, Glycine max
  Coding DNA Sequence Number=SeqID_77473
MVVKKGVKKLFSHKFEEKKPNEDEARWGNVQGDSHKFEEKKPNEDEARWGNVQGDRQFTFLGDRNMLDGVVITNEVIQEENR

SEQ ID NO: 169159 - protein, 59 aa, Glycine max
  Coding DNA Sequence Number=SeqID_77474
MGRQYHAGLEKGWEDKDGTGGYGKDNLHHSMGNLLLQGDVICAEERWGKIPVGHGGAIP

SEQ ID NO: 169160 - protein, 80 aa, Glycine max
  Coding DNA Sequence Number=SeqID_77475
MVFKSDSDPPSPRSTKLMASLANQMDKLQRNKHSRVEWENGRHGEEEDIGHLILLKEVMMAMKKVEGIGIGGIGMEWIGR

SEQ ID NO: 169161 - protein, 98 aa, Glycine max
  Coding DNA Sequence Number=SeqID_77476
MCPLSFRSSESSGKRAETNFAPFIIQEQQVGWFYWKGGSLAEWCFARTKIVSYLYFPFISHKRQVKRGDCHTLILSGGPSIVGIRLSFDHFEVFGTHR

SEQ ID NO: 169162 - protein, 123 aa, Glycine max
  Coding DNA Sequence Number=SeqID_77477
  Homolog annotation: Hit_ID=A7PI78; Match level="QueryCoverage=41%, HitCoverage=20%, E-value=2e-09, Identity=61%"; Hit description =Chromosome chr13 scaffold_17, whole genome shotgun sequence
  Subcellular localization annotation: CTP_CleavageSite=55; ConfidenceScore=5.11e-01
MEDQCGGNGKHMNTNTNSNGYVDTSKAERAVWLMKCPPLVSRSLRAPPSDPSRPVAKVVVSIDPLNSNDDDSPPQFLLAVVYFPSSTKKRALARVQVLLMGKKSDWEKRSSEGPDSSPAEINH

SEQ ID NO: 169163 - protein, 102 aa, Glycine max
  Coding DNA Sequence Number=SeqID_77478
MEDLFKRWTEHLDNIHSRVNQTPLITCDFCGREHTNSLCHLYFTNNSRWGQESSPYDQHEERGTPNLESVFEEFMAYNASSNENQNVMNNQEIDVAKSYSIN

SEQ ID NO: 169164 - protein, 218 aa, Glycine max
  Coding DNA Sequence Number=SeqID_77479
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=91%, HitCoverage=14%, E-value=1e-102, Identity=93%"; Hit description=DNA -directed RNA polymerase subunit beta''
  Pfam annotation: Domain name=RNA_pol_Rpb1_5; Domain location=20-218; Score=-71.5; E_value=2.6e-06; Accession=PF04998.8; Description=RNA polymerase Rpb1, domain 5
MSDPQGQMIDLPIQSNLREGLSLTEYIISCYGARKGVVDTAVRTSDAGYLTRRLVEVVQHIVVRRTDCGTIQGISVNTQNGMMPERIWIQTLIGRVLADDIYRGSRCIAVRNQDIGIGLINRFKTLQTQPISIRTPFTCRNTSWICRLCYGQSPTHGHLVELGEAVGIIAGQSIGEPGTQLTLRTFHTGGVFTGGTAEQENHTGPVQSLFQSEKIKIK

SEQ ID NO: 169165 - protein, 484 aa, Glycine max
  Coding DNA Sequence Number=SeqID_77480
  Gene Ontology: Mol. function=catalytic activity; Cellular component =integral to membrane; Biological process=potassium ion transport
  Homolog annotation: Hit_ID=Q1GZJ9; Match level="QueryCoverage=99%, HitCoverage=85%, E-value=1e-162, Identity=56%"; Hit description=TrkA- N
  Pfam annotation: Domain name=TrkA_N; Domain location=213-323; Score =73.2; E_value=8.8e-19; Accession=PF02254.9; Description=TrkA-N domain
  Pfam annotation: Domain name=TrkA_N; Domain location=49-170; Score =81.4; E_value=3e-21; Accession=PF02254.9; Description=TrkA-N domain
  Pfam module annotation: Pfam domain module=TrkA_N::TrkA_N; Domain location=213-323::49-170
MTFSIYMTVISWFYAIGAIIALFQESALKQALKTAIFQRDVRNLMEPFYLICGYGETGGELVRALDRNELRVVVLEIAPERINELEMTDYQFNIPHLCADAKLSEVLLFAGIKNPMCRGVAALTDDDHANLAISVAVKLIKPDLPVLARVQDDVIAANMASFGTNRIINPYHIFGEHLAMRLNALGTYLLHEWLTRAPGDAIATPAAIPQGQWIACGYGRFGKSVVSSLQNENMQVTIIEADPEGTQCDDCIIGSGVEAHVLQQAGVEHAVGIVAGTDNDINNLSIVMTALELNPDLFVIIRKNKRHNDPLFQHFNADITMQPSDVIAHTCLAYMVSPMLAEFLTIARHKGNQWANAVIAQLVSKLGEQVPDTWDITIADDMAIAVCAMMEQGLQPALKHLMMSPAGQQRREMPVVPLMLVRGDQEMLLPELSTPLQIGDRILCCGLDQAKSIQRFVMHDVKTMHYLVTGSEMPETWIGRWLKQ

SEQ ID NO: 169166 - protein, 57 aa, Glycine max
  Coding DNA Sequence Number=SeqID_77481
MHALSATVALSIWLPVREKHQLQCPRHDMADQDSHHKMPGTNTQTMSLAKRSFRKGM

SEQ ID NO: 169167 - protein, 143 aa, Glycine max
  Coding DNA Sequence Number=SeqID_77482
WPLGKGNQPPLDLRNQYDEFCWELERTRWHKALTRQPDGRIDVALVKDFYANLFDPEDKSPRQVRVRRKLIKFDREKLNAFLETSVVLEPRERYSTYSRFCHSQPDPQELVVRLCIPGRGFVLNVEGAPWKLQRKDLTTLVQT

SEQ ID NO: 169168 - protein, 155 aa, Glycine max
  Coding DNA Sequence Number=SeqID_77483
MSNSHRCVRQRRLDKESTCPQAGRKADLAQLIAAQRVAVNRETGGQREQKLRETAMAKAVHQCDILSYERLNRQARAAIKNPPQRVYCRPGRASKTAAVAPPGVGGQRLAEVAGDKALGQFVQRRRQHLGGAAAFDDFSFVHHQHLVADMLHHAE

SEQ ID NO: 169169 - protein, 93 aa, Glycine max
  Coding DNA Sequence Number=SeqID_77484
MAFWITGWKEEEGLLLAKKYMWGGGEFAVPHWQSQHAFLPPSHSLHLPHFLIRPSRRIKFASLADPLRPFPRRRPNPQSLMVRTPPFFIVEHC

SEQ ID NO: 169170 - protein, 179 aa, Glycine max
  Coding DNA Sequence Number=SeqID_77485
  Homolog annotation: Hit_ID=A5C4I3; Match level="QueryCoverage=22%, HitCoverage=16%, E-value=2e-11, Identity=82%"; Hit description =Putative uncharacterized protein
MAARALGVPRHLRAPGVGLWAPHSARLETRTKESDMCASQRASKPVRRKEADWWDPPVVAPPTDPDLLKLWWRPAAILTIAGARGRVLSGRCGCSVEPRHGIESSKWAIFGKQNWRCGMNRKLGYGAQLRANLDPTKGVGRLRQQDGGHGSRNPLRTPMSRRSRRSLQNPGREPGGAVV

SEQ ID NO: 169171 - protein, 88 aa, Glycine max
  Coding DNA Sequence Number=SeqID_77486
MMITKDDDKGDDKKLKDQSKNNSSESKINQRTIHEFKIRIKKNSRLKKKVYSQESRFKVQDLKNQDQDSRIKRRLNQDKYEKFFSKIE

SEQ ID NO: 169172 - protein, 147 aa, Glycine max
  Coding DNA Sequence Number=SeqID_77487
  Homolog annotation: Hit_ID=Q6UUU1; Match level="QueryCoverage=40%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPGNYRLESNPERHAKAPLGSSH

SEQ ID NO: 169173 - protein, 99 aa, Glycine max
  Coding DNA Sequence Number=SeqID_77488
MEEGFSHGSVPIILGGSFMKTARTKIDVYVGTLSMEFGDIVVHFNILDAMKHPFEDHSVFRVEIIDQIVDDYMFDLDFVLHELECSNHVAGITYTSNLL

SEQ ID NO: 169174 - protein, 152 aa, Glycine max
  Coding DNA Sequence Number=SeqID_77489
  Homolog annotation: Hit_ID=UPI00006A2D9E; Match level="QueryCoverage =94%, HitCoverage=95%, E-value=8e-10, Identity=18%"; Hit description =UPI00006A2D9E related cluster
GLHALAFRGLHVLTFRGLHALTFRGLHVLAFRGIHALAFKGLHVLAFRGLHALAFRGLHALTFRGLHALTFRGLHVLTFRGMHVLTFRGLHICAFKELKGDQMCEHNLRGGGYHTTIMHTGARFHPCRCKETSADRAHQHDHSYTDMDDIAT

SEQ ID NO: 169175 - protein, 131 aa, Glycine max
  Coding DNA Sequence Number=SeqID_77490
  Gene Ontology: Mol. function=RNA binding; Cellular component =ribonucleoprotein complex; Biological process=regulation of transcription, DNA-dependent
  Homolog annotation: Hit_ID=Q2YPW7; Match level="QueryCoverage=59%, HitCoverage=16%, E-value=2e-31, Identity=89%"; Hit description=NAD binding site:TrkA-N:TrkA potassium uptake protein:TrkA-C
  Pfam annotation: Domain name=LSM; Domain location=66-119; Score=38.0; E_value=3.5e-08; Accession=PF01423.13; Description=LSM domain
  Pfam annotation: Domain name=TrkA_C; Domain location=4-72; Score =67.7; E_value=4e-17; Accession=PF02080.12; Description=TrkA-C domain
  Pfam module annotation: Pfam domain module=LSM::TrkA_C; Domain location=66-119::4-72
MAELIEAEALETSSLVGAPLRDLDLPEGLRIGAIYRDGQVIRPNGDVRIKPKDRVVIFATSDAVKHVEQMFRKISLTIFLINGVKLTGIVTSFDNFCVLLRRDGHSQLVYKHAISTIMPSQPVQMFEGEEA

SEQ ID NO: 169176 - protein, 95 aa, Glycine max; identical to SEQ ID NO: 109893
  Coding DNA Sequence Number=SeqID_77491
  Homolog annotation: Hit_ID=A0PAV3; Match level="QueryCoverage=40%, HitCoverage=17%, E-value=5e-07, Identity=76%"; Hit description =Restriction endonuclease

SEQ ID NO: 169177 - protein, 72 aa, Glycine max
  Coding DNA Sequence Number=SeqID_77492
MDEYFRVSNYKNAKEMWDTLQEHKMELMRLNQHEENDKKKKGMTLKVLSSFQEESDKEDLNEVEEMMISVSS

SEQ ID NO: 169178 - protein, 595 aa, Glycine max
  Coding DNA Sequence Number=SeqID_77493
  Gene Ontology: Mol. function=dipeptidyl-peptidase activity; Cellular component=membrane; Biological process=sulfur metabolic process
  Homolog annotation: Hit_ID=Q88HX5; Match level="QueryCoverage=48%, HitCoverage=89%, E-value=2e-81, Identity=55%"; Hit description =Periplasmic aliphatic sulfonate-binding protein, putative
  Pfam annotation: Domain name=NMT1; Domain location=32-232; Score= -35.4; E_value=2e-05; Accession=PF09084.2; Description=NMT1THI5 like
  Pfam annotation: Domain name=Peptidase_M19; Domain location=310-593; Score=239.4; E_value=8.1e-69; Accession=PF01244.12; Description =Membrane dipeptidase (Peptidase famil
  Pfam annotation: Domain name=SBP_bac_3; Domain location=26-242; Score= -71.4; E_value=0.0029; Accession=PF00497.11; Description=Bacterial extracellular solute-binding proteins, family 3
  Pfam module annotation: Pfam domain module=NMT1::Peptidase_M19::SBP _bac_3; Domain location=32-232::310-593::26-242
EMIMKRVTLTMLLLASGSVAAHGVTLRIADQKGNMRAELEAAQKLNDLSYRIEWAEFPAAAPLAEALNAGAVDAGIIGDAPLLFSLAAGSQVKAVAVSKSTPAGLAVLVAPDSPIKMPRDLRGKRIATGRGSIGHFIALKALESAGLSDKAVSWRFLTPADARIALASGSVDAWATWDPYTALAEVTHTGRVLINGVGLSSGNSFLAATDAALSDASKRAALQDYINRLAAADRWANRHVEAYSARLAKIIGFPQEAAAKSFARRQSHWQSIDDHTVQQQQETADFYQKYGLIAQPLDHGGIKSVADNPMLIKTFDGHNDLLLNLWLHHRDDPAAAFFTGIEKGHLDFPRMQQGGFAGGLFALFVPPQRYVSEVAPQLAGEAWQPLEILWQQLEILKTLVARSDGRARLCLSTADIAACRRDGVLAMVAHIEGADGFDGDGADLAAFWQAGVRSIGPFWIWKIALALASPAHFPVRRIARMMIDVSHMNEKAFWDTARLSSAPLVASHSNAHALCAQPRNLTDDQLRAIRDSGGVVGINFGNAFLRADGKRDHDGGLIEMVKHCEHLMTIMGSDHVALGSDFDGIIVPAELKDVT

SEQ ID NO: 169179 - protein, 266 aa, Glycine max
  Coding DNA Sequence Number=SeqID_77494
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSVPKKLLLKASIYECYMLARGYTATSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169180 - protein, 372 aa, Glycine max
  Coding DNA Sequence Number=SeqID_77495
  Homolog annotation: Hit_ID=Q6WAY6; Match level="QueryCoverage=82%, HitCoverage=63%, E-value=5e-17, Identity=23%"; Hit description =Putative uncharacterized protein
MANQDEWVPFMDALALLIFGVVLFPNVDGLVDLAAIDAFLAYHHSKESPVVAVLADLFDTFDRRVDWDQHLAGIGGRTVNWFPRWKEGNKGVLFSCGGYPSIPLIGTRGCISYNPSLAIRQLGYPMRGALTEESLSPFLVRDFGAQNFKGKIKELRGIRNGIIGGYHEWLKVHTRGLDWLSKLKMINEENFEALEEDEEVRALKTELGKARLVKEKFKLVATDVWKECAELREENAATARALEQETKRARKEEHGRDKFQGALWGSNSELKLRREERDQSRAHSMVLKEELAACSRSKRNLSQRLCETETNMLAIVSKYQEELNLATAHEHKVVDEYAQVYVQKEARGRVIDSLHQEATIWIDRFALTLNGS

SEQ ID NO: 169181 - protein, 118 aa, Glycine max
  Coding DNA Sequence Number=SeqID_77496
  Subcellular localization annotation: CTP_CleavageSite=8; ConfidenceScore=5.29e-01
MVGIRRFSCSAYGGSRNPRALENLALPLLFVTVKSLFSFSSRLKTAGNRSLDTHIVLAQTHRTPNTAGKPTFSSLEPTEPPTLFLEVWLKENPTYTVATRVLKQSWVLKAQSFLREYC

SEQ ID NO: 169182 - protein, 141 aa, Glycine max
  Coding DNA Sequence Number=SeqID_77497
MAKVDPDIVLEFYANAWPTEEGVRDMRSWVRDMPPTRHPLDPDKSNKALGFPALITSLCQSFGVPVTPSKVIRPPITRAFIEKYCMPRQAQGDAPQAASAPPPPHQADPAGSFGMEQYLQHLVRQQAANHRGQVQIHECLY

SEQ ID NO: 169183 - protein, 30 aa, Glycine max
  Coding DNA Sequence Number=SeqID_77498
MAGMPPTRHPLDPDKSNRALGFPALIMGLC

SEQ ID NO: 169184 - protein, 102 aa, Glycine max
  Coding DNA Sequence Number=SeqID_77499
MGCIHYNLVLSIRQLSYPMRRVPSEESITPFITRGFGDPNVKILQGVWKACGAMQRNDKELRESSNGITNGYHKWLRVQTKELDWLPKLKAAREEQAETPEK

SEQ ID NO: 169185 - protein, 42 aa, Glycine max
  Coding DNA Sequence Number=SeqID_77500
MEVHLCISAESRAAAKPMVTDYRTASKSFYNKLENTTTSTAS

SEQ ID NO: 169186 - protein, 108 aa, Glycine max
  Coding DNA Sequence Number=SeqID_77501
  Gene Ontology: Mol. function=transferase activity; Cellular component= chloroplast; Biological process=glycolysis
  Homolog annotation: Hit_ID=A7NSW0; Match level="QueryCoverage=67%, HitCoverage=14%, E-value=3e-20, Identity=71%"; Hit description =Chromosome chr18 scaffold_1, whole genome shotgun sequence
MEEDQRGLVFGNGKRSVVAIDGGLYENYPQYRAYLQDSVIELLGTEKSFCNVVIEHTKDGSGIGAVVLATSNSMKRQANLISPVKAPSFPTQEFWAEISILSEIEFFT

SEQ ID NO: 169187 - protein, 407 aa, Glycine max
  Coding DNA Sequence Number=SeqID_77502
  Gene Ontology: Mol. function=DNA binding; Cellular component=nucleus
  Homolog annotation: Hit_ID=A7PI75; Match level="QueryCoverage=34%, HitCoverage=8%, E-value=6e-13, Identity=33%"; Hit description =Chromosome chr13 scaffold_17, whole genome shotgun sequence
MSVNSVIEETRKRPRLNWGEGLAKLEKKKTKGDGVSATTIATTDSGAFSSFTGSLLSCQQLVTPGITHRDIEDGTYEWTNEKTAFLQVVLSFGENFRMTAWHVGIKSKDQCKKFSIKGQKSHRLDLMRHRLENIGSLLNEINHGRSTNNNDACIEEADSIIDNDKLGIKTNDDQPSSAVNLSHDKSKPMEARNLSVDFKEIDREFDHQDKNMISNTYNWESKLVDTNGCGVVLFNFDKSSSVKDKRDTTMTDIMEVRKDKVGDAFTKLVLSASEIIEPCYSYSVAEDRLSVMLTSFPTWLDDKDGKNGGDIDDDAVELKNQSHDSNTKVNTCLSSVVVSCSTLTFGVENQPKLFLKNSSYSGPSMEDPLPTSNSMLQNTASVVHAIQKEKSTTRNGLSLKEPVKKQV

SEQ ID NO: 169188 - protein, 64 aa, Glycine max
  Coding DNA Sequence Number=SeqID_77503
MSTFIMPTLFLLLFIVFNIGPRTPGGGGGGGGGATHQFPRELGQGSCSGYCITFQSPRDPRHKF

SEQ ID NO: 169189 - protein, 80 aa, Glycine max
  Coding DNA Sequence Number=SeqID_77504
MSFLESNPVDNKEKIEPRPTADSIADGLGFSFDASDSTPIQPRNGIKALPPLTRLSKKQMVKSRPTKAYGNTNSRIADID

SEQ ID NO: 169190 - protein, 39 aa, Glycine max
  Coding DNA Sequence Number=SeqID_77505
MYKDKWAPPCGGCRPWIFVINGVLSFLKMNGSIMEKEER

SEQ ID NO: 169191 - protein, 235 aa, Glycine max
  Coding DNA Sequence Number=SeqID_77506
KKKKKKKKKKKNYERESSSSKRHIDDVLSTPSHANFMNTREKLNSKEQCHDNNKKKNYEREESFGWKPLNKGNDTSERFYSQSMGKGLAKFDKKKSEGDGASTVTAATPSFGACNSFSELFTHEEGIATCPLAGARKRALVWAKGASSIEGTRMESPPIFIRGKRRKNQKDDSLRILKMRSTRGVSLAHMYPQIDFNRTKVVGPLNNLLILEKGESFVKALYPLNDLLILEGEKR

SEQ ID NO: 169192 - protein, 60 aa, Glycine max
  Coding DNA Sequence Number=SeqID_77507
MMITKDDDKGNDKKLKGQSKNEFKMFKIESRTPRGKLNSRIKIQEIKVQDSRLFKNQEKD

SEQ ID NO: 169193 - protein, 62 aa, Glycine max
  Coding DNA Sequence Number=SeqID_77508
MRCLRMSSGLPSPDDERVVRITMRCLRVSSDLASLDDERVADDHDWSPRVNGLAFLWLVKVW

SEQ ID NO: 169194 - protein, 121 aa, Glycine max
  Coding DNA Sequence Number=SeqID_77509
  Gene Ontology: Mol. function=binding; Cellular component=protein complex; Biological process=protein catabolic process
  Homolog annotation: Hit_ID=A7PJ89; Match level="QueryCoverage=80%, HitCoverage=40%, E-value=6e-31, Identity=68%"; Hit description =Chromosome chr12 scaffold_18, whole genome shotgun sequence
MLHACLDIKAIMLGKYHYVLYFLVLAMQPRMLWIVDENLKPLSLPVCVGQAVNVVGQAGHPKTITGFQTHYTPILLCVGDRAKLAMEKYLPLSPILEDAEKGRGYLLRVAATGSTQSEGKP

SEQ ID NO: 169195 - protein, 248 aa, Glycine max
  Coding DNA Sequence Number=SeqID_77510
  Gene Ontology: Mol. function=transferase activity; Cellular component= intracellular; Biological process=metabolic process
  Homolog annotation: Hit_ID=A7PAI6; Match level="QueryCoverage=49%, HitCoverage=42%, E-value=1e-37, Identity=46%"; Hit description =Chromosome chr14 scaffold_9, whole genome shotgun sequence
  Pfam annotation: Domain name=PPR; Domain location=154-188; Score =32.7; E_value=1.4e-06; Accession=PF01535.11; Description=PPR repeat
  Pfam annotation: Domain name=PPR; Domain location=189-223; Score =28.4; E_value=2.7e-05; Accession=PF01535.11; Description=PPR repeat
  Pfam module annotation: Pfam domain module=PPR::PPR; Domain location =154-188::189-223
MLRNELELMNKSLEESEAQLQGRTVESNELVSQIALLKKEAKRSLDELNRMKNLKYEKELAGRVLQSELEALRTQYNDLKSYLLGDEAEKENVRKQVFQLKDYNKFYEAFSNNLKLGLDEDSQNKTKLAELLRIRDANKVLNEMTESKIEAQNITCNTLINAYYKFGELKSALKFKNKLLEAGLKRDPFTYKALIHGFYKMNELERANELMFSMVDAGFTPSYCTFSWIGDGYNKKDNMDAVLALPDE

SEQ ID NO: 169196 - protein, 132 aa, Glycine max
  Coding DNA Sequence Number=SeqID_77511
MWIVFRFQQNGNQPILKRGRMYHGQKSNFRCDLSDLVEIIHKVVKLMDNLQSRGALREVLPNANSTGEDVIPDDNEHENHVEEVGNSQVGLEPMGATNSEHVNEDMLDGTNDFSEDEQLHAYNEVDFKVSTL

SEQ ID NO: 169197 - protein, 149 aa, Glycine max
  Coding DNA Sequence Number=SeqID_77512
METTTLETGREWSEGGARREREMRGGHFIGHIALSAISTGSGELLNHRSEVVGVGGENGASIDLLLLVLLMKMGGFHGRCNWVQIFGLDSLSLRRNYGDLGGILRESGGDVESQASCNDDCQTDVEYVIYEDGCLIKPVFEKRTFCIGY

SEQ ID NO: 169198 - protein, 76 aa, Glycine max
  Coding DNA Sequence Number=SeqID_77513
MAAEWRRKRERRRHFKEKMSLEETHHHRRPWIRAWRKKEMNEGRGREEHEILCSKRALKSEPTNPRSIPRFSTKCA

SEQ ID NO: 169199 - protein, 41 aa, Glycine max
  Coding DNA Sequence Number=SeqID_77514
MAEEPRRKYFPELKTAEGKATISSFHQFLDESLSEALERFR

SEQ ID NO: 169200 - protein, 34 aa, Glycine max
  Coding DNA Sequence Number=SeqID_77515
GTSFVVQVEGISTWVVVTENKRGYDAILPRKGIG

SEQ ID NO: 169201 - protein, 76 aa, Glycine max
  Coding DNA Sequence Number=SeqID_77516
  Homolog annotation: Hit_ID=A7PW56; Match level="QueryCoverage=44%, HitCoverage=6%, E-value=2e-08, Identity=82%"; Hit description =Chromosome chr8 scaffold_34, whole genome shotgun sequence
MDVRDKEQVISRMKAVVANKQFGQEDIICSLVADLRFRLPWPTDAILPKRRPITRAMLGDSKKIGLEMQKKTLGFS

SEQ ID NO: 169202 - protein, 63 aa, Glycine max
  Coding DNA Sequence Number=SeqID_77517
  Subcellular localization annotation: CTP_CleavageSite=34; ConfidenceScore=5.06e-01
MASSRFNFENFMPTLYCHCPATVLLNPNNTSEVRERRKAVKQVRSCASSGAHRCYSRRPSARV

SEQ ID NO: 169203 - protein, 164 aa, Glycine max
  Coding DNA Sequence Number=SeqID_77518
  Gene Ontology: Mol. function=DNA binding; Cellular component=nucleus; Biological process=regulation of transcription, DNA-dependent
  Homolog annotation: Hit_ID=A7QNQ9; Match level="QueryCoverage=78%, HitCoverage=29%, E-value=4e-38, Identity=64%"; Hit description =Chromosome undetermined scaffold_133, whole genome shotgun sequence
  Pfam annotation: Domain name=Bromodomain; Domain location=1-51; Score= -15.7; E_value=0.062; Accession=PF00439.16; Description=Bromodomain
MDFSTIKNQMEAKDGTGYKHVREICADVRLVFKNAMKYNDERSDVHVMAKTLLSKFEEKWLQLLPKVTEEETRREEEEAEAQLALQVAQEAAQAKMARDLSNELYEVDVILEELREMVVKRFSLCSPEIVFQPYMTENAYHYAKNIAVSGGTTHNTLHQTWPLP

SEQ ID NO: 169204 - protein, 275 aa, Glycine max
  Coding DNA Sequence Number=SeqID_77519
  Homolog annotation: Hit_ID=Q6WAY6; Match level="QueryCoverage=95%, HitCoverage=51%, E-value=2e-33, Identity=33%"; Hit description =Putative uncharacterized protein
STEAIASLAQYYDQPLRCFTFGDFQLSPMVEEFEEILGCPLGGRRPYLFSGFYPSLARISKIVQISAHELDHRKQVENRVVGIPRKYLEAKARILASKGEWAPFIDILALLIFGGVLFPNVDGLVDLATIDAFLAYHNHKESPYKDCLQYEDRSCTEKGGTNCDQLLANKEGASINWFPRWKEGRTRVLILCGGFPNVPLMGTRGCINYNLVLAIRQLGYPMRGAPLEEEIAPVISRGFNKTNVETLQKVRKAWEVVQKKDKELKGSNNGPIGGY

SEQ ID NO: 169205 - protein, 111 aa, Glycine max
  Coding DNA Sequence Number=SeqID_77520
MAKHMDKSGRRMSCIEALSEGQLAKHTVFTFRLIFGYGETERELSLTRKASCGALDEILRDCEEASLLWRAKPSVGSSYGVLDYSILVCLCLDHALPCLVRGTHIGKWFNP

SEQ ID NO: 169206 - protein, 100 aa, Glycine max
  Coding DNA Sequence Number=SeqID_77521
MGLEIYAEVHENHRAFFNGSSPILLEPLAHGSSGWSLPREDCIINYNNSRVQDKNQEEFKTQEESLETRIKIQGSRSQESRSRFKTQVSRMKRRLNQDKY

SEQ ID NO: 169207 - protein, 122 aa, Glycine max
  Coding DNA Sequence Number=SeqID_77522
CLKLGNLTLFNEQVVVSLAKPPPKPNPEVDDPLYLMTLTIPELFLRPYQVTWDATVFGVFNPDFPLYIKHEDLFEIAHGGQCLSISVLQLWILHLTETCMRAGNSDIYEFLEPQSIQRSGQS

SEQ ID NO: 169208 - protein, 181 aa, Glycine max
  Coding DNA Sequence Number=SeqID_77523
MPGILSRLNATIYCRIREAITRQQGVPTSLYRSSALPLCSLTSSHTLHTKSMITASHSNAMLGDVYAYGLISGRGSVRDFTKPAVGCLRGSVNLRRLQPLYGPLSFGCSTFDANRRIRDSSLLHGSWLKNFSASSSACYSAGAAHAVSFDGSPPDEQLANSSFSPDPYVIVVLNILNSISP

SEQ ID NO: 169209 - protein, 161 aa, Glycine max
  Coding DNA Sequence Number=SeqID_77524
  Gene Ontology: Mol. function=motor activity; Cellular component=cell projection
  Homolog annotation: Hit_ID=UPI00016621D1; Match level="QueryCoverage =82%, HitCoverage=40%, E-value=2e-14, Identity=37%"; Hit description =UPI00016621D1 related cluster
MTTRPYLQRTAHPHLQRTRRLHVLTFSELHVLTLRGLHALPFGALHILTIRGLHVLVFGGLDVLGFRGLHALTFRGLHVLTFRGLHSLPFGGLHVLTFRGLHVLTFRGLHALAFGGLHILTFRGLHALTFRGLYVLAFKELHALTFRGLHVLALRTTCPHL

SEQ ID NO: 169210 - protein, 78 aa, Glycine max
  Coding DNA Sequence Number=SeqID_77525
MGCSKKMLTSPLEFAKRNLQWLRTRKNPEEDELSSSLSAPLQVIKRTASSHPLSETSGLSQNPLMCAKRFRSALSARA

SEQ ID NO: 169211 - protein, 493 aa, Glycine max
  Coding DNA Sequence Number=SeqID_77526
  Gene Ontology: Mol. function=acyltransferase activity; Cellular component=integral to membrane; Biological process=metabolic process
  Homolog annotation: Hit_ID=A8AR40; Match level="QueryCoverage=41%, HitCoverage=84%, E-value=2e-88, Identity=80%"; Hit description =Putative uncharacterized protein
  Pfam annotation: Domain name=Acyltransferase; Domain location=253 -376; Score=79.0; E_value=1.6e-20; Accession=PF01553.12; Description =Acyltransferase
  Pfam annotation: Domain name=PP-binding; Domain location=419-491; Score=10.0; E_value=0.049; Accession=PF00550.16; Description =Phosphopantetheine attachment site
  Pfam module annotation: Pfam domain module=Acyltransferase::PP -binding; Domain location=253-376::419-491
EQWQQWSRYSHTIDPAAPAAKLNELPMMTARRLSSGSKLAVECGLAMLRRHEIDAVLYTSRHGELERNYRILHALAMEQAVSPTDFALSVHNSAVGNLTIAAKKPIASSSLSAGRDTFQQGLYEVMGLLQAGYQRVLMVDFDGFLPEFYHSQLPTAMPTWPYATAWVIESGGEWQCQAERYDAVPESPLPQSLLFLRHYLQNSPAHDAAFPTVKSPVARGDDRILFRTVWRRWAAAVTDLVQSAADRTVGVLDYQIKGREILRQERGCLVVANHPSLIDYVMLASVMPETDCLVKSALLKNPFVSGVIRAADYLINDRADTLLPASRQRLQQGDTILIFPEGTRTAPGEKMQLQRGAANIAVRCGSDLRVVVIRCTEHMLGKQSKWYDPPRTKPLFTVEALRLKQELMMEALYLEIKNLIISTLNLDELSADDIDTDAALFGDGLGLDSIDALELGLAVKKQYGVVLSAESEEMRQHFFSVATLASFIQAQRA

SEQ ID NO: 169212 - protein, 189 aa, Glycine max
  Coding DNA Sequence Number=SeqID_77527
MPSPSEDYTSSPLEDYTSSPSEDYMFPIFKGGHALTFGGLHVLAFKGSCTFNFRGLHVLAFKGSCTFNFRGLHVLAVKGSCAFTFVGLHALTFRGLHVLTFRGLHVLAIRGLHVPHFQRGACPHLRRTTRPRLQRVMYLQLQRTTRPRLQRVMYLQLQRTTRPRRQRVMCLHLCRATCPHLQRTTRPHL

SEQ ID NO: 169213 - protein, 226 aa, Glycine max
  Coding DNA Sequence Number=SeqID_77528
MEAMKDQMTSMMEAMLSMRRIMESNAAIDAATSATTEADSTHPSDINQTSCPIPYMIGQGGENKNSFPPYRLPPNYTPPNVVHVPNENAYHSVLVPLEGQQPQLGHEPFAQPMGEAREEPRDHPLGEFKPYPTYATKGPVVSGMPQPNVAGAPQRHLLQPLYFLVGKLPLAMEEREKLNLIEERLRAIKEVGDYPFADMAELYLMPDVVISPKFKVPDFNKYKGTT

SEQ ID NO: 169214 - protein, 239 aa, Glycine max
  Coding DNA Sequence Number=SeqID_77529
  Homolog annotation: Hit_ID=Q2HW90; Match level="QueryCoverage=68%, HitCoverage=36%, E-value=5e-14, Identity=31%"; Hit description =Putative uncharacterized protein
ESPVVAVLADAYDTFDRRCEKSSMRIVCCTPALYVWLVSNIFLHESRPDCPLQGHRMCAEKGKANWEQLLAGFPNVPLMGTRGCINYNPILAIRKLGYPMRGVPLEEIITPFIARGFYEGNSNVLQRVQKAWNAVERKDKELRVSNNDVIGGYHKWLKARMQGITWLPKLKISSGEEAEVPEESEKVQALKAELERTVRKECDEMRDANMDIIEGRVEVGKYDIRGQVKGLSKVEEELD

SEQ ID NO: 169215 - protein, 52 aa, Glycine max
  Coding DNA Sequence Number=SeqID_77530
MKGGSKIFPGDITTIWLAMRDGKRSSYVIGIRGEFLRWPWGKVPCRIGTDAK

SEQ ID NO: 169216 - protein, 155 aa, Glycine max
  Coding DNA Sequence Number=SeqID_77531
MASRKRKATAFRPQPHYDTHRFTSEDAWNRYADNVLGRIILSERNVKLFVIEFDEFRTELVRRNWHKMLTNLMEGSIDVALVKEFYAYLYDLEDKSPKQGKVGLWISDEDGHEGWIPHLWTDHSHGLVQLLEARISCPYHFLMNRPRSHFRFSNF

SEQ ID NO: 169217 - protein, 86 aa, Glycine max
  Coding DNA Sequence Number=SeqID_77532
MYHGKEFIRTQDTVHLIANHFAKRMLLAKRIIFHALSHEFQALSAHPWYLRLIISAKLAKVKLSPNQFELNSAKRQTNVLAMASLG

SEQ ID NO: 169218 - protein, 66 aa, Glycine max
  Coding DNA Sequence Number=SeqID_77533
MSGRSSTRQFPSRKPGGHGRTNSDPLGESSSHIATTWPSCPRPALIKLLLMWQGGPPLTSCPNREP

SEQ ID NO: 169219 - protein, 176 aa, Glycine max
  Coding DNA Sequence Number=SeqID_77534
MTTLTQIWMTLLISNILPSDHNSNLPLPKCMAPTRHPLDPDKSNRALGFPALITGLCQSFGVPVAPTKAASAPPPPHQAGPTGSFDMEQYLRHLVRQQAANHRAHVQTHDCLYQLSLSMQSQGFASFSCPTPDQFRAEVAWPGDWPEAQAGEASPEAPGDGEEAHEDEEMVDLLDF

SEQ ID NO: 169220 - protein, 98 aa, Glycine max
  Coding DNA Sequence Number=SeqID_77535
MTKLKKTLSPETKTVAPKWIEVKQQFSAAIVPPSLPLQQLSEQMKCPQSLDGCLVEMILSFDLAFAWIPLLKFSSSKVTSSTSIEERLQGFQGKGTRG

SEQ ID NO: 169221 - protein, 36 aa, Glycine max
  Coding DNA Sequence Number=SeqID_77536
ELEEGLVPSLEEFESRSKGSTTLRAIGLDRGRTRIK

SEQ ID NO: 169222 - protein, 138 aa, Glycine max
  Coding DNA Sequence Number=SeqID_77537
MSESDDMREVLYGYLHLSSSRDGEFDDMWGDNEFDDMRGYLMIICTFCQPEASKSVDTQRLTSSSAPFVNQGDGESDDMRGYLMIIRTFCQPEASKSVDTQRLTSSSAPFVNQGFYFRHAETFKPDDAQDSSLLGGND

SEQ ID NO: 169223 - protein, 56 aa, Glycine max
  Coding DNA Sequence Number=SeqID_77538
PPNQSQKNDDLEPVHRWIVVKFEYHVRNTIPSILTVGNFDIMSDQAYRYRRPRGGA

SEQ ID NO: 169224 - protein, 115 aa, Glycine max
  Coding DNA Sequence Number=SeqID_77539
MAFLGETSSQTVVNSTLSFIFPNGSIVYNDGDVSLQASTPVPIRVPNGCDFQTLKTRIHNTLKLTDKQFLDEIYYRQPFTYAGKNPKKFDISIRCTMDELKDLIKQVAPPGIPPY

SEQ ID NO: 169225 - protein, 169 aa, Glycine max
  Coding DNA Sequence Number=SeqID_77540
MTLVSACYQTLSLTDSKRVFVGYRRVSPHATGLLSRWIAKGVCGLLSGVYACHQTLGSLDNKGCLRVTVGVFAGYRRVSSHATELLGHGNKGKGADEHIGLCLSIGLGTLGSLDNKGCLRVTIGCLRMPPDSWVMGKDGLSHPGSRFMRFRDKGDVPHYFHDTHATGIL

SEQ ID NO: 169226 - protein, 57 aa, Glycine max
  Coding DNA Sequence Number=SeqID_77541
MQFRATSHNDRDIVKVPFFTTFSGHQNILNMFVSNIMDLYIKSNSDSIREKSFLLKD

SEQ ID NO: 169227 - protein, 189 aa, Glycine max
  Coding DNA Sequence Number=SeqID_77542
DGIIYSEVHNVSIVIDQSLFFSLTKLPNEGVPFEGTIVDDWKFDYSSHDARCQIDWAHLIRYRMHKALRANAPLPYPHLVTLFLHHFKIPLEDEPFVQVKRSFVIGAGAVILFGYRKDDDGQVDSSSLLNDVPSELHSLRAFVGDRFDAMDTPLDAMDAHFDGMDTRITRLEDDMSFIRRCFDPPANPL

SEQ ID NO: 169228 - protein, 1009 aa, Glycine max
  Coding DNA Sequence Number=SeqID_77543
  Gene Ontology: Mol. function=nucleic acid binding; Cellular component= chromatin; Biological process=regulation of transcription, DNA -dependent
  Homolog annotation: Hit_ID=A7PIA9; Match level="QueryCoverage=80%, HitCoverage=68%, E-value=0.0, Identity=48%"; Hit description =Chromosome chr13 scaffold_17, whole genome shotgun sequence
  Pfam annotation: Domain name=PWWP; Domain location=366-439; Score =52.0; E_value=2e-12; Accession=PF00855.8; Description=PWWP domain
MEEQEKGLSGVSETTVTHEEKVRVETLEGSVDCRGVVLMEGSFTADLVGEGGACNGKEVMVEVLGSDLYIDGDCTHENGDELSGGGSIDGGEGLVKDVGSGGVGGGDSRCLESEEDRSENVGMELDSVVLGREERDEAVVGSGEVDAPSLLEESVLDSRAQKEVGTEVSNVEDPSVVDVEVECTNAPDAEASDHEVNNALGCLLVGENVQVSSDTGQGVDKDSTIEEELNKNVSDAEKCGLHKGIEVEAGGQPEAESTKTTNHTSEIEGEDTQIDDQDNLALMDAGHEEIYDESNIRPNVEVQTGISEQVGSNGGQEFEVEVEEFIEAEQRKVEGRVTRRSSLMKSMCLESLHNARYLLPIEKEGEFSVSDMVWGKVRSHPWWPGQIFDPSDSSEKAMKHYKKDCHLVAYFGDRTFAWNEESQLKPFRTHFSSIEKQSTSESFQNAVDCAVDEVTRRAEYGLACSCIPKDTYDSIKFQTVENTGIRSELSARHGVDESLNASSFSPGNLVEYLKTLSALPTGGFDRLELEIAKAQLLSFYRFKGYSCLPELQYCGGFDDDMDSLVHDDENNHAAPVSKNYGQAGSGNLKNQSSSHRKRKHNLKDIMHETKKERSLSELMGGTPDSPDGDYWSEEKVIDNLVSPGRSKKRRTVDHYADDFGKPDGRKTISVAKVSNTTKPSFLIGDRIRRVASKLTGSPSTVKSSGDRSQKTDGSTDGFSGNGTDFSFEEAQRSSMAAPTEYSSLDNLLSSLHLVAQEPLGDYNFLNPIVSFFSDFRNSIVVADDSVKGIFCKEKVGTKRKKLPPAGLPESFEFDDMSDTYWTDRVIDDGSEVKPVQLSQPAQPSQPARRNRKKDHQLVPAEPGKPVQVSHRPYSKKHYSNNNHIEAPAKPPGYIDENAPAELVMNFAELGSVPSETNLNKMFRHFGPLKEAETEVDTVSSRARVVFKKCVDAEVACSSAQKFNIFGSILVNYQLNYTPSALFKASSVATTQDQEMHLDLSNFEVHMIGR

SEQ ID NO: 169229 - protein, 55 aa, Glycine max
  Coding DNA Sequence Number=SeqID_77544
  Gene Ontology: Mol. function=nucleic acid binding; Cellular component= nucleus; Biological process=mRNA processing
  Homolog annotation: Hit_ID=Q9FT01; Match level="QueryCoverage=96%, HitCoverage=13%, E-value=9e-20, Identity=88%"; Hit description =Putative splicing factor
MVKPSEAEKNLVQSNASGGAAGVTGPYGAVDRKLYVGNLHFNMTESQLREEYECT

SEQ ID NO: 169230 - protein, 85 aa, Glycine max
  Coding DNA Sequence Number=SeqID_77545
MGKKVFSLSLMDPSSPRLAIALSAHFPINRYAREAKEKFQGSVLEGIERIEREEEERRGNEVEALPNCDYDESLCGSLFGAFHAT

SEQ ID NO: 169231 - protein, 149 aa, Glycine max
  Coding DNA Sequence Number=SeqID_77546
  Subcellular localization annotation: CTP_CleavageSite=68; ConfidenceScore=5.19e-01
VWSVLSYSNLAPTSHTSDLIVDKARLIFGLVSRMDMNIGALISGQMTSIAQSNTSRLGFLALITTLCRAIGVVSDSLTFERLSLVINLAYIRKNCWNLEDLTVSILGARRARARPAELPSTSAAPTPASTSAAPFVPALTNSQHFEAML

SEQ ID NO: 169232 - protein, 102 aa, Glycine max
  Coding DNA Sequence Number=SeqID_77547
  Gene Ontology: Mol. function=protein serine/threonine kinase activity; Cellular component=cytoplasm; Biological process=protein amino acid phosphorylation
  Homolog annotation: Hit_ID=P15792; Match level="QueryCoverage=74%, HitCoverage=12%, E-value=2e-31, Identity=84%"; Hit description =Protein kinase PVPK-1
MEIMNKTKLANRKKLLRSQTEREILQSLDHPFLPTLYTHLEAKTFSCLVMEFFPGGDLHPLRQRQPEKYFSEHAVKASGVCKKWKQGVKESLARRHNLSFAD

SEQ ID NO: 169233 - protein, 71 aa, Glycine max
  Coding DNA Sequence Number=SeqID_77548
MELLLLRARLRGQDIYSSQEETTSSPSSSESEDEVKREESSEEVYPHEEGDLLMVRRLLGVDLVAIVVAQN

SEQ ID NO: 169234 - protein, 566 aa, Glycine max
  Coding DNA Sequence Number=SeqID_77549
  Gene Ontology: Mol. function=phosphoprotein phosphatase activity; Biological process=intracellular signaling cascade
  Homolog annotation: Hit_ID=Q2HTA0; Match level="QueryCoverage=70%, HitCoverage=65%, E-value=2e-35, Identity=29%"; Hit description=IMP dehydrogenase/GMP reductase, related
MVRTRGLGRALGQVTGKGVDKGDHDDSDDAPQHRQLIASARRQRVVVTVAHDEPVVPASDVQDDPMEAPAAVEDIVADIPADTGAEAVEDEHEGFPGGPSDPSVLTQYADHVACSVWMGEECPKWKLSSHRRKVHSLGRPVPAIEGLVVGTGLSPLIACSVNTSNRGLLSAFVEQWLRETSSFHLPPLHVDDAVQMLVDLLMVSAEFARAEIAQCRGPYRRCQAGHWAAVAHAYFLHLLGCTLFANKSATNVHVVYLEALRDLSMTERYAWGVAALVHMYDQLNDASMSHSRQLGGYITLLQCWIYEHFPSVADSTADREYDKDSPLACRWIATKKTVKSIRTSAYREHLDRLWISNVCWILCGEHREVRDFHVRSCYSGLLCWRPGAVYYRPKKVVWQFGYTHTIPAPPVDSWFSYDDIHDRWMHYEDHIVPAGEVCVVLGQCSSDYMDWFFRISHPFMTLGHALDPLPHGHTPQPRVIPQAPQTDIPHLLELGASSTSAEEPRHAMEVCDDIAERLERHLSLEVVTPGSSTHEVIEECLRLARSVTQDHLVYVRSRRRRCTDQA

SEQ ID NO: 169235 - protein, 151 aa, Glycine max
  Coding DNA Sequence Number=SeqID_77550
MCFWWLSVYYKDPLKFQHWSPLGLRVDSLQNVANIIMSQWVDQCLNVMCHGVGFVAQTQCLGSKKEEIGFVKILAKALSVFVTMEWVPPLDPKVKVNFVVAMIEDVGTGLEVIFSNSKGETMASGTCFMLDECYVSKIAETLYYKWAMEKS

SEQ ID NO: 169236 - protein, 1118 aa, Glycine max
  Coding DNA Sequence Number=SeqID_77551
  Gene Ontology: Mol. function=protein serine/threonine kinase activity; Biological process=protein amino acid phosphorylation
  Homolog annotation: Hit_ID=A5B7L9; Match level="QueryCoverage=99%, HitCoverage=95%, E-value=0.0, Identity=61%"; Hit description =Putative uncharacterized protein
  Pfam annotation: Domain name=Arm; Domain location=1021-1061; Score =2.4; E_value=5.6; Accession=PF00514.14; Description=Armadillobeta -catenin-like repeat
  Pfam annotation: Domain name=Arm; Domain location=1063-1102; Score =24.5; E_value=0.00039; Accession=PF00514.14; Description =Armadillobeta-catenin-like repeat
  Pfam annotation: Domain name=Arm; Domain location=979-1019; Score =22.6; E_value=0.0015; Accession=PF00514.14; Description =Armadillobeta-catenin-like repeat
  Pfam annotation: Domain name=HEAT; Domain location=1027-1063; Score =21.5; E_value=0.0031; Accession=PF02985.13; Description=HEAT repeat
  Pfam annotation: Domain name=HEAT; Domain location=1068-1104; Score =3.1; E_value=9.4; Accession=PF02985.13; Description=HEAT repeat
  Pfam annotation: Domain name=HEAT; Domain location=984-1021; Score =22.8; E_value=0.0013; Accession=PF02985.13; Description=HEAT repeat
  Pfam module annotation: Pfam domain module=Arm::Arm::Arm::HEAT::HEAT:: HEAT; Domain location=1021-1061::1063-1102::979-1019::1027-1063::1068- 1104::984-1021
MCSDQDVPESNQSLRILSNLVAAGAFSSSGLIDELIKELLVFTESVIAMKSSEVTDMMAKLLLPLARGGLLPALSQWFVTCVAFVVFMVGVVVAMTVRSIMFEEINMNEDTGEELAVVENIDCSDAFNTSQDALPWACIVVYDIGFVAVIVRSDTSTGKRGRTSFVLIGCERSVKYRVYKKGLVLTMTSTRKCGCPFKLRMKPDGKIILSDMTKSMVKSKDILLILKEQYANNCTTMKQVYNYYCLLWKNDMHILRRYVKNLPLDSRCHREMYKKGLVLTMTSTRKCGCPFKLRMKPDGKIILSDMTKSMVKSKDILLILKEQYANNCTTMKQVYNGFSITKILLDNGGSFTSSSYVSHWVEFVEIYSQVVTSNNDASGRVLYESSACITVMLSRVAQVLRSSPKISGQEKLNETAYRILEHSKTTGLVDHLCLCLATSGSSLITGSSNMLRAASEACKAVWMEVVHHEQDLLHKADSTKVVDAMTRAFLRSKTVLVAVYYCFHQGLESAMNCGLQLLSRCCLHNGIVPALLCGLPSSLPVTTVVSGGGDGTIVSEVFTVLSLCSSSVNKDTQSVEPSNAKCKLTNPSALVRHSCLLVAVIAQCLKSSGRNSAIFMLTTSPKKQFARLSVLAHQISSDDKIKASIEPQSASAMLALASILSLESGALVESPISEIAMPLIPRTSTLSDHLKFSSSNVNELDPCNISGKFSYWQGVRDGFVGLLDSRLKWGGPLAVQQLCASGTPLLLMGLLGNDVLNASHGNDHVNDRVGLSPIGVVWTISSLCHCLSGGALTYRQILIRNEHIKLFSNLICDVHMKLVKCWIGPGGGRAGVRDLINGVIDLLAFPFVALQNAPGLPSATASVSSGFLLNIGSPGQRVCMEDKGIVKAIEEDMGKYIKILVEVGVPGIILRCLDHMDLNDLGRPVAFMAKMVCHRPLAIQLVSKGLLDPNSMRKLFDCLAPKEVKLDALMIISDLARMDKGFYEYIKGASILEFLKDFLSHEDPNMRAKACSALGNMCRHSAYFYSSLARHQIVGILIERCSDPDKRTRKFACFAIGNAAYHNDLLYEELRRSIPQLANLLQMAEEDKTKANAAGALSNLVRNSDKLCEDIVCKGAVQ

SEQ ID NO: 169237 - protein, 124 aa, Glycine max
  Coding DNA Sequence Number=SeqID_77552
MNCNLKRVVGGIYGCQCKLKLPPPEDKTPLFISEVAELEYAKATVATCHFAGERRRGSRVRFPKEERCAESPPTFICGKRRENQRKPVKIKILSSGVIFMLEEGRQKRGSCSYVPSIEEEIRPT

SEQ ID NO: 169238 - protein, 430 aa, Glycine max
  Coding DNA Sequence Number=SeqID_77553
  Homolog annotation: Hit_ID=A7PS27; Match level="QueryCoverage=12%, HitCoverage=7%, E-value=1e-12, Identity=69%"; Hit description =Chromosome chr14 scaffold_27, whole genome shotgun sequence
MHCRKPHASHVVFLFFFLSIEASIKAPNFAHHFYSKLQKEVIFGVVKRTTTLWDFKFQQNFCSCAENACALLVMGKLGGVDGDPVLRGTRIRATWGVVPGDMSRGSGDLGDIRRAPSSQPIKEQRPQSKEACVVAGQLWILSGIYNLASSNRLPREVEMASGNRLPRGVIDYKAYKWRQDVEVASGFHVQKLCNSSLGTGNRLHTVITMAAQLIHDRVEMECLEGVWETLEGNERCRFRGTIRLTATSLVHPEEPARTLQRTVEWILPTHTPYRLVEPVQVIEELPPEPAVDALDFLEDDKDPLPDVDSPEDVMSASEADSTEESGPGGTANNGDSSSYHYLGTPQVTCGEFGVQPAHEEWELSKTIDPPKKPEGRLKFLKKPLEQGPTIMYVPTRTETLRIAKYLCKFGVKATTYNAGVWDILYSILFD

SEQ ID NO: 169239 - protein, 106 aa, Glycine max
  Coding DNA Sequence Number=SeqID_77554
MKPRGYIEFDHVQDDVPYQVDEMSHVNEVIEVESIYGLQDLRGGVEEVDPANMLTNEEESNNLNEESNNIEQDNEGELEDEFEICHQVVLTLPDPHHITPMGKGPL

SEQ ID NO: 169240 - protein, 95 aa, Glycine max
  Coding DNA Sequence Number=SeqID_77555
  Homolog annotation: Hit_ID=A9P8B4; Match level="QueryCoverage=81%, HitCoverage=80%, E-value=2e-30, Identity=79%"; Hit description =Putative uncharacterized protein
MYGLPEMGDAKGLSSIGSIFEVKVSRGFHSTGMKRMGGGHGHDEPYYLHAKHMYNLDRMKHQGLKMSLAVFTAFSIGVAVPVYAVIFQQKKTASS

SEQ ID NO: 169241 - protein, 82 aa, Glycine max
  Coding DNA Sequence Number=SeqID_77556
  Subcellular localization annotation: CTP_CleavageSite=44; ConfidenceScore=5.53e-01
MRGYLMITRTFRQPWANKSVDAKRLTSSSAPFVIQGQRVFTLVVQKHSSPMTRRILLYSAGTIECNGIGKCRGCPTLSLSRH

SEQ ID NO: 169242 - protein, 70 aa, Glycine max
  Coding DNA Sequence Number=SeqID_77557
MRGYRMVIRTFRQPGANELMTGETNPMRGKSDDMRGTAMVIRTFGHLETASPMTCGGTVWLSAPFVIPRR

SEQ ID NO: 169243 - protein, 73 aa, Glycine max
  Coding DNA Sequence Number=SeqID_77558
MIRGDTLRLSAPFCHPEAAGPMTSRDQIWSFCTLVSSRGGGPDDTRRLMQSYSARALDRKTPSRLGQRCKRRP

SEQ ID NO: 169244 - protein, 175 aa, Glycine max
  Coding DNA Sequence Number=SeqID_77559
MAPRKLASKRSRRDKAAEGTSSAPEYDSHRFRSAEHQQRFEAIRGWSFLRERRVQLRDDEYADFQGEIVRRRWASLVTPMAKFDPDIALEFYANAWPTEEGVRDMRSWVRGQWIPFDADAISQFLGYPLVLEEGQECEYGQRRNREASANYAHQHDQPDPDMDDIAAQQHPAQRS

SEQ ID NO: 169245 - protein, 77 aa, Glycine max
  Coding DNA Sequence Number=SeqID_77560
MAEEDALSLDNIEGCVCVEYTDAGAYGRRNSGSNKEAFEMGERRLYLSWTHSERLLRNYGTLLNPSIWQKMPQVTNS

SEQ ID NO: 169246 - protein, 477 aa, Glycine max
  Coding DNA Sequence Number=SeqID_77561
RIPRAHVHVRRGQPLQRGIQGGGLARAGRAGDQHDAVRSLDQRIPAGGLLRAETELVDALEGGIGVEDAHHALLAEGGGHGRQAHLDLAAARRAGLDAAVLRAPALGQVHAAEHLDAADHGGHHCRRDLEHLVQHAVDAEAHAPHFAAWLQVDVRGALFVGVLQQPVDDVHDVLVVGIDVAGAAQLHQLLEAGQGGVGLAAHVATGAAHRAGHPVELHGVAVQVQRIDHRQFDAAAGQVLQVAAPFLHQRLAGGHQHALGIHRQRQETVAARVGVRHQRGHRSDVDPGWIDAQVAAAGALRQPLGEALQGQFAAAGGGQLEVGQQYQRMHFTGVACAMRGKPHALAVLLGHQVIGDQGRGNLLELQPSPRQRDAASLAGRARRQPMFHLPAPPGYGMPRRSAVILAHPLAGQDSAACSSSRSTWRWVPVPSTRPPSCVRLVRRAGTRPTCSPRAARPTAATARTRTVCSATTSSRWR

SEQ ID NO: 169247 - protein, 33 aa, Glycine max
  Coding DNA Sequence Number=SeqID_77562
MKHSSKLIGWRMHDENAINGAPTKWRGWRVALE

SEQ ID NO: 169248 - protein, 350 aa, Glycine max
  Coding DNA Sequence Number=SeqID_77563
  Gene Ontology: Mol. function=iron-sulfur cluster binding; Cellular component=mitochondrion; Biological process=biotin biosynthetic process
  Homolog annotation: Hit_ID=A6GPW7; Match level="QueryCoverage=17%, HitCoverage=18%, E-value=2e-14, Identity=59%"; Hit description =Probable biotin synthase protein
  Pfam annotation: Domain name=TPR_1; Domain location=120-153; Score =3.8; E_value=1.9; Accession=PF00515.19; Description=Tetratricopeptide repeat
  Pfam annotation: Domain name=TPR_1; Domain location=188-221; Score =17.4; E_value=0.043; Accession=PF00515.19; Description =Tetratricopeptide repeat
  Pfam annotation: Domain name=TPR_1; Domain location=86-119; Score =12.2; E_value=0.18; Accession=PF00515.19; Description=Tetratricopepti de repeat
  Pfam annotation: Domain name=TPR_2; Domain location=120-153; Score =10.9; E_value=1.3; Accession=PF07719.8; Description=Tetratricopeptide repeat
  Pfam annotation: Domain name=TPR_2; Domain location=188-221; Score =23.6; E_value=0.00071; Accession=PF07719.8; Description =Tetratricopeptide repeat
  Pfam annotation: Domain name=TPR_2; Domain location=86-119; Score =18.6; E_value=0.023; Accession=PF07719.8; Description=Tetratricopepti de repeat
  Pfam annotation: Domain name=TPR_4; Domain location=188-213; Score =23.7; E_value=0.00067; Accession=PF07721.5; Description =Tetratricopeptide repeat
  Pfam annotation: Domain name=TPR_4; Domain location=222-247; Score =12.3; E_value=1.3; Accession=PF07721.5; Description=Tetratricopeptide repeat
  Pfam annotation: Domain name=TPR_4; Domain location=86-111; Score =7.4; E_value=5.1; Accession=PF07721.5; Description=Tetratricopeptide repeat
  Pfam module annotation: Pfam domain module=TPR_1::TPR_1::TPR_1::TPR _2::TPR_2::TPR_2::TPR_4::TPR_4::TPR_4; Domain location=120-153::188 -221::86-119::120-153::188-221::86-119::188-213::222-247::86-111
SPVVVSPVPPRHHPDVNAAPAKAVLAPQIEGEFSIKPAETTAANPVVSVIEPPLEAANTAKQVKSNQEEPGVRGVVNKQVRPDQEVNLLIQRAVDHEQKGRLNEALVTLRQAINSYPQSEDARQLLAAYLFESKQDSEAVAVLQTGIKQYPGQIGLSKSLAKWQLSHGQPEPVLQTLKPVANLLIQDAESQWMLAMAYQQTGQHAAALPHFERATVLRPGVAQWMVAYAISLQAAGQSAQALQQLRWLITCHSASGYLSFAVTRFAPAVCGSEMQTSVINLDGLKPSRGCSEDCGYCPQAARYHTEVENEPLMQLDEVLAAAQAAKDSGASRFCMGAAWRSQAAKLVDGI

SEQ ID NO: 169249 - protein, 85 aa, Glycine max
  Coding DNA Sequence Number=SeqID_77564
MELLLLRAGLREEERTSIARFLSGLNMEVRDKVELLPYRDIHEIVQLCIRVEQQLKRNPSSKSYGFHFYLRKDQTQGTVGATPSK

SEQ ID NO: 169250 - protein, 263 aa, Glycine max
  Coding DNA Sequence Number=SeqID_77565
  Homolog annotation: Hit_ID=A8AEF3; Match level="QueryCoverage=23%, HitCoverage=47%, E-value=1e-10, Identity=49%"; Hit description =Putative uncharacterized protein
MRISGHNIDRDAVFAAARDDDIGVLFGRFDKLQEHRAHGFLADIRQQQDLPSRMITFLGSRWTVSFLAYARCSCTAAVHRLAGFQHLQMLEQQVVIHGARVVIVGFDPFFHGQVSLVFIVTVFWNNADVLIADLLAEFAVQRGELKRDNYRESPGIAPLYIARRRANSGCHATGTRHFKNLAARATRRNGLHSPALTFAPRPLSSEIDHVVAALRADSVFIASLIHLPRTRAAGWQLGRCLRITGGAMVFAQRDMERHLPQQA

SEQ ID NO: 169251 - protein, 53 aa, Glycine max
  Coding DNA Sequence Number=SeqID_77566
MRQEGQKWNKLTKVQQVKEGCRSHLIEEIFLKAVSISVCLLLCWKKVRMLKSQ

SEQ ID NO: 169252 - protein, 85 aa, Glycine max
  Coding DNA Sequence Number=SeqID_77567
APQTDIPHVLEPGASSTSTEEPRHAVVKVCDDIVERLERHLSLWVVTLGSSIHEVIEECLRLTRSVTQDHLVYIRCRRRRRTDQA

SEQ ID NO: 169253 - protein, 207 aa, Glycine max
  Coding DNA Sequence Number=SeqID_77568
  Homolog annotation: Hit_ID=A0ST23; Match level="QueryCoverage=12%, HitCoverage=53%, E-value=2e-07, Identity=100%"; Hit description =Putative reverse transcriptase
  Subcellular localization annotation: CTP_CleavageSite=46; ConfidenceScore=5.18e-01
MVKVGTSYVPINVSFSPKVGPGLPAVPPVQLLTGWCVTAKAPPDISAGKCSGHAARRVPFAIQAAQLLGRAIGAGLFAITPAGERGMCCKAIKLGIRWGRAAARSQQRSQDKNGTGAQAHVESSLSIPSTSRGGPVPAFVPFSEVGKPVVPAALMNRPTRGERRFAYWALAECILAYYVGTDEGEKKGCTGASAEYVIQDIFRFLAH

SEQ ID NO: 169254 - protein, 136 aa, Glycine max
  Coding DNA Sequence Number=SeqID_77569
  Subcellular localization annotation: CTP_CleavageSite=72; ConfidenceScore=5.18e-01
MNFVFVHESSTFEFGAMRSDCLVQFSILNLFRSPMNCVFVHVSSTFEFGAMRTDCLVQFSILNLFRSPMNCVFVHVSSSFEFGAMRSDCLVQFSILNLFSKPMNCVFIHESSTFEFGAMCSDCLVQFSILNLFRSP

SEQ ID NO: 169255 - protein, 179 aa, Glycine max
  Coding DNA Sequence Number=SeqID_77570
MAIVSKQFIWKLGRGDQILFWEDSWVGGGITLKEKFPEFYQISSKKLQTVATFIDQTVAISPNVTLKDCWVWGADPKGIFSTNSAYLCIKAKQFSEDQSTVNVYASCDLAGKRALWEELRQLKVSNPNGLWCFLGDFNSMRIQEERIGSSQRMADTSDISDFNEWIFDMELQEIKGFGG

SEQ ID NO: 169256 - protein, 192 aa, Glycine max
  Coding DNA Sequence Number=SeqID_77571
  Homolog annotation: Hit_ID=A5BLZ2; Match level="QueryCoverage=58%, HitCoverage=9%, E-value=1e-07, Identity=33%"; Hit description =Putative uncharacterized protein
MKRKRKASRLRSLSTRPPGAERPVVHVDPATGKADGPQRKKLRTYLVIVARDKVDVTYENWKEVPTAHKDLIWEDIQRLLTVGRKGSYFRPWARDGADQDGEEDTVREKYGIKKEKWAQFCQTRRYPSWEDVRKKAQVIQKQNTAPHVLSRGGYDYLEQKLLAEKTKKKLEEAAQTGSVDGIIDPPSPVRRH

SEQ ID NO: 169257 - protein, 170 aa, Glycine max
  Coding DNA Sequence Number=SeqID_77572
MSLKLPHYLELVKVFYCNLKIQDGIISSEGHGIPMIIDQSLFFSLTHLPRQGAPFEGTIVDDWKFDYSSHDARRMVCNDQAGMTVKHSFAIGAGAVTSFGYRKDRNGQWLKKDALPPQDERTPSPPPQREDSALLNEVLTELRGLRSYDGERFDSLDTRFAGMDISPHTS

SEQ ID NO: 169258 - protein, 123 aa, Glycine max
  Coding DNA Sequence Number=SeqID_77573
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=69%, HitCoverage=72%, E-value=3e-24, Identity=69%"; Hit description=LacZ protein
LLVIDYQRVNLNLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRRGDRYTCQR

SEQ ID NO: 169259 - protein, 229 aa, Glycine max
  Coding DNA Sequence Number=SeqID_77574
  Homolog annotation: Hit_ID=A7Y7M7; Match level="QueryCoverage=37%, HitCoverage=60%, E-value=7e-27, Identity=68%"; Hit description =Putative wound-induced protein
MSAASRAWIVASSIGAVEALKDQLGVCRWNHALRSLQQHAKSNIRSYTQAKTLSSATSAAVSNKVKRTKEESMRKVMDLSCWAGNAPIGNAPRHCPSGKCTLKLAEVDDVAIPQNTIYTLELAEVDAAVEARKKPPVEEMNGFREEDRLIRITPHSHECYGSDDRIVLLTVATGGHHAAFTAYWDPPNKGIPTLHVGSRKHLLGFDIEHYIYTHCLAHCHVMDYLSYSD

SEQ ID NO: 169260 - protein, 628 aa, Glycine max
  Coding DNA Sequence Number=SeqID_77575
  Gene Ontology: Mol. function=methyltransferase activity; Cellular component=nucleus; Biological process=proteolysis
  Homolog annotation: Hit_ID=A7P1D2; Match level="QueryCoverage=65%, HitCoverage=65%, E-value=1e-97, Identity=50%"; Hit description =Chromosome chr19 scaffold_4, whole genome shotgun sequence
  Pfam annotation: Domain name=Met_10; Domain location=538-628; Score= -83.5; E_value=0.00012; Accession=PF02475.7; Description=Met-10+ like- protein
MESTTQKNKSKKSSLLMRLKPVMGFDDSIMPNRNGDDPVLSYLAIANKNGAVLPAMLSSMFGGAEDLGEKCGCRRRKWQALRAVFSGTTLMRMAIKRRVNKGKLSLTRTTSKLEETNGKISNPKCKSTCRTSSKVSSTFGSSSTLTSSSPSSSISSVRTVSSSSTNEKLSHSIPLNGTHVMKQKQCGVEDKKKGQNYGSNIALSFEQQVGGRMISKVFLKPHLVGLLLPSKFGLVFPHTTKPSSSLPTTFFISHFSSAPLSSYGPSLHKGTTIPSQSLNDAVLCEEAFTRVFHLAALRVPSSECSALESRLRGHLLNWPRLRNIARVPGDDIDPTLAPLLPQPGNGEFDFDENEVEERRLVSLQRRIHGKADGDGDVLSPVLYRDRLARTFNTSGFVKFRHLAKISRPNRNKRRRKRKEKESSEGVKRVGENGFAAVEVIEEEEEGEESGGLRNLLGEEFARKKWRGSTRLLLLDERYADRGFEELPEATKAVLKEYAEKSTNLMLELVRCKLTLFYDYWQMNEVLETLLPEGMIIPSAFETVGHIAHLNLRDEHLPYKWLIAKVVLDKNKPRIQTVVNKIDTIQNEYRTMQLEVLAGNHSLVTTVVENGIHFQVDLATVYALLSIPD

SEQ ID NO: 169261 - protein, 248 aa, Glycine max
  Coding DNA Sequence Number=SeqID_77576
  Pfam annotation: Domain name=FBD; Domain location=145-196; Score =34.0; E_value=5.5e-07; Accession=PF08387.1; Description=FBD
MTTPSLEAVNEIPCYVNYLQYVFDEDRTYVGFESIFLQEQIATSEKSYCYCIYLLPHSCQGSTSSFSGKFENLAISHQGTTSSFAGIFENLATLCIDFDLKTVKNAITLFSALKACPKLQNLEINSEINDNAVDYYDQHDEDDAMEYYRRKEPCECIDQQLKTLSIMGFAGKKTEVEFLKYVITNGEVMKKITIWFVDDCSWIHAAETGCLLSFQTASPNLSIILNPGPFYMANVGGNFETWLSTLRE

SEQ ID NO: 169262 - protein, 61 aa, Glycine max
  Coding DNA Sequence Number=SeqID_77577
MMMSLKRHKGSWLTAMRVPVVGGWVAAWWWVCGHGGLGERRLRFCFGEQEQKGDIEKIGGS

SEQ ID NO: 169263 - protein, 92 aa, Glycine max
  Coding DNA Sequence Number=SeqID_77578
  Gene Ontology: Mol. function=unfolded protein binding; Cellular component=cytoskeleton; Biological process=tubulin folding
  Homolog annotation: Hit_ID=A9PA70; Match level="QueryCoverage=76%, HitCoverage=60%, E-value=2e-24, Identity=80%"; Hit description =Putative uncharacterized protein
  Pfam annotation: Domain name=TBCA; Domain location=1-63; Score=10.9; E_value=0.0017; Accession=PF02970.7; Description=Tubulin binding cofactor A
MTEKGADPHDLKQQENVLAESRMMIPDCRKRLEAALADLKGILAELEESDEKASLEIDEAKNTIVEVEKVDSNPLCQGAKKLTQHFHLWLWS

SEQ ID NO: 169264 - protein, 25 aa, Glycine max
  Coding DNA Sequence Number=SeqID_77579
MEVCWRDSLGEEVQEGNIEYSGGKI

SEQ ID NO: 169265 - protein, 178 aa, Glycine max
  Coding DNA Sequence Number=SeqID_77580
DRAAHHHDALDALWQGRVQLQRQGQVGQRAEHHQHQFAGVLVRQAQDGQCGVLGFGLAARRRQVHVAVAVTAMHVGSVDGGMQQRIRAAGKHRHVGAADDVAELEGVADGVLEADIAGGDGQGDHVVPFIGEGHQQGQGVVHTGVGVDQQRDLVGLRPAPAEAGATANARATAEAGFL

SEQ ID NO: 169266 - protein, 137 aa, Glycine max
  Coding DNA Sequence Number=SeqID_77581
MGTFSEDRWRWDFKWRRNLFDHENDLAVNFMEDITSISIQRYVKDNMVWKAESTGVYSTKSAYRIMLNTNASASDVRNFKLIWKMKIPQGQQSSLGGSSRTDYLLRMLAALSVVKCRRKWVTYFLIAKGHYPCGGYP

SEQ ID NO: 169267 - protein, 48 aa, Glycine max
  Coding DNA Sequence Number=SeqID_77582
MDINPAYSCLLGAPVDPLGGSRSLYAPPKIEIRSRGAFGYRIGQGRHL

SEQ ID NO: 169268 - protein, 168 aa, Glycine max
  Coding DNA Sequence Number=SeqID_77583
MASSEENFEAPKEDEEVRDLKLELGEARLAKEKFKSAATHIRKECTELQEENAATARALEQETKRARKEEYGREKFRGALWGSNNELKLRREERDRSRVHGMILKEELVACTRSKRSLAQHLEATEQSMLAIIGQYKEELNQSMAHEQKLVEDFAPSVCRKRSKREGD

SEQ ID NO: 169269 - protein, 67 aa, Glycine max
  Coding DNA Sequence Number=SeqID_77584
ISRMLHEDSALMNEVLSELRGLRSYVGDRFDSLDSRFAGMDIRLTQLEEDVRYIRQSFNLPPPPLSS

SEQ ID NO: 169270 - protein, 137 aa, Glycine max
  Coding DNA Sequence Number=SeqID_77585
  Homolog annotation: Hit_ID=A5CAY2; Match level="QueryCoverage=77%, HitCoverage=10%, E-value=1e-11, Identity=35%"; Hit description =Putative uncharacterized protein
MGRWLWAFASDQQQLWARVITSKYGGWSDLQNARDKRGYSHWWRDIRNLYHQLDCSIFKDNLSWKVGCGENIKFWTDNWLGEQYSLQQKYYQLFLISRQQRDLISQEEENFLCTLVDSKKNLMPNRKDLIQSEQRGT

SEQ ID NO: 169271 - protein, 163 aa, Glycine max
  Coding DNA Sequence Number=SeqID_77586
  Homolog annotation: Hit_ID=A5B5G7; Match level="QueryCoverage=98%, HitCoverage=10%, E-value=1e-06, Identity=27%"; Hit description =Putative uncharacterized protein
MASKKRKAPSTPTQARFEKSRFTSQEAWERYTDVIVPRKLFPERNVVVYYTEFDELKEELERRHWDEELTDFGDSNNDVAIVKEFYANLYDPEDKSSKQVRVRGHLIKFDEDTLNTFLKTPVIMEKGESLCAYSRFALLRPDPQELAAKLCIPRRGFELNADG

SEQ ID NO: 169272 - protein, 111 aa, Glycine max
  Coding DNA Sequence Number=SeqID_77587
ENRGGACHPARPGEPGCFLQKQPPSVGTIWKAQVGLKLTDCVSILSFDFRHVTEFHGLRNNASFLFPACLGTSRIVQQRVPSTSKRSTKGCMPSNNSPRTKLGYDSCLDHT

SEQ ID NO: 169273 - protein, 386 aa, Glycine max
  Coding DNA Sequence Number=SeqID_77588
  Gene Ontology: Mol. function=iron-sulfur cluster binding; Cellular component=cytoplasm; Biological process=porphyrin biosynthetic process
  Homolog annotation: Hit_ID=A0G6N4; Match level="QueryCoverage=87%, HitCoverage=79%, E-value=1e-118, Identity=53%"; Hit description =Radical SAM
  Pfam annotation: Domain name=Radical_SAM; Domain location=82-262; Score=72.0; E_value=2e-18; Accession=PF04055.12; Description=Radical SAM superfamily
MISPALSGITAKIANPDIDRHYPRPAICEVLSRPENADLLEYVVHDPFGCHVFPGDIDDFPLPNFLRAMQHSLSHAPQIHLWAYIPTCRYKCHFCQFPTVIVNPQSPRAPELFRDIVDRNIQEAKLWLAQLPALGEVPVGEFNLFGGTPSLLPPDELRRLMDFYRNHFNFREATLRFEGEPGTLTREFLAQLRELGFSKLSFGAQSFSDRLIKGCGRLHSADACYKVIRDARELGFALVSVDLMYGLLGQTVDDVRDDLQQARALDLSHLYQMRALAEQWLDGDYLEHPTMYFHHRSAPPEKWKAIITDLDQQAPEVAIGLGGSSKCAGAELINLTDYADYQRALDNGHQRLQDGAVNADSARRCAVSAEVWRQPVCPADHRPCAA

SEQ ID NO: 169274 - protein, 439 aa, Glycine max
  Coding DNA Sequence Number=SeqID_77589
  Gene Ontology: Mol. function=catalytic activity; Cellular component =integral to membrane; Biological process=metabolic process
  Homolog annotation: Hit_ID=A4WEA8; Match level="QueryCoverage=60%, HitCoverage=92%, E-value=8e-97, Identity=64%"; Hit description=5 -oxopent-3-ene-1,2,5-tricarboxylate decarboxylase
  Pfam annotation: Domain name=DUF204; Domain location=108-179; Score =71.5; E_value=2.7e-18; Accession=PF02659.6; Description=Domain of unknown function DUF
  Pfam annotation: Domain name=DUF204; Domain location=6-82; Score =98.1; E_value=2.7e-26; Accession=PF02659.6; Description=Domain of unknown function DUF
  Pfam annotation: Domain name=DUF981; Domain location=1-158; Score= -78.5; E_value=0.05; Accession=PF06168.2; Description=Protein of unknown function (DUF981)
  Pfam annotation: Domain name=FAA_hydrolase; Domain location=250-413; Score=131.4; E_value=2.6e-36; Accession=PF01557.9; Description =Fumarylacetoacetate (FAA) hydrolase family
  Pfam module annotation: Pfam domain module=DUF204::DUF204::DUF981::FAA _hydrolase; Domain location=108-179::6-82::1-158::250-413
MTFIATLILAFGMSMDAFAAALGKGASLYRPGFKEALRTGLIFGVIEMLTPLVGWAIGLAASHYIMAWDHWVAFGLLGILGGRMIMEGFRQTADEPCEAPQRHGFMVLALTAVATSLDALAVGVGLAFLQVNIVLTALTIGAATTIMATTGVLVGRFIGPVMGKWAEVLGGVARKSYGIVQPDGVIDLGARLGDSCPDLKTLLQRGGLSDLQVYLSEPVDYAFSAIRFLPVVENPGKVFCVGMNYADKRQEFAATLDAPTLFVRFADSLAAHEQALLKPATTAEFDYEGELAVIIGKAAYQVKAADALQHVAGYSCFMDATVRDMQFTWFTAGKNWQQTGGFGPWMTTADDIPDPQQLAIKTWLNQREVQNDTTASMVHPVAKIIEYISAFSPLSPGDVIITGSPGGVGKKRTPPLFMFPGDEIEVEIEKIGRLRHRIV

SEQ ID NO: 169275 - protein, 54 aa, Glycine max
  Coding DNA Sequence Number=SeqID_77590
MAYPIIFLPHSAAIKLQDAWDSIDEEDLSPTSSTRSYIMWYQEHLRLGSIIFQS

SEQ ID NO: 169276 - protein, 65 aa, Glycine max
  Coding DNA Sequence Number=SeqID_77591
MHLRDQEKNKMKDCKNTSGEDVSFTSRISNSSQALKLASASSSGLYRSSHNKISQNSLELGPFSL

SEQ ID NO: 169277 - protein, 86 aa, Glycine max
  Coding DNA Sequence Number=SeqID_77592
  Gene Ontology: Mol. function=NADH dehydrogenase (ubiquinone) activity; Cellular component=mitochondrial respiratory chain; Biological process=ATP synthesis coupled electron transport
  Homolog annotation: Hit_ID=Q0WLU6; Match level="QueryCoverage=77%, HitCoverage=38%, E-value=7e-23, Identity=79%"; Hit description=NADH dehydrogenase subunit 4
MGWSGMRSYGKEYITTSLIHEFLMIVVLRMLDPLLFYVLPESVLIPMLCGAEHLLFIGIKLFLCRDLDPPTRVLYGYAGRGAPRCM

SEQ ID NO: 169278 - protein, 213 aa, Glycine max
  Coding DNA Sequence Number=SeqID_77593
MYTSANPIFFYGSRSITFTQFIQKINNRLPAQATEQVAQLLFHVPISFHLGQTRFISAQLFDNDDLRGAMETIVQNPQLNSTEFYVVTDLIPQPQPSSPQPSCPPLQLPPPQQLSYNNIDLNNPVSSYNNLESQDPFDMYTSYTQLLSENDYFFHAQQTSFDQQNHLSSLFTSPSQLPQTQTSNQDEHPIANEDPIIRFHNENMDDSSEDEDQ

SEQ ID NO: 169279 - protein, 91 aa, Glycine max
  Coding DNA Sequence Number=SeqID_77594
MQQEQADILIARFPDPSYGFHSLPKPRAKLEDSASVEEFLSVWVSTENNDGLWWLMVVVGDGEKAWVVGNDFGRKKGEEMAFFLSYTKAKG

SEQ ID NO: 169280 - protein, 157 aa, Glycine max
  Coding DNA Sequence Number=SeqID_77595
LRYSISSISIYYGTQSDIRVKSYCRLNLLRASTFNFERLDILRDSIRHPSKNFLSFEFAQSFSIPFRASRYITGLNRTSEASTFNFELFDILRDSIRHPSKKLFSFEFAQGFGIQFRASRYITGDENHETGLIQAKGPSGEGRRPKWRRTKPPSGEG

SEQ ID NO: 169281 - protein, 73 aa, Glycine max
  Coding DNA Sequence Number=SeqID_77596
MLLSSNVIHICVRVVTLVRMIHTRLFVAARVKSCPGMHSSCTIASSSGCAHTVGPPPGSGGGPRTDKRKLLGS

SEQ ID NO: 169282 - protein, 126 aa, Glycine max
  Coding DNA Sequence Number=SeqID_77597
MVFTDERIDVGLKRGKFSHSAWMNEKTRANEEGENEGEAHVVTAIPIQPSFPPTQQCHYSANNQPSPYPPPIYPQRPSLKQPQTIGQFAQVTYAPQFGTSKTVQSEITRLARWWGCRKTTSKVQNK

SEQ ID NO: 169283 - protein, 442 aa, Glycine max
  Coding DNA Sequence Number=SeqID_77598
  Homolog annotation: Hit_ID=Q6WAY6; Match level="QueryCoverage=56%, HitCoverage=41%, E-value=2e-29, Identity=35%"; Hit description =Putative uncharacterized protein
MGTNQTGKRFYQVKVKSPDTTSIKELGRLMEPLQMQAFRKTYGKIFRVDHSRELQLWVKDSARGLDRIKQTRNGIAGLPQKYLEDKARGMANQGDWVPFMDVLALLIFGVVLFPNVDGLVDLAAIDAFLAYHHSKESLVVAVLADLFDTFDRRCEKSSARIICCLPALCVWLVSRLFQQDARHPCPLLSHRSCTEKRRIDWDQLLAGIGGRTISWFPRWKEGKEGVLFSCGGYPNIPLVGTRGCINYNPALAIRQLGYPMRGAPTEESMSPILVRDFGAQSSKTIQRIHKAWETPLKKDQELRGIRNGIIGGYHEWLKVHIRGLDWLAKLKVVSKESFEAPEEDEEVQALKSELGKAKLAKEKFKLAATHVRKECAGLREENAITARALEQETKRARKEEYGRNKFRGALWGSNSELKLRKEERDQSRAHSMVLKEELVACS

SEQ ID NO: 169284 - protein, 164 aa, Glycine max
  Coding DNA Sequence Number=SeqID_77599
MPPTRHPLDPDKSNRALGFPALITGLCQSFGVPVTPSKVIQPPITQAFIEKYCTPRQAHGDAPQAADASPPPHQADPAGSLGMERYLQHLVRQQAANHREQGQSFTPFVCPTPYQFRAEVALPGDGPEAQAGEAPVGAPGNAEEACMDEEMTNLLGFLGGSGAT

SEQ ID NO: 169285 - protein, 220 aa, Glycine max
  Coding DNA Sequence Number=SeqID_77600
KDQELRGIRNGIIGGYHEWLKVRIRGLDWLAKLKVVSEENFEAPEEDEEVQALKSELGKAKLAKEKFKLAATHVRKECAGLREENAITARALERETKRARKEEYGRNKFRGALWGSNSELKLRREERDQSRAHSMVLKEELIACSRSKRSLSQRLCETETNMLAIIAKYQEELGLATGPTSIESRMSMPKYMRKKEARGRGDRLFTPKRQPCGWIGLLLP

SEQ ID NO: 169286 - protein, 60 aa, Glycine max
  Coding DNA Sequence Number=SeqID_77601
IMNKKLKRIKNKSRVQESRRIQDSRRKPTNKNQDSRFKISRIKIKIQDSRFKNEEKTQSR

SEQ ID NO: 169287 - protein, 67 aa, Glycine max
  Coding DNA Sequence Number=SeqID_77602
MEYLSINQNIADLIRKFGIENAKRMATPISTACYLDKDEIGQSIDIKKYRDSKQVPKNHILVQLREL

SEQ ID NO: 169288 - protein, 139 aa, Glycine max
  Coding DNA Sequence Number=SeqID_77603
  Gene Ontology: Mol. function=two-component response regulator activity; Cellular component=mitochondrion; Biological process=two -component signal transduction system (phosphorelay)
  Homolog annotation: Hit_ID=A7NZB2; Match level="QueryCoverage=72%, HitCoverage=14%, E-value=1e-46, Identity=87%"; Hit description =Chromosome chr6 scaffold_3, whole genome shotgun sequence
  Pfam annotation: Domain name=Response_reg; Domain location=20-129; Score=47.6; E_value=4.3e-11; Accession=PF00072.15; Description =Response regulator receiver domain
MATQALITPKSRCLWLPLWDASFNLSTFFYRFEAGLSTITAVSNGLQAWKVLEDPENGIDLVLTEVAMPILSGIGLLCKIMSHKTLKNIPVIMMSSHDSMGIVFKCLSKGAVDFLVKPIRRNELKNLWQHVWRRCHSVS

SEQ ID NO: 169289 - protein, 433 aa, Glycine max
  Coding DNA Sequence Number=SeqID_77604
  Gene Ontology: Mol. function=protein dimerization activity
  Homolog annotation: Hit_ID=A5ASU7; Match level="QueryCoverage=41%, HitCoverage=48%, E-value=5e-29, Identity=32%"; Hit description =Putative uncharacterized protein
  Pfam annotation: Domain name=DUF659; Domain location=241-330; Score= -35.3; E_value=0.00017; Accession=PF04937.6; Description=Protein of unknown function (DUF 659)
  Pfam annotation: Domain name=RVT_2; Domain location=2-151; Score= -173.0; E_value=0.0025; Accession=PF07727.5; Description=Reverse transcriptase (RNA-dependent DNA pol
  Pfam module annotation: Pfam domain module=DUF659::RVT_2; Domain location=241-330::2-151
MSLAPELPIALRKVKIGPNGNPDHYKARLVANGYTHTSSVDYRQKSSLFIFSLPCLSSIIGLFINWTLKMPYYLVSNKKSLCIYLIVYIDDIVITSDDSAKIHNQFQTKDLVKEELLNLALEKEKRENSEMPNVAYDLSSDDEIQIPAAASNVKGKKNVAKKGPMDMFCRNPPSEISKRQKDKLRQANIKELCDKTLKADVHQYIARFWYQAGLSFNLVKLNSFQDMIDAIAAYGPNLPAPSYHDSRFPLLNKEMELTENLLKDHKSQWGRHGWTMFVKSIDGSKFVKTGEKLFELLYSLVEEIGEHDVVQYNQQLAHRYNIRDEIDPITLNDNDECNEWLVGQVDDDNDLVHADDPHLIEMYTRRKTSSKKRKQPSSGGIISGAAQASKKGPAATSASRGKGKAHEAIEESGEEEEGYAPLDMNEIDYDGTE

SEQ ID NO: 169290 - protein, 194 aa, Glycine max
  Coding DNA Sequence Number=SeqID_77605
MAITRGIEELTYLQRGCLEKLPKNVLEKEERWWGHQREAKPVVWAHQRSEITAVAGSGSGYCAPMKNNTPKGKTTEKCAGKGRAVVGSSERGKASGVVAPEIRDHSGGWQRQRSSGSGSESATHTRKFAKSRSNDACENNSDSSDENDYGSRDLSVRDGSGTQTSHMGLENGARYWDRPINIMQEKEDFEDWGS

SEQ ID NO: 169291 - protein, 455 aa, Glycine max
  Coding DNA Sequence Number=SeqID_77606
  Gene Ontology: Mol. function=DNA-directed RNA polymerase activity; Cellular component=DNA-directed RNA polymerase III complex; Biological process=transcription
  Homolog annotation: Hit_ID=A7NZA4; Match level="QueryCoverage=76%, HitCoverage=18%, E-value=6e-33, Identity=53%"; Hit description=DNA -directed RNA polymerase
  Pfam annotation: Domain name=RNA_pol_Rpb1_5; Domain location=105-440; Score=-74.2; E_value=3.6e-06; Accession=PF04998.8; Description=RNA polymerase Rpb1, domain 5
MMQLPEIATEKGDQCVATHRKSFWHCQCCLARLGNARESASDVKWGCCRQGWADQGEMAAAGTVAAMFGKVGKEERVIEKQKHATRISVTLFPVGDAFCYSLNLELVAKSIKVVMTSRSASVVITLDMKRIQDAHLNIDANIVKESILRTKKTKLKPEHIKILDIKKLEVVPQDVDRSKIHFQLHYLKNLLPTVVVKGIKTVDRVVISKDTKAEKFRLLVEGWHKTMLQVAFDRTGVVEDPKLVSGHTLHGDLSRLKTHRWRKGTTKSIVHFRTYGRNRFGELINAGEQRTKLGGMLLKFLSKLDQRVAEGNLRQLGVDQKYGCLIAVVVEYPARLKRALTEESSIVASINTGFREVMGVEGIDGRKTVSNHIHEVRDTLGIEAARESIVKEIKYTMVDTHGMNIDIRHMMLLADMMTATASVRGRDDSIGGVSESIIMGIPIQIGTGMIKVKQR

SEQ ID NO: 169292 - protein, 154 aa, Glycine max
  Coding DNA Sequence Number=SeqID_77607
  Gene Ontology: Mol. function=DNA binding; Cellular component =chromosome; Biological process=nucleosome assembly
  Homolog annotation: Hit_ID=Q01FF9; Match level="QueryCoverage=53%, HitCoverage=29%, E-value=2e-29, Identity=82%"; Hit description =Histone H4
  Pfam annotation: Domain name=Histone; Domain location=25-91; Score =51.2; E_value=3.6e-12; Accession=PF00125.15; Description=Core histone H2AH2BH3H4
MSGRGKGGKGLGKGGAKRHRKVLRDNIQGITKPAIRRLARRGGVKRISGLIYEETRGVLKIFLENVIRDAVTYTEHARRKTVTAMDVANLDLRNPCCYGYSKKKWQGLGVGSCRFAWSSIGPLYQRMLCLVDGGPLKPLGSVFNIVCINLRVRV

SEQ ID NO: 169293 - protein, 95 aa, Glycine max
  Coding DNA Sequence Number=SeqID_77608
MEKVGKGKTMKILVESAEKDSSNKTKDDIKSTANDENVGGVALDVIALQLDFHATFALSTIVALNQYDDFSLLLGAKRALSTEQLHRAGPLRRAK

SEQ ID NO: 169294 - protein, 75 aa, Glycine max
  Coding DNA Sequence Number=SeqID_77609
MVPCDEDIALVLKSFNTRKAWMKGKGILLISSSPHAWSDQIQRKYRQSIGFVSALSPCMEKECTKLSLKHRASSL

SEQ ID NO: 169295 - protein, 186 aa, Glycine max
  Coding DNA Sequence Number=SeqID_77610
MRKMRLFRWAAICTSLFIFALRVYLAKTRSAFLKENGSAGNNIPYNDGEGREGHGKWRGKVARGGEGGEGGRRLRPWPRGKKKKVAVEEEERKKETNSVWGEREREGEVVSSGAEGEGGRRRKKKVERRGREVGEGRRRWRGGEEERLVGEEEKEKKEKGSACWEKEKKKNVLGEGSVLWGRGGKK

SEQ ID NO: 169296 - protein, 60 aa, Glycine max
  Coding DNA Sequence Number=SeqID_77611
MKNFKILETKIFVSIIQGYFEGLSLEYETCFYHVPFSTRALYRGGSLTMFSTEAATIASD

SEQ ID NO: 169297 - protein, 402 aa, Glycine max
  Coding DNA Sequence Number=SeqID_77612
  Gene Ontology: Mol. function=protein serine/threonine kinase activity; Cellular component=cytoplasm; Biological process=protein amino acid phosphorylation
  Homolog annotation: Hit_ID=Q9ZP91; Match level="QueryCoverage=100%, HitCoverage=100%, E-value=1e-173, Identity=75%"; Hit description=MAP kinase
  Pfam annotation: Domain name=Pkinase; Domain location=38-353; Score =242.2; E_value=1.1e-69; Accession=PF00069.16; Description=Protein kinase domain
  Pfam annotation: Domain name=Pkinase_Tyr; Domain location=41-353; Score=-30.5; E_value=1.6e-10; Accession=PF07714.8; Description =Protein tyrosine kinase
  Pfam module annotation: Pfam domain module=Pkinase::Pkinase_Tyr; Domain location=38-353::41-353
MENNGAESENPKGIPIHGGKYVRYNILGSHFQVYSKYAPPLQPVGRGAYGITKEGVAIKKIGNAFDNRIDAKRTLREIKLLCHMEHDNIIKIKDIIRPAERENFNDVYIVYELMDTDLHQIIQSNQSLTDEHCQFVIVSVGVSAKEKNVIEWMGVKPGCRGDGLKYIHSANVLHRDLKPSNLLLNANCDLKICDFGLARTTSETDFMTEYVVTRWYRAPELLLNCSEYTAAIDIWSVGCILMEIVRREPLFPGKDYVQQLALITELKQASKEQIPHNHLSKQLLGSPNDSDLGFLRSDNAKKYVKQLPHVEKQSFAERFPEMSPLAIDLAEKMLVFDPSKRITVEEALNHPYMASLHEINEEPTCPTPFIFSFEQTILKEEDIKELIWKESLNFSQDHQMLE

SEQ ID NO: 169298 - protein, 38 aa, Glycine max
  Coding DNA Sequence Number=SeqID_77613
MDNHLGISACTLTSQGQYDRQRERRHKSLRVNGLVGRD

SEQ ID NO: 169299 - protein, 91 aa, Glycine max
  Coding DNA Sequence Number=SeqID_77614
HLVRQQAANHCGQVQIHECLYRFSLSQQGQGSAPFVCPTPEQFGAEVAWPGDWPDAQAGEEPAGSPGEADESYMDEDMIDLLGFLEGSEAA

SEQ ID NO: 169300 - protein, 125 aa, Glycine max
  Coding DNA Sequence Number=SeqID_77615
MTRGNPGDLQPFDPEIDRTFHRLVRHSVHLDYPENFVPFEHPEHSVIGESEHSVVGNFEHPDFENYNFEHSENMAHPPPRERTLREMAAPDFTYESLCIQYPDEDVTYVLKNGLTHLLPKFHGLA

SEQ ID NO: 169301 - protein, 187 aa, Glycine max
  Coding DNA Sequence Number=SeqID_77616
  Pfam annotation: Domain name=G-patch; Domain location=43-82; Score =26.0; E_value=0.00014; Accession=PF01585.14; Description=G-patch domain
MPYVEAAEESLETAFQSFEVVSISSVDSFSGQACLSDAAVMMARVMLGNGYEPGMGLGKDNGGITSLINAKGNREKYGLGYKPTQADMKRSIAGRKSGGQSSCWRQESEGSPPCHISRSFISAGLGDKGQVVVICEDDVPSTLDLVRPCPPDFQLGKLASGGTPWHLRNEHNVNPYGFKSSIVGPRL

SEQ ID NO: 169302 - protein, 89 aa, Glycine max
  Coding DNA Sequence Number=SeqID_77617
  Homolog annotation: Hit_ID=A5AG41; Match level="QueryCoverage=66%, HitCoverage=5%, E-value=2e-07, Identity=45%"; Hit description =Putative uncharacterized protein
MILLDNGDLESESSSDDEMPLLEDCSNVDVVEPVNGDVFVTRRALNMQPNIGGDEEQHEHIFHTRCHIKDKICSSFEQSHHCVNTSSAC

SEQ ID NO: 169303 - protein, 162 aa, Glycine max
  Coding DNA Sequence Number=SeqID_77618
MVTMIVDTLPVFYYEKLVGYMPSSFADLVFPEERIEMGLKRGKFDYISPVGASGRRVKTAGAKKKKGDAHTVTSTPAWPKPPEPPMVPTNTHNITRVFRLTPGALPTQCSPSQGHPCPHKGELLWLRLQPSLTRPTMPTLARAPTRRGTSRQGRLRFSPRSQ

SEQ ID NO: 169304 - protein, 205 aa, Glycine max
  Coding DNA Sequence Number=SeqID_77619
  Homolog annotation: Hit_ID=Q6UUU1; Match level="QueryCoverage=29%, HitCoverage=40%, E-value=2e-18, Identity=78%"; Hit description =Putative uncharacterized protein
AIGAGLFAITPAAKGGCAARRIRRGELELHRGGGRSRTSGSPGLQEFDSFMSNNYKGQSPARHGFKRLPIPFGKGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLQG

SEQ ID NO: 169305 - protein, 107 aa, Glycine max
  Coding DNA Sequence Number=SeqID_77620
MTRGNPGDLKPFDPEIDRTFHRLVRHSVHPDHSVHFEHSKYSDFEHSTTNFHTENMAQPPPRERTLREMAAPDFTYESLCIQYPDEGVPYVLKIGLIHLLPKFHGLA

SEQ ID NO: 169306 - protein, 117 aa, Glycine max
  Coding DNA Sequence Number=SeqID_77621
  Homolog annotation: Hit_ID=A8ARU6; Match level="QueryCoverage=28%, HitCoverage=42%, E-value=4e-10, Identity=84%"; Hit description =Putative uncharacterized protein
MAYERGGDFLEDARKILNREAFPPGGSLVRSPVPAFRFTGVIPLLWPRLSHSTPDTQFRVGSSLQAGLYARTPPFSPTAAPYPVTIVLSPTRKDMQKHHWQQPLVIDLEELVLKSCA

SEQ ID NO: 169307 - protein, 66 aa, Glycine max
  Coding DNA Sequence Number=SeqID_77622
MDTSKPYTRAMRDIVHEPQANLGEDQNGRQRRRGERRRHPQGNKPWKKELHHQDEPWIRSLERMLQ

SEQ ID NO: 169308 - protein, 259 aa, Glycine max
  Coding DNA Sequence Number=SeqID_77623
  Gene Ontology: Mol. function=endonuclease activity; Cellular component=cytoplasm
  Homolog annotation: Hit_ID=A7MI38; Match level="QueryCoverage=98%, HitCoverage=98%, E-value=1e-109, Identity=77%"; Hit description =Putative uncharacterized protein
  Pfam annotation: Domain name=Exo_endo_phos; Domain location=37-252; Score=71.5; E_value=2.9e-18; Accession=PF03372.14; Description =EndonucleaseExonucleasephosphatase family
MRYVAGQPAERIFPPGAMLHLGQALPPGAPLPADPTLRVLVWNIFKQQRADWMSVLQGFGKDAHLVLLQEAQTTPELVQFATSNYLAADQVPAFVLPQHPSGVMTLASAHPVYCCPLREREPLLRLSKSALVTAYPLPTGEMLMVVNIHAVNFSLGVDVYSKQLGPIGEQIQHHRGPVIMAGDFNAWSRQRMNALYRFAREMALREVNFTDDHRRKAFGRPLDFVFYRDMKVSEASVLVTRASDHNPLLVEFSPGAAKR

SEQ ID NO: 169309 - protein, 386 aa, Glycine max
  Coding DNA Sequence Number=SeqID_77624
  Gene Ontology: Mol. function=hydrolase activity, acting on carbon -nitrogen (but not peptide) bonds; Cellular component=chitosan layer of spore wall; Biological process=carbohydrate metabolic process
  Homolog annotation: Hit_ID=A6T9E8; Match level="QueryCoverage=43%, HitCoverage=67%, E-value=3e-78, Identity=85%"; Hit description =Putative hydantoin racemase
  Pfam annotation: Domain name=Asp_Glu_race; Domain location=4-196; Score=13.4; E_value=0.00011; Accession=PF01177.13; Description =AspGluHydantoin racemase
  Pfam annotation: Domain name=Polysacc_deac_1; Domain location=263 -373; Score=9.6; E_value=0.00018; Accession=PF01522.12; Description =Polysaccharide deacetylase
  Pfam module annotation: Pfam domain module=Asp_Glu_race::Polysacc _deac_1; Domain location=4-196::263-373
MTATIGAAARAVAAPGTEIVAVCPSEGVPSIEGHFDEAIAAVGVLEQVKRGKEQGVSGHIIACFGDPGLLAARELASGPVIGIAEAAMHTATLVATRFSIVTTLPRTLVIARHLLQQYGFSHHCAALHAIDLPVLALEDGSGVAQEKVRERCLQAKREDGSGAIVLGCGGMASLAQDLTKETGPAGTCRMSDVSEKKEYSFNKNYPRDLIGYAGQPPHAQWPGEARVAVQFVLNYEEGAENNVLHGDAGSEQFLSDIIGAASYADRHMSMDSLYEYGSRAGFWRIHQEFQQRGLPLTIFGVAMALARHPQIVEAIKAADYDVVSHGWRWIHYQGMDAKTERQHMQQQWTCSPSYSVKRPPAGGFSYDSDYYGDDLLFWTQSPVRRH

SEQ ID NO: 169310 - protein, 90 aa, Glycine max
  Coding DNA Sequence Number=SeqID_77625
MGQTLANLLRIHLGSSICIIYSKGEKSFCSSHKLSCNQETDCLLDCENCNQETSCLLDCENLEHKGEGSQGVFKVCKGFTEVVENLKWVA

SEQ ID NO: 169311 - protein, 266 aa, Glycine max
  Coding DNA Sequence Number=SeqID_77626
  Gene Ontology: Biological process=transposition, DNA-mediated
  Homolog annotation: Hit_ID=Q6UUU1; Match level="QueryCoverage=28%, HitCoverage=51%, E-value=9e-22, Identity=70%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLRQENHLNPGGRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKMAYERGGDFLEDARKILNRE

SEQ ID NO: 169312 - protein, 56 aa, Glycine max
  Coding DNA Sequence Number=SeqID_77627
QTGSYAWRAAALVSMYENLNNASKRSAKQLVGYITLLHCWIYMHFPTVASSIAAED

SEQ ID NO: 169313 - protein, 78 aa, Glycine max
  Coding DNA Sequence Number=SeqID_77628
MADGSTSMSSLLQDIWKNLGFGYDRKEFEEILGCPLGGRKSYLFSGLYPSMARIAKVVKVSVQELDRVKCWIKWPQNN

SEQ ID NO: 169314 - protein, 118 aa, Glycine max
  Coding DNA Sequence Number=SeqID_77629
MLYAADDMNAFTDTRARKMISSYLYTWGCSAPCLTHKTIPSGVANCRNLPFCGRARRGLTAASSKGGKCAESPPHVYLWKCRKTEGTDHEEYSRFGSCITFEEVLAPLTFVPKDNTLN

SEQ ID NO: 169315 - protein, 133 aa, Glycine max
  Coding DNA Sequence Number=SeqID_77630
  Subcellular localization annotation: CTP_CleavageSite=42; ConfidenceScore=5.16e-01
MVLGVGYSIINQLPSVNLPVPRAWSDVQYFRGCATVAGRRTRQRAGEGGRPRITGGEHAFRLAMIELRKGTKQGPQQRASDPAKTEWKAAKSTKGVEQGAVGQQHDDIPDRHRQKVQTGAAQAAEQHGGKRQY

SEQ ID NO: 169316 - protein, 176 aa, Glycine max
  Coding DNA Sequence Number=SeqID_77631
MARKATAGEGSRAAPQAEIEFEEHRFQSEEHQCPFLGAGQWIPHDEDAINQFLGHPLILEEGQCCQYDERRSQVSCFDEEAIGQLLCSPGHDFSQSVAGSQVRIMHTSMTTLTQIWMTLLLSNILPSDLNFDLLLPKCQLIYAILTQIRVHVSQLISDAIYQFIGIAPPRHPANPK

SEQ ID NO: 169317 - protein, 74 aa, Glycine max
  Coding DNA Sequence Number=SeqID_77632
MMLVLSASFPAKLSLKAQLTKSIWGLAQDGMLSAAIINFHREEVALSASSTLSPLLKVQLTVKMLGLAQQCALS

SEQ ID NO: 169318 - protein, 652 aa, Glycine max
  Coding DNA Sequence Number=SeqID_77633
  Gene Ontology: Mol. function=catalytic activity; Cellular component =endoplasmic reticulum membrane; Biological process=metabolic process
  Homolog annotation: Hit_ID=A7Q2X7; Match level="QueryCoverage=94%, HitCoverage=89%, E-value=0.0, Identity=71%"; Hit description =Chromosome chr12 scaffold_47, whole genome shotgun sequence
  Pfam annotation: Domain name=AMP-binding; Domain location=86-545; Score=294.5; E_value=2.1e-85; Accession=PF00501.19; Description=AMP -binding enzyme
MVDHGGVPVEVGGEAGYAVRNARKTELVEAPWKEAPTMAHLFEQSCDKYSHNPFLGTRKLIRKEFVTSSDGRKFEKLHLGNYEWETYGEVFSRVSNFASGLLKLGHSADSRVAIFSDTRAEWLIALQNVTVVTIYATLGEDALVYSLNETEVSTLICESKLLKKLDAIRSRLTSVQNVIYFEDDSNDEDAFSGSLSNWTIASVSEVEKLGKESPVQPSLPSKNDIAVIMYTSGSTGLPKGVMITHGNIVATTAAVMTIIPNLGSKDVYMAYLPLAHVFEMAAESVMLAVGCAIGYSSILTLTDSSSKIKQGTKGDANVLKPTLMAAVPAIVDRIRDGVVKKRRLSAVKGSWLGAWGLEKLVWDTIVFKKIRDAIGGRLRYMLCGGAPLSGDSQHFINVCMGAIIGQAYGLTETFAGAAFSEWYDRKVGRVGPPLPCSYIKLVSWEEGGYLTSDKPMPRGEIVVGGFSVTAGYFKNQEKTNEVFKVDEHGMRWFYTGDIGQFHPDGCLEIIDRKKDIVKLQHGEYVSLGKVEAALSSCDYVDNIMVYADPFYDYCVALVVVSYQSLEKWAEQAGIEHRNFSDLCNKPETITEVLQAISKVAKATKLVKSEIPAKIKLLPDPWTPESGLVTNALKIKREQLKAKFKDDLLKLYA

SEQ ID NO: 169319 - protein, 170 aa, Glycine max
  Coding DNA Sequence Number=SeqID_77634
  Homolog annotation: Hit_ID=Q6WAY6; Match level="QueryCoverage=74%, HitCoverage=21%, E-value=1e-11, Identity=33%"; Hit description =Putative uncharacterized protein
MGQLQRQAFRKAYGEIDLGLGYDRSLCKGDRFPHLLVPTVEEFKEILGCPLEGRKPYLFSGFYLSMSRIARVVRILAQELDRVKQNRNGVVGIPRKCLEERARALASQNEWPPFIDIMALLIFGVVLFPNVDGLVDLAAIDAFLAFHHSKESPVVTVLADIYDTFDQSVK

SEQ ID NO: 169320 - protein, 62 aa, Glycine max
  Coding DNA Sequence Number=SeqID_77635
MWSSAPFPEMSASSGWNFLVSQTTSVDPDPRVGWQANIPRYFLSSRDDQVDDAPRTSSVVQK

SEQ ID NO: 169321 - protein, 110 aa, Glycine max
  Coding DNA Sequence Number=SeqID_77636
MKLLFFLGDPYVLSSEGKDKKFLSLVKVYGRRVEVLAQKVPAGPACVSTRFRPQAKPPWPRTAQEWAKGKDWGPDFVGVGCCRNLPFGGRATRDSRDACSTKGIRAESPP

SEQ ID NO: 169322 - protein, 256 aa, Glycine max
  Coding DNA Sequence Number=SeqID_77637
RDIVIKGDPLVVGGHSSGSGRLGSSRIMAAFLCGPNWGEVPKDLYIAIQDCLIHGVRLTPTHEEILSLLAGPLSFLSLGINASRDDALGHALMSRSYPSYSPLLPSTFDKDFFDDDMDMGWNVRRVVKSSELLHLPLESVEMNWIDDEIWGTRSKFDISVMNELCKTMWLTCDRNGGFRSWQPLEIIAGFVPKVSPSSCIATARLLSLPLRGYVSGLIWGVIKIYSATSLCPIGIAFDGGGKNATKFPLYWTEDHY

SEQ ID NO: 169323 - protein, 149 aa, Glycine max
  Coding DNA Sequence Number=SeqID_77638
MRRSYPYYKGVCGPEGQDKEVDTTGSDQVEAKPDQVGTSATNEGGRCGVINTITSGFVGEASSRRSIPLIMCTGVDFARFDPEQNDPMVITVGIANWDYVLIDVDTYNILIGRTTLNALGTIISMPHLPIKFPNQRGDIVTVKPGQVEA

SEQ ID NO: 169324 - protein, 116 aa, Glycine max
  Coding DNA Sequence Number=SeqID_77639
MSQCHILSEYCVLTLSQPSLRREGEAKGKIVSSREEKAWSRHQHLFEENIRKTKKRSVNFENKGSIVFYAWGSDEDITKGKDHEALEGPMTRGRLKQAQHVIETRLVICIAAIDDD

SEQ ID NO: 169325 - protein, 337 aa, Glycine max
  Coding DNA Sequence Number=SeqID_77640
  Homolog annotation: Hit_ID=Q2HW90; Match level="QueryCoverage=91%, HitCoverage=62%, E-value=4e-36, Identity=32%"; Hit description =Putative uncharacterized protein
MGTNQNGKRFYQVKVKGLDVTNLKELGRLMGPLQRQAFRKVYGKILDLTAMEVFTEAVVSLAQYYDQPLRCFTFGDFQMVPTVEEFEEILGCPLGGRKPYLFSSCGRRFGKRVGSHEANSERRSGPAAEYLEGKARDMASQEKWVPFADILALLIFGVVLFLNVDGLVDLAAIDAFLAYHHSKESLVVAILADLFDTLDRRCEKNSAQIVCCLPALCVWLVSHLFQQDIRHPCPLQSYCSCVEKRRVDWDQHLAGIGGNTINWFPRWKEGNEGVLFSCGDYPNVPLIGTRGCINYNPALAIRQLGYPMRGAPTEESLSKLFPNYNPMYLCPSSASST

SEQ ID NO: 169326 - protein, 207 aa, Glycine max
  Coding DNA Sequence Number=SeqID_77641
  Homolog annotation: Hit_ID=Q6CQE6; Match level="QueryCoverage=42%, HitCoverage=59%, E-value=3e-07, Identity=38%"; Hit description =Kluyveromyces lactis strain NRRL Y-1140 chromosome D of strain NRRL Y- 1140 of Kluyveromyces lactis
MEISNLTLGRKNRRIFPVVVQSERFFDVSEKNMENTQKRGQKGHSEAFSDPWLAQASLWLAWAPRRLRGEVTSSPWRARLLQVEATACLGKLLFNLLPSFPINRREGAEGMGSDFQTLKDLVKLRRRRIQIEAKALPNRFKINPTCNNPFSDDPLSPWKQQPMGSRLGLSCPNLKAYPFSEVTDSFCQLLLPTLFHRPEVVHLGDLR

SEQ ID NO: 169327 - protein, 60 aa, Glycine max
  Coding DNA Sequence Number=SeqID_77642
  Homolog annotation: Hit_ID=A3BPW6; Match level="QueryCoverage=51%, HitCoverage=3%, E-value=9e-09, Identity=90%"; Hit description =Putative uncharacterized protein
MKMVTAFNGNMKKAAAGLRRINLDGLRWRVFDAKGQEILLFFYPLYKMQLGGTKVIMHSP

SEQ ID NO: 169328 - protein, 297 aa, Glycine max
  Coding DNA Sequence Number=SeqID_77643
  Homolog annotation: Hit_ID=A5BEV8; Match level="QueryCoverage=46%, HitCoverage=24%, E-value=1e-14, Identity=30%"; Hit description =Putative uncharacterized protein
  Subcellular localization annotation: CTP_CleavageSite=62; ConfidenceScore=5.18e-01
MQIVKPKEEIFPNKRRPAQAPSTNPNDKEWAVASASSSFSLFGAQCFAVFSSFSCDWLASVKVKEKVSVFILAVVGSSAVTFEMDEDQWMYDSIMSEEVNMDYQNEEEYGVNEPHVDCSNVFNTSQVIMCLTAEMMYCGGLDPLLMKTDLWRSDEYRCRKKEFVRRDTGTRKCGCPFKLRGKLVDGGQGWMMKLMYGIHNHELSMVKPRNILLTLKEHNGNSCMTIKQIYNERSAYRSSRRGSDTEMQHLMKLLERDQLLLLDFVGVTQPGMTFSAGFAYLEGERLNNVVWALERFR

SEQ ID NO: 169329 - protein, 128 aa, Glycine max
  Coding DNA Sequence Number=SeqID_77644
MQNNNSSVRRSASSSEQPNPRRIMPMLDQFQLFIHNFIHNIVDVKADGNFGYRSIAGLLDYIKLFGGTDKFEELRMSLLVDGLTKVTMDKWMDITDMGYVFASRYNVILVSLSQQQSMSLFPCLQCIA

SEQ ID NO: 169330 - protein, 123 aa, Glycine max
  Coding DNA Sequence Number=SeqID_77645
  Gene Ontology: Mol. function=peptidase activity
  Homolog annotation: Hit_ID=A5ANP1; Match level="QueryCoverage=69%, HitCoverage=25%, E-value=1e-10, Identity=36%"; Hit description =Putative uncharacterized protein
MEEGFSTNKPPLFRGVKYDYWKERIVDNFESIHIDLWDMVENGNYIPYDDQLNEIPRSRWTKAQKIIFLFNSKARNVMLCALLEEEYTKRCNSLPHTFTRVSLTVSRKELHTYTLGIAPETEK

SEQ ID NO: 169331 - protein, 128 aa, Glycine max
  Coding DNA Sequence Number=SeqID_77646
FSLGSLLNQSQTYQVNPYGVYPDLSSFTGSGVYPDLSSFTGSGVIQISIVCIKRSAPSSCNKGPIGNLGISLLGDQMVVDLMAVGASALSSSSNLRLAKPSLCASEHRVRRTRASSQVSASSPSPPYL

SEQ ID NO: 169332 - protein, 218 aa, Glycine max
  Coding DNA Sequence Number=SeqID_77647
  Gene Ontology: Mol. function=maltose transmembrane transporter activity; Cellular component=periplasmic space; Biological process =carbohydrate transport
  Homolog annotation: Hit_ID=P19576; Match level="QueryCoverage=97%, HitCoverage=53%, E-value=1e-111, Identity=93%"; Hit description =Maltose-binding periplasmic protein precursor
NRTSPWPLIAADGGYAFKFENGKYDVKNVGVDSAGAKAGLTFLVDLIKNKHMIADTDYSIAEAAFNKGETAMTINGPWAWSNIDKSKVNYGVTLLPTFKGKPSKPFVGVLSAGINAASPNKELAKEFLENYLMTDPGLEAVNNDKPLGAVALKSFQEKLEKDPRIAATMANAQKGEIMPNIPQMSAFWYAVRTAVINAASGRQTVDAALKDAQGRITK

SEQ ID NO: 169333 - protein, 75 aa, Glycine max
  Coding DNA Sequence Number=SeqID_77648
  Gene Ontology: Mol. function=transcription factor activity; Cellular component=intracellular; Biological process=regulation of transcription, DNA-dependent
  Homolog annotation: Hit_ID=A4WG64; Match level="QueryCoverage=81%, HitCoverage=17%, E-value=7e-23, Identity=90%"; Hit description =Transcriptional regulator, LacI family
  Pfam annotation: Domain name=LacI; Domain location=24-49; Score=46.4; E_value=1e-10; Accession=PF00356.12; Description=Bacterial regulatory proteins, lacI fa
MVTSEVRCSGEEKTLKSRKEVAAATMKDVAEKAQVSTATVSRALMNPDKVSQATRNRVEQAALEVGYFPQAMGRN

SEQ ID NO: 169334 - protein, 96 aa, Glycine max
  Coding DNA Sequence Number=SeqID_77649
MPLSPVILVTLADNELRSLASSFLSLGGAYLHGTAWLFQYGNGTGLTTKGYRGFWGAASLVKYITKGLGLPKLLSSADYIHICFSSLPSSPTSSQP

SEQ ID NO: 169335 - protein, 40 aa, Glycine max
  Coding DNA Sequence Number=SeqID_77650
MEEEYSTNKPPMFRGINEALGLNPELGLDLKRTDYFILQN

SEQ ID NO: 169336 - protein, 139 aa, Glycine max
  Coding DNA Sequence Number=SeqID_77651
MDFFFDESFECIQAFQNSNLIPFMSLKLSVYSELVKAFYSNLEIQESTLISEVYRIKLVIDQSFFYVLTQLTSEGVPFEGTLDDDWKFDFSMHDARWLVCTNQADMIGRLLAGSLALESRILHYLIVRILLPRSSNLAQ

SEQ ID NO: 169337 - protein, 124 aa, Glycine max
  Coding DNA Sequence Number=SeqID_77652
  Gene Ontology: Mol. function=protein binding; Cellular component =nucleus
  Homolog annotation: Hit_ID=A7NVG5; Match level="QueryCoverage=87%, HitCoverage=15%, E-value=5e-12, Identity=39%"; Hit description =Chromosome chr18 scaffold_1, whole genome shotgun sequence
MHLNHPNSQPHVETEVFSDHDVQILQFSTVIKRSVNHPHSSVTTIVALERALESEENNAPSALAAPVLENVSHDQFQAFSYVPSDSFAFDSDSSFVITPPPILEGRDIVKCYGTKALVVPMHSG

SEQ ID NO: 169338 - protein, 165 aa, Glycine max
  Coding DNA Sequence Number=SeqID_77653
MSAGIYVMRIMKLAKYRLKAQVEKDKAPEWRRTYQGNPCGVYPDLSSFTGSGVFLDLSSFTGSGVYPDLSSFTGSGVIQTFVACIKRSAPTQEMFDRRHPDPLEGLGGSMKRARARKAKEALQQVLSILFEYKPKFQGEKSKGPIGNLGISLLGDQMVADLLAVG

SEQ ID NO: 169339 - protein, 109 aa, Glycine max
  Coding DNA Sequence Number=SeqID_77654
MGEKLATQLAQASRVASSRSNRLLEESSGGPKWAWVLFAPPFLLKSHLIMQRCFHLISGVSRKLTDCASIFFGFPACPEFHKLPNDGCQAPHKDQRKVACHQAKVPGRN

SEQ ID NO: 169340 - protein, 124 aa, Glycine max
  Coding DNA Sequence Number=SeqID_77655
  Homolog annotation: Hit_ID=A0PAV3; Match level="QueryCoverage=30%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVVRNGKSTARTSALASVAVTAARRVPFAIQAAQLLGRAIGAGLFAITPAGERGMCCKAIKLGNARVFPVTTL

SEQ ID NO: 169341 - protein, 39 aa, Glycine max
  Coding DNA Sequence Number=SeqID_77656
MCFHEENPSQGASVTLLRRFREQFREDFPPFFTVLRSST

SEQ ID NO: 169342 - protein, 101 aa, Glycine max
  Coding DNA Sequence Number=SeqID_77657
MAPRKLASKRSRKDKAAEGTSSAPEYDSHRFRSAVHQQRFEAIKGWSFLRERRVQLKTRTHLVAHDPGNLNKTSASSEGGKIPWICMYIAKIPHKNMHMFR

SEQ ID NO: 169343 - protein, 44 aa, Glycine max
  Coding DNA Sequence Number=SeqID_77658
MASFGTPTIFTVLQMSMYVASWIKEYGYEKLAVCTSGLAMLVKY

SEQ ID NO: 169344 - protein, 93 aa, Glycine max
  Coding DNA Sequence Number=SeqID_77659
MRVALIGRSLSQQIGLARRLHYSLHSFLEIRIVIIVIKRKECALRRPYRTRAKARIMSEIEEVHEQMKADMESMKEKMTTMMEAMMSMRKIME

SEQ ID NO: 169345 - protein, 312 aa, Glycine max
  Coding DNA Sequence Number=SeqID_77660
  Gene Ontology: Cellular component=mitochondrion
  Homolog annotation: Hit_ID=Q6Z8F0; Match level="QueryCoverage=20%, HitCoverage=58%, E-value=4e-21, Identity=79%"; Hit description =Putative uncharacterized protein P0459B01.18
YALTRTLHRRSGSVGGATHRGIPPISFLAPYGPTPGARRCRGTPRARAAIHNRDDDVSTSISTARAWATIAIRVGQCPESIGGPALTSFSSFPRGTCSLSVSRQYLALDGIYRPIGAAFPNNPTRRQRLVVRQGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPD

SEQ ID NO: 169346 - protein, 51 aa, Glycine max
  Coding DNA Sequence Number=SeqID_77661
MVKKRLSFELKKVAVGLSSAVGLSDYSPLSAASERLVQRRIWQSINIKVAR

SEQ ID NO: 169347 - protein, 54 aa, Glycine max
  Coding DNA Sequence Number=SeqID_77662
MVLACHRVRRLWMTKGKSVGPNGSRMSSDPPPLDDKGPNGSRMSSGPPPLDDNR

SEQ ID NO: 169348 - protein, 55 aa, Glycine max
  Coding DNA Sequence Number=SeqID_77663
MELSLMCDALKGSLSNVVLGMTLREEPLLMSTLATMRSKHLGTELEFVIMVIAVS

SEQ ID NO: 169349 - protein, 152 aa, Glycine max
  Coding DNA Sequence Number=SeqID_77664
MTDLVSAEDDVNLRVSTGLSAAIDEGAEDDTAKKNVYTDNHSGISARQRDSNVSMTDLVSAEDDTAKKNVYTDNHSGISARQRDSNVSMTDLVSAEDDTTKKNVYTDNHSGIPARQGDSNVSMTDLVSAEDDVNLRLSTGLSAAIDEGRRRR

SEQ ID NO: 169350 - protein, 20 aa, Glycine max
  Coding DNA Sequence Number=SeqID_77665
MTEDIVVFQILPYRASPHAT

SEQ ID NO: 169351 - protein, 115 aa, Glycine max
  Coding DNA Sequence Number=SeqID_77666
  Gene Ontology: Mol. function=metal ion binding; Cellular component =plasma membrane; Biological process=embryo sac development
  Homolog annotation: Hit_ID=A9P8M8; Match level="QueryCoverage=99%, HitCoverage=99%, E-value=2e-32, Identity=59%"; Hit description =Putative uncharacterized protein
  Pfam annotation: Domain name=zf-C3HC4; Domain location=63-101; Score =5.4; E_value=0.022; Accession=PF00097.16; Description=Zinc finger, C3HC4 type (RING finger)
MELIYDLRGHMELLYNEISELRKSIKGCMEMQIELQQSMKQEVQTVKKEEKKSNNRTPKKGNCCICYEMKVDSVLYRCGHMCTCLKCANELQWNSGKCPICRAKIEDVVRVYVDG

SEQ ID NO: 169352 - protein, 146 aa, Glycine max
  Coding DNA Sequence Number=SeqID_77667
  Homolog annotation: Hit_ID=A5BUQ3; Match level="QueryCoverage=98%, HitCoverage=35%, E-value=3e-10, Identity=33%"; Hit description =Putative uncharacterized protein
MMGKSNVHIEKNEHLQWMNMSLQSSQHEVELQHQNRHQGSFSKSEATIKDSGKRMEDEGSKCGTLCMCLPCFGFGKTKAVKARKGGIKVDHSMNHVMSSTFSLENFELNSTQAKGIVIQENNHEDDSFSSYFDLPSIVLKCSGDDA

SEQ ID NO: 169353 - protein, 24 aa, Glycine max
  Coding DNA Sequence Number=SeqID_77668
MAELMDKRIPEVEIGRYATPHEYR

SEQ ID NO: 169354 - protein, 853 aa, Glycine max
  Coding DNA Sequence Number=SeqID_77669
  Gene Ontology: Mol. function=DNA-dependent ATPase activity; Cellular component=nucleus; Biological process=DNA replication initiation
  Homolog annotation: Hit_ID=Q8H1A3; Match level="QueryCoverage=100%, HitCoverage=100%, E-value=0.0, Identity=79%"; Hit description=Mini -chromosome maintenance protein MCM6
  Pfam annotation: Domain name=AAA_3; Domain location=394-535; Score= -13.8; E_value=0.011; Accession=PF07726.2; Description=ATPase family associated with various
  Pfam annotation: Domain name=AAA_5; Domain location=394-541; Score= -6.1; E_value=0.0084; Accession=PF07728.5; Description=ATPase family associated with various
  Pfam annotation: Domain name=MCM; Domain location=336-660; Score =693.3; E_value=1.8e-205; Accession=PF00493.14; Description=MCM235 family
  Pfam annotation: Domain name=Mg_chelatase; Domain location=361-549; Score=-146.3; E_value=0.017; Accession=PF01078.12; Description =Magnesium chelatase, subunit ChlI
  Pfam module annotation: Pfam domain module=AAA_3::AAA_5::MCM::Mg _chelatase; Domain location=394-535::394-541::336-660::361-549
MEAYGGFMVDEKAVRVENAFLDFLKSGISSFKSSSQRNELYYEAEIELMKSNESNTMFIDFDHVIRFSDLLQQTISDEYLRFEPYLKNACKRFVMDLKPSLVSDDSPDKDINIAFYNMPIVKRLRELGTSEIGRLVSVTGVVTRTSEVRPELLHGTFKCLECGGVIKNVEQQFKYTEVPTICANATCSNRTRWVLLRQESKFADWQRVRMQETSKEIPAGSLPRSLDIILRHEIVEHARAGDTVIFTGTVVVIPDIMALASPGERSECRRDASQRKGSTAGNEGVSGLKALGVRDLNYRLAFIANSAQICDGRREIDIRNRKKDVDEDNQQFTDQELEEIKRMRSTPDFFTKLVESIAPTVFGHPDIKRAILLMLLGGVHKFTHEGINLRGDINVCVVGDPSCAKSQFLKYTSGIVPRSVYTSGKSSSAAGLTATVAKEPETGEFCIEAGALMLADNGICCIDEFDKMDIRDQVAIHEAMEQQTISITKAGIQATLNARTSILAAANPAGGRYDKSKPLKYNVALPPAILSRFDLVYVMIDDPDDQTDYHIAHHIVRVHQKREGALAPAFTTAELKRYIAYAKTLKPKLSPDARKLLVDSYVALRRGDTNPGSRVAYRMTVRQLEALIRLSEAIARCHLDNEVQPRHVRLAVKLLKTSIISVESSEIDLSEFQEQNHDDGAGGGNENDNNRDANYQEGNDTAQQAAGNGNDQVGNDAAQQATGNNGNPADGSKPQVRKLIMSDEYYQRVTSALIMRLRQHEEAVVQGDGLSGMRQKDLIQWYVDQQNERNNYSSMDEVQAEISKIKAIIESLIRREGHLIVVDNGEAAAAAAEPPGAPRNYRILAVAPNYVID

SEQ ID NO: 169355 - protein, 279 aa, Glycine max
  Coding DNA Sequence Number=SeqID_77670
  Homolog annotation: Hit_ID=A7NW58; Match level="QueryCoverage=30%, HitCoverage=81%, E-value=1e-28, Identity=75%"; Hit description =Chromosome chr5 scaffold_2, whole genome shotgun sequence
MVKEIENLTEDERRALRGSKFAPLPRRSNSKPRLAHPCGPLATNKAAALAKFLERKLKDPNGLASINPDLLELAVNNAKETVYASAVCAVLQLELENYLSNPHNKGVKVEGIIVETTLISTLNAGALRLNVIQWQIDTYCVYSFANLNLKAIKCAIVVASLVFVDFEGGGRLKLVVDLQNQALPLAWLYQCPKFITTTTTSSKKEHSYSQPHTSHIRAGSPLAVLNSSPDTSLPDPPDTRRRPSLPDRQPRPLRNPILKNHPMHPQTPPHHRYWLPLHS

SEQ ID NO: 169356 - protein, 235 aa, Glycine max
  Coding DNA Sequence Number=SeqID_77671
  Homolog annotation: Hit_ID=A7UQU7; Match level="QueryCoverage=42%, HitCoverage=17%, E-value=5e-10, Identity=34%"; Hit description=IMP dehydrogenase/GMP reductase, putative
MVRIKCLSWALGRVIGRALGREMSRDVDEALQQRRPITSAQALVDDVVTDAEGFLGGPHNTSILMDYVHHVPMTFWNGEECPELKLSSHGRKVEKFDRSAPEIEGLVTATGLSHLITFSLDTDVFRDLTQSGNYAWGVVALFYMYENLNDASKSSAIQLAGYTILLQCWIYKHFPSVASSITEDYREKTLRACRWKFEKTLSVLMYRKKLNRLASNVVCSIPYDDHQTLREFELK

SEQ ID NO: 169357 - protein, 369 aa, Glycine max
  Coding DNA Sequence Number=SeqID_77672
  Gene Ontology: Cellular component=mitochondrion
  Homolog annotation: Hit_ID=A7QWL2; Match level="QueryCoverage=75%, HitCoverage=17%, E-value=8e-15, Identity=38%"; Hit description =Chromosome chr4 scaffold_205, whole genome shotgun sequence
  Pfam annotation: Domain name=DUF537; Domain location=208-346; Score =16.4; E_value=2.3e-06; Accession=PF04396.5; Description=Protein of unknown function, DUF537
MCRWRIFIDPPLKVLKKSVICIVSPKCTKYINSRNKLLWMCGNAESLNKKVGRDNADDALLEHLKRWVSENPPPAHVMLIAGDRGYARTLRQLRENKYNILLVTRDAPPSKVFSDIASILWKWSAILEKKPLGKHLNDPLMDTCLMKVHRRPKKSSNISTVYVFCTVERDNANDALLERRPPRIRPLYSSFWSHYPSSSLSSSPTNLMQICVWWDIKNCLIPSSCDASQIDDYIETALIANKAHDLSRRNQEKLVERPKIRIIFNQGTFLDSVIQHYHTPRVGVFCVVGRDNADDALLKHLKRWVSENPPPAHVMLIASDRGYAPTLRQLREQMARGCITHAATTTMIAAAIEDRVVNRSERFHYAIAL

SEQ ID NO: 169358 - protein, 151 aa, Glycine max
  Coding DNA Sequence Number=SeqID_77673
  Gene Ontology: Mol. function=sequence-specific DNA binding; Cellular component=intracellular; Biological process=regulation of transcription, DNA-dependent
  Homolog annotation: Hit_ID=A7PTW4; Match level="QueryCoverage=71%, HitCoverage=58%, E-value=7e-43, Identity=77%"; Hit description =Chromosome chr7 scaffold_31, whole genome shotgun sequence
  Pfam annotation: Domain name=CBFD_NFYB_HMF; Domain location=31-96; Score=124.0; E_value=4.3e-34; Accession=PF00808.14; Description =Histone-like transcription factor (CBFNF-Y) and archaeal histone
  Pfam annotation: Domain name=Histone; Domain location=28-99; Score =12.8; E_value=0.0085; Accession=PF00125.15; Description=Core histone H2AH2BH3H4
  Pfam module annotation: Pfam domain module=CBFD_NFYB_HMF::Histone; Domain location=31-96::28-99
FWGISQSMEDIGGSSSNDNNNNGGIIKEQDRLLPIANVGRLMKRILPQNAKISKEAKETMQECVSEFISFVTSEASEKCRKERRKTVNGDDICWALATLGFDNYAEPMRRYLHRYREVEVDHNKVNLQEKGNSPEEKDDELFKLSNRGVGL

SEQ ID NO: 169359 - protein, 41 aa, Glycine max
  Coding DNA Sequence Number=SeqID_77674
MAPVTGGEELWWSWLGKDAQRNGKGKGPDEYQKKFLINPPT

SEQ ID NO: 169360 - protein, 421 aa, Glycine max
  Coding DNA Sequence Number=SeqID_77675
  Gene Ontology: Mol. function=oxidoreductase activity; Cellular component=anchored to membrane; Biological process=electron transport
  Homolog annotation: Hit_ID=A7Q4U0; Match level="QueryCoverage=93%, HitCoverage=79%, E-value=1e-105, Identity=49%"; Hit description =Chromosome chr10 scaffold_50, whole genome shotgun sequence
  Pfam annotation: Domain name=BBE; Domain location=331-388; Score =78.3; E_value=2.5e-20; Accession=PF08031.3; Description=Berberine and berberine like
  Pfam annotation: Domain name=FAD_binding_4; Domain location=1-109; Score=21.8; E_value=5.9e-05; Accession=PF01565.14; Description=FAD binding domain
  Pfam module annotation: Pfam domain module=BBE::FAD_binding_4; Domain location=331-388::1-109
GGHGYEGVSYVAAQPFFLLDMFNLRSIEVNMDTETAWVEAGATLGEVYYRIAEKSEVHGFPAGVGPTVGVGGRISGGGYGNLMRKYGTSVDNVVDAQVVDVQGRLLNRSSMGEDLFWAIRGGGGGSFGVVLVYKIKLVRVPERATVFQVERTLEQDATNITTELRPTKGVNSLQQRDESRLKFEEVSIFSDQQCLEQNYLQQKIIKTQSECIETSWLQSVLFWYNMDIATPVEILLERQPWSLKYLKRKSDYVKRPIPKEAVMYFNPYGGRMAENPSTETAFPHRAGNLWMIQYKADRYETGQEVAKYYINLVRDLHKYMTPFVSQNLRQAFMCYKDLDLGINHHNVYGYFEGSSYGVQYFHDNFKRLVQIKTRVDPANFFRTEQSIPVLSHAELVRMVTEKSIVPILFGLFALNWIRTFK

SEQ ID NO: 169361 - protein, 333 aa, Glycine max
  Coding DNA Sequence Number=SeqID_77676
  Gene Ontology: Mol. function=nucleotide binding; Cellular component =mitochondrion; Biological process=response to cold
  Homolog annotation: Hit_ID=A7NW61; Match level="QueryCoverage=57%, HitCoverage=83%, E-value=2e-33, Identity=37%"; Hit description =Chromosome chr5 scaffold_2, whole genome shotgun sequence
MDCIRGCGYFFGSGRASRNVMLLIDEGATDSVIAFLLQKRFSVILCSGFKETLDEIKEMGFEPFKKKFGLALLAKKIVPKSHWEAKVDVFKSWGWSEELVIGMFKRQPLFMLASQDKIDRVMRFWVKQLGWDSLALAKKPEIFGFSLERRIIPRALVVQYLVAKGLRKKSASMIVPFAVSDKEFLEKYVMRFKEEEAELLKLYQGKMSGHGNKEDGAAPLTVVLSMSEGFQVSNDDEDHHDASSSAVQHGNDDDDHNDASNSAGVIFGELLYDAVSGFHKLVDSEQTREFAQNWTSLTTMIETAPLIGFKHYSRNQPGIASGKLNPQCIILLS

SEQ ID NO: 169362 - protein, 260 aa, Glycine max
  Coding DNA Sequence Number=SeqID_77677
  Gene Ontology: Mol. function=protein binding; Biological process =xylan catabolic process
  Homolog annotation: Hit_ID=Q1S5Q1; Match level="QueryCoverage=69%, HitCoverage=32%, E-value=3e-17, Identity=29%"; Hit description =Leucine-rich repeat
  Pfam annotation: Domain name=LRR_1; Domain location=151-173; Score =0.6; E_value=2.3e+02; Accession=PF00560.24; Description=Leucine Rich Repeat
  Pfam annotation: Domain name=LRR_1; Domain location=175-197; Score =4.6; E_value=43; Accession=PF00560.24; Description=Leucine Rich Repeat
  Pfam annotation: Domain name=LRR_1; Domain location=199-219; Score =12.8; E_value=1.3; Accession=PF00560.24; Description=Leucine Rich Repeat
  Pfam annotation: Domain name=LRR_1; Domain location=65-84; Score=3.8; E_value=60; Accession=PF00560.24; Description=Leucine Rich Repeat
  Pfam annotation: Domain name=LRR_1; Domain location=87-106; Score =0.7; E_value=2.2e+02; Accession=PF00560.24; Description=Leucine Rich Repeat
  Pfam module annotation: Pfam domain module=LRR_1::LRR_1::LRR_1::LRR _1::LRR_1; Domain location=151-173::175-197::199-219::65-84::87-106
MGEGYDTDDLVEITLFGKYVDELNTFLATGVVDNVVVILHLDKVKTYNEEQLVWDVSLDISNFKSLVLINLGENHFAGVVPTKMPESMQGMILRCNQFTGNIPPQNKLSGFIPPCLFNITSMDGARRMSHYQFSVDLFLKGSEMEHRGTWLFGSLDLSTNNLSGEISTEIFGFTQFVSLNLCRNRIMGIISSNIGGMKNLEILDLSYNNLSGNPKLCGPPLIKNSSDEEANHDKAKQEFGILCSSVEHGDTNIFRPWIIL

SEQ ID NO: 169363 - protein, 678 aa, Glycine max
  Coding DNA Sequence Number=SeqID_77678
  Gene Ontology: Mol. function=triacylglycerol lipase activity; Cellular component=integral to membrane; Biological process=lipid metabolic process
  Homolog annotation: Hit_ID=Q8W4L6; Match level="QueryCoverage=99%, HitCoverage=98%, E-value=0.0, Identity=55%"; Hit description =Putative uncharacterized protein Z97340.15
  Pfam annotation: Domain name=Lipase3_N; Domain location=45-126; Score= 79.5; E_value=1.1e-20; Accession=PF03893.7; Description=Lipase 3 N -terminal region
  Pfam annotation: Domain name=Lipase_3; Domain location=230-363; Score= 81.7; E_value=2.4e-21; Accession=PF01764.16; Description=Lipase (class 3)
  Pfam module annotation: Pfam domain module=Lipase3_N::Lipase_3; Domain location=45-126::230-363
MATAAGAAVMLYYVLSRRMARKEEDDGEDHGGEVPKLSRSVRRRRLSRRPAQAPATLLESIVTLSETIRFTYSETLGKWPIGDLAFGINYFMRKQGNLAVASVYAGSDCVQLKGDEIIVELYELLRLLTLCMLFSKKPFPVFLDSAGFSLDDVLIQKPKAGIWLYMEKLCGLFEIRGSYGLYYLGVLGILKVTPIFFSYSKFVNIKRPLVVLLLKPAFTIIRDTQSKCLLLLIRGTHSIKDTLTAATGAVVPFHHSVLNDGGISNLVLGYAHCGMVAAARWIAKLCTPTLLKALGECPDFKVKIVGHSLGGGTAALLTYILREQNEFSSTACMTWELAESGKHFITTIINGSDLVPTFSTSSIDDLRSEVTASSWLNDLRDQVEHTKVLNVVYRSATALGSRLPSISSAKARVAGAGAILWPVTSSTQVVMKRAQSVAEAVVRTRSSLSSWSCMSARRRNVGSSVNSKTDDLTETSLISERSTESRMTEEVVREPMLKDENTSSSGGSGHDDTDEEEQLIPANQDITASAVDDFTEGQLWYELEKELQKQDNTMNIDAQEEEAAAAKEITEEENQLVDAAAECSSSSITTADNVDSHRFYPPGRIMHIVSVPSLDESNSNSDDPLEEHVGLYETPRELYSKLRLSRTMINDHYMPMYKKMMELLIRELEKDSSCNILD

SEQ ID NO: 169364 - protein, 81 aa, Glycine max
  Coding DNA Sequence Number=SeqID_77679
MVQKEGGGIGFILDDDGSDNHGGVNNDNHDDKCDNNHDSSVSNNHSNDDDNDHGSGEYVQDDSSDEVDIEHQPTSPSPKES

SEQ ID NO: 169365 - protein, 71 aa, Glycine max
  Coding DNA Sequence Number=SeqID_77680
MAIIDFLETAKGHICVHVSTVRTVIRSDRIRGWLVGGGGGGIEAKEVRERVKLGPQFLRGEVAATLHTNEV

SEQ ID NO: 169366 - protein, 100 aa, Glycine max
  Coding DNA Sequence Number=SeqID_77681
MECYSYGLHEEERHLEEVDLVEGELVRVADYYPEGEEGEGEDRVENGKLGLVDREVIAGVFGVGVEVVEPGVDKHGEYSLGIVTGLVWLAEAEGGGRESS

SEQ ID NO: 169367 - protein, 92 aa, Glycine max
  Coding DNA Sequence Number=SeqID_77682
MAPQQDLVKIGLEGFDLIDRFYGAPIRRPANVSKQRQGRSGVQATHQNHKEEPVVINSREAASKFGGIMVVNYYPKTKPQNRWGKFIQAFKP

SEQ ID NO: 169368 - protein, 75 aa, Glycine max
  Coding DNA Sequence Number=SeqID_77683
MDTHKRELKLECKIYNLLCELFVGERLQASASSPSQTSSAREDNEEEATVGKKLKRLGFEKKKGNEEEPVADHCN

SEQ ID NO: 169369 - protein, 108 aa, Glycine max
  Coding DNA Sequence Number=SeqID_77684
  Gene Ontology: Mol. function=aspartyl esterase activity; Cellular component=extracellular region; Biological process=cell wall organization and biogenesis
  Homolog annotation: Hit_ID=Q42920; Match level="QueryCoverage=63%, HitCoverage=15%, E-value=2e-27, Identity=85%"; Hit description =Pectinesterase precursor
  Pfam annotation: Domain name=Pectinesterase; Domain location=2-108; Score=-134.6; E_value=1.9e-11; Accession=PF01095.10; Description =Pectinesterase
  Subcellular localization annotation: CTP_CleavageSite=38; ConfidenceScore=5.04e-01
MALASSLPFLSIFLPRRQPKTVNGANFMAKDIGFENTAGSAKKQAVALLVRANQAVFYNCQMDGFQDTLFAQSQRQFYRDCSISGTIDSVAPLTLSLETPLECSKTAN

SEQ ID NO: 169370 - protein, 648 aa, Glycine max
  Coding DNA Sequence Number=SeqID_77685
  Gene Ontology: Biological process=T cell differentiation in the thymus
  Homolog annotation: Hit_ID=A7Q8F8; Match level="QueryCoverage=88%, HitCoverage=84%, E-value=1e-127, Identity=45%"; Hit description =Chromosome chr5 scaffold_64, whole genome shotgun sequence
  Pfam annotation: Domain name=DUF1032; Domain location=24-581; Score= -142.5; E_value=0.0012; Accession=PF06278.2; Description=Protein of unknown function (DUF1032)
MVRIVMWVSDSINQEVLRSKRVLCDQVVNSLILSASILKQKSEFQHKVGVCALPVLDDLCCRHVRDMKPIIQQDHKDGPSVQPEESGPCAVTDEENDQFWGLDDIPVEEKNSLDGTTGKEVNLEHFIKPPANLVVLEGDCLDAGGDGGELESFLLSTTDLYQDFILLDTSDAVAVHEFLKGSKAATTQNDANRGTSARKSFHSPGHTGGSARRLSAAKNQGANNCTPKLNCGFDDENVRPSSPASAGLDDFNYGFDMDHGCDASRDSDNSDEDNDDPWKPLNPHEPGNLRVKPFRKLNTLKKNSINVRQPVSMNTLFPLAKLHGPISPELMEMWEMRHHVHERQRDSLALLYEKLRQSLVNEGNKTGGTFFNSEADNDDNEYDGGNPDFDTPDNAYMEEDLPPFSNEHEFDDAHINPDEAVDLSQASLEDLCRSHLNALLASIAETEKQTEMAARVSTWKQRIENNLEEQESHPPFDIQDYGERILDKFSLLSLEASSSGVLSFSDLVKGQEKHDVARSFSSLLQLVNNGDVTLERNGVDGSVCCTSVDPFHVRLLKQSSKEGDNAQLRLPKKRAKSPTKKPSTKGDKNKTVREKSPSSSRYGSTGVSPPTNCKFSVKLGKVSAMKSPEAKRRRRSQYVEPVNLHSAG

SEQ ID NO: 169371 - protein, 747 aa, Glycine max
  Coding DNA Sequence Number=SeqID_77686
  Gene Ontology: Mol. function=transferase activity, transferring glycosyl groups; Biological process=sucrose metabolic process
  Homolog annotation: Hit_ID=A7Q8G2; Match level="QueryCoverage=97%, HitCoverage=98%, E-value=0.0, Identity=76%"; Hit description =Chromosome chr5 scaffold_64, whole genome shotgun sequence
  Pfam annotation: Domain name=Glycos_transf_1; Domain location=483 -673; Score=87.9; E_value=3.3e-23; Accession=PF00534.11; Description =Glycosyl transferases group 1
  Pfam annotation: Domain name=Sucrose_synth; Domain location=1-480; Score=820.5; E_value=9.7e-244; Accession=PF00862.10; Description =Sucrose synthase
  Pfam module annotation: Pfam domain module=Glycos_transf_1::Sucrose _synth; Domain location=483-673::1-480
MPATSVRERVLDTLSRYRNEFISLLSRYVAGGKGILQPHDLLYEVEKLLEEDEGMQKLKDSPFEAIVLPPFVSIALRPRPGVWEYVRVDAFELSVDNLSVAEYLRLKEELVDGQLQGLGFERGWGDTAERVSEMVHLLLEILQAPDPNTLESFLGRIPMVFNVVVVSPHGYFGQANILGLPDTGGQDSGSSPGHATVLNTWRESFAAHSGPIRLEQDCLRNTVTHDGQLVYILDQVRALENEMLIKIQKQGLDVSPKILIVTRLIPEAKGTTCNQRLERVSGTEHSYILRVPFRTKNGILRKWISRFDMWPYLETFAEDASHEIAGELQGIPDLIIGNCSDGNLVATLLSYKLGITQCNIAHALEKTKHPDSDIYWKKYEDKYHFTCQFTADLIAMNNADFIITSTYQEIAGSKNNVGQYESYTAFTLPGLYRVVHGIDVFDPKFNIVSPGADMCIYFPYSDRERRLTSLHGSIEKLVYGAEQNEEHIGLLNDRSKPIIFSMARIDPVKNITGLVECFGKSSKLRELVNLVVVGGYIDVQKSTDIEEMREIEKMHNLIEEYNLHGQFRWIKAQMNRARNGELYRYIADVKGAFVQPALYEAFGLTVVEAMTCGLPTFATCHGGPAEIIEHGVSGFHIEPHHPDHVAAILINFFEQCQSDPGYWNKISDAGLRRIHERSTFARYTWKIYSERLLTLAGVYGFWKHVSKLEKRETRRYLEMFYILKFRDLVSHISLNNFCVQPLCLSLY

SEQ ID NO: 169372 - protein, 217 aa, Glycine max
  Coding DNA Sequence Number=SeqID_77687
MADVNDGNCANGGKEGNVVNPPERTLQDYLTPWWESLPLHGLSFEDLVLHLKKFLRLKHNKEPNYNSRLHQFAYFFVREKLKTGIWTYQTGALPPRTSVQCNSCKNSSQWQSLQMNCSHHGYSSQRLVHIFYGGLSQHNKTCLDVAAKENLMHKLTNATVEIIEAMVSNAYNGIGDTRILKRPTGVHLVEASSSSIAIHQKLDVLAKQMETLTKAQI

SEQ ID NO: 169373 - protein, 168 aa, Glycine max
  Coding DNA Sequence Number=SeqID_77688
  Gene Ontology: Biological process=embryonic development ending in seed dormancy
  Homolog annotation: Hit_ID=A2ZVD4; Match level="QueryCoverage=25%, HitCoverage=10%, E-value=4e-09, Identity=71%"; Hit description =Putative uncharacterized protein
MAMSVARLKKDEIQRLKKEIDSVWRPAMELHELETSARRVQQHHHHHRRCYSNPNPPHPHPQPALLVFFDGTAFNNIVEEFKNFTTHIAHVLPVFDDGGSTAKIVVCPRDWRNLIVLGDNGFFLCYIYQGGNTIFFEVAVDGTLAIVDGLRWGGSTTMDGPKLILKLL

SEQ ID NO: 169374 - protein, 95 aa, Glycine max
  Coding DNA Sequence Number=SeqID_77689
MGEPPVKLASSWQESTTYISYVCRLRAAAGETGAQEELAIGAGELQLWCREEHAIGAGELQLWCREELASLTGELSFKILFYKTRDMGLLLGQHK

SEQ ID NO: 169375 - protein, 361 aa, Glycine max
  Coding DNA Sequence Number=SeqID_77690
  Gene Ontology: Mol. function=heat shock protein binding; Cellular component=integral to membrane; Biological process=protein folding
  Homolog annotation: Hit_ID=A7Q8C6; Match level="QueryCoverage=99%, HitCoverage=99%, E-value=1e-109, Identity=58%"; Hit description =Chromosome chr5 scaffold_64, whole genome shotgun sequence
  Pfam annotation: Domain name=DUF1977; Domain location=264-357; Score =94.8; E_value=2.8e-25; Accession=PF09320.2; Description=Domain of unknown function (DUF1977)
  Pfam annotation: Domain name=DnaJ; Domain location=103-164; Score =115.2; E_value=1.9e-31; Accession=PF00226.22; Description=DnaJ domain
  Pfam module annotation: Pfam domain module=DUF1977::DnaJ; Domain location=264-357::103-164
MEGNKDEALRCVRIAEEAIASGNKDRALKFLRIAQRLNRDLPLQSLLEKCDRFDSHSAAAAACGGSGASPANGHSPRREGLNGERNYTEENVQLIREIKGKSDYYAILGLEKSCSVEEIRRAYRKLSLKVHPDKNKAPGSEDAFKKVSKAFKCLSDDGSRRMYDQTGTGTDDYESTEVNTFWRRRRRRTTTTRDFFGDEFDPDEIFRAFFGHSDVFGRNNNVYRTRGMGNPNHQHRHEFNAGSGGRHHNVMLLIQLLPFLIIVLLAYLPFSEPEYSLHKHYNYQIPKTTERLEVQFFVKSTAFDANYPLGSDAREAIEESVIKDYRSMLRRYCQVEMQRRSWNRNLPAPHCDKLHNFAVVA

SEQ ID NO: 169376 - protein, 457 aa, Glycine max
  Coding DNA Sequence Number=SeqID_77691
  Gene Ontology: Mol. function=microtubule motor activity; Cellular component=microtubule associated complex; Biological process =microtubule-based movement
  Homolog annotation: Hit_ID=Q6WJ05; Match level="QueryCoverage=94%, HitCoverage=46%, E-value=0.0, Identity=80%"; Hit description=Central motor kinesin 1
  Pfam annotation: Domain name=Kinesin; Domain location=191-453; Score =146.1; E_value=9.5e-41; Accession=PF00225.14; Description=Kinesin motor domain
MPQGNAAAAAALLDHGGDAGDAVMARWLQSAGLQHLASPLASTAIDHRLLPNLLMQGYGAQSTEEKQRLLKLMRNLNFNGESGSEPYTPTTQSLGVAGSDGFYSPEFRGEFGAGLLDLHAMDDTELLSEHVVSEPFEPSPFMPGDTRVFEDDFDPINSKLESGEADTDASISLPMNSTRENNVAKIKVVVRKRPLNKKELAKKEDDVVTVTGNAYLTVHEPKLKVDLTAYVEKHEFCFDAVLDEHVTNDEVYRSTVEPIIPTIFERTKATCFAYGQTGSGKTYTMQPLPLRAAEDLVRQLHQPVYRDQRFKLWLSYFEIYGGKLYDLLSDRKWVFNLLYDYVGKLCMREDGRQQVCIVGLQEFEVCDVLIVKEFIEKGSAARSTGSTGANEESSRSHAILQLAVKKHSEVKASKRNNDGNEARSGKVVGKISFIDLAGSERGADTTDNDRQTRYFYI

SEQ ID NO: 169377 - protein, 133 aa, Glycine max
  Coding DNA Sequence Number=SeqID_77692
  Gene Ontology: Mol. function=aspartic-type endopeptidase activity; Cellular component=small subunit processome; Biological process=DNA integration
  Homolog annotation: Hit_ID=A7PFA7; Match level="QueryCoverage=93%, HitCoverage=18%, E-value=7e-20, Identity=39%"; Hit description =Chromosome chr11 scaffold_14, whole genome shotgun sequence
MASFGPIFSFSGTPTITTTKLNWKNYPSRSASVELWFLGQGHHDHLEKASDSVPNDKRPEWEKFDYQLCTVLSFKTCRSFWKKAQEIFANDIQSLFDATMKVTALKQTSHDMIAHVGKARAAVEELRKFLVAD

SEQ ID NO: 169378 - protein, 86 aa, Glycine max
  Coding DNA Sequence Number=SeqID_77693
MKEGSRVQRFESPLGKASLWSGKALVMEGSRWRVGRTCGFVTRNPFYVRPRAEGIPLDIMVGNLIDHDEVCEILRIPLDDKPKRTS

SEQ ID NO: 169379 - protein, 111 aa, Glycine max
  Coding DNA Sequence Number=SeqID_77694
  Gene Ontology: Mol. function=serine carboxypeptidase activity; Cellular component=extracellular region; Biological process =proteolysis
  Homolog annotation: Hit_ID=Q2Z1Y2; Match level="QueryCoverage=63%, HitCoverage=14%, E-value=2e-13, Identity=58%"; Hit description =Serine carboxypeptidase
  Subcellular localization annotation: CTP_CleavageSite=22; ConfidenceScore=5.23e-01
MAPSSTLTLSKVSLLLFFLSLSSSYATSRLSHDHVNPPKSRAEKLIRSLNLFPKNPINIVKGDGLANAFVSGNIVEKKFSFLGDSGPSIEDLGHHAGYFSLPNSKAARGEN

SEQ ID NO: 169380 - protein, 227 aa, Glycine max
  Coding DNA Sequence Number=SeqID_77695
  Gene Ontology: Mol. function=methyltransferase activity; Cellular component=cytoplasm; Biological process=metabolic process
  Homolog annotation: Hit_ID=A7NW50; Match level="QueryCoverage=87%, HitCoverage=40%, E-value=2e-56, Identity=58%"; Hit description =Chromosome chr5 scaffold_2, whole genome shotgun sequence
MEDSAAQKRKQQEFALASVSEVSSAPSSASPGVALFAGDRLQIRNESHRVALNAHLSDIQLFRLGPIESVCMVEGSEADKQTSYSSGVAIQFRNEEESEAFHCVFQQWKKGFDVQGGNLPNGTDVITSKSKFDEKIEPSSAKMYFHYYGQLLHQQNMLQDYVRTGTYYAAVLENRADFVGRVVVDVGAGSGILSLFAAQLNENSGCFPCPLLPKLSMKSSSDPKLDP

SEQ ID NO: 169381 - protein, 180 aa, Glycine max
  Coding DNA Sequence Number=SeqID_77696
MGSFKTEPHVHYIKEDENGYHYAVVDVDTWLYFEAVGMTKDDLGYKNGNFKLWWKENGVDFQEGWKEIYNDMEALNLSNYAANIGLVVHIYVQHLPPTHGGQDVVSIVVNSIDGFIRSEPDFVAKPIENGGFKEIKSGKGKDDEDFVSNSEHASEEESLCASDVEKEAEDNNRVSWRIPV

SEQ ID NO: 169382 - protein, 170 aa, Glycine max
  Coding DNA Sequence Number=SeqID_77697
  Gene Ontology: Mol. function=receptor activity; Cellular component =integral to membrane
  Homolog annotation: Hit_ID=Q6A151; Match level="QueryCoverage=87%, HitCoverage=76%, E-value=1e-34, Identity=46%"; Hit description =Peripheral-type benzodiazepine receptor
  Pfam annotation: Domain name=TspO_MBR; Domain location=18-163; Score=- 21.4; E_value=0.00018; Accession=PF03073.6; Description=TspOMBR family
MASQILHDTKKSQARRALRSLAIGIAVPFTLTLAIIIIFGSGRKYNQIISKPFWFSPLWFIHLATLGSSFFMGLAMWLVWADGGFQGETDAMSLYIVHVSLSIVWHPLVLVMGVYWLALISCLVNFGTLFLCYLRFRKVNPFARDLAKPCLTWTAYLCLIINDLRHRKNV

SEQ ID NO: 169383 - protein, 266 aa, Glycine max
  Coding DNA Sequence Number=SeqID_77698
  Gene Ontology: Mol. function=phosphoprotein phosphatase activity
  Homolog annotation: Hit_ID=A7NW44; Match level="QueryCoverage=81%, HitCoverage=55%, E-value=9e-32, Identity=36%"; Hit description =Chromosome chr5 scaffold_2, whole genome shotgun sequence
MDFLNQEMSMLSPEGELKISFGYQCNSESANATLANTNICNGVIGEDKSFRFWTLLNHFVGPSTPSNMLEYDPCTFTSMSAPSRSEGFLNGMEVPVAGGAAGEDRVQAVCSEDEWLFCEIYDDSIKASNIASMGGSFQYNFDDSLNLQEHQSLSSFKGSDSSLDCFTDSTPHSNSEASPKSFSQTTVLNGLQHVLSQVENDFLHTVDNEAERARLLSDHPDDPKAIVAGKVKGKLKVKRALGAGYLKKAYTPKSLSGFLPPDLGPT

SEQ ID NO: 169384 - protein, 87 aa, Glycine max
  Coding DNA Sequence Number=SeqID_77699
  Homolog annotation: Hit_ID=A7PRL5; Match level="QueryCoverage=87%, HitCoverage=14%, E-value=2e-16, Identity=50%"; Hit description =Chromosome chr14 scaffold_27, whole genome shotgun sequence
MRVFEGRKERDNGTWSVMIKLYALEVLGLFRRMQSEGLASLNHGRQVHAQLMASEFYQGLYVASVLITMYAKCGDLVIPSMARERKL

SEQ ID NO: 169385 - protein, 42 aa, Glycine max
  Coding DNA Sequence Number=SeqID_77700
KCDNSLSVCCLCLDPVMILSFVFGGADEYEEPHARGHGNTTF

SEQ ID NO: 169386 - protein, 149 aa, Glycine max
  Coding DNA Sequence Number=SeqID_77701
  Gene Ontology: Mol. function=aspartic-type endopeptidase activity; Biological process=RNA-dependent DNA replication
  Homolog annotation: Hit_ID=Q69F85; Match level="QueryCoverage=65%, HitCoverage=9%, E-value=2e-10, Identity=48%"; Hit description=Gag -pol polyprotein
MVSPHKAPNMSLITFTSIDFKAIDLDQDDSVVISVEITSFIVRKTLIDQGSLADILFWNIFKQLVYTPHLAIKFPLNTGYIITIHVDQRTTRECYMESLKLGPLMKDEPCRVVHYVEIMAGIEGFEELDLDPRTNTDNRVKPYEETCAF

SEQ ID NO: 169387 - protein, 105 aa, Glycine max
  Coding DNA Sequence Number=SeqID_77702
MKVLEKCAIDVEASNKFNKKEVMRLESALGTTEKERDAKIEEKIWIKQKTYNEVYKAHDFEFNHYLLKRGTRWWATNYLPGETQMANPGEDDVLSSSIGSILIWF

SEQ ID NO: 169388 - protein, 57 aa, Glycine max
  Coding DNA Sequence Number=SeqID_77703
MSLSLRRFMALPKIVQADYQQRRPQDKTAQITRERSEKVVDIEKNGRKEEMLKAEEE

SEQ ID NO: 169389 - protein, 265 aa, Glycine max
  Coding DNA Sequence Number=SeqID_77704
  Gene Ontology: Mol. function=protein binding; Cellular component =cytoplasm
  Homolog annotation: Hit_ID=Q8VXU6; Match level="QueryCoverage=78%, HitCoverage=77%, E-value=5e-36, Identity=42%"; Hit description =Protein DEHYDRATION-INDUCED 19 homolog 4
  Pfam annotation: Domain name=Di19; Domain location=7-248; Score =246.3; E_value=6.7e-71; Accession=PF05605.3; Description=Drought induced 19 protein (Di19)
MDSDSWISTRLSSSSRRHHYRSDLYAEESEGNDDFRAEFLCPFCAEDYDVVSLCCHIDDHHPIQAKNGVCPICGKKVGVDLVGHFTTQHGNFLRISFLQVVILVISALLTITYVQRKRRVRKGGSASTISILRKELQEGALQSLLGGSSYLASSNSEPDPLLSSFMFNPVVADESVSATPPSTEDALVKESSKDDFLKRFENFLSDNGMMYGYRKPQQLQLSEEDQVEKARSSYANVERAGAVLSSRFYSMIQIHKKGETAGVSI

SEQ ID NO: 169390 - protein, 165 aa, Glycine max
  Coding DNA Sequence Number=SeqID_77705
MEISSFHQFPDESLNELVQLNIFLDGLRPQSKQLLDAFAGEKIKMKTLEEAMELIENMAANDHAILHDRAYTPTKRSLLELTAQDATLAQNNLSDLVDLQLGAHDLTSKVVDLEGERSHRGRGGPAKYGSKCHGRDMAEVLSMVFDDHRERSEGPRWGKSGVIYG

SEQ ID NO: 169391 - protein, 131 aa, Glycine max
  Coding DNA Sequence Number=SeqID_77706
  Gene Ontology: Cellular component=anchored to membrane
  Homolog annotation: Hit_ID=A7Q8M1; Match level="QueryCoverage=85%, HitCoverage=13%, E-value=3e-34, Identity=58%"; Hit description =Chromosome chr5 scaffold_64, whole genome shotgun sequence
MRLIHHPLVADAVTIYRSCEETCRLNENGNLNVPVEKTDTFCQGPCLSETNLVLNCLDNVFSNFIFYNRATIQDIRETIEAGCGYGRQRGNFNVAEHIQREESKAPKATSHVVMGLAIVMMGRALLPLNFT

SEQ ID NO: 169392 - protein, 305 aa, Glycine max
  Coding DNA Sequence Number=SeqID_77707
  Subcellular localization annotation: CTP_CleavageSite=25; ConfidenceScore=5.04e-01
MGNFQSSNNYSEMFSLDSSSVVFVRKSKSPKGREVVDTWSADYFLFGRASCELELTKTNPKNHREELSISIHDHASNHTNDNVYFQVKMSVEEGLLLASSTLNGPRSMQRLPERKNPISQGGGVLKSSSFLYGRDTDRKCLIVILREKRSDDDEELPYMITVKHYFVAACCSHGVSFVAKIRSSDGGLSVELGKPSIRPKGSLLSMFDDVKGKGWCPDPIEPIPSQNKNPTIANINPGLQNLPIAVIGNGGYFKGNAVKLCLGDLLVMGSNPETASLHMQGKAAYNIPPPYLRITKSLWAMGYEV

SEQ ID NO: 169393 - protein, 56 aa, Glycine max
  Coding DNA Sequence Number=SeqID_77708
MQTNHRHEPLDQSIGTCLSHFIIYTNSRPIDDHHHEPPDRSTGTMSTRPWYGSSNE

SEQ ID NO: 169394 - protein, 595 aa, Glycine max
  Coding DNA Sequence Number=SeqID_77709
  Gene Ontology: Mol. function=molecular_function; Cellular component =cytoplasm; Biological process=regulation of transcription, DNA -dependent
  Homolog annotation: Hit_ID=A2Q283; Match level="QueryCoverage=100%, HitCoverage=34%, E-value=0.0, Identity=56%"; Hit description =Cytochrome cd1-nitrite reductase-like, C-terminal haem d1
  Pfam annotation: Domain name=WD40; Domain location=189-227; Score =40.3; E_value=6.8e-09; Accession=PF00400.23; Description=WD domain, G-beta repeat
  Pfam annotation: Domain name=WD40; Domain location=231-269; Score =30.4; E_value=6.7e-06; Accession=PF00400.23; Description=WD domain, G-beta repeat
  Pfam annotation: Domain name=WD40; Domain location=281-393; Score =12.4; E_value=0.92; Accession=PF00400.23; Description=WD domain, G -beta repeat
  Pfam annotation: Domain name=WD40; Domain location=418-455; Score =28.2; E_value=3.1e-05; Accession=PF00400.23; Description=WD domain, G-beta repeat
  Pfam annotation: Domain name=WD40; Domain location=468-532; Score =21.1; E_value=0.0041; Accession=PF00400.23; Description=WD domain, G- beta repeat
  Pfam module annotation: Pfam domain module=WD40::WD40::WD40::WD40::WD4 0; Domain location=189-227::231-269::281-393::418-455::468-532
MALQKYAPSGNAPSVNMKHLSFSSKVPKKAELDEANLNHNMDVDIDLREIYFLIMHFLSAGPCHKTHLQFWNELLEHQLLPRRYHAWYSRTGACSGDKDDDASPSLGMNLGNAPNAADVPTLLGSDDRDKMKEVKWPPPHMRWPHMKANQVHGLNLREIGGGFPRHHRAPSIRAACYAIAKPSTMVQKMQNIKRLRGHRNAVYCAIFDRAGRYVITGSDDRLVKIWSMETAYCLASCRGHDGDITDLAVSSNNALVASSSNDCVIRVVSFHLTEQWRLPDGLPISVLRGHTGAVTAIAFSPRPNASMHVIVLRSWGGEAEWPLATPKALAAACLVVAVPFMEQIAENQGCDICCPWKSVCNLPSSIPFSSTGVVLANLATDGSSDDGTCRIWDARYTQSSPRLYVPRPSDSVIGKSNGPSSSTVPQSHQIFCCAFNANGTVFVTGSSDNLARVWNACKLSMDDTGQPVHEIDVLSGHENDVNYVQFSGCAVASRFSTAETWKEENIPKFKNSWLNHDNIVTCSRDGSAIIWIPKSRRSHGKSGRWTRAYHLRVPPPPMPPQPQRGGPRQRILPTPRGVNMIVWSLDNRFVLAAIM

SEQ ID NO: 169395 - protein, 322 aa, Glycine max
  Coding DNA Sequence Number=SeqID_77710
  Gene Ontology: Mol. function=hydrolase activity, hydrolyzing O -glycosyl compounds; Cellular component=vacuole; Biological process =carbohydrate metabolic process
  Homolog annotation: Hit_ID=O49011; Match level="QueryCoverage=57%, HitCoverage=95%, E-value=7e-78, Identity=68%"; Hit description=Beta -1,3-glucanase 1
  Pfam annotation: Domain name=Glyco_hydro_17; Domain location=34-269; Score=143.1; E_value=7.7e-40; Accession=PF00332.9; Description =Glycosyl hydrolases family 17
MASLFARTKWFSLPTLLLLLELFTINLSTADAQIGVCYGMIGDNLPPANEVVPLRNSGIELTLGVLQQDLQGLATNASIAQQWVQSNVLNFWPSVKIKYVVVGNEIDPVGSSSQFAQYVLPAIQNTYQAIRAQGLHDLIKVTTAISMDLLGNSYTPSQNYFKPDVRSYIDPIIGYLFPMLFSTNVVVWDGQYGYQNLFDATLDAVLVAIDNTGIGYVEGVHRINHLRNGTVILNVDGSRALVTLEDWQTASQTGEFTDSEEAAIPIGDFAMHGGTASQTGEFVAGEGRGPGYVVGLRHRGASERCRDARIVIGAGGLQEELA

SEQ ID NO: 169396 - protein, 337 aa, Glycine max
  Coding DNA Sequence Number=SeqID_77711
  Gene Ontology: Mol. function=hydrolase activity, hydrolyzing O -glycosyl compounds; Cellular component=vacuole; Biological process =carbohydrate metabolic process
  Homolog annotation: Hit_ID=P23535; Match level="QueryCoverage=84%, HitCoverage=82%, E-value=1e-152, Identity=91%"; Hit description =Glucan endo-1,3-beta-glucosidase, basic isoform precursor (EC 3.2.1.39) ...
  Homolog annotation: Hit description=((1->3)-beta-glucan endohydrolase) ((1->3)-beta- glucanase)
  Pfam annotation: Domain name=Glyco_hydro_17; Domain location=34-335; Score=559.7; E_value=3.1e-165; Accession=PF00332.9; Description =Glycosyl hydrolases family 17
MPSLFARNQRFSLATLLLLLELLTGNLRMADAQIGVCYGMLGNNLPSANDVIGLYRSNNIKRMRLYDPNQAALEALRNSGIELILGVPNSDLQGLATNPDTSRQWVQKNVLNFWPSVKIKYVAVGNEVSPVGGSSSVAQYVLPAIQNVYQAIRAQGLHDQIKVSTSIDMTLIGNSFPPSQGSFRGDVRSYLDPIIGYLVYANAPLLVNVYPYFSYTGNPRDISLPYALFTAPNVVVWDGQYGYQNLFDAMLDSVHAAIDNTKIGYVEVVVSESGWPSDGGFAATYDNARVYLDNLVRRANRGSPRRPSKPTETYIFAMLGKVVIDDFNATTSIKSDV

SEQ ID NO: 169397 - protein, 119 aa, Glycine max
  Coding DNA Sequence Number=SeqID_77712
MLLEVQNYDLGVADERTVCGKGRERRCGSCPLGGRSSGGRMSGRSNHGTINSFNNHGNGNQNFAGATINSGANSGNRNSYSTANYYGGHTINNSGTFNGNGNGSFIKGGFNSSTMNYYR

SEQ ID NO: 169398 - protein, 83 aa, Glycine max
  Coding DNA Sequence Number=SeqID_77713
MALTSQLRNLLAALEAEEAAQKSKGKNITGTKTNSGAYSGDGNTHHATNNYGGGPAINNSGNFQGHGNGGFIGGNFDASTRNY

SEQ ID NO: 169399 - protein, 284 aa, Glycine max
  Coding DNA Sequence Number=SeqID_77714
  Gene Ontology: Mol. function=transcription factor activity; Cellular component=nucleus; Biological process=regulation of transcription, DNA-dependent
  Homolog annotation: Hit_ID=A2Q2X8; Match level="QueryCoverage=100%, HitCoverage=59%, E-value=5e-80, Identity=50%"; Hit description=GRAS transcription factor
  Pfam annotation: Domain name=GRAS; Domain location=52-284; Score= -56.5; E_value=1.1e-05; Accession=PF03514.5; Description=GRAS family transcription factor
MVPLCDQTRDKPHSNSTTPLASLEILNNYGKGFKRLRNDDVAMATTNEESESLPFLETHPFGIYFSGLSDEEKEDAKLAEFLLASAEKVGQQHFEQALRLRMDRATGRVSCKDLQKGPSFDPLEAAKVLNPTVVAFYEELPFCQISVFTEVQDIIEDVAEAKKIHVIDLEIKKGGQWTILMQALESRHECPIELLKITAVESGTTGHIAEDTGKRLKDYAQGLNLPFSFNIVMVSDMLHLGDVFEIDAEEIIAVYSHFALRTKILESDQLEIMMRVIRTLSPIV

SEQ ID NO: 169400 - protein, 164 aa, Glycine max
  Coding DNA Sequence Number=SeqID_77715
  Gene Ontology: Mol. function=enzyme inhibitor activity; Cellular component=cell wall; Biological process=response to stress
  Homolog annotation: Hit_ID=A2Q2X4; Match level="QueryCoverage=97%, HitCoverage=97%, E-value=1e-62, Identity=73%"; Hit description =Universal stress protein
  Pfam annotation: Domain name=Usp; Domain location=3-158; Score=44.1; E_value=5e-10; Accession=PF00582.17; Description=Universal stress protein family
MAGARRLGVAVDFSACSIKALNWTVDNVVREGDNLILIIVRNAHGYEHGEMQLWETTGSPLIPLAEFSDPVLMKRYELKPAPEVIDIVSTAAKQKNIVVLMKIYWGDARERLCEAIDHVPLDYLTLGNRGLGTLQRVIMGSVSNYVVNNATCPVTVVKSSVHNY

SEQ ID NO: 169401 - protein, 30 aa, Glycine max
  Coding DNA Sequence Number=SeqID_77716
MKKRELEQKVVGGGTMVVVVGGEALQVGGL

SEQ ID NO: 169402 - protein, 90 aa, Glycine max
  Coding DNA Sequence Number=SeqID_77717
  Gene Ontology: Mol. function=transferase activity, transferring acyl groups, acyl groups converted into alkyl on transfer; Cellular component=cytoplasm; Biological process=cellular carbohydrate metabolic process
  Homolog annotation: Hit_ID=Q9AXR6; Match level="QueryCoverage=98%, HitCoverage=14%, E-value=4e-42, Identity=92%"; Hit description =ATP:citrate lyase
MATGQLFSRTTQSLFYNYKQLYIQRMLDFDFLCGRETPSVSGIISPGSEGFQKLFFGQEEIAIPVHATIEAACAAHPTADVFINFASFRR

SEQ ID NO: 169403 - protein, 1149 aa, Glycine max
  Coding DNA Sequence Number=SeqID_77718
  Gene Ontology: Mol. function=G-protein coupled photoreceptor activity; Cellular component=membrane; Biological process=regulation of transcription, DNA-dependent
  Homolog annotation: Hit_ID=A1IIA2; Match level="QueryCoverage=95%, HitCoverage=95%, E-value=0.0, Identity=89%"; Hit description =Phytochrome b
  Pfam annotation: Domain name=GAF; Domain location=248-426; Score =109.8; E_value=8.2e-30; Accession=PF01590.17; Description=GAF domain
  Pfam annotation: Domain name=HATPase_c; Domain location=1028-1140; Score=77.2; E_value=5.4e-20; Accession=PF02518.17; Description =Histidine kinase-, DNA gyrase B-, and HSP90-like ATPase
  Pfam annotation: Domain name=HisKA; Domain location=916-980; Score =49.0; E_value=1.7e-11; Accession=PF00512.16; Description=His Kinase A (phosphoacceptor) domain
  Pfam annotation: Domain name=PAS; Domain location=643-759; Score =107.3; E_value=4.5e-29; Accession=PF00989.15; Description=PAS domain
  Pfam annotation: Domain name=PAS; Domain location=774-896; Score =105.8; E_value=1.3e-28; Accession=PF00989.15; Description=PAS domain
  Pfam annotation: Domain name=PAS_2; Domain location=97-215; Score =239.0; E_value=1.1e-68; Accession=PF08446.2; Description=PAS fold
  Pfam annotation: Domain name=PAS_4; Domain location=649-764; Score =20.8; E_value=0.0019; Accession=PF08448.1; Description=PAS fold
  Pfam annotation: Domain name=Phytochrome; Domain location=437-616; Score=429.9; E_value=3.6e-126; Accession=PF00360.11; Description =Phytochrome region
  Pfam module annotation: Pfam domain module=GAF::HATPase _c::HisKA::PAS::PAS::PAS_2::PAS_4::Phytochrome; Domain location=248 -426::1028-1140::916-980::643-759::774-896::97-215::649-764::437-616
  Subcellular localization annotation: CTP_CleavageSite=3; ConfidenceScore=5.35e-01
MASASGAENSSVPPSPLPPPPPPQIHTSRTKLSHHHHNNNNNNNNNIDSTSKAIAQYTEDARLHAVFEQSGESGRSFDYSQSIRVTSESVPEQQITAYLLKIQRGGFIQPFGSMIAVDEPSFRILAYSDNARDMLGITPQSVPSLDDKNDAAFALGTDIRTLFTHSSAVLLEKAFSAREISLMNPIWIHSRTSGKPFYGILHRIDVGIVIDLEPARTEDPALSIAGAVQSQKLAVRAISQLQSLPGGDVKLLCDTVVESVRELTGYDRVMVYRFHEDEHGEVVAETKRPDLEPYIGLHYPATDIPQASRFLFKQNRVRMIVDCHASAVRVVQDEALVQPLCLVGSTLRAPHGCHAQYMANMGSTASLVMAVIINGNDEEGVGGRTSMRLWGLVVCHHTSARCIPFPLRYACEFLMQAFGLQLNMELQLAAQSLEKRVLRTQTLLCDMLLRDSPTGIVTQSPSIMDLVKCDGAALYYQGNYYPLGVTPTEAQIRDIIEWLLAFHRDSTGLSTDSLADAGYPGAASLGDAVCGMAVAYITEKDFLFWFRSHTAKEIKWGGAKHHPEDKDDGQRMHPRSSFKAFLEVVKSRSLPWENAEMDAIHSLQLILRDSFKDAEHSNSKAVLDPRMSELELQGVDELSSVAREMVRLIETATAPIFAVDVDGRINGWNAKVSELTGLPVEEAMGKSLVRDLVFKESEETVDKLLSRALKGEEDKNVEIKMRTFGPEHQNKAVFVVVNACSSKDYTNNVVGVCFVGQDVTGQKIVMDKFINIQGDYKAIVHNPNPLIPPIFASDDNTCCLEWNTAMEKLTGWSRADVIGKMLVGEVFGSCCQLKGSDSITKFMIVLHNALGGHDTDRFPFSFLDRYGKHVQAFLTANKRVNMDGQIIGAFCFLQIVSPELQQALKAQRQQEKNSFARMKELAYICQGVKNPLSGIRFTNSLLEATCLSNEQKQFLETSAACEKQMLKIIHDVDIESIEDGSLELEKGEFLLGNVINAVVSQVMLLLRERNLQLIRDIPEEIKTLAVYGDQLRIQQVLSDFLLNIVRYAPSPDGWVEIHVHPRIKQISDGLTLLHAEFRMVCPGEGLPPELIQNMFNNSGWGTQEGLGLSMSRKILKLMNGEVQYIREAQRCYFYVLLELPVTRRSSKKC

SEQ ID NO: 169404 - protein, 72 aa, Glycine max
  Coding DNA Sequence Number=SeqID_77719
MALRCGNKLANIVDDKCHVKLGLVDQITVEDTPPTTEVTTTMTTTKVMTIMIMMVEPTIMIMMGCLICVRKS

SEQ ID NO: 169405 - protein, 65 aa, Glycine max
  Coding DNA Sequence Number=SeqID_77720
MLSCESLTITAIDFKTPIELFGYPTYNRVSEGKLEPRSKKGFFMDYEDGVKGFQVGSPYEKGHSE

SEQ ID NO: 169406 - protein, 382 aa, Glycine max
  Coding DNA Sequence Number=SeqID_77721
  Gene Ontology: Mol. function=hydrolase activity, acting on ester bonds; Cellular component=cellular_component; Biological process =lipid metabolic process
  Homolog annotation: Hit_ID=A7Q8R2; Match level="QueryCoverage=78%, HitCoverage=82%, E-value=1e-101, Identity=61%"; Hit description =Chromosome chr5 scaffold_64, whole genome shotgun sequence
  Pfam annotation: Domain name=Lipase_GDSL; Domain location=23-286; Score=98.5; E_value=2.1e-26; Accession=PF00657.13; Description=GDSL -like LipaseAcylhydrolase
MFRVFMVLLLFKIGLSNYVPASFVFGDSLLDVGNNNYIVSLAKANHDPYGIDFGMATGRFSNGRTVADVINQKLGLGFSPPYLAPTTTGSVVLKGVNYASGAGGILNNSGQIFGGRINFDAQIDNFANTREEIISLIGVPAALNLFKKALFTVALGSNDFLDNYLTPILSIPERVLVSPESFVATLRLFNLGARKIVVVNVGPIGCIPYVRDFTPFAGDECVTLPNELAQLFNTQLKSLVAELRTKLEGSLFVYADVYHIMEDILQNYNDYASHSSSSSSSPSRHLTYPLPRRSGYLPSEPPPKMTPLLQTLNLFISLVVETTYIVIAAADTDIVFTEDEVERVESLKTISAPTFMTPTLSMPRPSLCPSSRPSVSTRMTTL

SEQ ID NO: 169407 - protein, 102 aa, Glycine max
  Coding DNA Sequence Number=SeqID_77722
MRIKGYTKKDIFCPSNCSRKFYYPLVVKVERKEESATTTDREGVEMEEEKGGLPVFLGLAAEQAEARLVRAKVRYHGVPDLGTISMVFREGHIVKCNAEERK

SEQ ID NO: 169408 - protein, 135 aa, Glycine max
  Coding DNA Sequence Number=SeqID_77723
EAALGDGESNFWIEPWFENSCIALEIPFVDVHAVDLRVRGVINDEGACDLSLGEEDLHHIFWECGSIVYLKGRVVGFALWKENCSNIFCVSDSLHAVQLIKQQVQGCHAYAAIVEHIRDFLEGGVEAFSASVQMP

SEQ ID NO: 169409 - protein, 66 aa, Glycine max
  Coding DNA Sequence Number=SeqID_77724
MDQHKEREMDMRVLQSYVAELLGVKLTRLKELNTDEIQIDSEAIVNGAICKLFESWQVKFIRSMGG

SEQ ID NO: 169410 - protein, 425 aa, Glycine max
  Coding DNA Sequence Number=SeqID_77725
  Gene Ontology: Mol. function=heat shock protein binding; Cellular component=endoplasmic reticulum membrane; Biological process=protein folding
  Homolog annotation: Hit_ID=A2Q660; Match level="QueryCoverage=90%, HitCoverage=54%, E-value=1e-176, Identity=78%"; Hit description=Heat shock protein DnaJ
  Pfam annotation: Domain name=DnaJ; Domain location=119-183; Score =93.0; E_value=9.6e-25; Accession=PF00226.22; Description=DnaJ domain
MLRHERVALLITTVYSVYCAWLYVGWLGLLLAFNITFISSDVLIYFLKKNIEQQSRSNPFEHRAGMHEPGFSDEPTHASSSENGQGPSADRNAGIPSTSGVDSDVTSEDEVVRLLNCSDHYAALGFMRYQNIDVSILKREYRKKAMLVHPDKNMGNEKAAEAFKKLQNAYEILMDSLKRKAYDDELRREEILSVFRRFNDASRKNGRHGFFPSGFARSDADGEDPFGDSRRIACKRCGGFHVWIHTKKQKSRARWCQDCQDFHQAKDGDGWVEQSSQPFLFGLLQKVDAPSAYVCAGSRIYDATEWYICQGMRCPANTHKPSFHVNTNLMSKHNSGKGTSSGQRGGRMPTPNIEETMTEEEFFEWLQNAVQTGAFDNFSGTATESPSPKSGNGMKSPGSSSGGAGATATASGSSSKRKKKGKKQW

SEQ ID NO: 169411 - protein, 291 aa, Glycine max
  Coding DNA Sequence Number=SeqID_77726
  Gene Ontology: Mol. function=heat shock protein binding; Biological process=protein folding
  Homolog annotation: Hit_ID=A2Q660; Match level="QueryCoverage=93%, HitCoverage=35%, E-value=6e-65, Identity=54%"; Hit description=Heat shock protein DnaJ
VNGYMARKGTQQKNGVDRHGLNNKKGVSGGVLPGMKGHGKGGPVKVFPREGLAETDSIGVSQTACDGRSSGDDYNNEQRSEKISGKEKQGMAGKHDLEESSSFESNSGDGSLNSEAEASIQEENGTLPRSNQGQQSIKSRLSCILDSLLLKSVVEKVELADNVIIRRLRLSVFSIFTAASEWLNRHTPLFVSLRTIMFETCNTVRTKVVQAYPVVLKWLMHLGNIMLLLLVFWLDCALRGVDSFVRMGTTSFFSVIWCSIFSVISMIGMLKFLAVLVSSGHTCHCFLLSWS

SEQ ID NO: 169412 - protein, 340 aa, Glycine max
  Coding DNA Sequence Number=SeqID_77727
  Homolog annotation: Hit_ID=A7Q8U1; Match level="QueryCoverage=90%, HitCoverage=86%, E-value=1e-132, Identity=73%"; Hit description =Chromosome chr5 scaffold_64, whole genome shotgun sequence
MDVRGDGIFPDEVVIQILARLPVKSLFRFKTVSRKNPMILVEISDSSESKTSLICVDNLRGVSEFSLNFLNDRVKVRASCNGLLCCSSIPDKGVFYVCNPVTREYRLLPKSRERHVTRFYPDGEATLVGLACDSAHQKFNVVLAGYHRMFGHRPDGSFICLVFDSELNKWRKFVSFQDDHFTHMNKNQVVFVNIALHWLTASSTYILVLDLSCDVWRKMQLPYNLIYGTGNRIYLLDLDGCLSVIKISEAWMNIWVLKDYWKDEWCMVDKVSLRCIRGMVPGIFPISQTGECVFLATHKQILVYHRKTQIWKEMYSVKYRSTLPLWFSAHAYRSTMFSCN

SEQ ID NO: 169413 - protein, 51 aa, Glycine max
  Coding DNA Sequence Number=SeqID_77728
MCHCKLLRYMVHMLIIWYGAWQKRSSDEKDKLTANLLSSRITMQNLLTSSF

SEQ ID NO: 169414 - protein, 31 aa, Glycine max
  Coding DNA Sequence Number=SeqID_77729
MEGIYNVKGYNLKKESTSSDDRMVMKMSVQD

SEQ ID NO: 169415 - protein, 128 aa, Glycine max
  Coding DNA Sequence Number=SeqID_77730
MHGMLSSVVQILLTSGIVQVARTMSNQSLMMQININHTIRINYISSRSINNIDNFKEETIMDNASSCPNTHIHEVYNDTRALPIHVLSMYVKYKIIIGTNHKCNNARGGTWKDTTLGKTLGCFSEAEF

SEQ ID NO: 169416 - protein, 78 aa, Glycine max
  Coding DNA Sequence Number=SeqID_77731
MSRDEKATTKWRHERWNGDREVENLPSIGIRPLRSLRIREISSMIRISRHLRLQSTEWPLMKRYSGKRWFCPTRSAIP

SEQ ID NO: 169417 - protein, 1180 aa, Glycine max
  Coding DNA Sequence Number=SeqID_77732
  Gene Ontology: Mol. function=zinc ion binding; Cellular component =intracellular; Biological process=anti-apoptosis
  Homolog annotation: Hit_ID=A7Q178; Match level="QueryCoverage=73%, HitCoverage=97%, E-value=0.0, Identity=57%"; Hit description =Chromosome chr10 scaffold_43, whole genome shotgun sequence
  Pfam annotation: Domain name=zf-C3HC; Domain location=122-303; Score =64.1; E_value=4.6e-16; Accession=PF07967.4; Description=C3HC zinc finger-like
MRSWKDEWFKNEHQPARSSQENISSDEADPFFHAVEIGKTRGDTEKFDKWSPRALTLRNSRMREEVISSGGTVDPTPAASSAGASSAVPMNVGSIDGSSHGQVSKAASLSCVGSQPPWTSLSTSAGSSAFWFFKIFILQGSHVLFNFFQIISSLACAQKGWMNNGVDKIACESCGSCLSFTALPSWTLAEGNAFMRIMDVKSCASLSKLYPVTRLKEFSVVADYIHQLFLTCFLIVMAKAQNASESFARQLDSGHKVNYLWKGNSCPESLVQFPPTPPSALIGGYKDRCDGLVQFHCLPVVAISAIELMSVSRGPQIERFLSQSQNSMSGEVDIKPDIAQKLISLCGWESSWRLNVQDCEEHSAQSERNGYSFGPSKTQLHLTQDPGSKAVSASTKLDARKAKAPLKESRLDSRSPLLDCSLCGATVRISHFLTVPRPARFASNSIDIPDTSKKIRLTRGASAASGISGWIAADDTEKDQTEDRDEVATTNEGKLLVNTDLDLNLTMAGGFPFTPLGRTATSEYTHEDMGRDLMIGQPSGSEIGDRAASYESHGPSSRKRNLEKGGSSDNQPVLRLQQQADSVEGTVIDRDGDEVTDGGQYSAGPSKRAHDSDIFDTYCSPQQRDSSGAARDSTRASSVIAMDTICHSVNGDSMESVENYPGDLDDVHFPSSSMYGNVDVNEKSELNNSNQAQQSTCLQTATEVARGDVGVSGTNYGEELFNAETVTAQAPEIHGADISVHRADSVVGEMEQRVEDAENQGQTGESVSDPGLMDEFIPDMNREDPIGDSQEMMSHSAGRTDSGSKIGCSTESVESEIMKHDKSSFANNCALPESDFAIANGIGPPKGESNYEAAEFDPIVHHNQCCPWVNGNVAAAGCASSVPSSDAIALSVWQLTIDALDALSLGHNAIPTVPSESAASLYKQFVVNLVVPPHYLTGDDRIADRVNPEYETWEVQDRTLLVWLQSTLSKSVLSRVLGLNHSYQVLELMILSPRIVNTRLRPCLHRVSVNWDRVGLKAQVEKDEGPSGEGQSPRVEKDEGPSGLFVQLHYNSLLNQSQTYQGNPCGVYPDLSSFTGSGVYPDLSSFTGSGVIQTSVACIKRSTPTQVHITRYRNSGEKDSKISHRRSTSGTAIFLSPNLVSWWSHKQKADVLTKPLSASRFEALRGKLNVKSVSNENSPP

SEQ ID NO: 169418 - protein, 597 aa, Glycine max
  Coding DNA Sequence Number=SeqID_77733
  Homolog annotation: Hit_ID=A7P845; Match level="QueryCoverage=96%, HitCoverage=31%, E-value=3e-76, Identity=33%"; Hit description =Chromosome chr3 scaffold_8, whole genome shotgun sequence
MEPLLLKINAYIQVEVDANPLLLDFHALLKSIGKLLASFMQDKVYVRTEDTSGGACLNFLKKIFNTLMTSFTSVLHFSNYDTTNRTEISSTLPANEILVAMGYLLQIEYEVEIAILALCKAIRLVISHEGNTEGSSRFLVFLSNEFHSEAVERLLSSEKFINAIYKAVESIPEGQVCGCIRQITEDISESLRWMKDFCPLVDGKKLQNFNLQGELLGRGLSRLYCLVLGSVIITNSNRNLLGVAVNELMALVRPYLSILVGQQPDTICKFFSSVIGETVDQVVRKGKVLKKFGRSSQWVLVFFFQLFVSCQSLYRQASLRPPDLPKMSAEVEDYTTYSASELMERIDKIDFGYFSWIVQPSSSLLVVMQFISDIYLKLGSDDSSPLIYIFQSMALRRLVYLNKQIKLFKYLKKKHYLQKKSYRSQIKTLKEEAADLTNFILEYLSCVYQSPIFVSDYVTCEDVVSVVTQSIQDHIKERCNQWDWDLGVYAANKKSLPTLIWSKLCKNVDIWSNHASKKQLKTFFSHLLHAYLHSVTSSFQEPGVQEIDKCKLLKTITLSQISSELLNDSLFYEQKITKRTYIIEKRNISTNAGVGYS

SEQ ID NO: 169419 - protein, 101 aa, Glycine max
  Coding DNA Sequence Number=SeqID_77734
MEVVGTSMMFESWNVNLLGELLPLNFVASMVDSSAMELKQKVGGFKKLMKKAEASDCLEYTVPSSLIEALHSTYQSALTKLKEKILESRRKPRISLVNRSK

SEQ ID NO: 169420 - protein, 179 aa, Glycine max
  Coding DNA Sequence Number=SeqID_77735
MGKFKFWEEIDQPCYCQATGSHRRSLISIVKGFFQSGAKPPLLPLASTKNKNQFQLGKVIIPGGPNWVWSKGYSSPRSFPSRLRFSMSGISMRREGQGLGVVKGESGPSYGISRSWPLRGFTTGVKERMDKSKEYREKGRAQAWNAKRSALRRAPAAGLVCAYVGTPRLAPVFPSTLSA

SEQ ID NO: 169421 - protein, 34 aa, Glycine max
  Coding DNA Sequence Number=SeqID_77736
MGPWAHLGPSRSFYMKQPARLGKPVTSGLSHQLA

SEQ ID NO: 169422 - protein, 60 aa, Glycine max
  Coding DNA Sequence Number=SeqID_77737
MTYPPPFDTKSEGLHLSPAPGAILPRKGPVTRDMSKRLQEDWARAAEEGPRVLMNLRIDF

SEQ ID NO: 169423 - protein, 55 aa, Glycine max
  Coding DNA Sequence Number=SeqID_77738
MSISPCGSISWDRAHMTPSGPGEVQQGPGVSSSGYGPLSVLPSARPPQQGHAIVT

SEQ ID NO: 169424 - protein, 61 aa, Glycine max
  Coding DNA Sequence Number=SeqID_77739
MKKQQWKRRFSGRQRRRGERRRHPLRNKPWKKELHHQDEPWIRSLEGCFNGGKERGREVEL

SEQ ID NO: 169425 - protein, 79 aa, Glycine max
  Coding DNA Sequence Number=SeqID_77740
MSEVEEVQEQIKADMEVMKEKMATMMEANMSMKEIMEHTLPVRMSITPLLYPLRANNPKLIMHMSLKPWGRHMKFPTTI

SEQ ID NO: 169426 - protein, 91 aa, Glycine max
  Coding DNA Sequence Number=SeqID_77741
MHHQKRKTLDEASLSSSESKTQHDRRSTSTPYGSHRPGLQWSHQLSQPTLRWGCKKAKVRPKCLSSREKTSGVATNAIRGKTLEKPKRRWN

SEQ ID NO: 169427 - protein, 49 aa, Glycine max
  Coding DNA Sequence Number=SeqID_77742
MVTKPSEFKIHRNVKRNWKGGLVSSLEEFKSRSKGQTTLRAIRLRSTPN

SEQ ID NO: 169428 - protein, 109 aa, Glycine max
  Coding DNA Sequence Number=SeqID_77743
MDKFDIFVPHPLTNASLLIQLSPECGCKPLVCLLKRPALLSLDFQDRSIRNYSCYTFGEGAVKRQPYTGAMRGTVHEPQANLGVDKKFSPVDVFKQKRGGQTLAFQWID

SEQ ID NO: 169429 - protein, 53 aa, Glycine max
  Coding DNA Sequence Number=SeqID_77744
MEQFLASRLREIMKANSCDFFMPKGFGGEEGRMRVEEECGVEGGGGTGKKMKR

SEQ ID NO: 169430 - protein, 84 aa, Glycine max
  Coding DNA Sequence Number=SeqID_77745
  Homolog annotation: Hit_ID=A5B4U1; Match level="QueryCoverage=57%, HitCoverage=6%, E-value=5e-10, Identity=64%"; Hit description =Putative uncharacterized protein
TIDDQFITLDKALASTLIMRFSSLWLTSVKGVHEYIMQMWDISTQFSKLEEEEGIIMEIGESALLTIACGKNKTTSLKIIRRGM

SEQ ID NO: 169431 - protein, 328 aa, Glycine max
  Coding DNA Sequence Number=SeqID_77746
  Homolog annotation: Hit_ID=A5B5V0; Match level="QueryCoverage=76%, HitCoverage=55%, E-value=5e-12, Identity=23%"; Hit description =Putative uncharacterized protein
  Subcellular localization annotation: CTP_CleavageSite=23; ConfidenceScore=5.55e-01
MVESSKKRKGSSSSAAAHRTSCSGANRASATPIPPSLSSSTLFSSDEQHIRYSSLFQSRQILDPKYLDLEFFDGETFDCYQVFQNTGLIPFMSLKLPYYSELVRVFYSNLKIQDGTLISEVHGIPMIIDESLFFSLTQLPSQGAPFEGTLVDEWKFDYSSHDARCMVCIDQADMTGRLLAGSLTFDCRIMHYIIVRILMPCSFNLAQASEEDLILMWAFLTGHPIDWAHLVCYRMHKALRSGAPLPYPQLVTLFLRHFEIPLDSEPFVLVKRSFAIGASAVTSFGYRKDVDGQWLKKDAQPPQDERTPSPPPPQDDSSALMNEVLSEL

SEQ ID NO: 169432 - protein, 96 aa, Glycine max
  Coding DNA Sequence Number=SeqID_77747
MGGKHFEVVKRRSHADKEWSPDEIRMDEDQWTYDNTMYQEVDMDYENEQECGVNEPPHVDCSEAFNTSQNLLEETLGVGNVVVPSSFMGNQCMEGK

SEQ ID NO: 169433 - protein, 186 aa, Glycine max
  Coding DNA Sequence Number=SeqID_77748
MASMMEAMLGMRQLMEKNVATAAAISSAAEADPTLLATAHHPPLNAVGRGRSTLGHNNNPHLGYNRVAYPYGLLPNYTPPVVQDDAGHVSSPILEGEPPRQPDEVHEDHREYAQGDVNFYPPIPVEGPTPNTLPHPNLTTQPIFLSTEGPPPAVEERRKLDLLEERLRAVEGFGDYPFANMTDLCL

SEQ ID NO: 169434 - protein, 231 aa, Glycine max
  Coding DNA Sequence Number=SeqID_77749
  Gene Ontology: Mol. function=oxidoreductase activity; Biological process=metabolic process
  Homolog annotation: Hit_ID=A4W5G4; Match level="QueryCoverage=39%, HitCoverage=28%, E-value=5e-39, Identity=90%"; Hit description =Alcohol dehydrogenase, zinc-binding domain protein
RRGLMVSFGNASGAVTGVNLGILNQKGSLYVTRPSLQGYITNREELEEASNELFSLIASGVIKVDVAEAQKYPLIDAQRAHEVLESRATQGSRYSSMNSLAAAIVTDSISKSYSVLSPAAGKVTMGSFGDFIARITHTTAMASSNHGNSLIVRANNPPITITTVATTIAARMPSSDTPVANSMTKKPITKSSSSMVLSHEFPSNATGITKSMPNLTLVLKAKRPARRRRAW

SEQ ID NO: 169435 - protein, 47 aa, Glycine max
  Coding DNA Sequence Number=SeqID_77750
MAKNIINNRDNGELTLLVIEPEIDPVMELLSDTEEEVEAEEDTNNSE

SEQ ID NO: 169436 - protein, 347 aa, Glycine max
  Coding DNA Sequence Number=SeqID_77751
AQVRQRADAVGGERRAFAHGDDDVERRERGLDLLVGDEVVEDPHFGVAAEGSPVRVALGDVVVIVEYCDFQVGLRVAWRSLRQPPGRRDPRRSVQSCLELVQRQRAAGARAVGEEHRGRPAHHQLLAQRQQLVLGHAAIGGGRLLAAQHPVIPRLARVRRAPDVTHLHVGVGRQDRVQEVTAVGVLEDRDLARAVALDLLDGQVQRQLVERDGTELFLRLAGDVAARHGVDQRTFHHPGHFFIGVDQVHAQLHLEQPVGRAAHGGHVHAGEALPETFLDRIRHGIGGRHLGGGIALAALARLADRAGGNGLVARCLRLSAGGQAQARGHEAGGQRGGKTEIHGDSCI

SEQ ID NO: 169437 - protein, 19 aa, Glycine max
  Coding DNA Sequence Number=SeqID_77752
MADQQATKVQSPKDAPSCS

SEQ ID NO: 169438 - protein, 87 aa, Glycine max
  Coding DNA Sequence Number=SeqID_77753
  Gene Ontology: Mol. function=helicase activity; Biological process =viral genome replication
  Homolog annotation: Hit_ID=Q9LX60; Match level="QueryCoverage=100%, HitCoverage=4%, E-value=3e-19, Identity=50%"; Hit description =Putative uncharacterized protein F4M19_60
MLSDLTKGQLLGKVVTYMHTIEFQKRGLPHVHLLLFLHPDNKYPSSTDIDKILSAEIPSHQDDPELYRLVENHMIHGPCGILQPNSP

SEQ ID NO: 169439 - protein, 251 aa, Glycine max
  Coding DNA Sequence Number=SeqID_77754
GCTPSPSEDLHVLASRGLHVLAIRGLHVLPLQRTTHPATSEDQTHPRLQKTTAPRSSEDYTSSPSEDCTCPPLQRATNILIFRGLHVLTFIGLHALTFRGLYVLTFRGLHILHFKGLHVLAFRGLHALAFRGLHALAFRASSCLLSTPGQPPYPGGGPTVRAQPKREVIMQLLCIPGQDLTRTVAKRRVDRAHKTPNGPGEVQQVIGFPALITGLCQSYRVPVPPTRSCRHDIGIAPARQIVDPEKSNRVL

SEQ ID NO: 169440 - protein, 60 aa, Glycine max
  Coding DNA Sequence Number=SeqID_77755
  Homolog annotation: Hit_ID=A5BI38; Match level="QueryCoverage=100%, HitCoverage=8%, E-value=2e-13, Identity=54%"; Hit description =Putative uncharacterized protein
  Pfam annotation: Domain name=RVT_2; Domain location=1-60; Score= -165.3; E_value=0.00072; Accession=PF07727.5; Description=Reverse transcriptase (RNA-dependent DNA pol
MDVKTTFFNGDLEEEVYMKQPEGFSFSSDDILLVANDRGMKDMGDASYYIGIKIHRDRPR

SEQ ID NO: 169441 - protein, 199 aa, Glycine max
  Coding DNA Sequence Number=SeqID_77756
MIRGDTLRLSAPPLPFRHSRVRWQAETKFGHSAHMIRGDTLRLSAPPLPFRHSRVRWQAETKFGHSAHMIRGDTLRLSAPPLPFRHSRVRWQAETKFGHSAHMIRGDTLRLSAPPLPFRHSRVRWQAETKFGHSAHMIRGDTLRLSAPPLPFRHSRVRWQAETKFGHSAHMIRGDTLRLSAPPLPFRHSRVRWQAETKF

SEQ ID NO: 169442 - protein, 92 aa, Glycine max
  Coding DNA Sequence Number=SeqID_77757
MECLEGVWETLDGMRGADSVARFDSLLLHLVHPEEPARTLQQPVEWILPTPTPYRLVEPFPSDKEDIMSASEADSTEESGPGGTANSEDSSS

SEQ ID NO: 169443 - protein, 45 aa, Glycine max
  Coding DNA Sequence Number=SeqID_77758
MARTVSQPTLRREGDARLTGASSKLFKNPRLTNKSEKDHFKALDL

SEQ ID NO: 169444 - protein, 71 aa, Glycine max
  Coding DNA Sequence Number=SeqID_77759
MGGGAWPFLVGGAICLGLWPLRPRKFEAITGPGKSLKFHRDGDRSLQLLVFNEEFPSKRESSARVDYVPAL

SEQ ID NO: 169445 - protein, 17 aa, Glycine max
  Coding DNA Sequence Number=SeqID_77760
VEINGVDQSRLSDIGVD

SEQ ID NO: 169446 - protein, 771 aa, Glycine max
  Coding DNA Sequence Number=SeqID_77761
  Gene Ontology: Mol. function=aspartic-type endopeptidase activity; Cellular component=small subunit processome; Biological process=rRNA processing
  Homolog annotation: Hit_ID=A7QAR6; Match level="QueryCoverage=75%, HitCoverage=89%, E-value=1e-112, Identity=44%"; Hit description =Chromosome chr5 scaffold_72, whole genome shotgun sequence
  Pfam annotation: Domain name=Sas10_Utp3; Domain location=299-375; Score=56.4; E_value=1e-13; Accession=PF04000.6; Description =Sas10Utp3 family
  Pfam annotation: Domain name=Sas10_Utp3_C; Domain location=694-769; Score=110.1; E_value=6.8e-30; Accession=PF09368.1; Description=Sas10 C-terminal domain
  Pfam module annotation: Pfam domain module=Sas10_Utp3::Sas10_Utp3_C; Domain location=299-375::694-769
MGVLEIGVFEIGQMEEEYPLSLLSLALTPHLTRRCETRECEEETKVQFWGLAVKNRTHTMGKKRGTSYQKKDAKSSKSKTSSRHGAYSSDDMDDDIDTFHKQRDIVPLDINDDAEESEDEELPIFDVQDIDEDEDDEDEDDGEDDDDDDDRDDVVAKMIRQRKYLQGKFGGGDDEMNDADDDDEDEEDYKLTLGGKKFSHGAENRNFELQSSDDEAPKEEEELALQIQREKAKSLTMEDYDLVDISEDKDNEKLTLKDASDKGSEAIKSLDRDINFSVDELNALSKEEQMNVLYRSAPELVDWLSELNEAHRQLECKKGEIVMKGEVRYFELKQLILLSYCQAITFYLLLKSEGQPVYDHPIIARLEEIKKLLDQVLLFSKYLNICDFKDLVSKIICLMSMIKQLDTKLPFELEDILKGNNGLETVVNSDNENAPTTADSIIKNQEQPLVSAKSTEETVPNKQFEMQKLETSKNSVQKTRKVKPQKDHIGAQSLEMLKVRASLEEKLKNKGLYSSIAPKPTCWNLLATYKFHSMLETYDDFNDDTMDANGEARLINGSVSKRVSQFLNANMKKPKPTFAKMSGRTWVPYALFGREERNRVVSGDDDLPKRDDIGERRRKHELRVLAGAGIRTEDDDDDQMADLGPNEVTDEEEDGGSGDSENEFYKQVEQLRAAKLAAKAETYSRNSSVSSLPETVEGKRHISSQIEKNRGLTRNRNKAKKNPRKNYKLKHQKAVKNRKGQVQSIKRPTAPYGGESSGINAAISRSIRFKS

SEQ ID NO: 169447 - protein, 129 aa, Glycine max
  Coding DNA Sequence Number=SeqID_77762
  Gene Ontology: Mol. function=catalytic activity; Biological process =activation of protein kinase C
  Homolog annotation: Hit_ID=A7QTV3; Match level="QueryCoverage=93%, HitCoverage=16%, E-value=8e-40, Identity=60%"; Hit description =Chromosome undetermined scaffold_171, whole genome shotgun sequence
MPIEADGIICGALLNGSWFWKDMEVGERAAEKLFSLDPNPIFTFVVLSNMYAILGRCGQKTKLRKRLQSLELRKDPGCSWIELNKNIPLFSVEDKTHPYSDDIYATVEHITATINSIIPFYYRYSSNGG

SEQ ID NO: 169448 - protein, 170 aa, Glycine max
  Coding DNA Sequence Number=SeqID_77763
  Gene Ontology: Mol. function=RNA-directed DNA polymerase activity; Biological process=RNA-dependent DNA replication
  Homolog annotation: Hit_ID=Q9AYG6; Match level="QueryCoverage=65%, HitCoverage=16%, E-value=9e-09, Identity=27%"; Hit description=Gag -Pol
MNSIPHHYILSKNGGPCVWATSLTSTIAELGSFWKYPATWPWHNPYILDSKPHAIRLAKEVGAQRVWCRSDSKIATEQINKVFQTRDPKLLKYYHAFEKLRGQFEEVQVTHISQEVNDKADKLAQLATSPKLGQLKTFILHLVPKPNISRKNVYRWKKPSRGRDRRYSTT

SEQ ID NO: 169449 - protein, 88 aa, Glycine max
  Coding DNA Sequence Number=SeqID_77764
  Gene Ontology: Mol. function=oxidoreductase activity
  Homolog annotation: Hit_ID=A3QRM3; Match level="QueryCoverage=98%, HitCoverage=24%, E-value=2e-37, Identity=85%"; Hit description =Senescence-associated nodulin 1A
MGEVDPAFIQDPQHRPKLSIIQPEHIPVIDLSPITNNTVSDPSSIEGLVKEIGNACKEWGFFQVTNHGVPLTLRQNIEKASRLFFAER

SEQ ID NO: 169450 - protein, 224 aa, Glycine max
  Coding DNA Sequence Number=SeqID_77765
  Gene Ontology: Cellular component=cytoplasm; Biological process =pollen maturation
  Homolog annotation: Hit_ID=Q9M1A2; Match level="QueryCoverage=99%, HitCoverage=38%, E-value=7e-87, Identity=71%"; Hit description =Putative uncharacterized protein T16L24.210
  Pfam annotation: Domain name=GRAM; Domain location=89-155; Score =70.2; E_value=6.8e-18; Accession=PF02893.11; Description=GRAM domain
QINVTIYDWDIIWKSAVLGSVTVPVESEGQTGAVWHTLDSPSGQVCLLIKTIKLSGNASRINGYGGANPRRRMPPLERQWPTVVHQKPGPLQTIFDLHPDEVVDHSYSCALERSFLYHGRMYVSAWHICFHSNVFSKQMKVVIPFEDIDEIRRSQHAFINPAITIILRMGAGGHGVPPLGSPDGRVRYMFASFWNRNHAFRNLQRAAKNFHEMLEAEKKVTALA

SEQ ID NO: 169451 - protein, 337 aa, Glycine max
  Coding DNA Sequence Number=SeqID_77766
  Homolog annotation: Hit_ID=A3A8V0; Match level="QueryCoverage=55%, HitCoverage=40%, E-value=2e-40, Identity=43%"; Hit description =Putative uncharacterized protein
  Pfam annotation: Domain name=C2; Domain location=113-197; Score=49.9; E_value=8.6e-12; Accession=PF00168.21; Description=C2 domain
MSYDRARGLWNEVTNPNLVPLLGSLVGFDSTRFSLMKKHLMHSYGVAVIVVLALSLSLGASAEQLSSRECENLGFTGLALCSDCNTLSEYVKDKELVSDCFKCCTEDSNDATTKVELFTAKDLVSAKLTGKPDPYAVITCGKDKRFSSMVSSSRNPMWGGGEGEVFNFSVDELPVQINVTIYDWYKCRENAVLGSVTVLVESEGQTGPVWHTLDSPSGKVVIPFEDIDEIQRSELALINPAITIILRKGAGGHGVPPSSPLASADGRVGYMFASFWDRNKALENLQRVSKNFNEMLEAEKENAEPQLCAHSSSVPDKVLEDSMPKLENLNLLSKKRL

SEQ ID NO: 169452 - protein, 161 aa, Glycine max
  Coding DNA Sequence Number=SeqID_77767
MGPLDGHSPTREEIDDRWMQFGEYIAPVRQLCAMSDHCSSDYMYWFYMILHPFMSPTQPRDPPRVPPVQQHEEFVEPNMYQQPIAAAAPNKADIDVHHLRHAVDDFVAIADRLDMLLNLRILTEGTKVYTVVEECVGIARCYIGQPIVGHKSKQRWRTNDH

SEQ ID NO: 169453 - protein, 70 aa, Glycine max
  Coding DNA Sequence Number=SeqID_77768
MKLQEKVLREKAQSFKNPWIYGQILFKREGMMQSYPPRVLDRRLQEDWARDAEEGPRVLMSLKVDFRPMS

SEQ ID NO: 169454 - protein, 61 aa, Glycine max
  Coding DNA Sequence Number=SeqID_77769
MVFCSIVGDPSFLGDLIVPSFEGKDRNSHLGSRFMVSWDFGSRLVERLDMMYARVLVWLAV

SEQ ID NO: 169455 - protein, 183 aa, Glycine max
  Coding DNA Sequence Number=SeqID_77770
  Gene Ontology: Mol. function=helicase activity; Cellular component =chromatin; Biological process=protein amino acid phosphorylation
  Homolog annotation: Hit_ID=Q9LTU4; Match level="QueryCoverage=98%, HitCoverage=12%, E-value=1e-45, Identity=55%"; Hit description =Helicase-like protein
  Pfam annotation: Domain name=DUF889; Domain location=92-183; Score= -80.1; E_value=4.8e-06; Accession=PF05970.5; Description=Eukaryotic protein of unknown function (DUF889)
MVASSSIASLLLPGGRTAHSKLKILVPVFEDSTCNIHQGTQLAELLNQTSLIIWDEAPMAHKFFFEALDHNLRDIIKHNSKDNKIFGGKVMVFGGDFRQILPVISRGSCFDIVNTTINSSYLLDHCQILRLTKNMRLQNNMQATYQEEIVAFAQWIIDIGDDIIGHENDGYATIEIPQELLTT

SEQ ID NO: 169456 - protein, 51 aa, Glycine max
  Coding DNA Sequence Number=SeqID_77771
MGNSAKVVIQQDMKGRRHKYGFNNNERYSVKTWSIFTSKIVRGKNDHVPMA

SEQ ID NO: 169457 - protein, 153 aa, Glycine max
  Coding DNA Sequence Number=SeqID_77772
MWAFQTGCQIDWGHLVRYQMHKALRANVPLSYPHLATLFLHHFNVPLDDEPFFKVKRSFSIGVGAITSFGYRKDVDGQWVRKQDLSLPIPDERTPSPPPQRTDSTSLLTEVLTELRDLRAFVDERFDAMDTRITRLEDDMSFIRRCFNPPVNS

SEQ ID NO: 169458 - protein, 365 aa, Glycine max
  Coding DNA Sequence Number=SeqID_77773
  Homolog annotation: Hit_ID=Q6Z8F0; Match level="QueryCoverage=17%, HitCoverage=58%, E-value=5e-21, Identity=79%"; Hit description =Putative uncharacterized protein P0459B01.18
SFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTLDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVI

SEQ ID NO: 169459 - protein, 92 aa, Glycine max
  Coding DNA Sequence Number=SeqID_77774
MSRWHDLAGGDGDVSSIGACRPRIFFINGFLCFLEDEWQRNGERKRERRCHFKEKMSLEEVHHHRRPWIRAWRKNEMNEGRGREEHEILYSK

SEQ ID NO: 169460 - protein, 181 aa, Glycine max
  Coding DNA Sequence Number=SeqID_77775
  Homolog annotation: Hit_ID=Q2HW90; Match level="QueryCoverage=62%, HitCoverage=21%, E-value=8e-09, Identity=34%"; Hit description =Putative uncharacterized protein
MFGSKGEDLGKSRRMGPVHGHPDTLDLRGGPLSKCGRESPIVAILADLYDTFGRRCEKNSARIVCCTPALYVWLVSHLFRQEVRHICLLEGHHSCTKKKEANWDKLLASKEGVSVNWFPRWKEGRTGILISCGEFPNVPLMGTSGCINYNPVCHTLISSGDHLLGGMQPLLDHFEVLDTHR

SEQ ID NO: 169461 - protein, 57 aa, Glycine max
  Coding DNA Sequence Number=SeqID_77776
  Subcellular localization annotation: CTP_CleavageSite=38; ConfidenceScore=5.43e-01
MSPPPLEPHNHSQTHIKLSGRLPLQAPFSTDSSSRSAKGMVRSADGSLSQLIGLASR

SEQ ID NO: 169462 - protein, 51 aa, Glycine max
  Coding DNA Sequence Number=SeqID_77777
MEKSEKKNINEKKLKKAYITWDENDIESSEDSENEEINLCFMAKSYESDEE

SEQ ID NO: 169463 - protein, 92 aa, Glycine max
  Coding DNA Sequence Number=SeqID_77778
MRKIGLYGTFFGGTRTRVRLRNVIGFEGIYRGGQGVIDYKVYGQEGFHSQKVVASSIRFVHNNCQQKYIPLLQWIKQHYFVSYYAKKLEQIQ

SEQ ID NO: 169464 - protein, 149 aa, Glycine max
  Coding DNA Sequence Number=SeqID_77779
  Subcellular localization annotation: CTP_CleavageSite=25; ConfidenceScore=5.50e-01
MASPPASPPSPLPRPPHPPSDASASSSAVKRTRRASLVHIDPATGKADGPHRKKLRTYLGIVARDKVDITYENWKKVSTAQKDLIWDDIQRLLTVGQKESYFRLWARDGADHDGVDDTVCEKYGISKENWAQFRQTRRDPSWEDVRKKA

SEQ ID NO: 169465 - protein, 261 aa, Glycine max
  Coding DNA Sequence Number=SeqID_77780
GGLHRLHKLGHPMRGAPSEEIKSPFIVRGFNETNARILQRIRKAWNIVEGKDKEIRGSSNGIIDGYHKWLKSRTQGITWLSKLKGLSGKEAKVLEESEEVQALKVELKKMRVVKEKIKTIVTRVRKKNKFRGALWGSTNELKLRRVERDGSRVESMVLEDKLKACQRLKKSLTEQLSRMEENMLKIIDQYKEKVNLATSHGEAMKWMDRFALTLNGSQELPRLLARAKAMADTYSAPDEVHGLFDYCQHMVELMTHIIRNC

SEQ ID NO: 169466 - protein, 275 aa, Glycine max
  Coding DNA Sequence Number=SeqID_77781
  Gene Ontology: Biological process=transposition, DNA-mediated
  Homolog annotation: Hit_ID=Q1J7G7; Match level="QueryCoverage=10%, HitCoverage=42%, E-value=8e-10, Identity=100%"; Hit description =Transposase
MVKVGTSYVPINVSFSPKVGPGLPGINRDTRIYLFCEVDLPSQWLLFLSAVPPVQLLTGWCVTAKAPPDISAGKCSGHAARRVPFAIQAAQLLGRAIGAGLFAITPAGERGMCCKAIKLGIRSCSPLKAKGCSPLKGRTCSPLKARACSPLKARTCSPLTMRASSPLQGLHALTSKGLHILALRDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 169467 - protein, 51 aa, Glycine max
  Coding DNA Sequence Number=SeqID_77782
MCSPLEVRACSPLLARMCSPLQEGYMIEFLQPGGSTSSRAAATAVELQFAL

SEQ ID NO: 169468 - protein, 82 aa, Glycine max
  Coding DNA Sequence Number=SeqID_77783
RYAITSRGSRLVGGGCMNSAWQITFMGLQKKWRMENWRTALRNNFVGLQARRWRMHEQRQAMTFMGLRKKVENGELANIATQ

SEQ ID NO: 169469 - protein, 35 aa, Glycine max
  Coding DNA Sequence Number=SeqID_77784
MEEIHGEDDEEQGIKRLKVGEDEWRERERRGTKML

SEQ ID NO: 169470 - protein, 43 aa, Glycine max
  Coding DNA Sequence Number=SeqID_77785
MGDIVFRSWVASRKQPSSPGRVGRQPPPPFSYKKAKGGCSKGP

SEQ ID NO: 169471 - protein, 139 aa, Glycine max
  Coding DNA Sequence Number=SeqID_77786
MERGVKAGERKWVPQKTFDLKNEVDGELKWVMNMEVAVKDAMSNLGVLEEEDGREGVGVRVQQGGVTLNHVPYLSDFYDNGCHSVTRWGWHGINRVMIHNATAAGMAEPQSALKNHIHMEHGRTLQFLHRPHRTQIFKS

SEQ ID NO: 169472 - protein, 769 aa, Glycine max
  Coding DNA Sequence Number=SeqID_77787
  Gene Ontology: Mol. function=transporter activity; Cellular component= integral to membrane; Biological process=transport
  Homolog annotation: Hit_ID=A7PDQ5; Match level="QueryCoverage=89%, HitCoverage=94%, E-value=1e-160, Identity=55%"; Hit description =Chromosome chr11 scaffold_13, whole genome shotgun sequence
  Pfam annotation: Domain name=Syja_N; Domain location=125-415; Score =355.1; E_value=1.2e-103; Accession=PF02383.9; Description=SacI homology domain
AKQKQKLFVGVLFLEFSAGDLVGKPELSEARDLNCEDGFKFNKGEAAEQSTACPFLSYSPQYSSSVVNIYGNFDEKGAKIDRLEPSELNIFEDSTLYSDIECCDLLRRIHEGNKSTGGLKFVTTCYGIIGFIKFLEPYYMLLITKRRKIGTICGHTIYAITKSEMVPIPHAIERSKMAYSKDENRYKKLLCSVDLTKDFFFSYSYNVMLSLQRNLSDHNTTGQSLYETLFVWNEFLTRGIRNNLQNTSWTVALVYGFFKQVKLSISDNEFNLTIIARRSRHYAGTRYLKRGVNEKGRVANDVETEQIVFTDARGGRPMQISSVVQIRGSIPLFWKDSNFEATRLHFENLVKRYGNPIIILNLIKTREKKPRETILRAEFANAVRSLNKNLKGENRLRSNTFSSKATNVLGQLGKVAAYALKLTGIFYCPVTSNVRLDGFSHYSYTDLKHGQCTSPHYLVLKLLGHKSYCVMDQVFQKHKLNNNVTDHCITEQASINKDNVDKETEIINCYCSSDENKDYSVKPQMLQSGVLRTNCIDCLDRTNVAQYAYGLAALGCQLQALGFVETPLLGHFQPQQGNPALWELDSDQHYTVKKHGLYVADDSVRSTIKRSLSDGNILSESDTTIRNLNVTNDQNSSEKPDKRFLSGSTPDIYTCGSDICHCRQIYVNGQNCESDHICYDEHGDACDCSNFLDVDWLSSSGNSCEEELLERSTSISSENIANELITTETSASESGSSIKGRQSGEELNKDSKYSESFERWITQGEMLFI

SEQ ID NO: 169473 - protein, 237 aa, Glycine max
  Coding DNA Sequence Number=SeqID_77788
  Gene Ontology: Cellular component=mitochondrion
  Homolog annotation: Hit_ID=A5BUU9; Match level="QueryCoverage=92%, HitCoverage=100%, E-value=1e-93, Identity=70%"; Hit description =Putative uncharacterized protein
  Pfam annotation: Domain name=CIA30; Domain location=52-233; Score =201.5; E_value=2.1e-57; Accession=PF08547.3; Description=Complex I intermediate-associated pro
MVEAVATVGGGGDREREMSRLRRLIQASVDATKKVISGNLDDLMPPPERPIFSFNSKQELSKWHLYSDSEFGGGITESENGATSGIFSGNLSLDVSEGSKWNITRSGFCGMRSKKFDGFIDLDSYDTIAMKLKGDGRCYISTIYTENWVNSPGQMEDNSWQAFVYVPEGNWYITKIPLARYLPTWRGNVIDAQIEMNPSRVLGMSLSVNAEGGVPGARSGPGDFRVELDWIKAMRTE

SEQ ID NO: 169474 - protein, 977 aa, Glycine max
  Coding DNA Sequence Number=SeqID_77789
  Gene Ontology: Mol. function=nucleocytoplasmic transporter activity; Cellular component=nuclear pore; Biological process=transport
  Homolog annotation: Hit_ID=Q3EB65; Match level="QueryCoverage=99%, HitCoverage=97%, E-value=0.0, Identity=64%"; Hit description =Uncharacterized protein At3g14120.2
  Pfam annotation: Domain name=Nup84_Nup100; Domain location=118-939; Score=875.7; E_value=2.2e-260; Accession=PF04121.4; Description =Nuclear pore protein 84  107
MAMGTSPSYFDPHNLSSRQQFRRYGKRHSSSGASIQYDNSASKLSETGLLYDGQSIHSPTNAALVLENIKQEVESLDADYLEEKTPYSTRRKLSAVIDGVPGVDAGFDSGRYSLKACKTEGDSLGDGAETIFTLFASLLDSSLQVTEELSKDQILVSGTSHVVACEFVVEDHTAQLCLRIVQWLEGLASKALDLEAKVRGSHVGSYLPSCGVWHHTQRYLKKGNLDMNVVHHLDFDAPTRENANLLPDDKKQDESLLEDVWILLRAGRLEEACGLCRSAGQPWRASSLCPFGGLNTFPSVEALVKNGKNRTLQAVEFESGIGHQWHLWKWASFCASEKIADQGGKCEAAVYAAQCSNLKRMLPLCNDWESACWAMAKSWLDVQVDLEITRSLPGGVDQLRTFGDVIDGSPGNADGSFEPSNGPENWPIQVLNQQPRQLSSLLQKLHSGEMIHEAVTRQCKEQQRQIQKTFQFVGIISPKFFVLSHRPSGDPQMIRFGAHLVLVLRYLLAEEMKDTFKDKILSVGDNILHLLPKLSCLFHDFLVCDREHEELVGIYASQLARHRCIDLFVHMMELRLHNSVHVKYKIFLSAMEYLPFSSMDDSKGNFEDIIQRSREIKVGKYDNLSDVAEQHRLQSLQKAKVIQWLCFTPPSTITNVKDVSKKLLLRALIHRVPAMPIGAHTVLGFLAEPLKQLAETLETSEDYNVFEDLREFQDWREYYSCDATYRNWLKTEVENAEVPISELSLEEKERAISAAKETLSASLSLLKRKETPWLASTDCMYESAEPVFLELHATAMLCLPSGECLCPDATVCTTLTSALYSSAGDEVVLNRQLMVNVSISSRDSYCIDVVLRCLAIAGDGLEPHDLNDGGILGTIMAAGFKGELPRFQAGVTMEISCLDAWYSDKDGTLECPATYIVKGLCRRCCLPEVILRCMQVSVSLMGSGVLPDCHDTLIELVGSPETDFLHLFSQQQLQARL

SEQ ID NO: 169475 - protein, 297 aa, Glycine max
  Coding DNA Sequence Number=SeqID_77790
  Gene Ontology: Mol. function=binding
  Homolog annotation: Hit_ID=A7P6F5; Match level="QueryCoverage=100%, HitCoverage=97%, E-value=1e-91, Identity=57%"; Hit description =Chromosome chr9 scaffold_7, whole genome shotgun sequence
  Pfam annotation: Domain name=TPR_1; Domain location=224-257; Score =14.6; E_value=0.093; Accession=PF00515.19; Description =Tetratricopeptide repeat
  Pfam annotation: Domain name=TPR_1; Domain location=264-297; Score =15.5; E_value=0.074; Accession=PF00515.19; Description =Tetratricopeptide repeat
  Pfam annotation: Domain name=TPR_2; Domain location=184-217; Score =7.6; E_value=3.4; Accession=PF07719.8; Description=Tetratricopeptide repeat
  Pfam annotation: Domain name=TPR_2; Domain location=224-257; Score =12.5; E_value=0.84; Accession=PF07719.8; Description=Tetratricopeptid e repeat
  Pfam annotation: Domain name=TPR_2; Domain location=264-297; Score =13.9; E_value=0.56; Accession=PF07719.8; Description=Tetratricopeptid e repeat
  Pfam module annotation: Pfam domain module=TPR_1::TPR_1::TPR_2::TPR _2::TPR_2; Domain location=224-257::264-297::184-217::224-257::264-297
MAVLIRCSCFLTRPRFSQPQFYANNTKPVLPGKLACLSLKRDKGVPHFVDTFDGSSKIPSLLHCSKCKEDIHQRFPSLIFVASNILMFSMPNTALAETCEADTSVFNMPILLAVALIGATVGGLLARQRRNELQRVNEQLIQINSALRKQAKIESYAPSLSYAPIGGGRILDNEIIVNPKKQELISKLKNGKNFLRNQRPDKAFTEFKNALELAQNLKDPIEEKKAARGLGASLQRQGKYRDAIKYHSMVLAISEREGEDSGSTEAFGAIADCYTELGELEKAGQFYDKYIARLEKD

SEQ ID NO: 169476 - protein, 205 aa, Glycine max
  Coding DNA Sequence Number=SeqID_77791
  Gene Ontology: Mol. function=phosphopantetheine binding; Cellular component=chloroplast; Biological process=fatty acid biosynthetic process
  Homolog annotation: Hit_ID=A7P6D9; Match level="QueryCoverage=51%, HitCoverage=67%, E-value=5e-27, Identity=63%"; Hit description=Acyl carrier protein
  Pfam annotation: Domain name=PP-binding; Domain location=65-131; Score=63.0; E_value=9.9e-16; Accession=PF00550.16; Description =Phosphopantetheine attachment site
  Subcellular localization annotation: CTP_CleavageSite=67; ConfidenceScore=5.59e-01
MASVLSTSSISLATLSFNSGGSSMFGELKLVNKVQLKRATKTSFALSGGINTIISCSTAELETLQIVQSTIAKQLSIDEATVTPQTKFSDLGADSLDTVEIMMALEEKFDISIGEGGAENISTVQDAADLIEKGVRGVVGAEGAEVVVVVPKPDWERTMVMLRLIGTCSATVDRTELPPENELYFRSFPRPVSGAGPANVSSHSL

SEQ ID NO: 169477 - protein, 1145 aa, Glycine max
  Coding DNA Sequence Number=SeqID_77792
  Homolog annotation: Hit_ID=A7P6E2; Match level="QueryCoverage=96%, HitCoverage=86%, E-value=0.0, Identity=45%"; Hit description =Chromosome chr9 scaffold_7, whole genome shotgun sequence
MKLSVAREEREKVKKPYSVLNCPNRIALSTLLRACGNGAGAITVADATTKELLRAIDVRLSAVRQDLTTACARASASGFNPHTVSHLKHFADRFGAHRFNEACTKYMSLYKRRPDLISHWPGGDDRELRSSVSSDMSIDNDDGPNQAQDQAQPIDPPKPKPISNFASLRRSNTSVSSKDETSDTPTKEETESPAPAPTTAPSGRRLSVQDRINLFENKQKENSGGRAPELRRLSSDVLRRWSGASDMSIDGSGEKKDFDSPLPPPASSVSETKSVVVSEDKVRIDKSEKFVITDQGSSQETGKVSVFDEDKNGGFKDQVGGGVSEATLKKGSSEVVIVGPMLSSGDDDAKFYGGMKNHVVAPSLIRGSRSHSRSLSAQFEGGNGLKFRDVSVRVDQSSPNEVEDSSSSSSFPNKEEDSQIPKMKYQKPLPGRNEQQISTAQGKRDGANESSKMKQVLETQDNARATSTPPLEQQHQRVRQSKGNQGMHDELKMKADELEKLFAEHKLRVPGDQSGSVRRVEPADVHVEQSQYRRGGVGESTPQLPSRSNVIEVAASSSNLTSFDAKLVTKMVDSQNYGDALRQNFSDLNLSEDSRGKFYEKYMKKRNAKLQEDWSMNRAEKEARMKAMQDSLERSRAEMKVKFSGSANRQDSASGAYRAEKLRYFKSNIKKEQHPIDSLQNEDDEDLSEFSEEKTYGASRQSRKFFPNRHISSGTPRTIAVSVSRSSGGRRRDDPLAQSVPNFSDLRKENTKPSSAVSKTTRTQVRTYSRSKSTTEEIQGVKEEKSRQTLSLRKSSANPAEFKDLSHLNSDGIVLSPLKFDMGESHLGPYDQSPRSFLKKGNNIGSGSVGNAIRMKASMVSDTQKNKEFDDLEFDEEDSLRMATEEQDDIETMAIKDVAYNNNGKVSLSQESGKSGNSGSEIGDSTRSLAQVDPISGGEMATGFPSTFNGVRSLQDSPVGSPVSWNSRVPHPFSYPHESSDIDASIDSPIGSPASWNSHSLNQGDNDAARMRKKWGSAQKPFLVANSSQNQPRKDVTKGFKRLLKFGRKTRGSESLADWISATTSEGDDDTEDGRDLANRSSEDLRKSRMGFSHGHPSDDSFNENELFNEQVQSLQSSIPAPPAHFKLRDDHISGSSLKGDPWVT

SEQ ID NO: 169478 - protein, 125 aa, Glycine max
  Coding DNA Sequence Number=SeqID_77793
  Subcellular localization annotation: CTP_CleavageSite=87; ConfidenceScore=5.54e-01
MVKVGTSYVPINVSFSPKVGPGLPAVPPVQLLTGWCVTAKAPPESALASVAVTLRVTTTPAALNAPLQGASHSPFRLRNCWEGRSVRASSLLRQLAKGGCAARRLSWVTPGFSQSRRCKTTASEL

SEQ ID NO: 169479 - protein, 100 aa, Glycine max
  Coding DNA Sequence Number=SeqID_77794
SRGYIYLGCYTENKRGYISYGSVQVEGTSLMDQFKWRVHPLGCSKRTREGTSLVDLWLVKDFKRLKEISRTVGCLGTRCRHGMLPNQYKSCVCLLLPYTL

SEQ ID NO: 169480 - protein, 63 aa, Glycine max
  Coding DNA Sequence Number=SeqID_77795
  Subcellular localization annotation: CTP_CleavageSite=41; ConfidenceScore=5.05e-01
LEDSNAVGLISSNSESCSFLCSLDAASSKFGSLRPSMLYVPSPLVSDKTCHRPVGMGISLSES

SEQ ID NO: 169481 - protein, 55 aa, Glycine max
  Coding DNA Sequence Number=SeqID_77796
  Gene Ontology: Mol. function=transcription factor activity; Biological process=regulation of transcription, DNA-dependent
  Homolog annotation: Hit_ID=UPI00005F7237; Match level="QueryCoverage =100%, HitCoverage=17%, E-value=9e-22, Identity=90%"; Hit description= COG0583: Transcriptional regulator
  Pfam annotation: Domain name=HTH_1; Domain location=4-55; Score=38.1; E_value=3.1e-08; Accession=PF00126.18; Description=Bacterial regulatory helix-turn-helix protein, lysR family
MWSEYALEVVDAVARTGSFSAAAQELHRVPSAISYTVRQLEGWLAVPLFERQHRE

SEQ ID NO: 169482 - protein, 470 aa, Glycine max
  Coding DNA Sequence Number=SeqID_77797
  Gene Ontology: Mol. function=pyruvate kinase activity; Cellular component=cellular_component; Biological process=glycolysis
  Homolog annotation: Hit_ID=A4TIP8; Match level="QueryCoverage=100%, HitCoverage=100%, E-value=0.0, Identity=88%"; Hit description =Pyruvate kinase
  Pfam annotation: Domain name=PK; Domain location=1-345; Score=731.6; E_value=5.6e-217; Accession=PF00224.12; Description=Pyruvate kinase, barrel domain
  Pfam annotation: Domain name=PK_C; Domain location=355-469; Score =96.1; E_value=1.1e-25; Accession=PF02887.7; Description=Pyruvate kinase, alphabeta domain
  Pfam module annotation: Pfam domain module=PK::PK_C; Domain location =1-345::355-469
MKKTKIVCTIGPKTESEEMLTQLLEAGMNVMRLNFSHGDYAEHGQRITNMRAVMEKTGRQAAILLDTKGPEIRTMKLDGGNDVSLKAGQTFTFTTDQSVIGNSERVAVTYAGFTEDLKIGNTVLVDDGLIGMEVTEVTENTVVCKVLNNGDLGENKGVNLPGVSIQLPALAEKDKRDLIFGCEQGVDFVAASFIRKRSDVLEIREHLKAHGGEHIQIISKIENQEGLNNFDEILEASDGIMVARGDLGVEIPVEEVIFAQKMMIKKCNKARKVVITATQMLDSMIKNPRPTRAEAGDVANAILDGTDAVMLSGESAKGKYPLESVTIMATICERTDRVMKSRIDSLQDSRKLRITEAVCRGAVETAEKLEAPVIVVATEGGKSAKSVRKYFPDATILALTTNQTTARQLILSKGIETRLVSEIASTDDFYRIGKEMALQSGYAQKGDVVVMVSGALVPSGTTNTASVHVL

SEQ ID NO: 169483 - protein, 16 aa, Glycine max
  Coding DNA Sequence Number=SeqID_77798
EALRVGRLSLNSVVNG

SEQ ID NO: 169484 - protein, 300 aa, Glycine max
  Coding DNA Sequence Number=SeqID_77799
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLSPSLEAREPVNENSGTGTGIGTLMPTWPTSMSSWNLHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169485 - protein, 68 aa, Glycine max
  Coding DNA Sequence Number=SeqID_77800
MAAKLRSGTGPLSHGVPPRSLCGKLSRSHFLQGQTFGKLVYKKTLILKQKQHANLSDLEQTCAHISLM

SEQ ID NO: 169486 - protein, 57 aa, Glycine max
  Coding DNA Sequence Number=SeqID_77801
ASDAKRSFSALSVTRESGRAQESTPHAKREISLLSKMFVSCQAQCTTGAKPISTYSR

SEQ ID NO: 169487 - protein, 74 aa, Glycine max
  Coding DNA Sequence Number=SeqID_77802
MRLLGKEMRGEKIAGAQDLVGNQRETTTLGRGVATYPSAGGRRVTRGCVFQERNTRGVATNVYLRKTSEKLEKT

SEQ ID NO: 169488 - protein, 272 aa, Glycine max
  Coding DNA Sequence Number=SeqID_77803
MAKFDPDIVLEFYANAWPTEEGVRDMRSWVRGLWIPFDADALSQFLGDPLVLEEGQECEFNQRRNRADGFDEEAIAQLLCTSGQDFTRTAAGRQVQIMHTNMTTLTHMWMALLLSNVLPSDHNSDLPLSKCQLVYAILTRMSVHVAQLIVDAIYLFTSMPPTRHPLDLDKSNRALGFLALITGLCQSFGVPVTPNKAANHQGQVQIHECLYKLNLSQQGQGFAPFTCPTPEQFSPRPIQGRHLPDSPADAEEARMDEEMTDLLGFLGGSGAT

SEQ ID NO: 169489 - protein, 177 aa, Glycine max
  Coding DNA Sequence Number=SeqID_77804
MAEEDEVQERMKADMEAMKEQMTTMMEAMMSMKKIMEVNVVAVATVSAVSGVDPTLPSGLNLINRPTSDTGGPHFVQVQNKHVFSPYGLPPNYAPPNENINNSSPILIESQQPQTDHAHVSQPMGETHEISHRNLADFEPRLGYATKGQAVGDIPLQNTLEGPQYHPQPHPFAFHSG

SEQ ID NO: 169490 - protein, 60 aa, Glycine max
  Coding DNA Sequence Number=SeqID_77805
MPKDRGTCLDFRDCHHQKGGDCRQRIKLNVLMMPKDHMFLKALFKTKKLKIFKMDDQDSL

SEQ ID NO: 169491 - protein, 559 aa, Glycine max
  Coding DNA Sequence Number=SeqID_77806
  Gene Ontology: Mol. function=phosphoglycerate kinase activity; Cellular component=cytoplasm; Biological process=glycolysis
  Homolog annotation: Hit_ID=Q2YC27; Match level="QueryCoverage=55%, HitCoverage=77%, E-value=1e-126, Identity=75%"; Hit description =Phosphoglycerate kinase
  Pfam annotation: Domain name=Gp_dh_C; Domain location=78-235; Score =321.3; E_value=1.7e-93; Accession=PF02800.11; Description =Glyceraldehyde 3-phosphate dehydrogen
  Pfam annotation: Domain name=Gp_dh_N; Domain location=1-73; Score= -6.0; E_value=3.8e-09; Accession=PF00044.15; Description =Glyceraldehyde 3-phosphate dehydrogen
  Pfam annotation: Domain name=PGK; Domain location=247-559; Score =249.4; E_value=7.8e-72; Accession=PF00162.10; Description =Phosphoglycerate kinase
  Pfam module annotation: Pfam domain module=Gp_dh_C::Gp_dh_N::PGK; Domain location=78-235::1-73::247-559
RDPNNIDWRKGGAEVVVESTGAFLTQETCQSHVNGGAVKVVQSAPGKDDTPMFVYGVNHTDYAGQAIISAASCTTNGLAPLAKVLHDTFGIKRGLMTTIHAATASQLTVDGTSKKDWRGGRSVFENIIPSTTGAAKAVGKVIPSLNKKLTGMSMRVPSADVSVVDLTVELNSEATYEAICAAMQQAADGALKGVLEYTNDKVVSSDFRSSPAASVFDAGAGIMLDPTFVKVVGCLYSSGGDRLRETFMKFIKMTDLDLRGKRVFIRADLNVPVKDGVVTSDARIVASMPTIEFALKAGAKVMVTSHLGRPEEGVYSEENSLQPVADVMSKLLGQPVRLVKNWLAPNAPEDSLTTQDGQLILLENCRFNVGEKKNNDELAKKYAALCDVFVMDAFGTAHRAEASTHGIAKFAPVACAGILLTEELDALSKALLAPARPLVAIVGGSKVSTKLTVLESLADKVDQLVVGGGIANTFLKASGQEVGKSLCEDDLVDTAKCLMDKMAARGACVPIAKDVVVGKQFDANEPAVKKPATEVAADEMIFDIGAQSAAELVDIIMKA

SEQ ID NO: 169492 - protein, 280 aa, Glycine max
  Coding DNA Sequence Number=SeqID_77807
  Gene Ontology: Cellular component=integral to membrane; Biological process=barrier septum formation
  Homolog annotation: Hit_ID=A4W6J6; Match level="QueryCoverage=92%, HitCoverage=92%, E-value=1e-140, Identity=95%"; Hit description=Cell division protein FtsQ
  Pfam annotation: Domain name=FtsQ; Domain location=131-249; Score =120.0; E_value=6.9e-33; Accession=PF03799.6; Description=Cell division protein FtsQ
  Pfam annotation: Domain name=POTRA_1; Domain location=58-128; Score =93.4; E_value=6.9e-25; Accession=PF08478.1; Description=POTRA domain, FtsQ-type
  Pfam module annotation: Pfam domain module=FtsQ::POTRA_1; Domain location=131-249::58-128
MSQAALNTRTRDDEEEYASSRRSNGTRLAGIIFLLGVLCTVFISGWMVLGWMEDAQRLPLSKLVVTGERHYTRNDDIRQSILALGSPGTFMTQDVNIIQSQIERLPWIKQASVRKQWPDELKIHLVEYVPIARWNDQHMVDVDGNSFSVPTDRVNKQNLPMLYGPEGSENEVLQGFREMGQVLAKDRFTLKDAAMTARRSWQLTLTNGIKLNLGRGDTMKRLARFVELYPVLQQQAQTDGKRISYVDLRYDSGAAVGWVPAPVEEPNQQQNQAQVQAEQQ

SEQ ID NO: 169493 - protein, 86 aa, Glycine max
  Coding DNA Sequence Number=SeqID_77808
  Pfam annotation: Domain name=G-patch; Domain location=2-43; Score =17.9; E_value=0.0013; Accession=PF01585.14; Description=G-patch domain
MMVARVMLGNGYEPEMGLGRNNDDRNSLISTRGNRGKFGLGYKPTQADIRKSVTGRKSGSQGSQSGQKVEGGPPCHISRSFISAGL

SEQ ID NO: 169494 - protein, 63 aa, Glycine max
  Coding DNA Sequence Number=SeqID_77809
MARTCNPLKARTCVGPCRNLPFNGWTTRDSWVRVPRKEYARSRHQRLFEENVGKTGKDVVYEL

SEQ ID NO: 169495 - protein, 160 aa, Glycine max
  Coding DNA Sequence Number=SeqID_77810
MVVTARPERVVRQFGYIQSILPLPVSARLSHDEIDDRWMQFAEHLLPASQLCLVPGQVSVDYMEWFFRISHTFMIPTQAGDQSRDALAADPEDYIQPPSPQVPVTFDPPPHVRLERVLNLRIVTAGTKLYDIRQDCLTIARGGPSADGTVRARQRRRTDH

SEQ ID NO: 169496 - protein, 55 aa, Glycine max
  Coding DNA Sequence Number=SeqID_77811
VVILRTREGTSLMNQFKCNAILPRKGPVTRTMSKRLQEDWARAAEEGPRVLMNLR

SEQ ID NO: 169497 - protein, 47 aa, Glycine max
  Coding DNA Sequence Number=SeqID_77812
MGSKFTTLRLAPPSCLARHVEAALSGGCALSPTAECSASGKCTGSHK

SEQ ID NO: 169498 - protein, 134 aa, Glycine max
  Coding DNA Sequence Number=SeqID_77813
MSLATLFGKLQEHEMELMRLHRHEENDIKRKGIALRASSSFIQEESDKEDLTETKEDDDDFRLFVKRFNKFLRNKRNKRESIINTEKKEEDSSLTPTGYESNQLGHMRFDYLVFERRIEKSDKRNLKEKKEKKA

SEQ ID NO: 169499 - protein, 143 aa, Glycine max
  Coding DNA Sequence Number=SeqID_77814
MAAQLVHDCVVMECLEGVWETLEGDERCRFRGTIRLTATSLVHPEEPTRTLQQPVEWILPTPTPYRLVEPVQVIEVSSFEEDPEEDPEELPPEPAVDALDFPEDDEDPLLDVDSLEDIMSASEADSTEESGPGRTANSEDSSS

SEQ ID NO: 169500 - protein, 67 aa, Glycine max
  Coding DNA Sequence Number=SeqID_77815
MAPRKLSAKRSRKDAAAEGTSAAPEFDNHRFRSVEHQQRFEAIKGWSFHRERRVQLRDDETQISRKR

SEQ ID NO: 169501 - protein, 173 aa, Glycine max
  Coding DNA Sequence Number=SeqID_77816
  Homolog annotation: Hit_ID=UPI00016621D1; Match level="QueryCoverage =80%, HitCoverage=40%, E-value=4e-13, Identity=35%"; Hit description =UPI00016621D1 related cluster
MNDPLHESISCFLIRVDPWVLVPITFRGLHVLAFRGLHVLAFRGLHVLTFRGLHVLAFRGSCTFTFRGLHVLTFKGLHALTFRGLPVLAFKGIHALIFRGSCTFTFRGLHVLAFKGLHALTFRGLPVLAFKGLHALIFRGSCTFTFRGLHVLAFKGLHALTFRDYLSSPSKGY

SEQ ID NO: 169502 - protein, 172 aa, Glycine max
  Coding DNA Sequence Number=SeqID_77817
IILVITNINHMRNLMYLRCMFLDLCLIIIHHKHNINQQVSLVMRLKKSLGFSSYIPQYSFQVPSTSNVFYGSSQMFATTFNTPPSACNLAPSSSCYHPSLPTQIRDISHEDEDEDGDNNNNNDDDDDGDGDDDNGGHHVPQQQQTITGEHPRTRGGRGGRSRGQQTQTNPVQ

SEQ ID NO: 169503 - protein, 67 aa, Glycine max
  Coding DNA Sequence Number=SeqID_77818
MLHSLNQRLLLAGLLSRQKGSTKCGYYVMHWMSTIILGSFRNNWEATIGAREMKGVADPVGTVLSPS

SEQ ID NO: 169504 - protein, 137 aa, Glycine max
  Coding DNA Sequence Number=SeqID_77819
MAATLASSGSDASSYGANDEGCRSGGDNETILEPNEKLPPYGGQHEVGCHYEDSESYLFTIETPFNRVFPWKRDFVAEFDCNFSFMVQLPLHLHSSQAEADPNTLAVEVYNPPPSKEYVCCIEKTLLRTRGALVTAF

SEQ ID NO: 169505 - protein, 120 aa, Glycine max
  Coding DNA Sequence Number=SeqID_77820
MEGYANKGRKKESAVSFPKEVQAHAKKRWSISSDDFVDLRTNTLQEGGNDMGIQAHDNHQTQAHDQMEAQDPIQDIGGPMTRAKKAQETLKHMVTILGAVQMQGEAHKGELLVLCVDCLG

SEQ ID NO: 169506 - protein, 114 aa, Glycine max
  Coding DNA Sequence Number=SeqID_77821
  Homolog annotation: Hit_ID=A6FJQ2; Match level="QueryCoverage=33%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLKYALDILEETILLNAKPMDTPMDPSIKLLPSGGALIKSWEIQEIGWKIKRSDNYFPI

SEQ ID NO: 169507 - protein, 116 aa, Glycine max
  Coding DNA Sequence Number=SeqID_77822
  Gene Ontology: Mol. function=metal ion binding; Cellular component =plasma membrane; Biological process=cytokinin metabolic process
  Homolog annotation: Hit_ID=A7PM08; Match level="QueryCoverage=75%, HitCoverage=21%, E-value=2e-18, Identity=53%"; Hit description =Chromosome chr14 scaffold_21, whole genome shotgun sequence
MSKNIPPSRKEASFALAALMEIPSQYKAAIELNLLGTRQVNALQRHALPPPTYNPHAARFEPSIPPQHGNSHLVATAPSAPSSTYDNQKMDKIQGKARLTSMLALNISYADYGSRQ

SEQ ID NO: 169508 - protein, 110 aa, Glycine max
  Coding DNA Sequence Number=SeqID_77823
MGGRIIAPFCKGELGACNGEKFAPKSSNEDGITVRDEAAGKTVEFAYHIEEESGNLMGGISRLQGAKVSPFGETIDHDKDSGVAMRRRKARDKVKSEIFPWRGGYQNWLE

SEQ ID NO: 169509 - protein, 387 aa, Glycine max
  Coding DNA Sequence Number=SeqID_77824
  Gene Ontology: Mol. function=hydrolase activity, acting on ester bonds; Cellular component=cellulose and pectin-containing cell wall; Biological process=lipid metabolic process
  Homolog annotation: Hit_ID=A7PM03; Match level="QueryCoverage=96%, HitCoverage=95%, E-value=1e-116, Identity=56%"; Hit description =Chromosome chr14 scaffold_21, whole genome shotgun sequence
  Pfam annotation: Domain name=Lipase_GDSL; Domain location=35-368; Score=236.6; E_value=5.6e-68; Accession=PF00657.13; Description=GDSL- like LipaseAcylhydrolase
MGFLVQFVVFMLFPWFLSVRAEENYSSQHCDFPAIFNFGDSNSDTGCMAAAFYPEVLPYGETFFHEPVGRASDGRLIIDFIAQHLGFPFLSAYINSIGTSYRHGANFAAGSSTIRRQKRTVFEGGTPFTFEIQVAQFNQFKARTRKFFNQDAQGKNSFRGHFPRPEDFAKAIYTFDIGQNDIAAAINKVDTEDSHAVISDIVDYFENQVQTLLGLGARTFWIHNTGPIGCLPVAMPVHNAMNTTPGAGYLDQNGCINYQNDMAREFNKKLKNTVVKLRVQFPDASLIYVDMFSAKYELISNANKEGFVDPSGICCGYHQDGYHLYCGNKAIINGKEIFADTCDDPSKYISWDGVHYTEAANHWIANRILNGSFSDPPLSIAHSCRAQ

SEQ ID NO: 169510 - protein, 786 aa, Glycine max
  Coding DNA Sequence Number=SeqID_77825
  Gene Ontology: Mol. function=electron carrier activity; Cellular component=mitochondrion; Biological process=electron transport
  Homolog annotation: Hit_ID=A7PLX3; Match level="QueryCoverage=99%, HitCoverage=96%, E-value=0.0, Identity=56%"; Hit description =Chromosome chr14 scaffold_21, whole genome shotgun sequence
  Pfam annotation: Domain name=PPR; Domain location=249-283; Score =22.7; E_value=0.0014; Accession=PF01535.11; Description=PPR repeat
  Pfam annotation: Domain name=PPR; Domain location=290-324; Score =15.5; E_value=0.11; Accession=PF01535.11; Description=PPR repeat
  Pfam annotation: Domain name=PPR; Domain location=325-359; Score =39.5; E_value=1.2e-08; Accession=PF01535.11; Description=PPR repeat
  Pfam annotation: Domain name=PPR; Domain location=488-522; Score =19.8; E_value=0.011; Accession=PF01535.11; Description=PPR repeat
  Pfam annotation: Domain name=PPR; Domain location=530-564; Score =16.6; E_value=0.083; Accession=PF01535.11; Description=PPR repeat
  Pfam annotation: Domain name=PPR; Domain location=565-599; Score =19.9; E_value=0.0093; Accession=PF01535.11; Description=PPR repeat
  Pfam annotation: Domain name=PPR; Domain location=600-634; Score =32.2; E_value=1.9e-06; Accession=PF01535.11; Description=PPR repeat
  Pfam annotation: Domain name=PPR; Domain location=635-669; Score =18.7; E_value=0.022; Accession=PF01535.11; Description=PPR repeat
  Pfam annotation: Domain name=PPR; Domain location=670-704; Score =41.5; E_value=2.9e-09; Accession=PF01535.11; Description=PPR repeat
  Pfam annotation: Domain name=PPR; Domain location=705-739; Score =16.9; E_value=0.077; Accession=PF01535.11; Description=PPR repeat
  Pfam module annotation: Pfam domain module=PPR::PPR::PPR::PPR::PPR::PP R::PPR::PPR::PPR::PPR; Domain location=249-283::290-324::325-359::488- 522::530-564::565-599::600-634::635-669::670-704::705-739
  Subcellular localization annotation: CTP_CleavageSite=48; ConfidenceScore=5.32e-01
MISTWPSKVNHLVVPRFEIGPSGVTDQNRRRRVKLGFAFSVSHSEKVSVFQFSRGYGTVVFSGHAKLDLRCGFLLGCSRPKLGIILKPHKSHVGDLAPPLGWALEEDGVGSELVDEQIDSNDASVNRESEGVKSLNLDQVQDSDFEGQIRGYDDDSKESGGNELVEEQTDSNDALVNGDLEGVKSLNLDQVKDSDCEGKMCGDDNSKEGGEEESDGKVDVRALALSLQTVKTVEDVGGILKDKGDLPLQVFSTIISGFGKEKRMDSALILFNWMKKRKIETNGSFGPNLFIYNGLLGVVKQSGQFAEMEVILNEMAEDGIAYNVVTYNTLMAIYIEKGECDKALNMLEEIRRNGLTPSPVSYSQALLAYRRMEDGYGALNFFVEFREKYRQGEIGKDDDGEDWEKECLKLEKFTIRVCYQVMRCWLVSRDNLSKNVLKFLVDMDNVGIPLPRADLERLAWACTREDHYIVVKELYNRIRERYDKISLSVCNHAIWLMGKAKKWWAALEIYEDLLDKGPKPNNLSYELIVSHFNFLLSAAKRKGIWRWGVKLLNKMEDKGLKPGCREWNAVLVACSKASETTAAVQIFKRMVENGEKPTIISYGALLSALEKGKLYDDALRVWNHMIKVGVEPNAYAYTIMASIHTAQGNFNRVDAIIQEMVTLGIEVTVVTYNAIITGCAHNGMSSVAYEWFHRMKVQNISPNEITYEMLIVALANDGKPRLAYQLYTRAKNEGLTLSSKAYDAVVQSSQANNATIELGLLGPRPVDKKKKVQIRKTLNEFYNLAG

SEQ ID NO: 169511 - protein, 427 aa, Glycine max
  Coding DNA Sequence Number=SeqID_77826
  Gene Ontology: Mol. function=cysteine-type endopeptidase activity; Cellular component=vacuole; Biological process=proteolysis
  Homolog annotation: Hit_ID=Q852T1; Match level="QueryCoverage=88%, HitCoverage=77%, E-value=1e-125, Identity=57%"; Hit description =Vacuolar processing enzyme-2
  Pfam annotation: Domain name=Peptidase_C13; Domain location=48-319; Score=614.0; E_value=1.4e-181; Accession=PF01650.9; Description =Peptidase C13 family
MKFNSRNWVTLIASVWMSFTVSVMEGVRPLPNPLIEAHGHVKHATAKRWAVLVAGSKGYDNYRHQADVCHAYQVLKKGGLKDENIIVFMYDDIANHTLNPRLGTVINKPNGPDVYKGVPKDYTGNATTSENFYAVISGNRSALSGGSGKVVDSGPNDTIFIYYADHGATGVIGMPVGDFVMANDFVDVLKKKHAAKSYKKMVIYMEACESGSMFEGILPNNIDVYATTAANTDEDSYGFYCPDLYPTPPPEYTTCLGDEYSISWLEDSDKNDMVNETLQQQYETVRRRTLVSHINATSHVMQYGDKELNNDSLAIYIGALAPSLSLNENAHSFEQSTTQTKLISQRDTRLLHLRLELQKAQDGSEKLKAQKELADEIAHRKHVDNVVHLIGDLLFGEENSSAMMFHVRPAGKPLVDDWDCFKTLVSA

SEQ ID NO: 169512 - protein, 81 aa, Glycine max
  Coding DNA Sequence Number=SeqID_77827
MAAEWRRKRERRRHFKEKMSLEEAHHHRRPWIRAWRKKEMNEGRGRKEHEILCSKRALYLNPLIQDQFQDSPLSVLRCHEA

SEQ ID NO: 169513 - protein, 136 aa, Glycine max
  Coding DNA Sequence Number=SeqID_77828
  Gene Ontology: Cellular component=ribosome
  Homolog annotation: Hit_ID=A2Q6B4; Match level="QueryCoverage=94%, HitCoverage=52%, E-value=1e-12, Identity=30%"; Hit description =Ribosomal protein L33; Nucleic acid-binding, OB-fold
  Pfam annotation: Domain name=DUF223; Domain location=40-130; Score= -8.6; E_value=0.019; Accession=PF02721.5; Description=Domain of unknown function DUF223
MARIPDKIKSIDGSRETLKLAVRIMDLWFIGTPNKSEQAEMVTADSEGDQIHVVCKADQLKSWKAYLKENSTYVMHNFKVVKNDGQFRVCEHEYKLVFIGVTVVREAYLHELPFKEFRFVEFGNVVAGILWLACWL

SEQ ID NO: 169514 - protein, 104 aa, Glycine max
  Coding DNA Sequence Number=SeqID_77829
  Subcellular localization annotation: CTP_CleavageSite=35; ConfidenceScore=5.28e-01
MDMNVGAFISGQITSIAQSNSSRLRFPALITALCKAREVNSDSLVFERLRGAKWARTRPAEPPSTSTTHIPARISAAPSVPASADFQHLEAMLQSIYQGQIILL

SEQ ID NO: 169515 - protein, 150 aa, Glycine max
  Coding DNA Sequence Number=SeqID_77830
SVPDYGKRMQLPQEPLNKRPRGLARKSMAGTNFAELCGELVACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGY

SEQ ID NO: 169516 - protein, 168 aa, Glycine max
  Coding DNA Sequence Number=SeqID_77831
  Homolog annotation: Hit_ID=A5AK77; Match level="QueryCoverage=55%, HitCoverage=11%, E-value=7e-11, Identity=37%"; Hit description =Putative uncharacterized protein
MTRGNPGDLQPTDPEIDRTFHILVRHNVHLDHSVHFEHCEHFEYSIAGDSEYSDFEHSAINFHIENMAQPPPHERTLMEMVAPDFTYESLCIQYPDKGVPYVLKTRLIHLLPKFHGLAGEDPHKHLKEFHIVCFTMKPPDVQEDHIFLKAFPHSLEGVAKDWLYYLAP

SEQ ID NO: 169517 - protein, 66 aa, Glycine max
  Coding DNA Sequence Number=SeqID_77832
MRKDLEEDDLYRLTERTTSSHQEHCFSPSAEREKSAKQKFTNSFACLEILERERSKFQRVLRDSAV

SEQ ID NO: 169518 - protein, 50 aa, Glycine max
  Coding DNA Sequence Number=SeqID_77833
EKMKNKKVVVAGVSLCEACALSENHSLSETLSPFSMSGESRGESVKHLRA

SEQ ID NO: 169519 - protein, 89 aa, Glycine max
  Coding DNA Sequence Number=SeqID_77834
TLEDPSKGISPPTNRAFIKKYCVSRQAQGETPQQPGDGRQRATDAPPSPLEFTSAHPQKGLSIVYTTWPTNRRPSPKPKVARYLGYACI

SEQ ID NO: 169520 - protein, 326 aa, Glycine max
  Coding DNA Sequence Number=SeqID_77835
  Gene Ontology: Mol. function=chlorophyll binding; Cellular component =integral to membrane; Biological process=photosynthetic electron transport
  Homolog annotation: Hit_ID=Q2MI75; Match level="QueryCoverage=93%, HitCoverage=70%, E-value=1e-149, Identity=74%"; Hit description =Photosystem II P680 chlorophyll A apoprotein
  Pfam annotation: Domain name=PSII; Domain location=1-326; Score =487.3; E_value=1.9e-143; Accession=PF00421.10; Description =Photosystem II protein
MGLPWYRVHTVVLNDPGRLLSVHIMHTALVAGWAGSMALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFMGMELLGPMFLFEGQNLNIVWNK

SEQ ID NO: 169521 - protein, 72 aa, Glycine max
  Coding DNA Sequence Number=SeqID_77836
  Homolog annotation: Hit_ID=A5AEB7; Match level="QueryCoverage=100%, HitCoverage=8%, E-value=7e-16, Identity=45%"; Hit description =Putative uncharacterized protein
MDIEYTIRKDESPAITDESSPTDVALYEHWERSNRLSVIFIKTKISVEIRGSIDQYEKLTSVKGVHEYIMKM

SEQ ID NO: 169522 - protein, 67 aa, Glycine max
  Coding DNA Sequence Number=SeqID_77837
VFRKLRMQYPEEGLPEVVPEELLRNLYIPEDLLPEVVIPDLPPSVPKISSGYTFYCFSSLKTNRKMK

SEQ ID NO: 169523 - protein, 39 aa, Glycine max
  Coding DNA Sequence Number=SeqID_77838
MSGLLAVKYSADVLMQSYSARALDRKTPSRLGQRCKRRP

SEQ ID NO: 169524 - protein, 89 aa, Glycine max
  Coding DNA Sequence Number=SeqID_77839
MDSKSTLRLMRTLGPSLGSLAQSTWSLLSNALAGLDCIKPRIFFINGFLCFLEDEWQQNGERKREWRCHFKEKMSLEEAHHHRRTWIRA

SEQ ID NO: 169525 - protein, 105 aa, Glycine max
  Coding DNA Sequence Number=SeqID_77840
  Homolog annotation: Hit_ID=A6FJQ2; Match level="QueryCoverage=36%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARFSQSRRCKRRPVPSLHACSRL

SEQ ID NO: 169526 - protein, 41 aa, Glycine max
  Coding DNA Sequence Number=SeqID_77841
ERIVDPEGFLECSSHPYWCFLKKMKRRNLSEKRYGKRIAII

SEQ ID NO: 169527 - protein, 211 aa, Glycine max
  Coding DNA Sequence Number=SeqID_77842
  Homolog annotation: Hit_ID=A5C169; Match level="QueryCoverage=68%, HitCoverage=12%, E-value=4e-08, Identity=28%"; Hit description =Putative uncharacterized protein
MVIDQSLFHDLNQLSSDGVPFEGTLNDDWKFDFSAHDARQLVCTNHADMTGRLLAGSLAFESRILHYLIVRILLPRSSNLAQVSKEDLVIMWAFHTGCQLDWAHLVRYRMHKALRLNAPLPYPHLVTLFFRHFQIPLDSEPYVPIKRSFLIGAAVIASLGYRKKHDGSWVKKAAQPADDEGNLPTEDKLVKGIYKIVDSQARCLGTGRRHK

SEQ ID NO: 169528 - protein, 158 aa, Glycine max
  Coding DNA Sequence Number=SeqID_77843
MPQNVLYDAIGDISTVGYPVIFFSILAPLAPENLDNSKNTPGRDLISLWVKVGNLLRAGSTSHFRQKLAQGFPHRRTSALASVAVTLRVTTTPAALNAPLQGASHSPFRLRNCWEGRSVRASSLLRQLAKGGCAARRLSWVTPGFSQSRRCKTTASEL

SEQ ID NO: 169529 - protein, 19 aa, Glycine max
  Coding DNA Sequence Number=SeqID_77844
METSGGVKIGHRGLWIARN

SEQ ID NO: 169530 - protein, 170 aa, Glycine max
  Coding DNA Sequence Number=SeqID_77845
GGPWVLVTLTVERTTRPRLERTTRPHHQSRLPRPHHQRTTCPRLERATRPHLGGLHVLTIRGLHALTSRGLCPRLERATRPHLGTTRPHHQRAARPHLQRTIVLALRGLYALTLGLHVLTIRGLHAFTSRGLYVLAWRGLHALTLGTSYPHRQRTTHPRLQRATRPHLGY

SEQ ID NO: 169531 - protein, 139 aa, Glycine max
  Coding DNA Sequence Number=SeqID_77846
STGTIARSPPSTTCDGVVPGDMSRGLGDLGDVRLKNEDRKLRWPLVIDYQGLRNGDSMLWRPLVIDYQYCVIDYTEYQATGSLGDPRRQCEVPISGHDSIHGYFIGTSRGTSTHALAHCGVDITYTYSISTRGASPSDR

SEQ ID NO: 169532 - protein, 159 aa, Glycine max
  Coding DNA Sequence Number=SeqID_77847
QGAPFEGTLVDDWKFDYSVMMPAAWSTLTRILMPHSSNLAQASEEDFILMWAFLTGAGAVTSFGYCKDMDGQWMKKDAQPPQDKRTPSPPPQRDDSSALMNEVLLELQGLRTYVGERFDSLDGRIDAIDARFEGMNTRITQLEEDVSYLRRCFDLPPPS

SEQ ID NO: 169533 - protein, 77 aa, Glycine max
  Coding DNA Sequence Number=SeqID_77848
MVDTLPTFYYEKMIGYMPANFADLVFARERIEFGLRKGKFEYASNVAPNIPEGCMSPVVGARKKEGDTSGSPPPQHR

SEQ ID NO: 169534 - protein, 130 aa, Glycine max
  Coding DNA Sequence Number=SeqID_77849
MDISEDTDIPVILGRSFMLTTSCIVDMGKRKLELGFEDQKIDFDLFVEDKPTPEHNVCLQEGTEKWIRKHFLKNSPFTKRRLRAKRFFGHVLSRESQALSAQPLHLRLIWFAKLAKAELSQLQFDLNSAN

SEQ ID NO: 169535 - protein, 621 aa, Glycine max
  Coding DNA Sequence Number=SeqID_77850
  Gene Ontology: Mol. function=nucleic acid binding; Cellular component= cytoplasm; Biological process=mRNA catabolic process, deadenylation -dependent decay
  Homolog annotation: Hit_ID=A7P3F0; Match level="QueryCoverage=47%, HitCoverage=74%, E-value=4e-77, Identity=53%"; Hit description =Chromosome chr1 scaffold_5, whole genome shotgun sequence
  Pfam annotation: Domain name=zf-CCCH; Domain location=537-563; Score =53.9; E_value=5.7e-13; Accession=PF00642.15; Description=Zinc finger C-x8-C-x5-C-x3-H type (and similar)
  Pfam annotation: Domain name=zf-CCCH; Domain location=575-601; Score =24.5; E_value=0.00039; Accession=PF00642.15; Description=Zinc finger C-x8-C-x5-C-x3-H type (and similar)
  Pfam module annotation: Pfam domain module=zf-CCCH::zf-CCCH; Domain location=537-563::575-601
MLQQNEDIDYLAKINRLQEKDLSPSVYHTLKKLDDKFNEQAQKSQDLATNVLEKDCPTVELNPETLPSTFSQFDNLYSSSIIDLPLHGELFWTCRSPLQSNQLWSQNIQDLGICKELVCQDDFNIPDVDLTFQNFEELFGGDQDSIRILLDDQDVSCSSLEKDKSVGKSDIDNPSAMEESSAAASITISQSDLDNKDMNPLSQYRPRSMDPALAIRPFDSTIPFSVLRFNEESSCTSHDDSALSPYSERKAYSAPSKMHNKDTCSPSSNGGFGGGASAGQMPSTGGLYSSLYSALSSENLPSLSASCSNSSGGGGSLYPYSESIQKHQDMVNRQSMCLNRLVETSKEVEALREENGLLRAANKELQKQLHLVIQASLENHYGGGGSSGQMQPTLFDVLHGFRGLHIGEGNKENYADWNNNNHNNQNHNNIMNNNNNNNKELQEVSDESPTSVIENNNVVEVERFSLPKSISVRSNGYLKMSQSAALAPNNNNATRNKGATRPRASATPPEPVQKVYVRGGEKEEEPLEMIVYNQGMFKTELCNKWQETGTCPYGDHCQFAHGIGELRPVIRHPRYKTEVCRMVLAGVVCPYGHRCHFRHALTEQEKAVVSQPKPRSMKLER

SEQ ID NO: 169536 - protein, 429 aa, Glycine max
  Coding DNA Sequence Number=SeqID_77851
  Gene Ontology: Mol. function=nucleotidyltransferase activity; Biological process=biosynthetic process
  Homolog annotation: Hit_ID=A2WTZ9; Match level="QueryCoverage=99%, HitCoverage=99%, E-value=1e-117, Identity=50%"; Hit description =Putative uncharacterized protein
  Pfam annotation: Domain name=CTP_transf_2; Domain location=274-426; Score=13.9; E_value=6e-05; Accession=PF01467.17; Description =Cytidylyltransferase
MTESCIRSVVEAIHSSPFQAVLHLAGGASQVVGSLLSVPGASNTVLEVVVPYSKMSLIQLLGKIPSQFCGQQTAEDMALLAYNRALKLSKPGSPAVGVGFTGSLASSRPKLGEHRVIYLFPICAKKFTFARQSCVINLAPPYETTPKIAIAEYYFDENMGAQGCCLATWISCTQKAAFLLVVVRLCTLISNNKHQGLRTREEEDRVSSHLLIKAIGNACKVPGASVLLLSESDVSDECETQFNEDQQLEQLINGQICFKIYPFENEISAERKIIMPGSFNPLHDGHLKLMDVATRICGDGYPCFEISAVNADKPPLSVSQIKDRIKQFEKVGEAELFPGSAFVIGADTAVRLINPEYYDGDYNKMLKILVGCKETGCTFLVGGRNVDGAFKVLDDIDVPKELKDMFVSIPAEQFRMDISSTEIRNRSGM

SEQ ID NO: 169537 - protein, 46 aa, Glycine max
  Coding DNA Sequence Number=SeqID_77852
MADGPGRREKGWGGCLRNHTIQKVRRAEEEKEEGASDEDTLKHSVT

SEQ ID NO: 169538 - protein, 808 aa, Glycine max
  Coding DNA Sequence Number=SeqID_77853
  Gene Ontology: Mol. function=proteasome activator activity; Cellular component=proteasome complex; Biological process=RNA elongation from RNA polymerase II promoter
  Homolog annotation: Hit_ID=Q0WVT2; Match level="QueryCoverage=99%, HitCoverage=99%, E-value=0.0, Identity=61%"; Hit description =Putative uncharacterized protein At1g49540
  Pfam annotation: Domain name=WD40; Domain location=104-145; Score =18.1; E_value=0.034; Accession=PF00400.23; Description=WD domain, G -beta repeat
  Pfam annotation: Domain name=WD40; Domain location=158-201; Score =1.6; E_value=20; Accession=PF00400.23; Description=WD domain, G-beta repeat
  Pfam annotation: Domain name=WD40; Domain location=208-254; Score =32.6; E_value=1.4e-06; Accession=PF00400.23; Description=WD domain, G-beta repeat
  Pfam annotation: Domain name=WD40; Domain location=293-343; Score =26.9; E_value=7.7e-05; Accession=PF00400.23; Description=WD domain, G-beta repeat
  Pfam annotation: Domain name=WD40; Domain location=399-437; Score =30.3; E_value=7.3e-06; Accession=PF00400.23; Description=WD domain, G-beta repeat
  Pfam annotation: Domain name=WD40; Domain location=451-491; Score =12.3; E_value=0.95; Accession=PF00400.23; Description=WD domain, G -beta repeat
  Pfam annotation: Domain name=WD40; Domain location=46-95; Score=31.8; E_value=2.5e-06; Accession=PF00400.23; Description=WD domain, G-beta repeat
  Pfam annotation: Domain name=WD40; Domain location=581-619; Score =5.4; E_value=6.9; Accession=PF00400.23; Description=WD domain, G -beta repeat
  Pfam annotation: Domain name=WD40; Domain location=653-691; Score =44.2; E_value=4.8e-10; Accession=PF00400.23; Description=WD domain, G-beta repeat
  Pfam annotation: Domain name=WD40; Domain location=697-740; Score =13.6; E_value=0.66; Accession=PF00400.23; Description=WD domain, G -beta repeat
  Pfam annotation: Domain name=WD40; Domain location=761-804; Score =26.2; E_value=0.00012; Accession=PF00400.23; Description=WD domain, G-beta repeat
  Pfam module annotation: Pfam domain module=WD40::WD40::WD40::WD40::WD4 0::WD40::WD40::WD40::WD40::WD40::WD40; Domain location=104-145::158 -201::208-254::293-343::399-437::451-491::46-95::581-619::653 -691::697-740::761-804
MREVEVKRVFIGAGCNRIVNNVSWGASGLLSFGAHNAVAIFCPKSAQILTTLPGHKAVVNCTHWLPSSRFLFKAKQLEQHYLLSGDADGAIILWELSLADGKWRQVLQLPQSHKKGVTCISGIMVSQTEAMFASTSSDGTACVWELAFPMTGSGDCKLSCLDSFSVGSKSMVTLSLAELPGDSGQIVLAMGGLDNKIHLYCGGRSGKFVHACELKGHTDWIRSLDFSLPISINGEVNNIFLVSSSQDKGIRIWKMALRSSMSNGHGIDRKGEISLSSYIEGPVLVAGSSSFQVSLESLLIGHEDWVYSVMWQPPLVAPMEEDAYYQPQSILSASMDKTMMIWQPEKTSGVWMNVVTVGELSHCALGFYGGHWSPNGDSILAHGYGGSFHLWKNVGNDNWLPQKVPSGHFASVTDIAWARSGDYIMSVSHDQTTRIYAPWKVEASLQDGEFWHEIARPQVHGHDINCMAVIHSKGNHRFLCGAEEKVARVFEAPLSFLKTLNNATLQKSCSSDDIMGDVQILGANMSALGLSQKPIYAQAVHEAPKRSGIDGLDTIETIPDAVPTVFTEPPIEDQLAWHTLWPESHKLYGHGNELFSLCCDHKGELVASSCKAQSAAVAEVWLWQLQEFLIGYCNSAYILITQLWFTGTGEISYSLLVRQEGHKRIIWSCSWNPHGHEFATGSRDKTVKIWAIERESVKQLMSLPQFTSSVTALSWVGLHHRKNNGLLAVGMENGQIELWNLSYNRADDGSIAAPGLAASLAVRIDPFICHASTVNRLAWKKNEDDQTSMQLASCGADNCVRVFDVSVE

SEQ ID NO: 169539 - protein, 450 aa, Glycine max
  Coding DNA Sequence Number=SeqID_77854
  Gene Ontology: Mol. function=ATP-dependent helicase activity; Cellular component=intracellular; Biological process=transport
  Homolog annotation: Hit_ID=A7P3F8; Match level="QueryCoverage=98%, HitCoverage=41%, E-value=0.0, Identity=85%"; Hit description =Chromosome chr1 scaffold_5, whole genome shotgun sequence
  Pfam annotation: Domain name=HA2; Domain location=371-446; Score =82.1; E_value=1.8e-21; Accession=PF04408.14; Description=Helicase associated domain (HA2)
  Pfam annotation: Domain name=Helicase_C; Domain location=215-309; Score=53.0; E_value=1e-12; Accession=PF00271.22; Description =Helicase conserved C-terminal domain
  Pfam module annotation: Pfam domain module=HA2::Helicase_C; Domain location=371-446::215-309
MKGRDTHLLFCTTGILLRRLLADRKLKGVTHVIVDEIHERGMNEDFLLIILKELLPHRPELKLILMSATLDAELFSSYFNGAPIMFIPGFTYPVRTHFLENILEMTGYRLTPYNQIDDYGQERMWKMNKHAPRKRKSQIASAVEDAIMAADFKDYSLQTQESLSCWNPDCIGFSLIEYILCNICENERPGAVLVFMTGWDDISSLKEKLLTHTVLGDANRVLLLTCHGSMASSEQRLIFEEPEDGVRKIVLTTNIAETSITINDVVFVLDCGKAKETSYDALNNTPCLLPTWISKVSAKQRRGRAGRVQPGECYHLYPRCVYDAFAEYQLPEILRTPLQSLCLQIKSLRLGSISEFLSRALQSPETLVVQNAIEYLKIIGALDEDENLTILGRCLTMLPMEPKLGKMLILGAIFNCLDPILTVVAGLSVRDPFLTPLDKRDFCCLDTNFN

SEQ ID NO: 169540 - protein, 421 aa, Glycine max
  Coding DNA Sequence Number=SeqID_77855
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=A7P3F6; Match level="QueryCoverage=91%, HitCoverage=92%, E-value=1e-124, Identity=55%"; Hit description =Chromosome chr1 scaffold_5, whole genome shotgun sequence
MSSQNQNRSLEQAGPSGSGGQVGVRVVNWSGSDRLCISPKRDHKPENYDDLQFEFNPNIFASLEHYLPPHMLNLSRDVKLHYIRNILLRYLPENDRIWIQKLREYRLKIILNYPPLHKEIFTMDAESFFVPSFLRAIKENTEASFRSIMAEPCKGVYTFEMLQPQFCKKLMSEVDHFERWVHGTKLRIMRPNAMNKNKHGVILDDFAFEAMLDRFMCDFIQPISRVFYPELGGSSLDSHHGFVVEYGINKDVELGDAGSSITIKVSGSQNRSRPGSNSNINQSGQNKGNSSVAFSGLHEDEAEVTLNVCLGKEFSGGDLFFQGVRCDAHVTTNTQPEEAFNYSHVPGHAILHPGRNRHGTRPTTSGNRMNLILWCRSSAFIELKRYQRDFYSWCAECRRKKAERVRLSVVAAKQELLKSEI

SEQ ID NO: 169541 - protein, 373 aa, Glycine max
  Coding DNA Sequence Number=SeqID_77856
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=A7P3F6; Match level="QueryCoverage=70%, HitCoverage=71%, E-value=1e-111, Identity=67%"; Hit description =Chromosome chr1 scaffold_5, whole genome shotgun sequence
  Pfam annotation: Domain name=2OG-FeII_Oxy; Domain location=169-268; Score=16.9; E_value=0.0035; Accession=PF03171.11; Description=2OG -Fe(II) oxygenase superfamily
MPILSFICMFFVCWSLEVLGCAYFDNDTSAMYIQKHKEYRHRIMLNYPPLCKQIYSMDAEKFFTPSFLRAVEENSEASFRSIMAEPRKGLYTFEMLQPQFCEMLMSEVDNFERWVHDTKFRIMRPNIMNQYGAVLDDFGMESMLERLMNDFISPISRVFYTEIGGTSLDSHHGFVVEYGINRDVELGFHVDDAEVTLNICLGNEFSGGELFFRGVRCDEHVNSDIQPGEIFDYPHVPGHAILHPGRHRHGARPTTSGNRMNLIIWCRSSAFRELKKYRKDFSSWCGECRRKKKEKERLLVMATQQNACAKAQETTQQSPISGVALDIADLLMDEDQWMYDSIISEEVDMNDQNEDKAGVNLVHVDCSNAFNTS

SEQ ID NO: 169542 - protein, 51 aa, Glycine max
  Coding DNA Sequence Number=SeqID_77857
MEGAYPWLSVTYGRQAQFLMAITEVHEAKRQSWQLIEIRCGNVSAKRVLIS

SEQ ID NO: 169543 - protein, 488 aa, Glycine max
  Coding DNA Sequence Number=SeqID_77858
  Gene Ontology: Mol. function=branched-chain aliphatic amino acid transmembrane transporter activity; Cellular component=integral to membrane; Biological process=branched-chain aliphatic amino acid transport
  Homolog annotation: Hit_ID=A8GAK9; Match level="QueryCoverage=89%, HitCoverage=99%, E-value=0.0, Identity=82%"; Hit description =Branched-chain amino acid transport system II carrier protein precursor
  Pfam annotation: Domain name=Branch_AA_trans; Domain location=55-479; Score=740.4; E_value=1.3e-219; Accession=PF05525.4; Description =Branched-chain amino acid transport protein
  Subcellular localization annotation: CTP_CleavageSite=81; ConfidenceScore=5.26e-01
EKQFKSPALYRFGPHNALVKPVKPLFSRIQGTTQTQLPPQHQLQAVQKFMTHRLTSRDILALGFMTFALFVGAGNIIFPPMVGIQSGEHVWIAAFGFLITAVGLPVMTVIALARVGGGIDALSSPIGKAAGLLLATVCYLAVGPLFATPRTATVSFEVGIAPLTGDGPLPLFIYSLVYFALVIGISLYPGKLLDTVGHFLAPLKIVALTILGVAALLWPAGGISPATADYQRAAFSSGFVNGYLTMDTLGALVFGIVIVNAARSRGVEDSKLLTRYTMLAGVIAGVGLTLVYLSLFKLGSGSGAIVDQNANGAAILHAYVQQTFGGMGSVFLAALIFVACMVTAVGLTCACAEFFAQYLPLSYKALVFILGLFAMLVSNLGLSHLIQISIPVLTAIYPPCIVLVVLSFTLSWWNRSTRIIAPTMLISLLFGIVDAIKTTSFKDALPLFSQHLPLADQGLSWLPPSLAMLVIAAVVDRVKGREQVAVHQ

SEQ ID NO: 169544 - protein, 165 aa, Glycine max
  Coding DNA Sequence Number=SeqID_77859
MDRAHKTPSGPGEVQQGPAVSSFGYGPLSVLPGIAPIRHLVGLEMSNRVLGFLALITSLCQFYEVPFAPNKVIRPPTNQAFIRKYCAPRQVGRDTTTARGWLAAGNRHTAATSRAPQLIYKSWSVAYDPWSTTRRPSPKPKVSKSTRSVTDKSSCVQLKTLKKRY

SEQ ID NO: 169545 - protein, 315 aa, Glycine max
  Coding DNA Sequence Number=SeqID_77860
  Gene Ontology: Mol. function=transporter activity; Cellular component= membrane; Biological process=transport
  Homolog annotation: Hit_ID=A6T990; Match level="QueryCoverage=98%, HitCoverage=98%, E-value=1e-147, Identity=86%"; Hit description =Putative ABC transporter, nucleotide binding/ATPase protein
  Pfam annotation: Domain name=Peripla_BP_1; Domain location=30-305; Score=-22.4; E_value=0.00025; Accession=PF00532.12; Description =Periplasmic binding proteins and sugar
MSSFSGKLRSLFIASGLLAAGSLCVQAHAAPTYALVQINQQALFFNLMNQGAQEAAKASGKQLVIYNANDNPVAQNDAIENYIQQGVKGILVDAIDVNGIMPAIKEAAAANIPVIAIDAVLPAGPQAAQVGVDNLEGGKILGKYFVDYVAKEMGGKARLGIVGALNSAIQNQRQKGFEETIKSNSQITVADVVDGQNIQDNAMTAAENLITGNPDLTAIYATGEPALLGAIAAVENQGRQKDIKVFGWDLTAKAISGIDGGYVTAVLQQDPKKMGEEALKALNSLTAGKTVSKTILVPATVVTKANVDSYRSLFK

SEQ ID NO: 169546 - protein, 276 aa, Glycine max
  Coding DNA Sequence Number=SeqID_77861
  Gene Ontology: Mol. function=transporter activity; Cellular component= membrane; Biological process=transport
  Homolog annotation: Hit_ID=A6T993; Match level="QueryCoverage=36%, HitCoverage=30%, E-value=3e-46, Identity=92%"; Hit description =Putative ribose/xylose/arabinose/galactoside ABC-type transport systems, permease components
GYSIPVPADSLFTFMGRAWVLGIPMPALIGIVVLLAGHIVLNHLRFGRYVTAIGANAEGARRSGINTKAVTMKVYILSGMAAALAGMIITARLGSGSSNQGEGDCGGGAGQYQPVWRLWNRDRYAARRAVDCHYPERPDFIAYLTVLYPDRHWHHHFARHLAQHPHSQPEPRARQRIAHERINFSPCGSVAARRQQRSGDDGARSAAGGGDGRHADARAHFTGCLRDRHIAEMPVRIENLGELSLNPLMSRDNCQLFDVDTAIEELMKYRALGGET

SEQ ID NO: 169547 - protein, 65 aa, Glycine max
  Coding DNA Sequence Number=SeqID_77862
MKAKNESLILDDGDLSPPGWLPRRKTTRNPHYKRNLKESWASSSKGNNTRKSSLPWIQTENANET

SEQ ID NO: 169548 - protein, 215 aa, Glycine max
  Coding DNA Sequence Number=SeqID_77863
  Gene Ontology: Mol. function=protein dimerization activity; Biological process=DNA integration
  Homolog annotation: Hit_ID=A2YTW4; Match level="QueryCoverage=74%, HitCoverage=23%, E-value=7e-25, Identity=39%"; Hit description =Putative uncharacterized protein
MVLQAIFNGRLLLNDGFFFDNSLHWQFYKYSCCRRFSSSSMSHITQMFASLGYQDDHAPPWSFVTIKGKIGDGGITNAYLVDLRRVCEEAENRLKSKNVPLPIDKRTPTPPTLPPKRRKSSNIESAFNIEDRNHLRAEIARMFYSAGLSFHLARNPHFVSSYSFAANCNLSGFLPPSYNALRTSLLQQERSHIERLLQPIKSLWSLKGVTLVADG

SEQ ID NO: 169549 - protein, 76 aa, Glycine max
  Coding DNA Sequence Number=SeqID_77864
MSKRLQEDWARVDKEGLRVLMNLRLSSSFSRKLLKEVSLVFRWLLKEVFSKKLLKEVFLRKLLKEVFLRKLLKEAT

SEQ ID NO: 169550 - protein, 149 aa, Glycine max
  Coding DNA Sequence Number=SeqID_77865
MGSKIYPKVHENPRSFFSSSSPSLLESSIQYPWGEELFESRGSNSFYRGARRARARPVELPSTSVAPTPASTSAAPSVPAQTDSQCFEAMLQSIHQGQIILLQSLQVVAPPGSIPSVEQFREMVAWPRTQTSLHRKMNVHCPGTTTCGG

SEQ ID NO: 169551 - protein, 126 aa, Glycine max
  Coding DNA Sequence Number=SeqID_77866
MFVKFLIFFCKASICSLKSATTIVSLETEDELEIRIAARLPWWHCRMKLPENAQQLPLADMDKSSEQAAGTEPQSRRRRSNSTWEEEEEEEEEEATSSFVNPNFFGEEEATLHSGTNMQSGYNLRD

SEQ ID NO: 169552 - protein, 148 aa, Glycine max
  Coding DNA Sequence Number=SeqID_77867
  Homolog annotation: Hit_ID=A7B5X1; Match level="QueryCoverage=36%, HitCoverage=71%, E-value=2e-14, Identity=70%"; Hit description =Putative uncharacterized protein
MHHLCPRSRRHPSLSRGFAACQALVRFFALHRIKPHAPPLVRAPVNSFEFHSCEHALRPIIPDNACILCLTAAAGTELADAYSPDTVIASSPGKKFMTRSLLPSRGIAPSGFRPLRKFPTAASRRSLGRVSVPVWLIILSDQLLIIAL

SEQ ID NO: 169553 - protein, 216 aa, Glycine max
  Coding DNA Sequence Number=SeqID_77868
  Homolog annotation: Hit_ID=UPI0000ECBAF8; Match level="QueryCoverage =18%, HitCoverage=48%, E-value=8e-16, Identity=97%"; Hit description =UPI0000ECBAF8 related cluster
ESARGSFQGDTPGIFIVLSGFATSDLSVDFCDARQGAGAYGYTPATRPFYGSWPFAGLLLTCSFLRYPLILWITVLPPLSELIPLAAAERPSAASQRARKRKSAQYANRLSPRVGRFINAAGTTGFPTGKRTANFAKWEPGHGKFRFRHPWDLYLKVGALSRQCMRAWHWPSFYNVVTGKTLALPNLIALQHIPLSPAGVIAKRPVPIALPNSCAV

SEQ ID NO: 169554 - protein, 54 aa, Glycine max
  Coding DNA Sequence Number=SeqID_77869
MESFTSSRSMVVEWRRRKGDWRCHFKEKMSHKQAHGHRNSWPTNPISNPRFWEV

SEQ ID NO: 169555 - protein, 147 aa, Glycine max
  Coding DNA Sequence Number=SeqID_77870
  Subcellular localization annotation: CTP_CleavageSite=56; ConfidenceScore=5.28e-01
MHGATTTGASVKELPRGEGRASSSSGFAFYLRGVGRATSTGALCMEARNASQTGVLAMQVTGCTVLQQTAAAAGSREMPLEPTTCVCRFNAPSRGALSSFYMQFSCFLLYAYPFAQPSSSLLPLVGSLFPCFICIFGFCCNFLIRFS

SEQ ID NO: 169556 - protein, 88 aa, Glycine max
  Coding DNA Sequence Number=SeqID_77871
MYPPMVLIQSSQAVSPLKFCLWEREESKEFSDCVVLNSLTREKGDTKEFRQLVLCSLGKGRRETQKDLSRLVLGEFFLAKGEGNEKDE

SEQ ID NO: 169557 - protein, 79 aa, Glycine max
  Coding DNA Sequence Number=SeqID_77872
VDKRRVSLERKERSLAHLQGRGLQVEGVPICHISKSFISVGWMRKDQVTVIEEETPQNRPNWVQPSPPSFELGNWKIVE

SEQ ID NO: 169558 - protein, 127 aa, Glycine max
  Coding DNA Sequence Number=SeqID_77873
  Gene Ontology: Mol. function=structural constituent of ribosome; Cellular component=ribonucleoprotein complex; Biological process =translation
  Homolog annotation: Hit_ID=Q2PMT2; Match level="QueryCoverage=98%, HitCoverage=57%, E-value=4e-43, Identity=70%"; Hit description =Chloroplast 30S ribosomal protein S2
  Pfam annotation: Domain name=Ribosomal_S2; Domain location=13-119; Score=43.1; E_value=1e-09; Accession=PF00318.11; Description =Ribosomal protein S2
MTKRYWNIILEEMMEAGVHFGHGTRKWNPKMSPYISAKRKGIHITNLIRTARFLSEACDLVFDAASEGKQFLIVGTKKKAADSVARAAIRARVSIIGDTTETRLQKFISENASFQKTGRLNSFPKAK

SEQ ID NO: 169559 - protein, 163 aa, Glycine max
  Coding DNA Sequence Number=SeqID_77874
MEAHALVARLIEKDLQFPFMAVLISESGVRTREERGREVHFSRTFSEWRRGRRGEERYICQAKIVVDMDGFKHLDLQQCEKFKEFGAPEFHHDCAKELEIHSEFKVCKVALFITRVKAMADSNSGTPNSFNFSHCKNNNQRPRISIHHIEIQPEDLSITLLHA

SEQ ID NO: 169560 - protein, 64 aa, Glycine max
  Coding DNA Sequence Number=SeqID_77875
MQCTDRHHIAPARQRQQQLAPVLITVAHQSIVQFTAERSRQRHRLTGGRRIQPPADHGLQQSRV

SEQ ID NO: 169561 - protein, 80 aa, Glycine max
  Coding DNA Sequence Number=SeqID_77876
KAGVAAHDVKESDRAAQCTRQDKMSNEELKLQDPRCRIQCPGHPARKYWTHKSVISLTDCAGSSMSDTMSRTSCPKILDT

SEQ ID NO: 169562 - protein, 52 aa, Glycine max
  Coding DNA Sequence Number=SeqID_77877
MHIHGKDHKGKGERNNEDSQVDEVKTNDDLPREWRTSRYHPLDNIIGDISKE

SEQ ID NO: 169563 - protein, 102 aa, Glycine max
  Coding DNA Sequence Number=SeqID_77878
MEKSEKKNHSEKKLKKAYITWDENDLESSDDSENEEINLCLMAKSYESDEEVSLRKKWYIDSGCSKHMTGDASNFTHISPKKSGHVLSTACLALVNYVTKAI

SEQ ID NO: 169564 - protein, 76 aa, Glycine max
  Coding DNA Sequence Number=SeqID_77879
MKKIQGLQAPHEATSSTHGEGCCPCSYISLGAIKNSDLRSSLSLKACVLSCFYAFERFILVANKESFKALDLEMMF

SEQ ID NO: 169565 - protein, 979 aa, Glycine max
  Coding DNA Sequence Number=SeqID_77880
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=A4TLR2; Match level="QueryCoverage=48%, HitCoverage=99%, E-value=0.0, Identity=88%"; Hit description=PTS system, glucose-specific IIBC component
  Pfam annotation: Domain name=Nramp; Domain location=760-979; Score =112.6; E_value=1.2e-30; Accession=PF01566.9; Description=Natural resistance-associated macrophage protein
  Pfam annotation: Domain name=PTS_EIIB; Domain location=402-436; Score= 69.4; E_value=1.2e-17; Accession=PF00367.11; Description =phosphotransferase system, EIIB
  Pfam annotation: Domain name=PTS_EIIC; Domain location=13-320; Score =365.0; E_value=1.2e-106; Accession=PF02378.9; Description =Phosphotransferase system, EIIC
  Pfam module annotation: Pfam domain module=Nramp::PTS_EIIB::PTS_EIIC; Domain location=760-979::402-436::13-320
  Subcellular localization annotation: CTP_CleavageSite=48; ConfidenceScore=5.17e-01
MFKNAFANLQKVGKSLMLPVSVLPIAGILLGVGSANFSWLPAVVSHVMAEAGGSVFANMPLIFAIGVALGFTNNDGVSALAAVVAYGIMVKTMAVVAPLVLHLPAEEIAAKHLADTGVLGGIISGAIAAYMFNRFFRIQLPEYLGFFAGKRFVPIISGLAAIVLGVVLSFIWPPIGTAIQTFSQWAAYQNPVVAFGIYGVVERALVPFGLHHIWNVPFQMQIGEFTNAAGQVFHGDIPRYMAGDPTAGKLSGGFLFKMYGLPAAAIAIWHSAKPENRAKVGGIMISAALTSFLTGITEPIEFSFMFVAPILYVIHAILAGLAFPICILLGMRDGTSFSHGLIDFIVLSGNSSKIWLFPIVGIVYGLVYYTIFRVLIAKLDLKTPGREDTAAEQTAQGGSEMSAALVQAFGGKENITNLDACITRLRVSVADVSKVDQAGLKKLGAAGVVVAGSGVQAIFGTKSDNLKTDMDEYIRAKALFEFGERREELDLFAAVGFTHEILQRIALRQPGGDIAQQRNAQAVVDEFLQYGAGHAASELEKGGVEAVDGEGNHPGIVFKGGRDKQADVMLEHRQRFVRDMVLNPFAVQLGGFARHPDAHQQIDHDAVTAAHLLRQQLAFLAARDIGGSGFAGALQQIGDQLNVIFDQRIGLRFAGAAKTQGVLGLVRHVGLGVAVGVIWRAGNHSVGRPVSIKMASPGNAGRVALRYFMRDAATTPSLTERTNIAIGAALAGRKRGAFTPLLFAGPAVIASIAYMDPGNFATNIQAGAKYGYSLLWVVVMANLIAMLFQALSAKLGIVTNRNLAEMCRDQFSRPVVIGMWLLSEVAAMATDLAEFLGGAIALALLFHMPLLAGMGVTAVITYALLMVEKKGFRPVELMIGGLVGIIALCYLVEMFIVPVDWQAAGIGMVTPQLPDAQALTIAVGIIGATVMPHAIFLHSGLTQHRSPASDNGERRKLLRFSNIEVVIALALAGLVNIAM

SEQ ID NO: 169566 - protein, 108 aa, Glycine max
  Coding DNA Sequence Number=SeqID_77881
MKVILWMNALLEPKLLNPRKTMNCWQPNPITSLESLSDSFSVFIDVKKRLSHEVPKHNFSVLSAIEEPGRASISRSHAKREINALSATVVFSQTQRMTGAKLKPTYSR

SEQ ID NO: 169567 - protein, 209 aa, Glycine max
  Coding DNA Sequence Number=SeqID_77882
  Gene Ontology: Mol. function=motor activity; Cellular component=cell projection
  Homolog annotation: Hit_ID=UPI00016621D1; Match level="QueryCoverage =95%, HitCoverage=40%, E-value=5e-21, Identity=34%"; Hit description =UPI00016621D1 related cluster
MRLDVLTFRGLYALTFKGLHVLAFRGLHVLAFRGLHVLAFRGLHALNFRGLHALTFKGLHILTFRGLHALAFRGLHALAFRGLHVLAFRGLHVLAFRGQNVITFRGLHILTFRGLHVLAFRGHHVLTFRGLHVLAFRGLHVLAFRGLHVLDYRGLHALAFRRFHALDFKGLHVLAFRGLHVLAYRGLHTLSFRGLHALAFRGICRNKAS

SEQ ID NO: 169568 - protein, 279 aa, Glycine max
  Coding DNA Sequence Number=SeqID_77883
  Homolog annotation: Hit_ID=Q6WAY6; Match level="QueryCoverage=58%, HitCoverage=32%, E-value=5e-15, Identity=30%"; Hit description =Putative uncharacterized protein
MGSSQKPSLKKRFYQVKIKSLEVTSLRKLGQLMGQLQRQAFHKAYGKIWDLARVEVSMEPIASLSQYYDQPLRCFTFEDFQLVPTVKEFEEILGCPLEGRKPYLFSGLYPSTTRVAKYQGSVWRKGQRPWQIKANGLSFIDILALLIFGVVLFPNMEGLVDLAAIDAFLTFHHGKESLVVAILAIYDTPVLAIRQLGYPMRGAPLDESIAPFIARGFSDHNARWLKVRTQGLDWLPNLKTVRDNEVKASEESDEVQALKAKLERARVVKEKFKSIAIKV

SEQ ID NO: 169569 - protein, 260 aa, Glycine max
  Coding DNA Sequence Number=SeqID_77884
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLLCEVLQWLLFLSAVPPVQLLTGWCVTAKAPPDISAGKCSGRVPFAIQAAQLLGRAIGAGLFAITPAGERGMCCKAIKLGIRCLHILAKMSLDAGGLLGALESGLGILPCIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169570 - protein, 66 aa, Glycine max
  Coding DNA Sequence Number=SeqID_77885
MEKSNKKTFKDKKGKKTHITWEDNDMDSSGDSENEVVNLSLMAKNYESEEEMHSMTCIKNLPNLPN

SEQ ID NO: 169571 - protein, 96 aa, Glycine max
  Coding DNA Sequence Number=SeqID_77886
  Subcellular localization annotation: CTP_CleavageSite=39; ConfidenceScore=5.15e-01
MVKVGTSHVPINVSFRQKLAQGFPVLQWVLFLSAVPPVQAAQLLGRAIGAGLFAITPAGERGMCCKAIKLGNARVFPEFDLDIPQCADYSWNVRSR

SEQ ID NO: 169572 - protein, 323 aa, Glycine max
  Coding DNA Sequence Number=SeqID_77887
  Homolog annotation: Hit_ID=A7QKD3; Match level="QueryCoverage=77%, HitCoverage=41%, E-value=1e-69, Identity=52%"; Hit description =Chromosome chr2 scaffold_112, whole genome shotgun sequence
MGPEESLDLNNVIENSLDALVQNESEDIPYPEKHSVSLFECRADVSGGDGKVHDQSTPTTIDHEVVDESHGPDATVLSFSSPGHTNSDSSSVRYHQTDVSGALTSCVQGSEPIYEGEECVLDTRTGNFEDREPVYEGEVVLAEQSDKSTLAAPDLRAKDELTPEQGELIKSFLRNNASQLTFYGTMFKFEGELYLLATEQGYINQPDLVWEKLNEVNGDTLFLTSNFKEFKVENHESSTWDENNALTSTVDYLASIDSATHASLDINSDLQLAIALQQQEFEQQPPRQDNSQQQSSISGSSRLVTGPKPMDGIIFNFVGNLYY

SEQ ID NO: 169573 - protein, 22 aa, Glycine max
  Coding DNA Sequence Number=SeqID_77888
MQNLQIVPIYPVFSTCMHRRQS

SEQ ID NO: 169574 - protein, 403 aa, Glycine max
  Coding DNA Sequence Number=SeqID_77889
  Gene Ontology: Mol. function=oxidoreductase activity; Cellular component=proton-transporting two-sector ATPase complex; Biological process=response to gibberellin stimulus
  Homolog annotation: Hit_ID=Q2HSM4; Match level="QueryCoverage=82%, HitCoverage=98%, E-value=1e-154, Identity=77%"; Hit description=2OG -Fe(II) oxygenase
  Pfam annotation: Domain name=2OG-FeII_Oxy; Domain location=193-292; Score=151.1; E_value=3e-42; Accession=PF03171.11; Description=2OG -Fe(II) oxygenase superfamily
MESISDPPFHEAYKILFDKTRNGNNFEEHKELLAVAEECDLPVIDLSRLEESDEVVREECKSQIARASQEWGFFQVVNHGISTEIFSSLRCEQEKVFKQPFEKKTKEDKFLNFSAGSYRWGTPSATCIKQLSWSEAFHIPLTDILGSTGSNSLSWTIEQFATTVSSLAQTLADILAEKMGHKSTFFKENCLPNTCYLRLNRYPPCPIGFGIHGLMPHTDSDFLTILYQDQVGGLQLVKDSKWIAVKPNPDALIINIGDLFQAWSNGVYKSVEHRVMTNPKLERFSMAYFFCPSNDTVIESCREPSFYRKFSFREYRQQVRDDVQKLGSKIGLPRRQKREIDLEVEVERKQVCLSVYVWVGNKINLAETVGLKCWITVQNISNLSLAYRHNAGLLGRHIAFEYG

SEQ ID NO: 169575 - protein, 190 aa, Glycine max
  Coding DNA Sequence Number=SeqID_77890
  Homolog annotation: Hit_ID=A7P0X1; Match level="QueryCoverage=74%, HitCoverage=69%, E-value=1e-07, Identity=30%"; Hit description =Chromosome chr19 scaffold_4, whole genome shotgun sequence
  Pfam annotation: Domain name=Hin1; Domain location=26-157; Score =43.5; E_value=7.3e-10; Accession=PF07320.4; Description=Harpin -induced protein 1 (Hin1)
MCEGKSLYIWPLKVIGLLGLIVLCLWLALRPKNPSYSIMFISIQHPSNSSENCTIFYSLQIENPNKDSSIYYDKTILSFLYGEPEDEVGETTIVPFHQGTGNTRDVSDTVNAKPRPFKPLFSAISNATTELKVALITRYRYKTWGIKSKFHGLQLKGILPIDSDGKLSRKKKKYPLSRNSNKLGRFKIRH

SEQ ID NO: 169576 - protein, 2395 aa, Glycine max
  Coding DNA Sequence Number=SeqID_77891
  Gene Ontology: Mol. function=transferase activity, transferring phosphorus-containing groups; Cellular component=Tor2-Mei2-Ste11 complex; Biological process=cell cycle arrest in response to nitrogen starvation
  Homolog annotation: Hit_ID=A7QH41; Match level="QueryCoverage=98%, HitCoverage=85%, E-value=0.0, Identity=70%"; Hit description =Chromosome chr3 scaffold_95, whole genome shotgun sequence
  Pfam annotation: Domain name=FAT; Domain location=1298-1712; Score =327.7; E_value=2.1e-95; Accession=PF02259.14; Description=FAT domain
  Pfam annotation: Domain name=HEAT; Domain location=101-137; Score =1.5; E_value=16; Accession=PF02985.13; Description=HEAT repeat
  Pfam annotation: Domain name=HEAT; Domain location=173-209; Score =7.7; E_value=1.9; Accession=PF02985.13; Description=HEAT repeat
  Pfam annotation: Domain name=HEAT; Domain location=1735-1770; Score =12.2; E_value=0.4; Accession=PF02985.13; Description=HEAT repeat
  Pfam annotation: Domain name=HEAT; Domain location=472-504; Score =8.8; E_value=1.3; Accession=PF02985.13; Description=HEAT repeat
  Pfam annotation: Domain name=HEAT; Domain location=594-631; Score =16.2; E_value=0.1; Accession=PF02985.13; Description=HEAT repeat
  Pfam annotation: Domain name=HEAT; Domain location=639-675; Score =6.0; E_value=3.4; Accession=PF02985.13; Description=HEAT repeat
  Pfam annotation: Domain name=HEAT; Domain location=940-977; Score =23.8; E_value=0.00063; Accession=PF02985.13; Description=HEAT repeat
  Pfam annotation: Domain name=PI3_PI4_kinase; Domain location=1987 -2261; Score=295.2; E_value=1.3e-85; Accession=PF00454.18; Description=Phosphatidylinositol 3- and 4-kinase
  Pfam annotation: Domain name=Rapamycin_bind; Domain location=1817 -1920; Score=207.3; E_value=3.6e-59; Accession=PF08771.2; Description= Rapamycin binding domain
  Pfam annotation: Domain name=TPR_2; Domain location=1343-1376; Score =15.2; E_value=0.25; Accession=PF07719.8; Description=Tetratricopeptid e repeat
  Pfam annotation: Domain name=TPR_2; Domain location=1505-1538; Score =11.5; E_value=1.1; Accession=PF07719.8; Description=Tetratricopeptide repeat
  Pfam module annotation: Pfam domain module=FAT::HEAT::HEAT::HEAT::HEAT ::HEAT::HEAT::HEAT::PI3_PI4_kinase::Rapamycin_bind::TPR_2::TPR_2; Domain location=1298-1712::101-137::173-209::1735-1770::472-504::594- 631::639-675::...
  Pfam module annotation: Domain location=940-977::1987-2261::1817 -1920::1343-1376::1505-1538
MDHILSVLKVPQDRDSGFIALGEMAGALDGELIHYLPTITTHLREAIAPRRIKPSLEALACVGSIAKAMGSAMEPHVRGLLDIMFSTGLSTVLVEALEQISTSIPSLLPTIQDRLLDSISMVLSKSHYHLGRPAQSVGRGTIINVPQQVSELNGSALIQLALQTLARFNFKGHELLEFARESVVVYLDDEDGATRKDAALCCCRLIASSFSGMACSHFGSSRLTRSGGKRRRLVEEGPKECISTSTTGAAVERSDIMEGGDNHLLEKYHRLYTISVQQNQLIQHMGVYKNTGWEWDFKWQRPLFDSEIDQAVSFIQEVEGFRIRPDIGDQWVWEADPSGRYSVKSAYSVLRQDVSEEAPDEEFKELWKLKVPSKVANNGGERKSSVFSLQQNTSALVGIAVLGESALTWSIWKHRNSIVFSNNTLNANKMMDEALVEKLLISAVADADVTVRHSIFTSLHGDRGFDEYLAQADNLSAVFAALNDEDFDVREYAISVAGRLSEKNPAYVLPALRRHLIQLLTYLEQSADSKCKEESAKLIGCLIRNCERLIIPYIAPIHKALVARLIDVNANTGTISGVLVTVGDLARVGGFAMRQYIPELMPLIVEALLDGAAVSKREVAVATLGQVVQSTGYVITPYNEYPQLLGLLLKLLNGELVWSTRREVLKVLGIMGALDPHLHKRNQKTLPGPHGDVTRPASDSSQQIQSMDEFPLDLWPSFASSDDYYSTVAINSLMRILRDPSLASYHLKVVGSLMFIFKVLPDLFHTVRTCEDSLKDFITWKLGTLVSIVRQHIRKYLQDLLSLISEFWSAFTLPAPARPGPGYPVSVASSLVLHLVEQLCLALNDEFRTYLPVILPGCIQVLSDAERCNDYTYVLDILHTLEVFGGPKGVMHLIIAKKVGMGSEGAKTGIGPLGEFRLLKVPKESIYCKKCYISGSGTLDEHMHLLLPALIRLFKVDASVDIRRAAIKTLTSLIPRVQHKEFEEIEGRLQRREPLILGITASQRLNRRLPVEVISDPLDDVEIDPYEDGSDAHKLRDHQVNDGRLRTAGEASQRSTKEDWAEWMRHFSIQLLKESPSPALRTCARLAQLQPFVGRELFAAGFVSCWAQLNETSQKQLVQNLEMAFSSPNIPPEILATLLNLAEFMEHDEKPLPIDIRLLGALAEKCRAFAKALHYKEMEFEGARSKKMDANPVAVVEVLIHINSQLHQHEAALGILTYAQQHLDFQLKESWYEKLQRWDDALKAYTAKASQATSPHLVLDATLGKMRCLAALAQWDELNILCKEFWTPAEPAARLEMAPMAASAAWNMGEWDQMAEYVSRLDDGDETKLRGLGNTAASSDGSSSGTFFRAVLLVRRGKYDEAREYVERARKCLATELAALRLFAMRRYEGGMLYAALPLHMQRGCFRIQTHDQQVTKAQLYRCTRARPQVLESYERAYSNMVRVQQLSELEEVIDYRTLPIGNRVADERRALIRNMWTQRIEGAKSNVEALLAVRALVLPPVEDVESWLKFASLCRKSGRISQAKSTLVKLLQYDPEKSPENVRYHGPPQVMLAYLKYQWSLGEDSKRREAFIRLQNLAMELSSAPNIQPVTPSSFTNGLNLSVPLLARVYLNLGSWQWSLSPGLVDESIKDILNAFTKATQYANKWAKAWHKWALFNTAVMSHYTLRGFPDVAAQFVAAAVTGYFHSIACAANSKGVDDSLQDILRLLTLWFNHGATAEVQMALKKGFSLVNINTWLVVLPQIIARIHSNNHAVRELIQSLLVRIGQNHPQALMYPLLVACKSISNLRKAAAQEVVDKVRQHSGVLVDQAQLVSKELIRVAILWHEMWHEALEEASRLYFGEHNIEGMLNVLEPLHEMLEEGAMKNNVTIKERIFIEAYRQELLEAYECCMNYKRTGKDAELTQAWDIYYHVFRKIDKQLQSLTTLDLESVSPELLECRNLELAVPGSYRADAPVVTIASFARQLVVITSKQRPRKLTIHGSDGDDYAFLLKGHEDLRQDERVMQLFGLVNTLLENSPKTAEKDLSIQRYAVIPLSPNSGLIEWVPNCDTLHHLIREYRDARKITLNQEHKCMLSFAPDYDHLPLIAKVEVFEHALHNTEGNDLAREDKLYKEFGSYEHVPPSSFAKPLTLQSAGKGGTCAFVYNKSLVPLGRALCKLVGYLLGLGDRHPSNLMLHRFSGKILHIDFGDCFEASMNREKFPEKVPFRLTRMLVKAMEVSGIEGNFRSTCENVMQVLRTNKDSVMAMMEAFVHDPLINWRLFNFNEVPQMSMLTSNHVPPVVNSEESAPNRELPHPQRGARERELLQAVNQLGDANEVLNERAVVVMARMSNKLTGRDFSTCSSVSNNSLQHAVDHSSLISGDTREVDHALSVKLQVVHYPHDSSPKGLLCEGTC

SEQ ID NO: 169577 - protein, 358 aa, Glycine max
  Coding DNA Sequence Number=SeqID_77892
  Gene Ontology: Mol. function=metal ion transmembrane transporter activity; Cellular component=membrane; Biological process=metal ion transport
  Homolog annotation: Hit_ID=A7PKP4; Match level="QueryCoverage=96%, HitCoverage=96%, E-value=7e-95, Identity=51%"; Hit description =Chromosome chr7 scaffold_20, whole genome shotgun sequence
  Pfam annotation: Domain name=CorA; Domain location=17-357; Score =419.9; E_value=3.6e-123; Accession=PF01544.9; Description=CorA-like Mg2+ transporter protein
MRGGEERSTTGIRKKGSGVRQWLVLDGKGETEVVEAGKHAIMRRTGLPARDLRILDPLLSYPSTLLGRERAIVINLEHIKAIITAQELLLLNSRDPSVTPFLHELQARIIRHHNQADADPNPNPNDAIKILPFEFVSLEACLEAACSVLENEAKTLEQEAHPALDKLTSKISTLNLERVRQIKSRLVAITGRVQKVRDELEHLLDDDEDMAEMTAPELSFDNVLGRDSASFSAVTKQLDVEELEMLLEAYFVQIDGTLNKLSTLREYVDDTEDYINIMLDDKQNHLLQMGVMLTTATLVVSAFVVVAGIFGMNIHIELFDDQKAGMTQFLWTVGGSTAGTIFLYVVAIAWCKHKRLLE

SEQ ID NO: 169578 - protein, 187 aa, Glycine max
  Coding DNA Sequence Number=SeqID_77893
  Gene Ontology: Mol. function=DNA binding; Cellular component=nucleus; Biological process=nucleosome assembly
  Homolog annotation: Hit_ID=A9PEF0; Match level="QueryCoverage=76%, HitCoverage=85%, E-value=4e-26, Identity=50%"; Hit description =Putative uncharacterized protein
  Pfam annotation: Domain name=SWIB; Domain location=66-164; Score =101.2; E_value=3.3e-27; Accession=PF02201.9; Description=SWIBMDM2 domain
  Subcellular localization annotation: CTP_CleavageSite=54; ConfidenceScore=5.84e-01
MALSFGFGLLSSSSSSSSLCVLPPSETHTFMMRPSASSGLRMMRTSRITCCTLSQSSKPARKIRGIMKPRKVSPEMEDLVGAPEMARTQVLKRIWAYIKDNNLQAYVSMLLHWLTNETLSFLYKCSDPTDKRTINCDEKLKKVFAGKDQVEMLEIARLISPHFLKSERITGGVESRAEKGGSVNCKF

SEQ ID NO: 169579 - protein, 191 aa, Glycine max
  Coding DNA Sequence Number=SeqID_77894
  Gene Ontology: Biological process=transposition, DNA-mediated
  Homolog annotation: Hit_ID=Q1J7G7; Match level="QueryCoverage=19%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDGSSLATYELLFPLVRVNFELGVIMVIAVSFGKPVVPAALMNRPTRGERRFAYWALAECILAYYVGTDEGVSEVLHVAGEKRLH

SEQ ID NO: 169580 - protein, 360 aa, Glycine max
  Coding DNA Sequence Number=SeqID_77895
  Homolog annotation: Hit_ID=Q2HW90; Match level="QueryCoverage=44%, HitCoverage=32%, E-value=4e-16, Identity=34%"; Hit description =Putative uncharacterized protein
EVSIEAIASLTQYYDQPLRCFTFADFQLVPTIEEFEEILGCPLGGRKPYLSSGYLPSLSRIATVVKDSARGLDRIKQTRNGTAGLPQKYLEDKARGMANQGDWVPFMDVLALLIFGVVLFPNVDGLVDLAAIDAFLAYHHSKESPVVAVLADLFDTFDRRGCINYNPTLAIRQLGYPMRGAPSEESMSPFLVRDLGAQSSKTIQRIHKAWETPLRKDQELRGIRNGIIGGYHEWLKAHIRGLDWLAKLKVVSEESFEAPEEDEEVQALKSELGKAKLAKEKFKLAATHVRKECARLREENAITARALEQETKRARKEEYGRNKFRGALWGSNSELKLRREERDQSRAHSMVLKEELIACS

SEQ ID NO: 169581 - protein, 183 aa, Glycine max
  Coding DNA Sequence Number=SeqID_77896
ALRAELEQAQTVKERFKSAALKIRKENAELRDTNIATTKALELETKRARREEHGRNKFRGALWGSNSELKLRREERDHSRVDSLILKDELKTNMLAIISKYQEELKLATAHEHRVADEYAQMYAQKEARGKVIDSLHQEAMMCMDRFALTMNGSQELPRLLAKAKAMADTYSAPVEIHGLLGY

SEQ ID NO: 169582 - protein, 53 aa, Glycine max
  Coding DNA Sequence Number=SeqID_77897
MRTDQESAIKTLSLAPSLYSSPLDLSLEAVRATCQLRKGASSHFRGVVESLVA

SEQ ID NO: 169583 - protein, 268 aa, Glycine max
  Coding DNA Sequence Number=SeqID_77898
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDTLFDRLPIGLRVPLEASVTLLEATTPVKLPTIHCPRSAIGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169584 - protein, 266 aa, Glycine max
  Coding DNA Sequence Number=SeqID_77899
LKGDRAYHTELDDFKAELERRNFHKRLINLADRSIDLTLVKEFYANLYSSEDRPPKQSKVRGHLVKIVTDSLNAFLETPVVLAEGETLPAYSRYCRLPIDFREIEAALCIPGRGFILNSEGHHGRILRKDLTTLAQVWSVLSYSNLAPTSHTSDLTVDRARLIFGLITFVAQSNTSRLGFPTLITALSRARGVLSDSLTIKRLSLVINLAYIRKNCWNPEDLTVSIRGARRARAKPAELPSTSIAPTPTAPSVPAQTNSQRFEAML

SEQ ID NO: 169585 - protein, 184 aa, Glycine max
  Coding DNA Sequence Number=SeqID_77900
  Homolog annotation: Hit_ID=Q2QVF2; Match level="QueryCoverage=39%, HitCoverage=8%, E-value=3e-08, Identity=37%"; Hit description =Transposon protein, putative, CACTA, En/Spm sub-class
  Subcellular localization annotation: CTP_CleavageSite=29; ConfidenceScore=5.63e-01
MDSPLASPPPPHPPSDASASPSAMKRTRKASRLRSLSTRPPGAERPVVHVDPTTDKADGLHRKKLRTYLGIVARDKVDVTNENWKEVPIAQKDLIWEDIQAEFEIPEASDSRTKKKLLQTVGERCRQFKSDLTRKWALAADQDDVDDTVCDKYGISKEKWAQFCQTHRDPSWEDVWKKAQAIQK

SEQ ID NO: 169586 - protein, 176 aa, Glycine max
  Coding DNA Sequence Number=SeqID_77901
  Gene Ontology: Mol. function=transporter activity; Cellular component= membrane; Biological process=transport
  Homolog annotation: Hit_ID=Q663S2; Match level="QueryCoverage=98%, HitCoverage=37%, E-value=3e-69, Identity=75%"; Hit description =Xanthine/uracil permease family protein
MNEQGLLQRIFRLQEHGTTARTEVIAGFTTFLTMVYIVFVNPQILGAAGMDTQAVFVTTCVIAAFGSILMGLVANLPVALAPAMGLNAFFAFVVVSAMGYSWQVGMGAIFWGALGLLILTLLRVRYWMIANIPLSLRVGITAGIGLFIAMMGLKNAGIIVPNADTIVTVGNLASHN

SEQ ID NO: 169587 - protein, 223 aa, Glycine max
  Coding DNA Sequence Number=SeqID_77902
  Homolog annotation: Hit_ID=Q2HTA0; Match level="QueryCoverage=79%, HitCoverage=27%, E-value=1e-19, Identity=31%"; Hit description=IMP dehydrogenase/GMP reductase, related
  Pfam annotation: Domain name=DUF1723; Domain location=76-125; Score =45.8; E_value=1.6e-10; Accession=PF08330.1; Description=Protein of unknown function (DUF1723)
LTNDAEEFPGGPHDPSVLTLFADHVAHVIWSGQERSELKLVSHGRKVMLIGRSVPKIEGLVAVTGLSPLIRCSIVIGDPGLISAFVEMWQRETNTFHLPIGELMITLDDVLSLLHLPISDAFHSFHALYVDKAIFLLIELLEVSAEEARAETTRSRGAYVRLGWVRDIYEMRCQARRWVVAAHAYLLHLRLFTSWVRVVVMPGELSRWFICMTSLMKLLGPRH

SEQ ID NO: 169588 - protein, 206 aa, Glycine max
  Coding DNA Sequence Number=SeqID_77903
  Homolog annotation: Hit_ID=Q6WAY4; Match level="QueryCoverage=84%, HitCoverage=30%, E-value=2e-23, Identity=36%"; Hit description =Putative uncharacterized protein
MAEVSTEAIASLAQYYDQPLRCFTFGDFQLTPTVEEFEEILGCSLGGRKPYLFSGFYPSLARISKIVKISTQELDRGKKVENGVVGVPRKCLEAKARVLATQGEWAPFMDILALLIFGVVLFPNVDGLVDRAAIDAFLAFYDRKDSPVAAILADLYDTFDQRYEKNNARIVCCTPALYVWLVSHFFRQEMRHVCPLEGHGSCTEKK

SEQ ID NO: 169589 - protein, 26 aa, Glycine max
  Coding DNA Sequence Number=SeqID_77904
MWGIPYGYPHLSSTKANKFDGFTFII

SEQ ID NO: 169590 - protein, 119 aa, Glycine max
  Coding DNA Sequence Number=SeqID_77905
MYTRSFIIPQFPKIGLTHKKQSPVESPTVAASPFAGERGEALGCAFQGRKMCGVTTNVYLWKTSEKPKVDKSGAFAPTYPPSKRKSDLHSSFKGESSDSFYLEGDHFKALDLKNDPFTW

SEQ ID NO: 169591 - protein, 343 aa, Glycine max
  Coding DNA Sequence Number=SeqID_77906
EMAPRKLYAKRSRKDAAVEGTSAAPKFDNHRFRSVEHQQRFEAIRDDEYTDFQEEIACRRWTSLVTPMAKFDLDVVLEFYANAWPTEEGVRDMRSWVRGQWIPFDADALSQFLGYPLVNRADGFDEEAIAQLLCIPGQDFARTVAGRRVRIMRTSDHNSDLPLPKCQLMYTILTWMSVHMPPTRHPLDPDKSNRALGFPALITGLCQSFGVPVTPSKVIRPPITRAFIEKYCTPRQAQGGAPQAPDAPPPPHQADPAGSFDTEQAHVQTHDCLYQLSLNLQSQGLTPFPCPTPDQFRAEVAWPGNWPEAQAGEAPAEAPDDGEEARMDEEMTDLLDFLGGSGA

SEQ ID NO: 169592 - protein, 69 aa, Glycine max
  Coding DNA Sequence Number=SeqID_77907
MVWPLGPNRKGTRSDEKRKHRAWLEEDGEGKQREKRAWAEGEGGWGQRREVCGRGKKRKKEEMGGGGGY

SEQ ID NO: 169593 - protein, 266 aa, Glycine max
  Coding DNA Sequence Number=SeqID_77908
  Gene Ontology: Mol. function=transferase activity, transferring groups other than amino-acyl groups
  Homolog annotation: Hit_ID=Q395D3; Match level="QueryCoverage=54%, HitCoverage=42%, E-value=3e-21, Identity=40%"; Hit description =Acyltransferase 3
  Pfam annotation: Domain name=Acyl_transf_3; Domain location=8-257; Score=-11.8; E_value=0.00012; Accession=PF01757.13; Description =Acyltransferase family
MKPQKPRDNIYDVAKGLCIILVVFGHAERGLNGSGAPPHFSLMGFCDYAIYTFHMPFFFFLSGLFFSGQATAPGRFFGKLGKNIVYPYFFWSVLHGSLMVMMGRLGLTNTIIDLNRVLEILWSPISPFWFLYSLFFCHLASYSLSWVPVFLRVAFALILFGLFYIQNQWVQLDVAYGFLYFTLGIAAKQYDFQQMRYTTRSFMGILAAFLIATYFSWKIEVPERLPFLSAILGIVMTVAISQALVIRETQLHQHSRQSANYPSEST

SEQ ID NO: 169594 - protein, 111 aa, Glycine max
  Coding DNA Sequence Number=SeqID_77909
  Pfam annotation: Domain name=zf-CCHC; Domain location=37-54; Score =26.6; E_value=9.1e-05; Accession=PF00098.14; Description=Zinc knuckle
MWDTLQVTHEGTTDVKRKLKRSNSNPKKKGEDSSLVPKCYECDQPGHLRFDCPVFKRRMEKSDKKNFKDKKEKKSYITWEDNDMDSSSDSENEIINLGLMAKDYESGEELL

SEQ ID NO: 169595 - protein, 102 aa, Glycine max
  Coding DNA Sequence Number=SeqID_77910
MSLPSAVHVFSIIKCEASGDWEARYSVVFQIGSFAKKQACAIREIPQCGGSRKGVFLRNPITLAFQKIPPEGCCFWRKQPGSPGQAELAWASWAASISPILL

SEQ ID NO: 169596 - protein, 196 aa, Glycine max
  Coding DNA Sequence Number=SeqID_77911
MGEAEEVQEQMKANMEAMKEQMATMMEAMMSMKKIMEANAVAVAATSTVAKVNPMPPSALNQMNHPTSAMHAFPPYGLPPNYTPPNVAYTPNENVNNSTPILIESREPQTDHAHVSQPMGETHEMPHHNLADFEPCLGYATEGQAIGGMPLQNPLEGPQYHPQLHLLHSTTSKNPHAMLEIGKLDHLEERLRAIEG

SEQ ID NO: 169597 - protein, 64 aa, Glycine max
  Coding DNA Sequence Number=SeqID_77912
MITKDDDKGDDKKLKGQSKNEFKIFKRSRFQESRFKRSRFKTQDSRIKKKLNQDKYEKVFSKTE

SEQ ID NO: 169598 - protein, 607 aa, Glycine max
  Coding DNA Sequence Number=SeqID_77913
  Gene Ontology: Mol. function=protein binding; Biological process =alkylphosphonate transport
  Homolog annotation: Hit_ID=A4TQR5; Match level="QueryCoverage=44%, HitCoverage=93%, E-value=1e-142, Identity=89%"; Hit description=PhnJ protein
  Pfam annotation: Domain name=PhnI; Domain location=1-352; Score =605.0; E_value=7.2e-179; Accession=PF05861.3; Description=Bacterial phosphonate metabolism protein (PhnI)
  Pfam annotation: Domain name=PhnJ; Domain location=328-606; Score =766.9; E_value=1.3e-227; Accession=PF06007.2; Description =Phosphonate metabolism protein PhnJ
  Pfam module annotation: Pfam domain module=PhnI::PhnJ; Domain location=1-352::328-606
VKGGEKAIASAHQLQADLRRGDRSVAELGCDQVAQQLGLAVDRVMTEGGIFDTQLAALAIKQASGDLVEAIFLLRAYRTTLPRLADSLALETAEMRIERRISAVYKDLPGGQVLGPTYDYSHRLLDFTLLANGETPAAARDDQALAQRCPHVFSMMTREGLAAREEDDGSEPCDITRQPPGYPASRAARLQQLVRGDEGFLLALGYSTQRGYGRNHPFAGEIRTGYLSVSICPEELGFEIEIGEILLTECEMVNGFTTQGDSAPHFTRGYGLVFGRAERKAMAMALVDRALQAPEYQERIAGPAQDEERSWSCCSGCANSIRSRMMSELTGYNNGYLDEQTKRTIRRAILKAVAIPGYQVPFAGREMPMPYGWGTGGIQITASIIGDSDVLKVIDQGADDTTNAVSIRRFFQRVSGAATTEATKDATLIQTRHRIPETPLEEDQVLIFQVPIPEPLRFIEPRETETRTMHALEEYGIMQVKLYEDIARYGHIATTYAYPVKVNDRYVMDPSPIPKFDNPKMHMMPALQLFGAGREKRIYALPPYTKVESLDFDDHPFSVQSWAQPCALCGSRQSYLDEVVMDDAGTRMFVCSDTDFCHQQQEQQHAQ

SEQ ID NO: 169599 - protein, 58 aa, Glycine max
  Coding DNA Sequence Number=SeqID_77914
  Subcellular localization annotation: CTP_CleavageSite=55; ConfidenceScore=5.07e-01
MFKEFKPLNPSVATYPSARGRREGSRVRLPRKENARSRHQRLFKENVGKTGKGVVCEL

SEQ ID NO: 169600 - protein, 566 aa, Glycine max
  Coding DNA Sequence Number=SeqID_77915
  Gene Ontology: Mol. function=kinase activity; Cellular component =integral to membrane; Biological process=signal transduction
  Homolog annotation: Hit_ID=A7PI32; Match level="QueryCoverage=94%, HitCoverage=94%, E-value=0.0, Identity=64%"; Hit description =Chromosome chr13 scaffold_17, whole genome shotgun sequence
  Pfam annotation: Domain name=C2; Domain location=284-368; Score =117.2; E_value=4.9e-32; Accession=PF00168.21; Description=C2 domain
  Pfam annotation: Domain name=C2; Domain location=449-531; Score=65.8; E_value=1.4e-16; Accession=PF00168.21; Description=C2 domain
  Pfam module annotation: Pfam domain module=C2::C2; Domain location =284-368::449-531
MGFLSSFLGVFGFAVGIPLGLLVGFFLFVYSETKRVKDPVVRPISELGPNSLQELLPEIPLWVKTPDYERVYDDYDDDVTVLLILFLHVIQVDWLNKFLLDMWPFLDTAICKIIRSTTQPIFAEYIGKYQIKAIDFDELSLGTLPPTVCGMKVLETNEKELVMEQVIKWAGNPNIVVSLYVSSLKITIQLVDLQIFAAPRITLRPLVPTFPCFANIVVSLMEKPHVDFGMNVSGGDIMSIPGLYRFVQETIKKQVANLYLWPQTLEIPILDESTVAIKKPVGILHVNVVRAQKLLKMDLLGTSDPYVKLSLTGDKLPAKKTTVKRKNLNPEWNEKFKIVVKDPQSQVLQLQVYDWDKVGGHDKLGMQLVPLKVLNPYENKEFILDLLKDTNLNETPHKKPRGKIVVDLTFVPFKEDSNKFGGPSEGYSRKESGIDIVSDDEVQEGAGLLSIVIQEAEEVEGDHHNNPFAVLTFRGEKKRTKTMKKTRHPRWNEEFQFMLEEPPLHEKIHIEVMSKRKNFSFLPKESLGHVEINLRDVVHNGRINDKYHLINSRNGVMHVEIRWKVV

SEQ ID NO: 169601 - protein, 705 aa, Glycine max
  Coding DNA Sequence Number=SeqID_77916
  Gene Ontology: Mol. function=phenylalanine ammonia-lyase activity; Cellular component=cytoplasm; Biological process=phenylpropanoid metabolic process
  Homolog annotation: Hit_ID=Q9SMK9; Match level="QueryCoverage=75%, HitCoverage=73%, E-value=0.0, Identity=90%"; Hit description =Phenylalanine ammonia-lyase 2
  Pfam annotation: Domain name=PAL; Domain location=1-375; Score=723.1; E_value=2e-214; Accession=PF00221.10; Description=Phenylalanine and histidine ammonia-lyase
  Pfam annotation: Domain name=PfkB; Domain location=386-661; Score= -78.7; E_value=0.0089; Accession=PF00294.15; Description=pfkB family carbohydrate kinase
  Pfam module annotation: Pfam domain module=PAL::PfkB; Domain location= 1-375::386-661
MEAITKFLNHNITPCLPLRGTITASGDLVPLSYVAGLLIGRPNSKSIGPNGQVLNAKEAFQLAGIDGGFFELQPKEGLALVNGTAVGSGLASTVLFEANLLVILSEVLSAIFAEVMQGKQEFTDHLTHKLKHHPGQIEAAAIMEHILDGSSYVKAAQKLHEIDPLQKPKQDRYALRTSPQWLGPQIEVIRHATNMIEREINSVNDNPLIDVSRNKALHGGNFQGTPIGVSMDNTRLAIASIGKLMFAQFSELVNDFYNNGLPSNLTASRNPSLDYGFKGAEIAMASYCSELQYLANPVTTHVQSAEQHNQDVNSLGLISSRKTAEAIDVLKLMSSTFLVALCQAIDLRHLEENLKNTVKNTVSQVAKRVLTVGINGELHPSRFCEKDLLKIVDREYVYAYIDDPCSATYPLMQKLRLVLVDHALQNGDKEASSSTSIFQKIGAFEEELNALLPKEVESARIEVENGNPAIPNRIKECRSYPLYKFVRENLGTTLLTGEKVKSPGEESDKVFTALCEGKFIDPLLDCLKEWNVEKAKYYYVAGFFLTVSLESIKILARNAAANNKARTFSQAHGWKTDNNVIIQDPVLPVVLAEDGKIKLFSAVPLPKEKIVDTNGVADAFVGGFLSQLVQEKAIEECVKAGCYAAILIIVKNKKENVLIARDTEFRIIGESKHILCMVQQGLEEWMVEHTYFDHKSLAILTNIDN

SEQ ID NO: 169602 - protein, 403 aa, Glycine max
  Coding DNA Sequence Number=SeqID_77917
  Gene Ontology: Mol. function=peptidase activity
  Homolog annotation: Hit_ID=Q8LBW2; Match level="QueryCoverage=90%, HitCoverage=80%, E-value=3e-54, Identity=38%"; Hit description =Putative uncharacterized protein
  Pfam annotation: Domain name=OTU; Domain location=297-403; Score =61.6; E_value=2.6e-15; Accession=PF02338.10; Description=OTU-like cysteine protease
MAIYELDPDVVRWGLHLLDDCTLSHHYSPSIVTQYDPDLSQVEYVTEGFCQHQYVDSDEAVAQAYQEELWQLDSMVASGISNFENEGMQGSVYTQDWPQSSNGNDNLGNESCQNSVGESYNMKEVGNYGPTPSERKNDVHENDVCGSSSGSVEVPATATSDDFWDSLEISDESLDGEVGKRLNQMVPIPKITAICGYSSVCTIAGQAMRPVPSSDSLCSASFLEFPVRQNCWVKRRRGAADGGKRLGFSFLGEGHVPKTNEKIPSDDEEISDHQRLLDRNLVFLRLQLYDLIECKVQGDGNCQFRSLSDQLYRSPDHHKFVREQIIQQLKYYPDLYAGYVPLAYSDYLRNMSKSGEWGDHVTLQAAADWPYPCICKEAISGFELMTNRSPRHKFTVVPGLSLK

SEQ ID NO: 169603 - protein, 335 aa, Glycine max
  Coding DNA Sequence Number=SeqID_77918
  Gene Ontology: Mol. function=L-isoleucine transmembrane transporter activity; Cellular component=integral to membrane; Biological process=amino acid transport
  Homolog annotation: Hit_ID=Q949Y8; Match level="QueryCoverage=63%, HitCoverage=39%, E-value=4e-87, Identity=72%"; Hit description =Putative uncharacterized protein At2g39130
  Pfam annotation: Domain name=Aa_trans; Domain location=55-327; Score=- 86.9; E_value=0.0066; Accession=PF01490.9; Description=Transmembrane amino acid transporter protein
MVKVILTCVKKVIGSIEEQSKLHDSPMNKDRGIPGMIIEEIIKRDLKAFVDDIDLKLFELLVMLFPYSYFGFCRHKCSLWCWNPFYTLCCQSSEPELETYPDIGQAAFGTTGRIAISVSLHADLYSYLKCPCPTRGDNLSSLFPSAHLNLGGIELNSRTLFAVITTLAVLPTVWLRDLSILSYISAGGVVASILVVLCLLWVGIEDVGFHSKGTTLNLSTLPVAVGLYGYCYSGHAVFPNIYTSMANPNQFPGVLLACFGICTLLYAGAAVMGYTMFGEAILSQFTLNMPKELVATNIAVWTTAALCITIITVGVVCSAFGTYSALSEIVKSLRE

SEQ ID NO: 169604 - protein, 92 aa, Glycine max
  Coding DNA Sequence Number=SeqID_77919
MLGSAVGLGSAGLGSAGLGSAVGSIIKSGVLLTPKVPFNPLLLKKQIMHDTQKKRIGTESEHCQLVKGVVKLGLAKQCKVKEVQQSWHNKCQ

SEQ ID NO: 169605 - protein, 668 aa, Glycine max
  Coding DNA Sequence Number=SeqID_77920
  Gene Ontology: Mol. function=peptidase activity; Cellular component =endoplasmic reticulum membrane; Biological process=proteolysis
  Homolog annotation: Hit_ID=A7PI42; Match level="QueryCoverage=100%, HitCoverage=71%, E-value=1e-102, Identity=55%"; Hit description =Chromosome chr13 scaffold_17, whole genome shotgun sequence
AGPHPWAIENFALVAKYPSGQVIAQDLFSSGAIKSATDFQVYKEVAGLSGLDFAYLDNTAVYHTKNDKLELLKTGSLQHLGENMLAFLLHIGASSHIPEGNSTESEEDISKNNAIYFDILGMYMVVYRQKFANMLHNSVIMQSLLIWVTSLVMGGIPAAASLALSCLSVLLIPMLVVGLFGAPAFLGALTGQHFGFLLLQKYLSNTLSKGRQLTPIIKAAVVKMEAERWLYKAGSFQWLILLILGNYFKIGSSYLALVCNTNPSQATKATQTGNHNSGVSHSDFIFCRHIYSAGCYTYRGNPGGTPEWLGNFVIAAFIASLLSLTLVYLLSYVHLSGAKRAIILATLVLFSLSLAVVLTGVVPPFSEDTARAVNSPFNILQDMDYCIPMSFMWRIKEFVYFIHCKVDAWTMTPYPDRSMALGSIGVSEGLAPINPVSFDVRYILSLGNYKAFLDCATPIPKKYPQGNGKLDQGQNPISYVSLFSNTPGNLNKEVKQIDEGFVCGRDKTVDFVTFSVKYGCWTYNDTTNDWTEMDIPTMNVVSDAKGNGRITQVSINTKGSIRWVLAINIEEIEDFEFKVDKKSSVDGWHIIQFSGGKNAPTLFDLTLYWRSGSTHNSDSPLLKLRTDVNRLTPITERVLEKLPRWCSLFGKSTSPYTLAFLTNLPVKF

SEQ ID NO: 169606 - protein, 655 aa, Glycine max
  Coding DNA Sequence Number=SeqID_77921
  Gene Ontology: Mol. function=intramolecular transferase activity, phosphotransferases; Biological process=carbohydrate metabolic process
  Homolog annotation: Hit_ID=A7PI40; Match level="QueryCoverage=80%, HitCoverage=92%, E-value=0.0, Identity=74%"; Hit description =Chromosome chr13 scaffold_17, whole genome shotgun sequence
  Pfam annotation: Domain name=PGM_PMM_I; Domain location=89-270; Score= 71.9; E_value=2.1e-18; Accession=PF02878.7; Description =Phosphoglucomutasephosphomannomutase, alphabetaalpha domain I
  Pfam annotation: Domain name=PGM_PMM_II; Domain location=308-412; Score=68.0; E_value=3.1e-17; Accession=PF02879.7; Description =Phosphoglucomutasephosphomannomutase, alphabetaalpha domain II
  Pfam annotation: Domain name=PGM_PMM_III; Domain location=414-538; Score=2.1; E_value=0.0091; Accession=PF02880.7; Description =Phosphoglucomutasephosphomannomutase, alphabetaalpha domain III
  Pfam annotation: Domain name=PGM_PMM_IV; Domain location=574-639; Score=0.6; E_value=0.054; Accession=PF00408.11; Description =Phosphoglucomutasephosphomannomutase
  Pfam module annotation: Pfam domain module=PGM_PMM_I::PGM_PMM_II::PGM_ PMM_III::PGM_PMM_IV; Domain location=89-270::308-412::414-538::574-639
MYLLCCTGIGFYLGIGIVREEKVTEKQKPVSVSPSWQLKEALSVSATLVTFTWQENERKTFDELRNLNESDKASASATAVPYLDKTDFLKLQNGSDIRGVAVDGVEGELVNLTEPVAEAIGAAFAAWLMEKKKADASQHLRVSIGHDSRISAKLLQNAISRGLAGAGLEVVHYGLASTPAMFNSTLTKNEAFLCPADGSIMITDCGHGTTTKPYPTRYMDHMTSFNAVKNQTSHLPFNRNGFKFFTNAGGFGKADIKDILERAADIYNQFTEESLPNSERKASLSIKKVDYMIVYTSDLVKAVRKAAGNIGMTLLKYFYNKKPLEGFHIVVDAGNGAGGFFAAKVLEPLGAITSGSQFLEPDGLFPNHIPNPEDKTAMKAITQAVLDNKADLGIIFDTDVDRSAAVDFTGREFNRNRLIALMAAIVLEEHPGTTIVTDSVTSDGLTTFIEKKLGGRHHRFKRGYKNVIDEAIRLNSIGEESHLAIETSGHGALKENHWLDDGAYLMVKILNKLASARASGKGGGSKVLTDLIDGLQEPAFAAELRLKINQNHPDLKGGAFRSFREYGEAVLKHLENSIGSDPSLLKAPVNYEGVRVSGYGGWFLLRLSLHDPVLPLNIEAPSNDDAVKLGLAVLAAVKDFAGLDTSALNKLVGAS

SEQ ID NO: 169607 - protein, 746 aa, Glycine max
  Coding DNA Sequence Number=SeqID_77922
  Homolog annotation: Hit_ID=A7NZK6; Match level="QueryCoverage=97%, HitCoverage=99%, E-value=0.0, Identity=64%"; Hit description =Chromosome chr6 scaffold_3, whole genome shotgun sequence
  Pfam annotation: Domain name=DUF1336; Domain location=514-721; Score =388.5; E_value=1.1e-113; Accession=PF07059.3; Description=Protein of unknown function (DUF1336)
  Pfam annotation: Domain name=PH; Domain location=8-115; Score=48.3; E_ value=2.6e-11; Accession=PF00169.20; Description=PH domain
  Pfam annotation: Domain name=START; Domain location=151-364; Score =21.8; E_value=3.2e-06; Accession=PF01852.10; Description=START domain
  Pfam module annotation: Pfam domain module=DUF1336::PH::START; Domain location=514-721::8-115::151-364
MGIPQRERKMEGWLYLIRANRFGQHYSRKRYFILKGNALRSFKIKPTSQMEEPIRSAIIDSCIRVNDNGRETMNKNVLFIFTVYNATDQSDKLKLGASSSEEAARWIRTLQDAAMKGCPSPAKNLVACHKKRRSSLRNGGSKSTDWKYSNLNFQSCIYTEAMTADVIAPSPWKIFGCQNGLRMFKEAKDWDSRGSHWVGENPAIMAVGVVDGASEAIFHTLMTLDPSRSEWDFCIYRGNVVDHIDGHTDIIHLQLYNDWLPWGMKPRDLLLRRYWRREDDGSYVLLFHSVYHSKCPPKKGYVRACVKSGGFVVTPVNKGTQSVVRHMLAVDWKFWKLYLRPASARSITIRMLERIAALRELFRTKGGNYSSEPLAMTKDIGLPLGVKEDIKTEVSQEKNKFEEPPLVVMEDEVEPSGRRSLMGLNDSDEFFDVPEPTEYDHFQNEWHADLSSEQMSMSIPRMTSAAGFVKKLHGLAVQKKGYMDLQEAAMEESTSCSYGATLQKDSSCASPCTWAASDPSLFLVRGENYLQDHQKVKANGTLTQMVGADWLRSDTREDNLSSRPGSIVQQYAAKGGPEFFFVINMQMPGSPMYSLALYYMLKTPLEDNPLLQSFVDGDDAYRNSRFKLIPYISKGSWIVKQSVGKKACLVGQALEMLYIRGKNYLEIDIDVGSSTVARGVASLVLGYLNNLVVEMAFLVQGSTPDELPEVLLGTCRLNHMDASKAFLEFSAGAGQFAKALVPHFPL

SEQ ID NO: 169608 - protein, 49 aa, Glycine max
  Coding DNA Sequence Number=SeqID_77923
QAQGETPQQPGDGQQQATNAPPPPPEPLSSSTKWRPAQDVKEALLGGNL

SEQ ID NO: 169609 - protein, 181 aa, Glycine max
  Coding DNA Sequence Number=SeqID_77924
MATMVEAMMIMKKIMEANTIAVAATSAVAKVNPMLPSDLKPNESSNLRYGGQRFGKYRRPHDVQIQNKHAFPPYGSPPKEDVNNSAPILIESQQPQSDHAHVSQPMGETHGMPHQNLANFEPCLGYATEGLAVGRYTPAKHFGGPSVSPTTTPLAFHTGLKPSCYGRNGKVRSSRGKAQVY

SEQ ID NO: 169610 - protein, 145 aa, Glycine max
  Coding DNA Sequence Number=SeqID_77925
AKVDVSLSELNALSECHPLSEASTRLADRRNLEGNLSRRHALSASSAHSVSRLSPFRLSASLALSENSLTRAKRDVEICEFLSDCKIPRGGGDIPTPLIRLPYVRTQSDEILPRKGPVTRAMSKRLQEDWVRAAEEGPRVLMNLR

SEQ ID NO: 169611 - protein, 79 aa, Glycine max
  Coding DNA Sequence Number=SeqID_77926
MTTTYTSEPYTGAMTGTMHELQANLGADKKSSLDRLKTQKGGLGKKRAMQTRHARGLPSSRLGNDDVKKKVERKSAKCE

SEQ ID NO: 169612 - protein, 162 aa, Glycine max
  Coding DNA Sequence Number=SeqID_77927
  Homolog annotation: Hit_ID=UPI00006A2939; Match level="QueryCoverage =80%, HitCoverage=82%, E-value=4e-12, Identity=33%"; Hit description =UPI00006A2939 related cluster
YLHFRGPHVLTLRGLHVLTIRGLHALTSRGLHVLTFRGLHALAIRGLHVLTFVGLHTLTFRGPHVLTFRELHALAIRGLHILTFVGLHALTFRGLHVLANRGLHALTLRGLQVLALRGLHVLTIRGLHAFTSRGLHVLALGTSYPHLQRTTRPRLGYYRPHL

SEQ ID NO: 169613 - protein, 117 aa, Glycine max
  Coding DNA Sequence Number=SeqID_77928
MPFCERARRGSRVRFPKEERCAESPPTLICGKRRKNRRKPVKTKILSSGVVFTFEEGISTSHVNKSGALAPMYPPLKRKSDLCSSFLRANQAILFTWKVVILRRWTLKMIHLLGKKN

SEQ ID NO: 169614 - protein, 125 aa, Glycine max
  Coding DNA Sequence Number=SeqID_77929
FLNTRDGLSLCGSDFVMDFTKIVEISSGLLEYWTPQGPTHVAFELYHLGYGDWKTFSGMATTKWFSNNEGHNSEYAMGIGENSSLGGRRVLYSSRQESYYWLAGVLLLELGGNFRLRSKSSGGCV

SEQ ID NO: 169615 - protein, 334 aa, Glycine max
  Coding DNA Sequence Number=SeqID_77930
  Gene Ontology: Mol. function=transcription regulator activity; Biological process=regulation of transcription, DNA-dependent
  Homolog annotation: Hit_ID=Q6D8M6; Match level="QueryCoverage=47%, HitCoverage=82%, E-value=4e-18, Identity=33%"; Hit description=TetR -family transcriptional regulator
  Pfam annotation: Domain name=TetR_N; Domain location=158-199; Score =27.2; E_value=5.9e-05; Accession=PF00440.14; Description=Bacterial regulatory proteins, tetR f
ITADERAERGAKGERRGHQPFGKWREIETALRGGQRHVGQRAGNNAGCRHHLIETAKNFACYRPWVIQDLVNDGIKRRFEYSQKRESVRLVTILTGWRLNKILHRPDCSAQVCAAAAPSHCVQTLAGLLQSRPRQGENFLLMYAGWLMRNTLRRNAERQLFRERGFNNVSTRDLTNTLGISRSHIYHYFKNWDALRLDSIAFMLDEDVAAFSVESEKRDDSQHDTFFRALVDYLLPDGPASHWLIYLELWPLAARDKQFEQLLLSSTQTWTAIIRQGLSGQAFSHLSEAGKDEVARNLHALIDGYSSALILNYSADKRTHFFLEIMAALQKLCR

SEQ ID NO: 169616 - protein, 455 aa, Glycine max
  Coding DNA Sequence Number=SeqID_77931
  Gene Ontology: Mol. function=lyase activity; Cellular component =integral to membrane; Biological process=amino acid transport
  Homolog annotation: Hit_ID=A2WIX4; Match level="QueryCoverage=73%, HitCoverage=86%, E-value=8e-34, Identity=31%"; Hit description =Putative uncharacterized protein
  Pfam annotation: Domain name=Ala_racemase_N; Domain location=1-226; Score=-11.1; E_value=5.8e-06; Accession=PF01168.11; Description =Alanine racemase, N-terminal domain
RNLQRMQQKADAAGVALRPHIKTHKSVWIAEQQRQLGARGITVSKPSEGVAFVLGGARDVLLAYPVVHAAALTELLQLAAQHQARITCIADCAAGVSAIAAAHQQQPDCALAIAIKVDVGLHRVGVDPHSDSALTLAQQIVASGLPFAGLISHAGHAYAAGHATAIAEVAQQEIALMRDLQRRLLDAGFVPCPISVGSTPTALAAPVAAGSDEIRPGNYALLDLTAWRLGLCEADALALTVVTRVVAVNPYYAIIDAGSKMLSSDKGPHGTNASGFGIAVDEHGHQYEVQKLSEEHGFLTYGEHAPAVGALLRIFPNHSCAVVAQSDRFVLRQADGSAGLHDIQGRGRDVSGLICRLPAPRRLHAAISDSDAHHSPTLTQEGQYWKAKGPEGTVKIRFTPYNPFGVMDHWIDTGSGKEIYMPMRVIANEQGAEVVMVVYRQPLMSDEKFAGDVAW

SEQ ID NO: 169617 - protein, 98 aa, Glycine max
  Coding DNA Sequence Number=SeqID_77932
LVDPPGCRNSIFVDHPTFAIMTQESGSRQRHLLVIRTSSFGDPEFDWQAEANVVICALSGDVSISRSEFLIINGGYVGAKAPLLLTTLPFVIMTREVK

SEQ ID NO: 169618 - protein, 417 aa, Glycine max
  Coding DNA Sequence Number=SeqID_77933
  Gene Ontology: Mol. function=S-adenosylmethionine-dependent methyltransferase activity; Cellular component=mitochondrion; Biological process=rRNA processing
  Homolog annotation: Hit_ID=Q1H069; Match level="QueryCoverage=93%, HitCoverage=88%, E-value=1e-148, Identity=67%"; Hit description=23S rRNA (uracil-5-)-methyltransferase rumA (EC 2.1.1.-) (23S rRNA(M- 5 -U1939)-methyltransferase)
  Pfam annotation: Domain name=Met_10; Domain location=259-397; Score= -121.4; E_value=0.061; Accession=PF02475.7; Description=Met-10+ like -protein
  Pfam annotation: Domain name=UPF0020; Domain location=278-417; Score=- 64.5; E_value=0.094; Accession=PF01170.9; Description=Putative RNA methylase family UPF0020
  Pfam annotation: Domain name=tRNA_U5-meth_tr; Domain location=101 -417; Score=-150.5; E_value=3.9e-05; Accession=PF05958.2; Description= tRNA (Uracil-5-)-methyltransferase
  Pfam module annotation: Pfam domain module=Met_10::UPF0020::tRNA_U5 -meth_tr; Domain location=259-397::278-417::101-417
MRNNRQRSSNLSSAAKAAQIPRTAIIESLDQEGRGVTHVDGKVIFIEGALPFEEVKFVSHHVKSTYELATTVEVIKASSQRVTPGCAYFGTCGGCAMQHLEFSAQVAAKQRMLEDDLWHIGRVRPEKILPPIQGTPWHYRHKARLRVRYVEKKGGVLVGFNEKGSSFVTFMDSCEVLTKPVSDLIVPLKQLIGQLSIKQSLPQIELAVGEDATVLVFRILEALTEADIALMQTFEETYGAQVWTQTKGPDTVKPLFEHGDKLHYSLPEYNLEYPFSPTEFTQVNPAINRVMIRRAMQLLEPKAGERIADFFCGLGNFTLPIACSGASVYGVEGSQALVKRAIENAGLNGVENVEFAESDLFDMTAESLQSLGAFDKWLVDPPRDGAIELIKALPDAGDPASGHAPSRIVYVSVIRLR

SEQ ID NO: 169619 - protein, 385 aa, Glycine max
  Coding DNA Sequence Number=SeqID_77934
  Gene Ontology: Mol. function=transporter activity; Cellular component= integral to membrane; Biological process=transport
  Homolog annotation: Hit_ID=Q1H073; Match level="QueryCoverage=35%, HitCoverage=51%, E-value=2e-41, Identity=62%"; Hit description =Binding-protein-dependent transport systems inner membrane component
  Pfam annotation: Domain name=BPD_transp_1; Domain location=146-383; Score=34.6; E_value=3.6e-07; Accession=PF00528.13; Description =Binding-protein-dependent transport s
  Subcellular localization annotation: CTP_CleavageSite=46; ConfidenceScore=5.25e-01
MPVISIAWWLAPAAATPISRLAVEMMPSFAPNTAARNQPLRCKNLRVSYIKSPSTTGKSLRITVMHIEISIPAQTLTLFDDNGGQVTRYAVSTAANGAGCVKNSGCTPLGAHIIRAKIGAGAAENTVFVGRRPTGETFTQDLKVQFPERDWILTRILWLSGTEPASGLLATSGHCLVMWWDFGTHTGLTSMPFWQWPSQQHWLGTDDLGLFYGDAGVSDHDGWAKYRAGHAAAIAFAAVLGAGINNLILALCLTGWVTYARLSRGQSLALRQRLHVLAAESLGAGSVRVMLLHILPLLISILLVEAAYSMASVMIAEASLSFLGLGIQAPNASWGAMLRDAVRFMLVAPHYVLTVGVCMMSLILAINLGGDVLRDKLDVRSERQV

SEQ ID NO: 169620 - protein, 37 aa, Glycine max
  Coding DNA Sequence Number=SeqID_77935
MAIAKIENRYYNDPLTKGLARDKVHNTSKRMRLLPLL

SEQ ID NO: 169621 - protein, 366 aa, Glycine max
  Coding DNA Sequence Number=SeqID_77936
  Gene Ontology: Mol. function=nucleotide binding; Cellular component =plastid chromosome; Biological process=cobalamin biosynthetic process
  Homolog annotation: Hit_ID=A6THT6; Match level="QueryCoverage=87%, HitCoverage=99%, E-value=1e-171, Identity=95%"; Hit description =Putative synthesis protein
  Pfam annotation: Domain name=CobW_C; Domain location=272-365; Score =119.7; E_value=8.8e-33; Accession=PF07683.5; Description=Cobalamin synthesis protein cobW C-terminal
  Pfam annotation: Domain name=DUF466; Domain location=1-50; Score =90.7; E_value=4.5e-24; Accession=PF04328.4; Description=Protein of unknown function (DUF466)
  Pfam annotation: Domain name=cobW; Domain location=53-232; Score =263.5; E_value=4.5e-76; Accession=PF02492.10; Description=Cobalamin synthesis proteinP47K
  Pfam module annotation: Pfam domain module=CobW_C::DUF466::cobW; Domain location=272-365::1-50::53-232
MLIGIPDYDNYVTHMQTNHPDQPYMTYEEFFRERQQARYGGDGKGGAIMAPIAVTLLTGFLGAGKTTLLRHILNEQHGFKIAVIENEFGEVSVDDQLIGDRATQIKTLTNGCICCTRSNELEDALLDLLDSRDRGEIAFDRLVIECTGMADPGPIIQTFFSHEVLCERYLLDGVIALVDAVHADQQMDQFTIAQSQVGYADRILLTKTDVAGDTEKLRERLTRINARAPIYTVIHGDIDLSQLFNTSGFMLEEKVVSATPRFHFVAEKQNDVSSIVVELDYPVDISEVSRVMENLLLSFAEQLMRYKGMLWIDGEPNRLLFQGVQRLYSADWDRPWGDETPHSTLVFIGIQLPEEEIRAAFAGLRK

SEQ ID NO: 169622 - protein, 91 aa, Glycine max
  Coding DNA Sequence Number=SeqID_77937
MESLKMFGEDIVEDADIPLILGCPFMSTTSCMVDMGKKMLQMGIEDQKISFDLFHEDKDPPSQNVCLKVHVMVERRPEKKVLEVGTLLDPG

SEQ ID NO: 169623 - protein, 106 aa, Glycine max
  Coding DNA Sequence Number=SeqID_77938
MASKKRKSLASSSSHIRFDRSRFHSQEAWDRYNNIVVLRKLLLERNVVVYCTEFDEFKEELERRKWDEELTSFADGSIDVAIVKEFYTNLYDPEDKSPKQVCTPEA

SEQ ID NO: 169624 - protein, 188 aa, Glycine max
  Coding DNA Sequence Number=SeqID_77939
MGEVEEVQEQMKADMEAMKEQMATMMEAMMSLKKIMEANAVTIAATSTVAKVNPMPPSGLNQMNHPTLAMTHEIPHRNLADFEPCLGYATEGQAFGGIPLQNTLEGPQYHPQLHLLHSTTSKNPHAMAEMGKLDHLGEKLRAIEGGKDYAFANLEEYFLVPNIITPPKFKVLDFDKYKGTTFPKNHLK

SEQ ID NO: 169625 - protein, 169 aa, Glycine max
  Coding DNA Sequence Number=SeqID_77940
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=74%, E-value=3e-24, Identity=67%"; Hit description=LacZ protein
MKHFTDTLISANIGTKAGTGPPLEVDGIDKLDAKPRTNDTATIRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 169626 - protein, 22 aa, Glycine max
  Coding DNA Sequence Number=SeqID_77941
EEEEGKKAPDQGSKENRRNVQK

SEQ ID NO: 169627 - protein, 111 aa, Glycine max
  Coding DNA Sequence Number=SeqID_77942
MPRQAQGDAPQAADAPPPPHQADPVGSLGMERYLQHLVRQQAANHRGQGQGFAPFACPTPEQFGAEVAWPGDWPEAQAGEEPAGSPGEAEEARMDEEMTDLLGFLGGSIAT

SEQ ID NO: 169628 - protein, 280 aa, Glycine max
  Coding DNA Sequence Number=SeqID_77943
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSILALSCFTLCSPRAATSSASRSAASRAAASSASRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169629 - protein, 116 aa, Glycine max
  Coding DNA Sequence Number=SeqID_77944
MECPRAPPRYAHVVFDSYPQKNGGLREPSRGYGYHCIIKWCLALVVWKVGFIVDLGMAFVDNWAVGKEKVCYWLSNDIVGLVGNLAVLEWESQPGLLLHPHPLHLPQFSHSSKQDD

SEQ ID NO: 169630 - protein, 317 aa, Glycine max
  Coding DNA Sequence Number=SeqID_77945
  Subcellular localization annotation: CTP_CleavageSite=24; ConfidenceScore=5.28e-01
MATSPVSPPPPPPSSSPPPPPPSQASTSPSTVDVTYETWKEVPIAQKDLIWEDIQAELEIPEASDNRTDSVADTVCEKYGISKDKWSQFCKTRRDPSWEDVRKKAQAIQKQNTALHVLSCGGYEYLEEKLISEKTKKKLEEVARGKDVVIDPSSPIRHHVKWKMARTKKTGQMTSESAKEIAQKIISHFQLTIATIIVYYVNAFNKYMSFVQDSLEEQASQGSFVPHGRQDVLTAAIGPRATDPTNQGPAGGVDHKKVTQQLLASFSQMQSQLQSHMQSQGLVLPPKPEVGPSRPHVSTKRSYVDPSGNDPKTGDSD

SEQ ID NO: 169631 - protein, 208 aa, Glycine max
  Coding DNA Sequence Number=SeqID_77946
  Homolog annotation: Hit_ID=A7NSI9; Match level="QueryCoverage=24%, HitCoverage=21%, E-value=2e-11, Identity=70%"; Hit description =Chromosome chr18 scaffold_1, whole genome shotgun sequence
MPYPRRIIPLNSITQQMLPCGPIPFKKTVFYGSFIRQERFPDREIAATITELIYGLQKSDTLLALACKKLTASPKDRLYDLEGKGVELVPVVRTVDKGHHLASVQPWVVRDVSDLLFRKSMRLKLEHSLMCYKVDFKDNKPVDLEKYTFSLTGRKPISLEEKRKLGEGYIPLLQTSILEKMETLTSHFCETLLELYVSNPKLFIITTK

SEQ ID NO: 169632 - protein, 155 aa, Glycine max
  Coding DNA Sequence Number=SeqID_77947
MGDGLRLQREANQRVHSAAIRLEPKLEIPGYGCEDHFLELNTVNHSYEGNENWSWSWHRETHVQRCRMREQLPRRCQSGDEFGEGGGDDGEGDGEFEKVEVVVVWDFVVIVGFWGLNSKKRKEEKEGSNVKPWNVECCYILIFKYRFVGATITDG

SEQ ID NO: 169633 - protein, 146 aa, Glycine max
  Coding DNA Sequence Number=SeqID_77948
  Homolog annotation: Hit_ID=Q2HSQ4; Match level="QueryCoverage=22%, HitCoverage=34%, E-value=2e-08, Identity=81%"; Hit description=RNA -directed DNA polymerase ; Zinc finger, CCHC-type; Peptidase aspartic, catalytic, putative
MARFSHGLNREIQDIVELHHYASLEDLIHQAIKCLRNGHIASQCLDKRTMVVLGNGDITSASSSSSSSSSSDSGSECDVESLEGDLLMVRRLMGSVCKDRDESQRENNFHTRLAIFYLEGLGSLSYPNFVRGLLFDGMQPLVDRFE

SEQ ID NO: 169634 - protein, 145 aa, Glycine max
  Coding DNA Sequence Number=SeqID_77949
MQSKSSAGDLVPLDLEIEATCRRNNTERRRKILKDITTSPILEEPQSSESSSIFLQTRESEIGSPEANIMVEDQPRRVTLENYSSFVVLQFFTSIAWPEVQAHNITYPHSLIQLIQGNLFHGLPNEDPYAHLATYIEICNTIKIA

SEQ ID NO: 169635 - protein, 65 aa, Glycine max
  Coding DNA Sequence Number=SeqID_77950
MSPPPLEPHSHSQTHLMLSRQLPLQAPFSAGVEGRSPKIHEPLDLRSNLFQGGGNAAILPPKGIG

SEQ ID NO: 169636 - protein, 77 aa, Glycine max
  Coding DNA Sequence Number=SeqID_77951
  Subcellular localization annotation: CTP_CleavageSite=51; ConfidenceScore=5.44e-01
MSLAQIAFGLACNFQSKKLTKLPGLSKSALLSHRHLNRRMSVHPQKMNSLSAVGISNMQARLAQQTHIFKHANTYIQ

SEQ ID NO: 169637 - protein, 92 aa, Glycine max
  Coding DNA Sequence Number=SeqID_77952
MGKEVLKAQVEKDKAPEWRRMKAQVEKDEGPETYQGNPCGVYPDLSSFTGSGIYPDLSSFTGSGVIQISVACIKQSAPSKDHIISTAIPALS

SEQ ID NO: 169638 - protein, 63 aa, Glycine max
  Coding DNA Sequence Number=SeqID_77953
MDEVHVEEIQSISIVQGGLQQCCWQDDITTVPFHSRGVTGKFWRFPWHLSNKLFSLVLTVLIE

SEQ ID NO: 169639 - protein, 226 aa, Glycine max
  Coding DNA Sequence Number=SeqID_77954
  Homolog annotation: Hit_ID=Q51617; Match level="QueryCoverage=18%, HitCoverage=59%, E-value=3e-14, Identity=95%"; Hit description =Putative uncharacterized protein
  Subcellular localization annotation: CTP_CleavageSite=77; ConfidenceScore=5.19e-01
MTVKTSDTCSSRRRSQLVCKRMPGADKPVRARQRVLAGVGAGLTMRHQSRLCVRRKYRIRRHSPFRLRNCWEGRSVRASSLLRQLAKGGCAARRLSWVTPGFSQSRRCKTTASAKLACLQVDSRGSPSRLYLKEKQENRHTRSNVEERAQNFKGSHHCPTIWVELRRRHIQLLKQSTLESGQGENETQDLKQTPIHKEERRTTKHRPQEREVASLNDYLAGALKAC

SEQ ID NO: 169640 - protein, 117 aa, Glycine max
  Coding DNA Sequence Number=SeqID_77955
MKTLWKTQYLEELKKVKEEEEGLQAEGKEARAYMAHSKTNLVSREVSNIHLSLPSCLALPTTSQDLNPNLSIFWEAPPIVGKATCGGVLRDHSETVVFAFSNSTRTCSIKLAELWAI

SEQ ID NO: 169641 - protein, 159 aa, Glycine max
  Coding DNA Sequence Number=SeqID_77956
MQCQCTQLRAFPVPPVRSFFSKLDLRDIAYEIIVEACRSLGSKQLTFAAREIGSVRQCRHCIVVADFDGSEQDEDGGGGIRRATSAGRPLQHQGKRDDIEEKGGREKKKGEGSWKVGGEEEEGVVVVGGGGEEERYVKGERGKRKEKSEGGMGRVLCVL

SEQ ID NO: 169642 - protein, 82 aa, Glycine max
  Coding DNA Sequence Number=SeqID_77957
MASILTYLPSPGSGVYPDLSSFTESGVIQISKLAKYRLMAQVEKAKSPSGEGQSPRVEKDEGTSGEGRRPRGRDTIKTINCC

SEQ ID NO: 169643 - protein, 129 aa, Glycine max
  Coding DNA Sequence Number=SeqID_77958
MIFTRLKEISRTAGRLGTGERFPNLKHDSNDPTTKVDEKMDLFVHNKLEEKKKTKLLKSNFIEEYNDAANKKWTKKAVRIVVSNDIISVKQGDANACLLDGDAPYMGDQDRSLKEKSEGGVLIVDIFLT

SEQ ID NO: 169644 - protein, 84 aa, Glycine max
  Coding DNA Sequence Number=SeqID_77959
MAPTMVGVGKGHDQVRKCRNAIAVEKFKIRDATNGIRANISPVQCGSKMNRVEVGGHVTPRSNHARMREIQRLYRYETVQLIMT

SEQ ID NO: 169645 - protein, 227 aa, Glycine max
  Coding DNA Sequence Number=SeqID_77960
  Homolog annotation: Hit_ID=Q6L477; Match level="QueryCoverage=55%, HitCoverage=21%, E-value=3e-10, Identity=28%"; Hit description =Putative uncharacterized protein OSJNBa0009L15.8
  Subcellular localization annotation: CTP_CleavageSite=31; ConfidenceScore=5.65e-01
MATPPSSPPPTGAASQSPSTLKRTRKATRLRSLATRPVGAKRPLVHVDPATGKVNGPYNKKLRTYLGIVTCDKVDVTYKNWNQVPTAQKDLIWEDIQTEFDILEASDLRTKKKILQTMGERWRQFKSDLMLKWALVADKESVNNTVCEKYDISKDKWAQFCQTRRDPLWEAQAIKKQNTAPHVLSHGGYEYLEKKLMDEKRKKKLEEASQSGSTGTVIDPPSPIRRH

SEQ ID NO: 169646 - protein, 145 aa, Glycine max
  Coding DNA Sequence Number=SeqID_77961
  Gene Ontology: Mol. function=receptor activity
  Homolog annotation: Hit_ID=A0EJF3; Match level="QueryCoverage=54%, HitCoverage=11%, E-value=1e-30, Identity=81%"; Hit description=Beta -glucan-binding protein 4
MADFMTLIRRLNSNYIRLRCFDLYKLHSWVGGLTEFGDGRNQQSTSEAVNAYYAATLMGLAYGHMHLLAIGSTLTTLEILSGTNVVAYERGSALCATAKYETLTKVILAVKKAELPNLDSTNQVAIAIGFIVYETKSYTWNGRWI

SEQ ID NO: 169647 - protein, 224 aa, Glycine max
  Coding DNA Sequence Number=SeqID_77962
MTALAVSVCSGLGAHAVIWGKIPGWTTRDYKCHFTCLPRPPCALIDAYHDNLSLIPSPLHKLFRQPLFIELQVYVKPDRQPQNLNKTLSTTLQLHHLQSKDYVHQSKAHEQQRFEGFVLSYFVQSLRLISLPFSSPHRKRYHTQIQCARSLPILGFNSSWVHFYKIAPMLEKGLAKRRGRRKEGGLVGDNGACGEEPTEITPDSDVQDSVEVHKEENWMRNDRV

SEQ ID NO: 169648 - protein, 18 aa, Glycine max
  Coding DNA Sequence Number=SeqID_77963
VILGLFAVLGQEHSASAA

SEQ ID NO: 169649 - protein, 65 aa, Glycine max
  Coding DNA Sequence Number=SeqID_77964
  Subcellular localization annotation: CTP_CleavageSite=27; ConfidenceScore=5.01e-01
MASSLRNAHVAGKPPFVLARRADLLCSAGLLFQAVDTFFSSETCFFRERGVAIAIGELRASCNCH

SEQ ID NO: 169650 - protein, 31 aa, Glycine max
  Coding DNA Sequence Number=SeqID_77965
MVGCREKVVGCREKVLYCHHQKGGDCRCNCF

SEQ ID NO: 169651 - protein, 281 aa, Glycine max
  Coding DNA Sequence Number=SeqID_77966
MQSQGLALPPEPEVGPSAARVSTKESCVDPLGKDRDTGDSDKCGLYIEENPPRLVALGRVYEGSTIVHNILLLHDQVKVDVEEVKDADAPIPVPIDEGVVGPAKLADKPDHEVMWDATVFGLFNQDFPLYIKHEDLSEIAHDAGNSDVYGFLEPHSIQRSGQSQFESKSYMKNWMQNSKRDVYLGAYLNGPNNYLKGIINRPVLFSNTFALALLSNINIVMFLVFNSALKELDDTPQPNSEVGDRWIVVKYFDDVRPLEAERLKALRIQWAQYYLKVRNQT

SEQ ID NO: 169652 - protein, 43 aa, Glycine max; identical to SEQ ID NO: 107065
  Coding DNA Sequence Number=SeqID_77967

SEQ ID NO: 169653 - protein, 109 aa, Glycine max
  Coding DNA Sequence Number=SeqID_77968
  Homolog annotation: Hit_ID=A0ST23; Match level="QueryCoverage=22%, HitCoverage=51%, E-value=3e-07, Identity=100%"; Hit description =Putative reverse transcriptase
MAHEHELDPTNVRNGRGGNQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 169654 - protein, 65 aa, Glycine max
  Coding DNA Sequence Number=SeqID_77969
MIMRSQDFYSSQEETTSSPSSGGNEDEARGEESSEEVYPHEEGDLLMHKISFQVEPHYQSPPKTL

SEQ ID NO: 169655 - protein, 105 aa, Glycine max
  Coding DNA Sequence Number=SeqID_77970
MGQLQQQAFHKAYGKIWDLAMAEVSTVAIASLTQYYDQPVEMLHLWGLPAITHDSPNLGTGIRLRKASRKWGGWNTEKMFGGHWASFIDILTLLIFGGVLFPNVD

SEQ ID NO: 169656 - protein, 291 aa, Glycine max
  Coding DNA Sequence Number=SeqID_77971
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRYKSMHLWPTDFQQSAKTVQWGKNSWIATYKRMKLVYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169657 - protein, 117 aa, Glycine max
  Coding DNA Sequence Number=SeqID_77972
MGAKHLTRTKERSHVIKQRSPDEIRILSGPKTFLHISSIFFQSLIRNFLSFSFLSIFDWEFSLCFLPRARIDIRTLGQGLWDKGDVPHYFHDTKATMMIWKFYAKLVMHAPMGTLKC

SEQ ID NO: 169658 - protein, 152 aa, Glycine max
  Coding DNA Sequence Number=SeqID_77973
  Subcellular localization annotation: CTP_CleavageSite=41; ConfidenceScore=5.41e-01
MAESSKKRKGSSSTTAVASHRHHGPSEAPTTPIHPSLSSLRSSTLFSSDDQRLRYLSQFSSRIILDPKYLDIDFLNDETFDCYQVFQNSGLIDFTSLKLPYYPELVKVFYCNLKIQDGIISSEVHASQGAPFEGTIVDDCKFDYSSHDARRM

SEQ ID NO: 169659 - protein, 200 aa, Glycine max
  Coding DNA Sequence Number=SeqID_77974
MTLTIPELFVRPYQVTWDSTVFRDFHPYFPLYIKLEDLFKIAHGGQCLSISVLQLWILYLTETSMRAGNYNIYGFLEPQSLQRCGQLRVESESYIKSWMQSSKREVYLGSFLNGALKGLDDAPQPKSKAPTRWIVVKCNRQKGSTECSYYVMHWMSTIILGSFRNNWEAYFNDPRPLDPKRLKALWIQWAQYYLRVRDQT

SEQ ID NO: 169660 - protein, 77 aa, Glycine max
  Coding DNA Sequence Number=SeqID_77975
MANQEEWVPFMDVLALLIFGVVLFPNVDGLVDLAAIDAFLAYHHSKESQAEQSIGFHDGKKEMKVFSSHVEATQTSR

SEQ ID NO: 169661 - protein, 271 aa, Glycine max
  Coding DNA Sequence Number=SeqID_77976
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDMHLIDCQLTRVKTARGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169662 - protein, 114 aa, Glycine max
  Coding DNA Sequence Number=SeqID_77977
MVRYAPSIFADLVFTYERIEVGLKRGKFNHPAWTNEKTGANEEGESEGETHVVTAIPIRPSFPPTQQCHYNPSPYLPPSYPQRLYLNQPQNPPSTQPMLNTTFSTNQNTKEGIL

SEQ ID NO: 169663 - protein, 87 aa, Glycine max
  Coding DNA Sequence Number=SeqID_77978
  Subcellular localization annotation: CTP_CleavageSite=65; ConfidenceScore=5.10e-01
MNEKVKVKRDKNLEVLKGAFALSSPFGLSVHPTLSAASALLSTIKEFGRASISRLCAKREIRLLSAMVVFSQAQRMTGTKPKSTNSR

SEQ ID NO: 169664 - protein, 146 aa, Glycine max
  Coding DNA Sequence Number=SeqID_77979
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MAPPACRGAALGRSDRTSLVGESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 169665 - protein, 156 aa, Glycine max
  Coding DNA Sequence Number=SeqID_77980
  Homolog annotation: Hit_ID=A5BEV8; Match level="QueryCoverage=48%, HitCoverage=9%, E-value=1e-08, Identity=41%"; Hit description =Putative uncharacterized protein
MAKSFIGHPYVGRLTKDEKIFVVDMTKSIVKPRNILLTLKEHNANNYTTIKQIYNARNAYRSSTRGMKSVFSDATNLLCWFHIGKNVKAKCKTLVGQKNAWEYVMEAWGSLVDCPCESYFDEYLKNFEMACSLWPMFADYVCPTWVILHKEKIVKT

SEQ ID NO: 169666 - protein, 196 aa, Glycine max
  Coding DNA Sequence Number=SeqID_77981
MDMNVGYLISHQISLIAQYDSSRLGFPALITALCKARGVHSDSLTHESLSSTINLAYIKKNYWNLNDPTVTFRGPRKARGKRSETSSTTPLEIGGPSSSTLPPSSSKEIPVIPPAPTQISLPAPLSAGPTYFIFTPQMLHSMFQSIHRGQSIIMQSLQSLGLPSIISMEEFDAQVAWLGHHLSSSGGGGASIAHEL

SEQ ID NO: 169667 - protein, 40 aa, Glycine max
  Coding DNA Sequence Number=SeqID_77982
MTTFKVPNKKFTILSPIALKVVRPLLLDSNSSRDGINPPF

SEQ ID NO: 169668 - protein, 68 aa, Glycine max
  Coding DNA Sequence Number=SeqID_77983
MSVSAERQLRKYSIGVMRIMKLAKYRLKAQVEKDEGPSGEGQSPRVEKDEGPEAETLLRLLIVAEGPN

SEQ ID NO: 169669 - protein, 115 aa, Glycine max
  Coding DNA Sequence Number=SeqID_77984
AKSGSTDTIIDLPSSIKRHVKWKMTRTKKTDEMTFEAAKKIDDKIVRFLGGSMPYRVPLSPMDDLSHVFVYGSQSPGAVDAKNQGPAGGGLTVPPEPEVGPSTAHVNTKESCVDP

SEQ ID NO: 169670 - protein, 103 aa, Glycine max
  Coding DNA Sequence Number=SeqID_77985
MTLLLSNILPKDHNSDFPLPKCQLVYAILTQVSVHVAQLISNAIYQFAGITPPRHPVDPKKSNRALGFPALIIGDMNGSGMEKEEREETPHQGEDESRRSSPP

SEQ ID NO: 169671 - protein, 89 aa, Glycine max
  Coding DNA Sequence Number=SeqID_77986
MLWKLGRIDVDLVLRGTRIRATWEYVSSVGGGQQGMVGLYVICGCGELFCTIARPPPSTTCDGVVPGDMSRGSGDLGDVRWGAIAENRA

SEQ ID NO: 169672 - protein, 58 aa, Glycine max
  Coding DNA Sequence Number=SeqID_77987
MEKGTFTCLIDYHLPLLIEPLKSMAAEWRRKKDDWRRHFKEKMSQEQAHYHRKPWIRA

SEQ ID NO: 169673 - protein, 48 aa, Glycine max
  Coding DNA Sequence Number=SeqID_77988
  Subcellular localization annotation: CTP_CleavageSite=12; ConfidenceScore=5.15e-01
MAESSKKRKGSSTSAVAHRTSRPGVTGASPAPIPPSLPSSTLFSSDEQ

SEQ ID NO: 169674 - protein, 43 aa, Glycine max
  Coding DNA Sequence Number=SeqID_77989
MGSDQAPSFKKRFYHVKVKNPELASLRKLGQRMDQVQRQAFSK

SEQ ID NO: 169675 - protein, 142 aa, Glycine max
  Coding DNA Sequence Number=SeqID_77990
MGNEEGVQEQMKANMSALKDQMASMTEAMLKIQKSIEDNATAVASNTTREAKPVLQPAMNSGRDRSATSFNRRYSPQAYPYGLPPDFTPRTAPDDLSQAPTFEGQLPPHADYPLQEDDEGDAHLGPLLPPREPAPMSCPSQT

SEQ ID NO: 169676 - protein, 51 aa, Glycine max
  Coding DNA Sequence Number=SeqID_77991
MAAHPNVLLLQPEVTLLAQASWGLGSNPSSENYEHDKHDEFATINDLESHK

SEQ ID NO: 169677 - protein, 99 aa, Glycine max
  Coding DNA Sequence Number=SeqID_77992
MQSHSEVVILRFKNSKVDYVNKTEYKFNCWGVNVLSKVRLSGILQSFILMFLINASHGQLQFSTDLHLPYVIFKVKVFIILMLTLLELHFDFGCSPCSL

SEQ ID NO: 169678 - protein, 89 aa, Glycine max
  Coding DNA Sequence Number=SeqID_77993
MSSLRSLTLDSGGAVREAVVRGNGGAEQGGVGGGGGVHGQDGGVWRWRRRRGGGAGGSVSEAVSEDLQAAQQSRIRVVLKSCLALGSHI

SEQ ID NO: 169679 - protein, 266 aa, Glycine max
  Coding DNA Sequence Number=SeqID_77994
  Gene Ontology: Mol. function=cysteine-type endopeptidase activity; Cellular component=integral to endoplasmic reticulum membrane; Biological process=proteolysis
  Homolog annotation: Hit_ID=A7QMR1; Match level="QueryCoverage=65%, HitCoverage=45%, E-value=5e-88, Identity=90%"; Hit description =Chromosome undetermined scaffold_127, whole genome shotgun sequence
  Pfam annotation: Domain name=Peptidase_C13; Domain location=41-245; Score=-9.6; E_value=1e-10; Accession=PF01650.9; Description =Peptidase C13 family
MALGVSKLPMNMIMEVLLLIFLSYSVAYSSSAFESTMHTNNWAVLVCTSRFWFNYRHMANTLSLYRTVKRLGIPDERIILMLADDMACNARNKYPAQVFNNENHILNLYGDNVEVDYRGYEVTVENFLRVLTGRHETSVPRSKRLLSDEGSHILLYMTGHGGDEFLKFQDSEELQSHDLADAVKQMKEKRRRIMSPPYAYALEEEITGTKLIVSLTNRLTNKDSDFLCLCIGLRTHFWLILIMGIVRFKELLIMVDTCQASTLFSQ

SEQ ID NO: 169680 - protein, 1075 aa, Glycine max
  Coding DNA Sequence Number=SeqID_77995
  Gene Ontology: Mol. function=binding; Cellular component=kinesin complex; Biological process=translation
  Homolog annotation: Hit_ID=A7PFK4; Match level="QueryCoverage=92%, HitCoverage=59%, E-value=0.0, Identity=70%"; Hit description =Chromosome chr11 scaffold_14, whole genome shotgun sequence
  Pfam annotation: Domain name=TPR_1; Domain location=1009-1042; Score =6.9; E_value=0.79; Accession=PF00515.19; Description=Tetratricopeptid e repeat
  Pfam annotation: Domain name=TPR_1; Domain location=925-958; Score =17.7; E_value=0.04; Accession=PF00515.19; Description=Tetratricopepti de repeat
  Pfam annotation: Domain name=TPR_1; Domain location=967-1000; Score =3.2; E_value=2.2; Accession=PF00515.19; Description=Tetratricopeptide repeat
  Pfam annotation: Domain name=TPR_2; Domain location=1009-1042; Score =15.5; E_value=0.2; Accession=PF07719.8; Description=Tetratricopeptide repeat
  Pfam annotation: Domain name=TPR_2; Domain location=925-958; Score =23.8; E_value=0.00063; Accession=PF07719.8; Description =Tetratricopeptide repeat
  Pfam annotation: Domain name=TPR_2; Domain location=967-1000; Score =8.5; E_value=2.6; Accession=PF07719.8; Description=Tetratricopeptide repeat
  Pfam module annotation: Pfam domain module=TPR_1::TPR_1::TPR_1::TPR _2::TPR_2::TPR_2; Domain location=1009-1042::925-958::967-1000::1009 -1042::925-958::967-1000
MAPKTGKTKPHKAKGEKKKKEEKVLPTVIEITVETPDESQVTLKGISTDRILDVRKLLAVHIETCHFTNFSLSHEVRGTRLKDTVEIVSLKPCHLTIVQEDYTEELAVAHIRRLLDIVACNTSFASAKPPAGKSKDPTEPGSENGSETNPKSKPVDPNSDPANAKSDKADADISMCPPPRLGQFYDFFSFSHLTPPFQYIRRSNRPFLEDKTEDDFFQIDIRVCSGKPTTIVASRIGFYPAGKRPLVTHTLVGLLQQISRVFDAAYKALMKTFTEHNKDVFTIIVVSFQFGNLPYGFRANTWVVPPVVSDNPSVFPPLPMEDETWGGNGGGQGRDGKHENRQWARDFAILAAMPCQTAEERQIRDRKAFLLHSLFVDVSVFKAVSAIKHLVDIKQNSFSNSALPTSYEERIGDLTIKVTRDVSDASLKLDCKNDGNRVLGLSDEELAQRNLLKGITADESATVHDTPTLGAVLIRHCGYTAVVKVSGDRDLEGSPNSLEIDIEEQPEGGANALNVNSLRMLLHRPSTPQSSNAIQRIQSTDIECSHSTRSLVRKVLEESLLKLKEETTRHSKSIRWELGACWVQHLQNQATGKTEPKKAEEGKVEPAVKGLGKQGGLLKELKKKIDIRNSKAEVGKDISPCNGNDINKPEATKQELERQDEEKATIWKKLLSDAAYTRLKESKTDLHLKSPDELMEMAHKYYVETALPKLVADFGSLELSPVDGRTLTDFMHTRGLQMSSLGRVVELADKLPHVQSLCIHEMVVRAYKHILQAVVAAVDNVSELASTIASCLNILLGMPSPETNDEDITSCDELKWRWVENFLLKRFGCQWKDENGQDLRKFAILRGLCHKVGLELVPRDYEMDTASPFRKTDIHVACSSADGRTLLESSKTSLDKGKLEDAVNYGTKALSKLVSVCGPYHRMTAGAYSLLAVVLYHTGDFNQATIYQQKALDINERELGLDHPDTMKSYGDLAVFYYRLQHTELALKYVNRALYLLHLTCGPSHPNTAATYINVAMMEEGLGNVHVALRYLHEALKCNKRLLGADHIQFKFIQQQQQQRLIPLGGVGYMNQLPP

SEQ ID NO: 169681 - protein, 307 aa, Glycine max
  Coding DNA Sequence Number=SeqID_77996
  Gene Ontology: Mol. function=receptor activity; Cellular component =integral to membrane; Biological process=response to sucrose stimulus
  Homolog annotation: Hit_ID=A5BLW0; Match level="QueryCoverage=88%, HitCoverage=52%, E-value=5e-83, Identity=55%"; Hit description =Putative uncharacterized protein
  Pfam annotation: Domain name=HlyIII; Domain location=20-285; Score =199.0; E_value=1.2e-56; Accession=PF03006.11; Description=Haemolysin- III related
  Subcellular localization annotation: CTP_CleavageSite=40; ConfidenceScore=5.10e-01
MTSTTGQGVVARTLKIAKTAQRRKKMSEQYTHLVGFFIFAAMMVLGGCLSNKFKAPAMKLLTMGKEINGSRPATTGFLDSHLRHILVQPIIHELRDDGAKTIPIWPWFVFLAGGMGCLASSTLSHLLACHSKPFNLFFWRLDYAGISLMIVCSFYAPIYYVFYCNPYIRTFYLTSISVLGVLAIITLLAPSLSSRHLRPYRASLFLCMGFSGVIPAVHTLATHYDHPHVVVALGYELLMAILYTTGAVFYVTRIPERWKPGAFDIAGHSHQIFHVFVVLGALAHTLATLLVMEFRQGSPTCNTQHCQ

SEQ ID NO: 169682 - protein, 200 aa, Glycine max
  Coding DNA Sequence Number=SeqID_77997
  Homolog annotation: Hit_ID=Q1RU80; Match level="QueryCoverage=48%, HitCoverage=79%, E-value=2e-10, Identity=37%"; Hit description =Putative uncharacterized protein
MDHVADEVHEQPEEAAVDDEVVDAEECPELKLPSHGRKVQKFGRPAAEIEGLVVTITLDDVASLLHLPITSVFYSFKTLHIDEAVLLLVELLEIVTHVHVVFLNVFRDLTQSGSYAWGTTTLVHMYDNLNDASKSSVRQLAGYITLLQAIDVEDYHERKPRVCRWKSAEWRRRKGDWRRHFKEKMSQEQTHHHRKPWIRA

SEQ ID NO: 169683 - protein, 115 aa, Glycine max
  Coding DNA Sequence Number=SeqID_77998
MRDKRVFSLSFRDPNSHRLACGSPGAPNYFNLKEPARLGEREGELRKGFQGSEVERIERIKKEEEERRGNEAEAAKKAYIAWDDNDSSEGSEKEEINLLTKNYESEEDDSQEIKD

SEQ ID NO: 169684 - protein, 277 aa, Glycine max
  Coding DNA Sequence Number=SeqID_77999
  Gene Ontology: Mol. function=DNA-directed RNA polymerase activity; Cellular component=chloroplast; Biological process=transcription
  Homolog annotation: Hit_ID=A5B3H8; Match level="QueryCoverage=81%, HitCoverage=18%, E-value=1e-37, Identity=43%"; Hit description =Putative uncharacterized protein
  Subcellular localization annotation: CTP_CleavageSite=48; ConfidenceScore=5.32e-01
MTLASSFPTPQVHAFDNPARSRSHLHIIKRNKPHRTLHFLLIPTSPPSSALLFSCSSFPLTHSDPILQFRHHHLLSTDGNFVVEDLSAAVEEDASPAAARIFVQEPPWLFLKGLLMQEEEMRQKGKEREKYNLLRRRQIEAETEAWERMVEEYRELEREMREKMLAPNLPHVKALLLGWFEPFRAAVEAEQTAHHARPKKQQDSIAPHVDDLPADKVAVIVMHKMMAMVMESEEGCVQLVHAAIHIGLALEQELSPFEVVPGSNMIASIGGYLMSRP

SEQ ID NO: 169685 - protein, 185 aa, Glycine max
  Coding DNA Sequence Number=SeqID_78000
  Homolog annotation: Hit_ID=Q5NRP4; Match level="QueryCoverage=58%, HitCoverage=6%, E-value=1e-07, Identity=33%"; Hit description =Putative gag-pol polyprotein, identical
  Pfam annotation: Domain name=zf-CCHC; Domain location=130-147; Score =27.2; E_value=6.2e-05; Accession=PF00098.14; Description=Zinc knuckle
  Subcellular localization annotation: CTP_CleavageSite=57; ConfidenceScore=5.65e-01
MRSSSSINKSSSIDVSSSKSSPSSSKTRFAKSTLGGTQDSCNTNHGDIDAKKVALVSLDEESDPTKDITSSINSEWDSNGMTTFSIGTTKCKDQAQGILGAAPSKPKEDKGKTIEKSTPKTSSRARTSKIKCFKCLGRGHIASQCPIKKTIIMRGQDIYSSQEETTSFRSSSGSEDEVRDEESSE

SEQ ID NO: 169686 - protein, 54 aa, Glycine max
  Coding DNA Sequence Number=SeqID_78001
MGFLMLEEGDEDAQNKRGPLTQKMALGAMVARLGELFLQPEVTLLTQASWLLHP

SEQ ID NO: 169687 - protein, 156 aa, Glycine max
  Coding DNA Sequence Number=SeqID_78002
  Gene Ontology: Mol. function=hydrolase activity; Biological process =purine base metabolic process
  Homolog annotation: Hit_ID=O65755; Match level="QueryCoverage=41%, HitCoverage=34%, E-value=4e-26, Identity=87%"; Hit description =Putative deoxycytidylate deaminase
  Pfam annotation: Domain name=dCMP_cyt_deam_1; Domain location=1-66; Score=1.7; E_value=0.00039; Accession=PF00383.13; Description =Cytidine and deoxycytidylate deaminas
MVASCHNMVLCNTDPTAHAAVTAIREACKKLKKIELADCEIYASCEPCPMCFGAIHLSRIKNRVGSFNEYRKVHNKFLASARRFMTGLAFWTILGKNLDKEAIRPAKLCASFKFLRLLISRMHYVILSELAEHFLQVFDMCWQIIRLDEHVIDIYF

SEQ ID NO: 169688 - protein, 198 aa, Glycine max
  Coding DNA Sequence Number=SeqID_78003
  Homolog annotation: Hit_ID=A2Q1A3; Match level="QueryCoverage=50%, HitCoverage=35%, E-value=4e-13, Identity=30%"; Hit description=RNA -directed DNA polymerase
MARCLILMGIRCVIRSAPCLLGYLYPTGWGGSCRRIEVFVPSQCSDYSSPPPPHTSLDSFSGMVVFVGVPHFHFARRVPFVWLLMKISLMLPNFAKSGFGAFGEMESWQSEAADYLNCSLLTLPFTYLGVPIGANPRRYQTWDPIISKIPHKVVDKLVRLQRNFIWGGDQQQRKIAWVNWETGAGLKIWWLEGLERRN

SEQ ID NO: 169689 - protein, 393 aa, Glycine max
  Coding DNA Sequence Number=SeqID_78004
MAPLSEGEAAEHFAEKGLAGEEGQERGKFVVVDQDIPSFFPFFYCVIWVLNNENYDEAKLARETANGKVMMEEEVDPLIKKEKHKEHKVKNVGCKDHFLDNPIPKLIKKEVEAGDAAKPHSFQDSDFHKKIVMMKQKSSLDPDLIMKVAGTSMVLESWNVNLLGEPLALNFVVSMDDSSTMGPRQKGCTKAVMMIHVIRSPSLSPPPPKLPYLSLHKVASGFAIDSLWKNTKEAHPVSVNDLVLKDEKESKNLEFNWVARFILLNLDACIADDTLIEKRWKKIAVTPMEWRSKVFEMVCGEGEGDVATQPRVGGDAYSDSLACKVEFFDTVAEDRAMLVDEGVDIEENRNNKEAVEEEEDDDGDQRFMRLLAAEVDMKSPVSEAPDNNDVGYP

SEQ ID NO: 169690 - protein, 125 aa, Glycine max
  Coding DNA Sequence Number=SeqID_78005
  Gene Ontology: Mol. function=DNA-directed RNA polymerase activity; Cellular component=chloroplast; Biological process=transcription
  Homolog annotation: Hit_ID=A7PFM9; Match level="QueryCoverage=100%, HitCoverage=12%, E-value=3e-57, Identity=82%"; Hit description=DNA -directed RNA polymerase
  Pfam annotation: Domain name=RNA_pol; Domain location=1-125; Score= -197.9; E_value=0.018; Accession=PF00940.10; Description=DNA -dependent RNA polymerase
  Subcellular localization annotation: CTP_CleavageSite=44; ConfidenceScore=5.05e-01
IRTSLQLLALQREGSAVSVKKQRSAFPPNFVHSLDSSHMMMTALACNDAGLCFAGVHDSFWTHPCDVEKMNQILREKFVELYNMPILENLLEGFQTTYPGLAFPPLPKRGDFDLQKVLDSPYFFN

SEQ ID NO: 169691 - protein, 139 aa, Glycine max
  Coding DNA Sequence Number=SeqID_78006
MQQGQTDILIARFPDPNYGVKMGFSKEAQNIQWWFQSQKRCKDKLKLTRNKHRIMVTSRKTMKVKSGFVLNRNREASLEDSASVEGFLLVWGFNGAQWCLWWLLVAVGDGERAWDVGNGFGRKKEKEMAFFQGYTKSKG

SEQ ID NO: 169692 - protein, 261 aa, Glycine max
  Coding DNA Sequence Number=SeqID_78007
  Homolog annotation: Hit_ID=Q5W7C9; Match level="QueryCoverage=49%, HitCoverage=53%, E-value=6e-15, Identity=42%"; Hit description =Unknow protein
  Subcellular localization annotation: CTP_CleavageSite=59; ConfidenceScore=5.53e-01
APLSFKRIRGMSSPGGILNALATALHGSIRTAPSIHRLRARTTGVSNPIRSPSFRLSVSVSAQQSAFAVGVLSDLYAFTAPPEIPSAPTVLQLDALRPIIPDNACILCLTAAAGTELADAYSPDTVIASSPGKEVHDPPSVADHPLGPATDHRLGKLLPHQLANQTRAPPRADSSFCSSAYGVLAAVSSCCSPPKGRIELSMRFLVALLIASLFVDKADSEFSSIPRHNLYPGASYSTGVRSQKYSPPTPRARTDNFTTSS

SEQ ID NO: 169693 - protein, 74 aa, Glycine max
  Coding DNA Sequence Number=SeqID_78008
MGGGRMNENAIYAAPKKGLEWRIALSNHYAWLQARGLRTDERKRNSWDSEKGLRMQNCTKQSLRMAPNSWVEDA

SEQ ID NO: 169694 - protein, 112 aa, Glycine max
  Coding DNA Sequence Number=SeqID_78009
  Gene Ontology: Cellular component=integral to membrane
  Homolog annotation: Hit_ID=Q7UBK4; Match level="QueryCoverage=63%, HitCoverage=43%, E-value=2e-30, Identity=91%"; Hit description =UPF0114 protein yqhA
DIPHPAAYLQRQRVGSDSDAAFAGRYDAGGRAAGDGKEKLNWLGKMDATSLKNKVAASIVAISSIHLLRVFMDAKNVPDNKLMWYVIIHLTFVLSAFVMGWLDNMSKVEKKS

SEQ ID NO: 169695 - protein, 179 aa, Glycine max
  Coding DNA Sequence Number=SeqID_78010
MTAAPYTLPLADFQRFEAMLRSIHQGQIILLQSLQLVAPLDSILTIEQFNEWVAWPGTQPPLHREDEDLAAQVPHQSEDESLESSTPEPLIRKRRVVVTQEAVATSEKSLEATSELLALVADTTSPQQAANPSTPEDQTTPDLSLNTSPVATHVLHLLEEEEVLCRSSVVARPEASGTV

SEQ ID NO: 169696 - protein, 319 aa, Glycine max
  Coding DNA Sequence Number=SeqID_78011
  Homolog annotation: Hit_ID=A8Q5G4; Match level="QueryCoverage=40%, HitCoverage=93%, E-value=2e-48, Identity=75%"; Hit description =Senescence-associated protein, putative
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSGLLVIGGEGRIKATRAESQWIVAARPLCHLQYPVAYLSRLQRILPAARWELRFKASRRANPPHEGHQRHVPLGGRGPLLLGKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPAQPKSPADN

SEQ ID NO: 169697 - protein, 147 aa, Glycine max
  Coding DNA Sequence Number=SeqID_78012
LFLDGGKGYNSAVECHLDVVEVISSSLIIPKPNRTPVEYEAPGYKLCLGMEENSESALSTNKEAISNATRNLMESSILAQDERWRHALHMQVGREVVFPVADGWKRLLYPVAEEQKEESARGGARWGIFRNGRKPDGAMPREGPRPT

SEQ ID NO: 169698 - protein, 612 aa, Glycine max
  Coding DNA Sequence Number=SeqID_78013
  Homolog annotation: Hit_ID=A4WAQ4; Match level="QueryCoverage=100%, HitCoverage=61%, E-value=0.0, Identity=94%"; Hit description =Virulence protein SrfB
  Pfam annotation: Domain name=SrfB; Domain location=1-612; Score =849.0; E_value=2.5e-252; Accession=PF07520.2; Description=Virulence factor SrfB
MVNGRYTLPGINGGSPEVVKPETTIPLHQSLPVLDGVWLPVPFLRFNPPRTFVEGPDNWARVQVRKLDTPDTAGNTHRVTLALDSQIAGHATSALSPVENDILNGTRFALAWRDAEVENFLDQTWIDGWLREAFTQYADGVENRSERDLQQAMRSFEYQAHWLNLLTMLGEQLTVPEVKFVTHTLSTPAIPVDLILDVGNTHTCGVIIEDHGDANDGLRQTAELQVRSLSEPQFLNEPLFTSRLEFSEARFGKQHFSVESGREDAFVWPSIVRVGDEARKLAMQRLGTEGNSGISSPRRYLWDETPVVQDWRFSQMNSKTQREPLATAFPLMNLMNDDGEPLFTLPQDERLPVFSPQYSRSTLMTHMLCELLAQALGQINSVATRLRLGFPASPRQLRTLILTLPSAMPKQEREIFRRRMFEAIAIVWKAMGWHPQDEDFVTRKQQEKSVVPVPEIQMEWDEASCGQLVWLYNEAISRFGGQTEAFFASLARPDREPEPGAQPGRALRVASIDLGGGTTDMAITHYQLDDGSGNNVKITPQLLFREGFKVAGDDTLLDVIQRYVLPALQTQLQKSGIADASLLMASLFGDSGRIDTQAVLRQQTALQLFMPI

SEQ ID NO: 169699 - protein, 83 aa, Glycine max
  Coding DNA Sequence Number=SeqID_78014
MAKFDPDIVLEFYANAWPTQEGVRDMRSWVRVLEEGQESEYMARGGIGPMGLMRRPSPSCCAYRDRILPGPLPGDEYKSCVPA

SEQ ID NO: 169700 - protein, 107 aa, Glycine max
  Coding DNA Sequence Number=SeqID_78015
MSVKILIGRLGVHDKTNHTLARKPVRVTLFCKNAPTIWDQHRLKGALKPGVFTLKAYTPKSPSGPLPPNLGSLHMFILIPIAINASLTSKRAHVCIVTTIAQSLTVS

SEQ ID NO: 169701 - protein, 97 aa, Glycine max
  Coding DNA Sequence Number=SeqID_78016
MERYLQHLVRQQAANHRGQVQIHECLYQLSLSQQGQGFVPFACPTLDQFRAEVVWPRDWPKAQAGEAPAEAPGDAEDACMDEEMTDLLGFLGGSRAT

SEQ ID NO: 169702 - protein, 166 aa, Glycine max
  Coding DNA Sequence Number=SeqID_78017
MDNEEGVQEQMKADLLALKDQMASITKAMLKLQKTIEDNATAAASNTAREAEPVLQLVINLGRDKNATGFNRRYSPQAYPYGLPPDFTPRTAPDDLSQAPTFEGQLPPHADYPLQEDDEGDAHLGPLLPLKDPTPHELPQPNIVCHVPSPSAPVKELVPFASTKPT

SEQ ID NO: 169703 - protein, 277 aa, Glycine max
  Coding DNA Sequence Number=SeqID_78018
  Gene Ontology: Mol. function=sugar:hydrogen symporter activity; Cellular component=periplasmic space; Biological process =carbohydrate transport
  Homolog annotation: Hit_ID=Q2NVD6; Match level="QueryCoverage=99%, HitCoverage=81%, E-value=1e-121, Identity=80%"; Hit description =Sugar ABC transporter periplasmic component
VLTFYDGRYDASVQNDQAATAIQTRADAIIVNPMDFEANIDIVTNANEAKIPVVVTNARLNTDAMTSEVVSNDELGGYLEAKAVLDKLDCKNHKVNVVIIEGPKGGSGEIQRGKGNDKAIAECGAGQVTVLERKTANWSRAEAQPLMENWLQKHRGKINGVIGQNDEMALGAIEAIKGAGLNVKDFAIAGVDGVSDAIHAVQAGEMVSILQDAKGQMQGSIDVALRAVKGESYQPQSDIWKQYAKDLKWEGGTQKHYYIPWTVVTAENAQSLLDARK

SEQ ID NO: 169704 - protein, 53 aa, Glycine max
  Coding DNA Sequence Number=SeqID_78019
LDRVQQNAETNYGHSASCINQEEQVRQYREDVSVLIIFKFLQVPLAGRFTGRK

SEQ ID NO: 169705 - protein, 131 aa, Glycine max
  Coding DNA Sequence Number=SeqID_78020
  Gene Ontology: Biological process=transposition, DNA-mediated
  Homolog annotation: Hit_ID=Q1J7G7; Match level="QueryCoverage=22%, HitCoverage=42%, E-value=2e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDTIDVMDWCE

SEQ ID NO: 169706 - protein, 242 aa, Glycine max
  Coding DNA Sequence Number=SeqID_78021
  Homolog annotation: Hit_ID=Q51617; Match level="QueryCoverage=15%, HitCoverage=55%, E-value=2e-11, Identity=89%"; Hit description =Putative uncharacterized protein
MTVKTSDTCSSRRRSQLVCKRMPGADKPVRARQRVFDGCRGWLNYAASEQIVLRVHHMRAIGAGLFAITPAGERGMCCKAIKLGNARVFPVTTLIPEATTHLVCILRQDFTRAAAKRRVRIMRTNMTTFSWIWMTDRAHKTPSGPGEVQQVPGVSSSGIAPARHPVDPKKSNRFYGVPVTSSKGIRPPTNRAFIKKYCVSRQAQGETPQQPGDGRQRATDAPPSPLEFTSWPTNRQPSPEPK

SEQ ID NO: 169707 - protein, 224 aa, Glycine max
  Coding DNA Sequence Number=SeqID_78022
  Gene Ontology: Mol. function=helicase activity; Biological process =viral genome replication
  Homolog annotation: Hit_ID=Q2QQ02; Match level="QueryCoverage=100%, HitCoverage=16%, E-value=2e-46, Identity=41%"; Hit description =Putative uncharacterized protein
MVHGPCGISRAESPCMKEDKCSRFYPKMFQPYTVLDADGYPDYRRRNNGHTIEKNGVIIDNRYIVPYNPKLLKKYQAHIDVEWYNQNTSIKYLFKYINKGYDRITVVLIHDDNDPIRYGSTHNDEIKEYLDCRCWQLRKKGYTIGRLLWVPPITGKLFYLRMMLTVCKGPTSFEDLRTVGNVQYPTYREACLVMGLLQDDHEFIEAIKEAKHWGSAHYIRKLSV

SEQ ID NO: 169708 - protein, 52 aa, Glycine max
  Coding DNA Sequence Number=SeqID_78023
MNSLSEHAALSEFISTHCPLRSLAHILAADVQLSGRCPAKPILQKLNFYNFR

SEQ ID NO: 169709 - protein, 57 aa, Glycine max
  Coding DNA Sequence Number=SeqID_78024
MGLRIKMENGELAHSATQELPGAPDSKWRMENWRIALRNNFAGLQLEGGGCMNRARQ

SEQ ID NO: 169710 - protein, 79 aa, Glycine max
  Coding DNA Sequence Number=SeqID_78025
  Subcellular localization annotation: CTP_CleavageSite=66; ConfidenceScore=5.14e-01
MEAMFTTSKDWKAVSNDSSTASTYGIEDGQLTKTSSSPDTMTKCPSTTNFSFWEVDLSPFLSTAVVEGTPWNLALDGKR

SEQ ID NO: 169711 - protein, 123 aa, Glycine max
  Coding DNA Sequence Number=SeqID_78026
  Pfam annotation: Domain name=G-patch; Domain location=2-43; Score =19.3; E_value=0.00089; Accession=PF01585.14; Description=G-patch domain
MMVARVMLGYGYEPEMGFGMNNDGRTSLVSTRGNRGKFGLGYKPTQADIRKRAPPCHISRSFISADLGHKGQFVAICEDDSPIRCDRPVPRTIFLCRTLISSWIIRPISLCFPSWMGSPVTIR

SEQ ID NO: 169712 - protein, 122 aa, Glycine max
  Coding DNA Sequence Number=SeqID_78027
ASKSPKGMEFRARKDKELRKSSNDVIGGYHQWLKAWTQWKTWLPQLKISSEEEAETPEESEEEKFKATTNRVKKECDKPRDVNMRTQALEGQKRRVEGGRYDIRGQVKGLTKIEKVLVRTVE

SEQ ID NO: 169713 - protein, 366 aa, Glycine max
  Coding DNA Sequence Number=SeqID_78028
WNAVQRKDKELRGNNNGIAGGYHKWLKARTQEITWLPKLKISSEEEAETPEERKKVQALKAKLERTQVVKEKFKTTTIRVRKECDELRDVNVATVEAVERDQSRVEGMILEVKLKACQRSKRSLSEQLSKTEENMWAIIDQYKEKLSLAAGHEQRLKDEHAKVLALQAEREARERVIDSLHGEAMMWMDRFASTLNGSQELPRLLAKTKAMADVYPTPKEDVQEKMKANMEAMKDQMTSMMEAMLSMKRMMESNAAAAAATSAAAKADPTHPSAINQSKQSIPDMVGHRGEVPTTPTCRGRREEPRDHVRVDFDPYPTFATKGPTCSGIPKPNTAGAPQHRLLQPLHFLVGRLPPAVEGREKLDLI

SEQ ID NO: 169714 - protein, 128 aa, Glycine max
  Coding DNA Sequence Number=SeqID_78029
MAESSSNSGKGQNVVEDNQAVNEILFKDELQLEFIMSVGIVKDFELSMPYMTKLSNYKWNLCLPVQGFEDILLGFFKEGEDVREAISVTVYDKGCHEFDMMLKKMGKGFQPLLCAKPEGGSFSATNSA

SEQ ID NO: 169715 - protein, 249 aa, Glycine max
  Coding DNA Sequence Number=SeqID_78030
  Gene Ontology: Mol. function=protein binding; Cellular component =nucleus; Biological process=embryonic development ending in birth or egg hatching
  Homolog annotation: Hit_ID=A7Q3S6; Match level="QueryCoverage=98%, HitCoverage=94%, E-value=4e-64, Identity=48%"; Hit description =Chromosome chr13 scaffold_48, whole genome shotgun sequence
  Pfam annotation: Domain name=BTB; Domain location=72-184; Score=76.2; E_value=1.1e-19; Accession=PF00651.22; Description=BTBPOZ domain
MPLILRPPRNTICGACYEGVRSIINMMSNVESEKVKAMANPNQNSSPVSRRNSKQTEQFNQQKEDMVFLRGFVAAFKAQIHTDILVSPGRNGPPIPAHKSVLAARSEIFKNMLECDECKAAPSNAITIPDLNHEELESLLEFLYSGTLNVEKLEKHVYALSQAADKYVIPHLLKHCERYLLSSLSTSNALETLEIADTCSNHNLKETTLNFLVKNIEHMVSSPKFEAFVHRSPHLTVQLVTRAFVNGAK

SEQ ID NO: 169716 - protein, 199 aa, Glycine max
  Coding DNA Sequence Number=SeqID_78031
  Gene Ontology: Mol. function=binding
  Homolog annotation: Hit_ID=A7Q3S2; Match level="QueryCoverage=90%, HitCoverage=67%, E-value=8e-57, Identity=64%"; Hit description =Chromosome chr13 scaffold_48, whole genome shotgun sequence
  Pfam annotation: Domain name=Arm; Domain location=83-124; Score=16.6; E_value=0.086; Accession=PF00514.14; Description=Armadillobeta -catenin-like repeat
MCTCVVCSRLLVVNDELTIEEEAERKVGWLLKTIFFVTAGVAGYHFFPYMGDNLMQQSVSLLRVKDPLFKRMGASRLARFAVDDERRKKIVEMGGAKELLNMLSTAKDDRTRKEALHALDALSQSAIPDTFLVSMLIFKNPVQINYFIVIDEALASLHHAGAISVIRSAPNSLEDAEVERFKLSLMKRFQDLRYDDVSS

SEQ ID NO: 169717 - protein, 91 aa, Glycine max
  Coding DNA Sequence Number=SeqID_78032
  Gene Ontology: Mol. function=metal ion binding; Biological process =metal ion transport
  Homolog annotation: Hit_ID=A7Q3R3; Match level="QueryCoverage=71%, HitCoverage=92%, E-value=3e-16, Identity=63%"; Hit description =Chromosome chr13 scaffold_48, whole genome shotgun sequence
  Pfam annotation: Domain name=HMA; Domain location=23-83; Score=32.2; E_value=1.9e-06; Accession=PF00403.17; Description=Heavy-metal -associated domain
MFSVCNYETEKVFLVACYHQVVEVKVGLHCEDCIKKILKAIKKIEDIETYNVDTQLNKVMVTGNVTTEQVIRVLQKIGKNATAWEDAETNK

SEQ ID NO: 169718 - protein, 788 aa, Glycine max
  Coding DNA Sequence Number=SeqID_78033
  Gene Ontology: Mol. function=solute:hydrogen antiporter activity; Cellular component=integral to membrane; Biological process =regulation of pH
  Homolog annotation: Hit_ID=A5B8C8; Match level="QueryCoverage=92%, HitCoverage=98%, E-value=1e-129, Identity=32%"; Hit description =Putative uncharacterized protein
  Pfam annotation: Domain name=Na_H_Exchanger; Domain location=43-430; Score=109.5; E_value=1e-29; Accession=PF00999.12; Description =Sodiumhydrogen exchanger family
MAAASEIGNKSMVCQDPHSFGHLDIWKGGNPLESPSCLLYMQVSLMTMVTQFMDACLKSLGQSSIVSQIMGGVLFGPSMLGNKKILGLALFPTKGAVVLDTVSLFGLMFFFFIWCVKMDIATLMKTEKVAITLGISVFAFTLIIPTGLAFLMMKYIAMDGSLAKALPFLAMSQTLTVFISIAVLLTDLKVLNTDIGRLTMSAAMFADVAGFILTVILFAILQDQSGSFVRLACILLSIVGVWLLVIFVMRPTIIWMVKHPGRGSVNEICLVCIFLLVLLSAFVSELIGQHFIMGPILLGLAVPEGPPIGTALMSKLETICTAFLYPIFLAVNGLQTDFFKIDKQSLWIVCVILIVAFFVKIGAVMLPGYYYNLPLKQCFVIGLFLNGRGIAELATYNMWKRGKLISEQEFALMVASIIVVNCILVPLIRYIYDPSELYQTGKRCTIQHTRRDLELRVMVCIHNNENLPMILNLLEASYASRESRIEVTALVLVELQGRARPILFANQEQPHDEMRSMSCNASHIDNALRQYAQQNEGYVSVQSFTSISTFETMYDDICKISLDTGSNILILPFHKRWEIDATVEISHRTIQTMNIEVLERAPCSVGILVDRGILSPSPSLLMARAAFYVAVFFIGGQDDAETLAYASRMENSKDRKRDSDLIDEYRYYNAGNQRFELMNEVVKNGIEMSTCIRRLIDYFDLVMVGREHPDSVIFQGHDQWSECQELGVIGDMLASPDFVTKASLLVVQQQKIRGTLVKHNVNANPVPNHRDQLVYDIPNDTVDKYDRV

SEQ ID NO: 169719 - protein, 656 aa, Glycine max
  Coding DNA Sequence Number=SeqID_78034
  Homolog annotation: Hit_ID=A7Q3Q5; Match level="QueryCoverage=67%, HitCoverage=96%, E-value=1e-149, Identity=55%"; Hit description =Chromosome chr13 scaffold_48, whole genome shotgun sequence
MAYNFPDVFCWIQSLPPISEWETSSMSLNICSSSSSSCQPHCNIPIHLWTSKPFKPSSTTITNKTHNNNKLIDDEETISNLFVNFIQAILLYGSNKNSTPFLRFPNLDSITSNNFSDVFNLSFFTLLFLVCIYEAPAADFRSGCISNLKDHLTVTNWVGELEAHNNPFRTPCPLFSYAFSTIGLWKVQLYCPLLVMDVENSKSNPASERLQFSLRYHHVEGVLQFNHKVLIKEEWAEIMVDIDNIRCDVIKLVNESLMSQRGVGAAEKHFPSRISLQLTPTLQDQVLSLSVGKSSENPRKEIGVDKSVEASFEPSNPLALKVSAGESSTVSLKPWKFEESVYGYSANLNWFLHDSVDGKEVFSSKPSKFAMLNPKSWFKNRYSSAYRPFNKEGGVIFAGDEYGEKVWWKVDKGAIGKTMEWEIRGWIWLTYWPNKRVTFYNETRSTSVGLHSSINKNQREEEKKALMGEIKEECTSLDKSEQEKQLHSKVSKVALYSSGESKAIAKLEVATNGLCEENVIDEGGYRIVYHGLFPDGTKIAGDLDLICPKVFGAPGGSHYAHYHLVGRRTARREILAEMGYEFTVMTADIDEKGIRREKPEDLVMALVEAKRCSALYIGLSVVIDVECLSFYIGYSTTVVENLAFYIDPAVVTVIEC

SEQ ID NO: 169720 - protein, 119 aa, Glycine max
  Coding DNA Sequence Number=SeqID_78035
  Subcellular localization annotation: CTP_CleavageSite=35; ConfidenceScore=5.04e-01
MANKDSSNEKDKDSSNEKDNYSNLINQNHPQAYVRSSPSQSRQPSTRVECVCPVGSSGHALNTGCMLSVLAHDSCLLMWLFALSELLKLNDFDSLSEEVELSMTIQFFNPLSCLCYNFT

SEQ ID NO: 169721 - protein, 50 aa, Glycine max
  Coding DNA Sequence Number=SeqID_78036
MTKARQKGVRKEKEGEACHPARPGELGCFLQKAPPGRPKWVWLLFAPPFY

SEQ ID NO: 169722 - protein, 219 aa, Glycine max
  Coding DNA Sequence Number=SeqID_78037
  Subcellular localization annotation: CTP_CleavageSite=80; ConfidenceScore=5.23e-01
MPPKVSSSFDRGGRSGTKGKDVILALPEPITKKATTSSSGSPTQTGSSTQKGKLEGSLTQIKPESSTQESPKPTTTKQIVADYAWSIQTLLALEDIGLTRVPKLAKKTWAAMASESDDDSEIDLQKQIQKAKQTKTIFPEEVQQGFQQFTKLFNSKESRIPADLKYGKTENSKQYPPLQRHAFVKWWSQFDTSKAAPEQVKNWFQSNPEFLKPADPETS

SEQ ID NO: 169723 - protein, 70 aa, Glycine max
  Coding DNA Sequence Number=SeqID_78038
MLLVEVLDTAFPTSMIRPSKVGMIPPPWIVPVAGEHKLQAIQLLQIVAQKGKGLCGGRQRSINHRVWRQV

SEQ ID NO: 169724 - protein, 159 aa, Glycine max
  Coding DNA Sequence Number=SeqID_78039
  Homolog annotation: Hit_ID=Q2HV50; Match level="QueryCoverage=68%, HitCoverage=64%, E-value=1e-08, Identity=31%"; Hit description=H+ -transporting two-sector ATPase, alpha/beta subunit, central region, related
MFHQPEQLWNRILISKYQGWRGLDQGLHKQHFSTWWADLKALNQDHNMTVVSKQFCWKMGRGDQILFWEDAWAEDGIPLKDQFPDLYSISSQRNHIVADMGSFTWRLLWDRLPTKDNLAKRQILINNDLCPFCHNKPESAPHLFFTCDKIQPLWWEFLS

SEQ ID NO: 169725 - protein, 66 aa, Glycine max
  Coding DNA Sequence Number=SeqID_78040
  Subcellular localization annotation: CTP_CleavageSite=47; ConfidenceScore=5.21e-01
AHLGGEAPSSMAYSLVDGASSHLFSFVFRCISMGSSPFACPTSEQFGAEVAWPRDWPDAQAGEEPA

SEQ ID NO: 169726 - protein, 58 aa, Glycine max
  Coding DNA Sequence Number=SeqID_78041
MSMSARKDDRSKSKKKNLMRIMKQAKYSLKAQVEKDEGPSGEGQCPRVEKDEGPSGEG

SEQ ID NO: 169727 - protein, 130 aa, Glycine max
  Coding DNA Sequence Number=SeqID_78042
  Gene Ontology: Mol. function=metal ion binding
  Homolog annotation: Hit_ID=Q53J16; Match level="QueryCoverage=39%, HitCoverage=27%, E-value=5e-20, Identity=84%"; Hit description =Pollen-specific protein SF3, putative
  Pfam annotation: Domain name=LIM; Domain location=11-63; Score=22.4; E_value=1.4e-05; Accession=PF00412.13; Description=LIM domain
MASFAGTTQKCKACEKAVYLVDQLTADNKIYHKSCFRCYHCKGTLKDSDLNVRKPVEHSSDAKLAGESDPLGELMKILFYVYQNPVEVPWEANQFGLPEIGAKFYITHADLAEIISGDKCLNIAILQLWT

SEQ ID NO: 169728 - protein, 134 aa, Glycine max
  Coding DNA Sequence Number=SeqID_78043
MSLATLFGKLQQHEMELVRLHHHEENDIKRKGITLRTSSSFIQEESDKEDLTETEEDDDDFRLFVKRFNKFLRNKRNKRKSNINTKKKEEDSSLAPSCYESNQPWHMRSDYLVFERRIEKSDKRNLKEKKEKKA

SEQ ID NO: 169729 - protein, 123 aa, Glycine max
  Coding DNA Sequence Number=SeqID_78044
MAQPPPRERTLREMTASDFTYESLCIQYPDEGVPYVLKTGIIHLLPKFHGLAAPGCPRRSYLSKGFSSFSGGLYCGKRLTILPYSQGLSNMEKSMIDASSGGALGDMIPAEARNLIEKMVSNS

SEQ ID NO: 169730 - protein, 57 aa, Glycine max
  Coding DNA Sequence Number=SeqID_78045
MVQKGLFSNEEGVLSLCEDIDRKGLRNFFAIVYLLSADPALSAQSSRAKLSLLSLSA

SEQ ID NO: 169731 - protein, 116 aa, Glycine max
  Coding DNA Sequence Number=SeqID_78046
MCLSVLLSCPTTFGIGWCTVAERVGSALAAELTVAAVAALFSISCLIPSMASIMEAICSFKADMLAFICSCTSSWSPIILDLDLVDKSGAFAPTYPPLERKSDLRSSSLRVNQVTL

SEQ ID NO: 169732 - protein, 52 aa, Glycine max
  Coding DNA Sequence Number=SeqID_78047
MGLRSKIFLGNGQMPGWIQRQRPIKVNGNAATVFYAMSFPAFRYLGTDASRG

SEQ ID NO: 169733 - protein, 89 aa, Glycine max
  Coding DNA Sequence Number=SeqID_78048
MEILGGEAPSSLAYSLVDGASPLLFSFSFRCISMPPQKPHKQASIKCYQSARAFCVEGRSPEFEEPRDLRSNPLQDGEDEAILPPKGIG

SEQ ID NO: 169734 - protein, 185 aa, Glycine max
  Coding DNA Sequence Number=SeqID_78049
MEACSAVGDLLQQMIDQGRLEVGDEGGEEQHICMQSADEEGLRKPKSLVIHFTRDAAPQTPRQPSVVRPIPFPYKNSHAIPWGYAPPSERNEGVTDISLLSAKVTNITELSGMTRSGRVFAPPDLPANAEGKAKMTEGKNVKVIPVPDEDVPMKGLSERRDGCDKKEVSLEEAGESSALFNKASS

SEQ ID NO: 169735 - protein, 261 aa, Glycine max
  Coding DNA Sequence Number=SeqID_78050
  Homolog annotation: Hit_ID=UPI00016621D1; Match level="QueryCoverage =80%, HitCoverage=40%, E-value=2e-17, Identity=33%"; Hit description =UPI00016621D1 related cluster
ATRLHLKRLHALISKDYTSHLRGLHVLAIRGLHALTFRGLHVLAFRGSCTFTFRGLHVLAFIGLHAITFRGLHVLAFRGLHVLAIRELHALTFRGLHVLAFRGSCTFTFRGLHVLAFKGLHALTFRGLPVLAFKGLHALTFKGLHALTFKGLHALIFKGLHALTFRGLYVLPFRGLHVLAFGGLHALAFRGLHVPLFKRLHALAFRGRHVLAFRGLRSPSPFEGYASSLLVGSISTPVATYPFTGERGEAHGCVFQRRKMR

SEQ ID NO: 169736 - protein, 208 aa, Glycine max
  Coding DNA Sequence Number=SeqID_78051
GLDWLSKLKIINVENFEAPEEDEEVQALKLELGKARLAKEKFKLVATDILKECAELREENAATARALERETKRARKEEHDQITRLQLLFGETLDSSARSGPFDASPEIEIRGWWTLGDSVTRRRYVGELPLLRTICRSSGGIIGNDFPILRGGTVTSPEWVWARTAMGIPMWSALGGTRTNMGWGMNPGNREEGMHRQDFRQIGHGPA

SEQ ID NO: 169737 - protein, 96 aa, Glycine max
  Coding DNA Sequence Number=SeqID_78052
MTKARQKAVRKENEGRACHPARPGELRCFLLKAPPPGELPGRPKWARLNFTDCALTLPFDFRHVSELHELPNDGCQVPQSGQTRVASQQRMVPGRN

SEQ ID NO: 169738 - protein, 115 aa, Glycine max
  Coding DNA Sequence Number=SeqID_78053
  Homolog annotation: Hit_ID=A7QVN6; Match level="QueryCoverage=66%, HitCoverage=64%, E-value=8e-13, Identity=40%"; Hit description =Chromosome chr14 scaffold_190, whole genome shotgun sequence
MAGEKGNKIRQKIVELKKKAEEATTPSGCSFMNLDKFIKERNLMYLAAIADSQPQPSPLAGQQQGMHNQLGMSFSGSQGLHMLQSEATNVGSNATIGTGGGFPEFVRIGSGKQDI

SEQ ID NO: 169739 - protein, 41 aa, Glycine max
  Coding DNA Sequence Number=SeqID_78054
MKTKNLSQQCWALLVCNEIMVLNQEPVEGDTTGNNVRKSCF

SEQ ID NO: 169740 - protein, 117 aa, Glycine max
  Coding DNA Sequence Number=SeqID_78055
MKHTSKLESGGHMNENAIHGAPKNRGRMEDCLEGPHLGNHETQLQTRKGRTHERKRNSWAPKKWENGRFALRVRTYAMMKHISKLESGERMNEIFISSAPKKGDNGGLPLGSLLMQS

SEQ ID NO: 169741 - protein, 120 aa, Glycine max
  Coding DNA Sequence Number=SeqID_78056
  Subcellular localization annotation: CTP_CleavageSite=95; ConfidenceScore=5.32e-01
MTLSLNSVISCYLVLGCRRASSAGSLVQSKFVPNFGSNYQAVCRIFPLDLMMKSVQFQVKKRLSREVLRVTVKLSSSVGLSAHPSLSEALAHLARQENLAKHQYQCAKCSSCYHPGSAHN

SEQ ID NO: 169742 - protein, 95 aa, Glycine max
  Coding DNA Sequence Number=SeqID_78057
  Gene Ontology: Mol. function=protein dimerization activity
  Homolog annotation: Hit_ID=A5ASU7; Match level="QueryCoverage=95%, HitCoverage=18%, E-value=1e-17, Identity=49%"; Hit description =Putative uncharacterized protein
MYLSKNRLEHKRLHDLVFVKYNQQLKQRYNARDEIDPISLNDIDVCNEWLVGEMDEDNDNDAENDLVFEDDDALNWATVYEASGVGECRMYTRQK

SEQ ID NO: 169743 - protein, 33 aa, Glycine max
  Coding DNA Sequence Number=SeqID_78058
MNQDAQGRVRAGTRLVVSRSSSRNWLCMLRRPY

SEQ ID NO: 169744 - protein, 223 aa, Glycine max
  Coding DNA Sequence Number=SeqID_78059
  Gene Ontology: Mol. function=helicase activity; Biological process =viral genome replication
  Homolog annotation: Hit_ID=Q9SH75; Match level="QueryCoverage=83%, HitCoverage=18%, E-value=6e-35, Identity=37%"; Hit description =Putative helicase
MDDSYERKRNRLTIKEFLCFRLHSKKDEAQTLLSKYPSPVDIDRIISVEIPDSIEQPQLYECVKKHMMHGPCGNAKRQSSCMKDGKCSRYFPKNSKLRLLLTKTTILFIKGVMMAHLNIEWCHQSMFIKYLLKYINKGYDRITAALVPVENEDGTTEQSVNEIKHYLDGRYISPCEACWRIFSFQIHKRSPVVERLYFYLPGENSVIFEDSDDIDALLSKPIR

SEQ ID NO: 169745 - protein, 95 aa, Glycine max
  Coding DNA Sequence Number=SeqID_78060
MEAIEQWKLLSNSNGHNFSLAGPIQAHNTMSRHKIEPRNLSRNSKVITLLGCPIQAHNISRCSKLNNGSSREIQMDITFNSDVRFRRITYRDARN

SEQ ID NO: 169746 - protein, 98 aa, Glycine max
  Coding DNA Sequence Number=SeqID_78061
MLILQPFDPEIDRTFHRLVRHSVHPNHSMHFEHSEYSIASDSEYFDFEHLTTNFHTKNMAQPPPRERTLREMATPISLMKACAFNILMRVFHMLSKLD

SEQ ID NO: 169747 - protein, 54 aa, Glycine max
  Coding DNA Sequence Number=SeqID_78062
MVGLTQHNNAKPVADSSFSKAKPEHSLDSQIKPPEASNYKARLRRADCNAKVHP

SEQ ID NO: 169748 - protein, 286 aa, Glycine max
  Coding DNA Sequence Number=SeqID_78063
MAPRKLASKRSRKDKAAEGTSSAPEYDSHRFRSAVHQQRFEAIKGWSFLQEQRVQLRDDEYTDFQEEIGRRRWVSLVTPMAKFDPEIVLEFYANAWPTEEGVHDMRSWVRGQWIPFDADAIGQLLGYPLVLEEGQECEYGQRRNRSDGFDEEAIAQLLCIPGQDFARTAAGRRVRIMRTNITTLTQIWMTLLLSNILPPIIIPTSPCRSASWCMAPTRHPLDPDKSNRALGFPALITGLCQSFGVPVAPTKVIRPPITRVFIEKYCTQRQGQGDAPQAAGAPPPPH

SEQ ID NO: 169749 - protein, 180 aa, Glycine max
  Coding DNA Sequence Number=SeqID_78064
  Gene Ontology: Mol. function=metal ion binding; Biological process =metal ion transport
  Homolog annotation: Hit_ID=A7NZ79; Match level="QueryCoverage=91%, HitCoverage=91%, E-value=1e-26, Identity=38%"; Hit description =Chromosome chr6 scaffold_3, whole genome shotgun sequence
  Pfam annotation: Domain name=HMA; Domain location=104-163; Score =30.1; E_value=8.2e-06; Accession=PF00403.17; Description=Heavy-metal- associated domain
  Subcellular localization annotation: CTP_CleavageSite=69; ConfidenceScore=5.73e-01
MNLFCSSISSTAVTDHHSKVRKSTKRLASIPRKSQLRVPCSSRLLPINPKPQNGEVRRKGSNIQVNNLCGTSSSTRYLLSDWVSESDKIPSHSHKPTLQNQIVVLRVSLHCKARAGKVTKHISKMEGVTSFSIDMEAKKVTIIGHVTPLGVLASVSKVKNAQLWPSSTSSLPSLSSSMPR

SEQ ID NO: 169750 - protein, 97 aa, Glycine max
  Coding DNA Sequence Number=SeqID_78065
  Homolog annotation: Hit_ID=Q9SN96; Match level="QueryCoverage=35%, HitCoverage=61%, E-value=4e-12, Identity=91%"; Hit description =Putative uncharacterized protein F18L15.150
MRLFDPWPVFFKREWKRNWPFLVGFAVTGTLITKLSLGLSANVLLLLLLRQPPKLDFCSESDFPFRRGGSHKVKIRPGTQEFNACICYNVRFFVCHE

SEQ ID NO: 169751 - protein, 476 aa, Glycine max
  Coding DNA Sequence Number=SeqID_78066
  Gene Ontology: Mol. function=sequence-specific DNA binding; Cellular component=nucleus; Biological process=regulation of transcription, DNA-dependent
  Homolog annotation: Hit_ID=Q9ZRY1; Match level="QueryCoverage=99%, HitCoverage=85%, E-value=0.0, Identity=76%"; Hit description=NDX1 homeobox protein
  Pfam annotation: Domain name=Homeobox; Domain location=254-317; Score= -6.8; E_value=0.049; Accession=PF00046.20; Description=Homeobox domain
MEEDASLEYDIFAAVGWILDYTSLDVRNATNLEFNLIPNSMPKASYAHHRTSLFVKFFANLHCFVPNICEGWFFVNIPKISRPNLIVLQVMECLQMDLSNLLPGFSFASDAPKAAIASKNLRGCPSSLTGKEHADLNKKGGNFKEGMSENSAFPDMDQHNTRAEDTNQGKGLNRLNQVDDKGIAGKTASGGAREMDKDAQNVETSGSDSSSAKGKNVVDNMDNGELSKSNERLKRTAVEENPEDEKIELSQRRKRKRTIMNDKQVMLIERALKDEPDMQRNAASLQSWADKLSGHGSEVTSSQLKNWLNNRKARLARTARDVKAAAGDDNPVPDKQRGPVPGSYDSPGSPGDVSHVARIASGDNKSEPSLALARFVDIGSPEFGHCNAGQYVVLVGVRQDEIGRGKVFQVHGKWYGKSLDELSAHVVDISELKADKGMRLPYPSEATGNTFAEAETKLGVMRVLWGSNRVFALPPE

SEQ ID NO: 169752 - protein, 229 aa, Glycine max
  Coding DNA Sequence Number=SeqID_78067
  Gene Ontology: Mol. function=cellulose synthase (UDP-forming) activity; Cellular component=membrane; Biological process=cellulose biosynthetic process
  Homolog annotation: Hit_ID=B0I545; Match level="QueryCoverage=75%, HitCoverage=16%, E-value=2e-84, Identity=82%"; Hit description =Cellulose synthase Z632
  Pfam annotation: Domain name=HMG_CoA_synt_C; Domain location=1-172; Score=-121.2; E_value=1.6e-05; Accession=PF08540.1; Description =Hydroxymethylglutaryl-coenzyme A synth
MEPDVVVDGKLSQTCYLMALDSCYNHLSHKYEKQEGKQFCISDAEYFVFHYPYNKFEKKFGQSSVFIASTLLEDGGVPKAASSATLLKEAIHVISCGYEDKTEWGKEVGWIYGSVTEDILTGFKMHCHGWRSVYCMPKRPAFKGSTPINLSDRLHQVLRWALGSVEIFFSRHCPIWYGYISYINSVIYPLTSIPLIAYCALPTVCLLTGKFIVPEVKHDFTSVLTSPPM

SEQ ID NO: 169753 - protein, 81 aa, Glycine max
  Coding DNA Sequence Number=SeqID_78068
MVLNGVLLGNNYGVAARVASDMMGSGISHGGDLEGGLELGGPTPLVLERSPTTTVVVGEWWRCRERLREGEYKEERRKAKF

SEQ ID NO: 169754 - protein, 600 aa, Glycine max
  Coding DNA Sequence Number=SeqID_78069
  Gene Ontology: Mol. function=UDP-glucuronate decarboxylase activity; Cellular component=Golgi apparatus; Biological process=cellular metabolic process
  Homolog annotation: Hit_ID=Q9AV98; Match level="QueryCoverage=45%, HitCoverage=89%, E-value=1e-144, Identity=84%"; Hit description=UDP -D-glucuronate carboxy-lyase
  Pfam annotation: Domain name=3Beta_HSD; Domain location=4-226; Score=- 94.6; E_value=0.00029; Accession=PF01073.10; Description=3-beta hydroxysteroid dehydrogenaseisomerase family
  Pfam annotation: Domain name=Epimerase; Domain location=3-200; Score =97.0; E_value=5.8e-26; Accession=PF01370.12; Description=NAD dependent epimerasedehydratase family
  Pfam annotation: Domain name=NAD_binding_4; Domain location=5-214; Score=-47.0; E_value=9.6e-06; Accession=PF07993.3; Description=Male sterility protein
  Pfam annotation: Domain name=Polysacc_synt_2; Domain location=3-246; Score=-146.0; E_value=0.00012; Accession=PF02719.6; Description =Polysaccharide biosynthesis protein
  Pfam annotation: Domain name=RmlD_sub_bind; Domain location=1-269; Score=-144.9; E_value=0.00031; Accession=PF04321.8; Description=RmlD substrate binding domain
  Pfam module annotation: Pfam domain module=3Beta_HSD::Epimerase::NAD _binding_4::Polysacc_synt_2::RmlD_sub_bind; Domain location=4-226::3 -200::5-214::3-246::1-269
MRILVTGGAGFIGSHLVDRLMENEKNEVIVADNYFTGSKDNLKKWIGHPRFELIRHDVTEPLLIEVDQIYHLACPASPIFYKYNPVKTIKTNVIGTLNMLGLAKRVGARILLTSTSEVYGDPLVHPQPESYWGNVNPIGVRSCYDEGKRVAETLMFDYHRQHGIVQCPGTQTRSFCYVSDLVDGLIRLMGGSNTGPINLGNPGEFTMTELAETVKELINPGVEIKMVENTPDDPRQRKPDITKAKELLGWEPKVKLRDGLPRMEEDFRLRLELPPMMGGVSGGDDDFVQIHQPNKPGDPFIITFNCPDKTGLACDICRIILDFGLCITKGDVSTDGVWCYFVLWVIPHSVLLPITCSYLILKERLQEICPPCLASFYIIQQPSRSSPVYLLKFCCLKSPEYEYNQGISSLSPALAEELELSDNQVRSQALTPDMTKLKKANVAIDNYLSPAHTLVQIRCADHKGRLYDIMRTLKDMNMKNDGKKILDREKQSALCSHLKQEMLHPLRVIIANRGPDTELLVANPVELSGIGRPRVFYDVTFALKTLGICVFSAEVGRHSTSEREWEVYRFLLDENCEFQLTGVAARNKIVNRVRRTLMGW

SEQ ID NO: 169755 - protein, 559 aa, Glycine max
  Coding DNA Sequence Number=SeqID_78070
  Gene Ontology: Mol. function=binding; Cellular component=nucleus; Biological process=regulation of transcription, DNA-dependent
  Homolog annotation: Hit_ID=A5C1R0; Match level="QueryCoverage=94%, HitCoverage=61%, E-value=0.0, Identity=69%"; Hit description =Putative uncharacterized protein
  Pfam annotation: Domain name=Noc2; Domain location=278-558; Score =472.6; E_value=4.9e-139; Accession=PF03715.4; Description=Noc2p family
MDVSERNLDGENSVRRRSRKKSMSGTASGAREHKEQLQKLQDKDPEFYEFLKEHDKELLQFSDDDVDEDVGTDTEDGDLQLDEEASEDEIQEKEQKSSKEVITTSMVDLWCKSIQESGSLSAVRSLMRAFRTACHYGDDGGNESMAKLSVMSSTVFNKIMLTVLTEMDRILRNLLKLPASGGKKETITDLVATKHWKSHGHLVKSYLGNALHVLNQMTDTEMISFTLRRLKYSLLFLAAFPSLLRKYIKVVLHFWGTGGGALPVVSFLFMRDLCIRIGSGCIDECFKGIYKAYVLNCHFVNAVKLKHIRFLGNCVIELLGVDLPTAYQHAFTYIRQLATILREALNTKTKESFRKVYEWKFINCLELWTGAICAYSSESDFKQLAYPLTQIISGVARLVPTARYFPLRLRCVRMLNQIAASTHSFIPVSMLLLDMLEMKELNRPPTGGVGKAVDLHSILKVSKLTLKTRAFQEACVISVVEELAEHLAQWSYSVAFLELSFIPLVRLRSFCKSTKVERFRKEMRQLIRQIEASSDYVNGKRLSISFFPNDPAAASFLEV

SEQ ID NO: 169756 - protein, 310 aa, Glycine max
  Coding DNA Sequence Number=SeqID_78071
  Gene Ontology: Mol. function=zinc ion binding; Cellular component =nucleus; Biological process=regulation of transcription
  Homolog annotation: Hit_ID=A7PIU8; Match level="QueryCoverage=95%, HitCoverage=96%, E-value=8e-52, Identity=41%"; Hit description =Chromosome chr13 scaffold_17, whole genome shotgun sequence
  Pfam annotation: Domain name=zf-Dof; Domain location=67-129; Score =135.4; E_value=1.6e-37; Accession=PF02701.6; Description=Dof domain, zinc finger
MVFSSIPVYLDPPNWQQQQQNQHQANGSNSPHELLPPLPQPPQAPHVGVESEQIRSGLMADRAKIPAPEGVLKCPRCESTNTKFCYFNNYSLSQPRHFCKTCRRYWTRGGALRNVPVGGGCRRNKKNKRSRSKSPVSTEKPSLPNNTSAIPELIGRFPQPFMASLQSMNRYGVGINTGVNLREIQAQNASQMEFQIGGLGNGSSVATAGGGGGGGVEQWRFQQFPFLNGFESTSAASNSYPFQSEIVEGLVGDINATSSRITQLPARVKMEYNGGLNLSRSPLNVSENSNHFYSWTDLSGLASSSASHLL

SEQ ID NO: 169757 - protein, 177 aa, Glycine max
  Coding DNA Sequence Number=SeqID_78072
  Homolog annotation: Hit_ID=A7Q079; Match level="QueryCoverage=42%, HitCoverage=11%, E-value=7e-13, Identity=47%"; Hit description =Chromosome chr8 scaffold_41, whole genome shotgun sequence
  Subcellular localization annotation: CTP_CleavageSite=12; ConfidenceScore=5.13e-01
MNPDKLRTYHVRPTLSSSGILSPHEPFTFSYPTSLSVEFSFSVFSNGHDLLLVLAVGDNISNYVGVEFDKSKDNNIPSVVMLARLLLSMRKFMMQWRLWPPLVSKKYEVKVIVKTLILQGCDLIKWKGPKLTLSFLQCNVVARNFTKEAHPEQKDDLVLWDEEFHALRTTCSKTIVN

SEQ ID NO: 169758 - protein, 716 aa, Glycine max
  Coding DNA Sequence Number=SeqID_78073
  Gene Ontology: Mol. function=protein serine/threonine kinase activity; Cellular component=plasma membrane; Biological process=two- component signal transduction system (phosphorelay)
  Homolog annotation: Hit_ID=Q5DW43; Match level="QueryCoverage=99%, HitCoverage=84%, E-value=0.0, Identity=73%"; Hit description =Phototropin
  Pfam annotation: Domain name=PAS; Domain location=158-280; Score =14.7; E_value=0.018; Accession=PF00989.15; Description=PAS domain
  Pfam annotation: Domain name=PAS_3; Domain location=183-283; Score =13.4; E_value=0.0054; Accession=PF08447.2; Description=PAS fold
  Pfam annotation: Domain name=Pkinase; Domain location=381-671; Score =279.6; E_value=6.2e-81; Accession=PF00069.16; Description=Protein kinase domain
  Pfam annotation: Domain name=Pkinase_Tyr; Domain location=381-665; Score=-19.8; E_value=3.5e-11; Accession=PF07714.8; Description =Protein tyrosine kinase
  Pfam module annotation: Pfam domain module=PAS::PAS_3::Pkinase::Pkinas e_Tyr; Domain location=158-280::183-283::381-671::381-665
MHCIAARQKEKATSSVTELLQAMKRPRALSESASRPSIRKSGSRSSDEEKLEQEQEDDKEKAQKTLRRISESGASFGRKSEGSGNRISMERISELPENKHRNSQRRSFMGFRRKSQSNDESMDSEVIEDESSESEDDERPNSFELDDKEKQREKRKGLDLATTLERIEKNFVITDPRLPDNPIIFASDSFLELTEYSREEILGRNCRFLQGPETDPATVNKIREAIDNQTEVTVQLINYTKSGKISLFNPGKKFWNLFHLQPMRDQKGEVQYFIGVQLDGSQHVEPLHNCIAEDTAKEGEQLVKQTAENVDEAVRDLPDANKSIWLQLWHDHPFGALQKPDDLWTNHSKTVHPKPHRKDDPAWKAIQKVLESGEQIGLKHFRPIKPLGSGDTGSVHLVELRGTGQYFAMKAMDKGVMLNRNKVHRACAEREILDKLDHPFLPALYASFQTKTHVCLITDYCPGGELFLLLDRQPTKVLKEDAVRFYAAEVVIVLEYLHCQGIIYRDLKPENVLLQSNGHVSLTDFDLSCLTSSKPQLIIPATNSKKKKKKKQKSQEVPMFMAEPMRASNSFVGTEEYIAPEIITGSGHTSAVDWWALGILIYEMLYGYTPFRGKTRQKTFANILHKDLKFPKSKPVSLQGKQLIYWLLQRDPKDRLGSREGANEIKRHPFFRGVNWALVRCMKPPELDAPLLPETEEEKEAKDIHPGLEDLQTNIF

SEQ ID NO: 169759 - protein, 57 aa, Glycine max
  Coding DNA Sequence Number=SeqID_78074
MGQQPVNARIELVRNSENGGSISFNTLLTGSPSSSTDSSSDLDTEVSKTLTKIIVYG

SEQ ID NO: 169760 - protein, 137 aa, Glycine max
  Coding DNA Sequence Number=SeqID_78075
  Homolog annotation: Hit_ID=A5BZJ2; Match level="QueryCoverage=89%, HitCoverage=99%, E-value=2e-52, Identity=78%"; Hit description =Putative uncharacterized protein
MSGVWVFDKKGVARLITNPTRESFEQKEPRQPGTATAPGARPRVLVYLPSNQVIRSYAELEQRLTELGWTRYRDSDRSDLIQFHRSDTSSHLISLPKNFSNFKHFHFYDIVVKNRSFFQVRDPTMQYQDYCDNDISS

SEQ ID NO: 169761 - protein, 662 aa, Glycine max
  Coding DNA Sequence Number=SeqID_78076
  Gene Ontology: Mol. function=DNA binding; Cellular component=nucleus; Biological process=regulation of transcription
  Homolog annotation: Hit_ID=A7NYY2; Match level="QueryCoverage=100%, HitCoverage=100%, E-value=1e-106, Identity=51%"; Hit description =Chromosome chr6 scaffold_3, whole genome shotgun sequence
  Pfam annotation: Domain name=Myb_DNA-binding; Domain location=562 -612; Score=21.3; E_value=0.0035; Accession=PF00249.22; Description =Myb-like DNA-binding domain
MVLQKRLDYSFYGYQVPTKRRATRLAKRRVTFQRRLEDNQMCAFDLLATVADNLLQEKQNPTTSSDRSSEKDGDGFPKEERQDANKPFKTELSDEASCDRKCQLEFVKEGSSNANSFKVELSDEGSSDRKCFSNISSQVYNQNCCSKELPEHEIDGHLCIASIVTSSSCSEKIVAETLVDGKGHNGMEKLASKVELGSCGYLESRGCKLDGDVSKVKDDKFGKVPIDTGTGLCCFEDTLDEKPLALISSCGNAKMSGYDDSMPQSSWSKGCDNVLVDSRDDDENFSGGTRIGKGEGMEKGIEKMMRKKRGFPRGEFSALGSGFGPSYSRLARSARSAQLSMQIMEHHPWDTLHYDLEILTMSFFYPVKLRIKSFRVPELFIEIPETATVGSLKRTVMEAVTAVLGGGLRVGVILHGKKVRDDSKTLLQTGISHDNHLDALGFALEPNCSRNRPSACATTDSLHIPSADMPQPLIGYPSSPAVIHQRIQGFSNMLAKHQATSSGNLVESDHDSAPSPINTSGEKYLSDSKELITVPEMGMEALAVLPVHQKSKRTEIAQRRIRRPFSVTEVEALVQAVEKLGTGRWRDVKLRAFDNAKHRTYVDLKDKWKTLVHTARISAQQRRGEPVPQELLDRVLTAHAYWSQQQTKQQLKHHSTKPCLLL

SEQ ID NO: 169762 - protein, 88 aa, Glycine max
  Coding DNA Sequence Number=SeqID_78077
MKVNQLEHITIEPDDEPNQVVSRRLRQSPTDPKKIAFLWKVDSNIQITEHIETAAVPNYTTDNKEEFTAMNSRSKRDTHRPKYLADYV

SEQ ID NO: 169763 - protein, 83 aa, Glycine max
  Coding DNA Sequence Number=SeqID_78078
  Gene Ontology: Mol. function=protein binding; Cellular component =nucleus; Biological process=ubiquitin-dependent protein catabolic process
  Homolog annotation: Hit_ID=A7NYR5; Match level="QueryCoverage=87%, HitCoverage=74%, E-value=3e-32, Identity=91%"; Hit description =Chromosome chr6 scaffold_3, whole genome shotgun sequence
  Pfam annotation: Domain name=Skp1_POZ; Domain location=5-70; Score =31.4; E_value=3.3e-06; Accession=PF03931.6; Description=Skp1 family, tetramerisation domain
MKKEDTVKLISAEGFEFVVDKEAAMVSQTIHNMLTSPGSFAERQHGEVTFPEISTTILEKICQYFYWHLQFASAWFSVKKDFP

SEQ ID NO: 169764 - protein, 126 aa, Glycine max
  Coding DNA Sequence Number=SeqID_78079
  Homolog annotation: Hit_ID=Q2HS30; Match level="QueryCoverage=98%, HitCoverage=99%, E-value=9e-22, Identity=48%"; Hit description =Putative uncharacterized protein
MEDKANMMIIKRSSRGGGCPTRLQKHAPASLDTDKVLVDRPSNPFGEASRAIPLLSPLVLSPQPTYADITIQVGTSEKNESAACASSSTPSPTTGWEHPAIISFPEPSSTLCSFFQKQCVFLNHPR

SEQ ID NO: 169765 - protein, 804 aa, Glycine max
  Coding DNA Sequence Number=SeqID_78080
  Gene Ontology: Mol. function=nucleoside-triphosphatase activity; Cellular component=nuclear origin of replication recognition complex; Biological process=double fertilization forming a zygote and endosperm
  Homolog annotation: Hit_ID=A7NZS0; Match level="QueryCoverage=97%, HitCoverage=87%, E-value=0.0, Identity=66%"; Hit description =Chromosome chr6 scaffold_3, whole genome shotgun sequence
  Pfam annotation: Domain name=AAA; Domain location=531-740; Score =52.8; E_value=1.2e-12; Accession=PF00004.20; Description=ATPase family associated with various cellular activities (AAA)
  Pfam annotation: Domain name=BAH; Domain location=229-404; Score =30.0; E_value=8.4e-06; Accession=PF01426.9; Description=BAH domain
  Pfam annotation: Domain name=PHD; Domain location=197-244; Score =43.0; E_value=1.1e-09; Accession=PF00628.20; Description=PHD-finger
  Pfam annotation: Domain name=zf-C3HC4; Domain location=198-241; Score= 5.0; E_value=0.025; Accession=PF00097.16; Description=Zinc finger, C3HC4 type (RING finger)
  Pfam module annotation: Pfam domain module=AAA::BAH::PHD::zf-C3HC4; Domain location=531-740::229-404::197-244::198-241
  Subcellular localization annotation: CTP_CleavageSite=72; ConfidenceScore=5.75e-01
MAATPSKSFQTPSNPKLRSKSNPKSSPAVTPDTPQTLHIRRSTRAKSLLFDAPKPPHSPLQISLTTPKRRTRRSIVEEDSAEDKATPSKISPKNKAPVVDASKKKNGKSSIEFFFAPVTPASSEKASTRKREGEGGVVSRAKRGKSENREKSAKLPQRRVYYKKVIYDGGEFELGDDVYVKRREDASSDDEDPEMEECRMCFSSNDEVMIECDDCLGGFHLKCLRPPLKDVPEGDWICGFCEARKMGKEVQLPKPPKGKKLVRTMREKLLSSDLWSGRVESIWREVDGNYWCRVRWYTIPEETSVGRQPHNLRRELYRTNDFADIEISNKGELGCHNNETVDAANAYIIRMILRSGIMFKMESVLRHCHVMTPKEYAKASNEGDDVFLCEYEYDIHWHSFKRLADIDNETENGEESDSDEDWNVGKESDSDTDEDVEYEEENIKNAQSQPSRSHHLAANLYKGRFFGLQKIGTKTIPQHVRSHKQTDLERAKATLLLASLPKSLPCRNKEMEEITTFIKGAISNDQCLGRCLYIHGVPGTGKTMSVLSVMRSLKSEVDAGNIKPYSFVEINGLKLASPENIYKVIYEALNGHRVSWKKALHLLNERFVEGKKTRDEADQPCILLIDELDLLVTRNQSVLYNILDWPTKPHSKLIVIGIANTMDLPEKLLPRISSRMGIQRLCFGPYNYQQLQEIISSRLKGIDVFEKQAVEFASRKVAAISGDARRALEICRRAAEIADYRVKKLISNPDCVTAGKGLVGMVDVEAAIQEMFQAPHIQGLHSERSLETYKLPGPVIIGHSKEVK

SEQ ID NO: 169766 - protein, 1015 aa, Glycine max
  Coding DNA Sequence Number=SeqID_78081
  Gene Ontology: Mol. function=2 iron, 2 sulfur cluster binding; Cellular component=peroxisome; Biological process=electron transport
  Homolog annotation: Hit_ID=A5APE9; Match level="QueryCoverage=98%, HitCoverage=94%, E-value=0.0, Identity=66%"; Hit description =Putative uncharacterized protein
  Pfam annotation: Domain name=Ald_Xan_dh_C; Domain location=572-679; Score=158.0; E_value=2.5e-44; Accession=PF01315.13; Description =Aldehyde oxidase and xanthine dehydrogenase, ab hammerhead domain
  Pfam annotation: Domain name=Ald_Xan_dh_C2; Domain location=687-1013; Score=-1.2; E_value=6.7e-14; Accession=PF02738.9; Description =Aldehyde oxidase and xanthine dehydrogenase, molybdopterin binding domain
  Pfam annotation: Domain name=CO_deh_flav_C; Domain location=410-521; Score=155.6; E_value=1.3e-43; Accession=PF03450.8; Description=CO dehydrogenase flavoprotein C-terminal domain
  Pfam annotation: Domain name=FAD_binding_5; Domain location=222-403; Score=243.9; E_value=3.6e-70; Accession=PF00941.12; Description=FAD binding domain in molybdopterin dehydrogenase
  Pfam annotation: Domain name=Fer2_2; Domain location=59-135; Score =161.4; E_value=2.4e-45; Accession=PF01799.11; Description=[2Fe-2S] binding domain
  Pfam module annotation: Pfam domain module=Ald_Xan_dh_C::Ald_Xan_dh _C2::CO_deh_flav_C::FAD_binding_5::Fer2_2; Domain location=572 -679::687-1013::410-521::222-403::59-135
MGSLKTEEDLKVSNEAILYVNGVRRLLSDGLAHFTLLEHYAINACLAPLYSVEGMHVITVEGLGSCKRGLHPVQESLARAHGSQCGFCTPGFVMSMYALLRSSQTPPSEEQIEECLAGNLCRCTGYRPIFDAFRVFAKTSNDLYTGVSSLSLEEGKSVCPSTGKPCSCNLSNTNDKCVGGDNGYEPTSYNEIDGTKYTERELIFPPELLLRTPTSLNLTGFGGLMWYRPLTLQHVLDLKAKYTDAKLLVGNTEVGIEMRLKRMPYRVLISVMHVPELNVLGAKDDGLEIGAAVRLSDLMNFFKKVVTERAAHETLSCKAFIEQLKWFAGTQIRNAASVGGNICTASPISDLNPLWMAARAKFRIIDAKGNIRTVLAENFFLPGYRKVNLASGEILLSVFLPWNRTFEFVKEFKQSHRRDDDIAIVNAGIRVHLQEHSENCVVADASIFYGGVAPYSLAATKTKEFLIGKNWNQDLLQNALKVLQKDILLKEDAPGGMVEFRKSLTLSFFFKFFLWVSHQMDSVKESIPSSHLSAVHSVHRPPVTGSQDYEIRKRGTSVGSPEVHLSARLQVTGEAEYADDTPMPPNGLHAALVLSKKPHARIIKIDDSEAISSPGFVSLFLAKDVPSDNKIGPVVADEDLFAVDYVTCVGQVIGVVVADTHENAKIAARKVIVEYEELPAILSIRDAINARSFHPNTEKCLSKGDVDHCFQSGQCDRIIEGEVQMGGQEHFYLEPHSTLIWTVDGGNEVHMISSSQLLWLESPRLYKPHIRFLYFQRGTQVPYLAPQKHQKYVSHVLGLPMSKVVCKTKRIGGGFGGKETRSAFIAAAASVPSYLLNRPVKITLDRDVDMMITGQRHSFLGKYKVGFTNEGRVLALDLEIYNNAGNSLDLSLAILERAMFHSDNVYEIPNMRVMGRACFTNFPSHTAFRGFGGPQGLLIAENWIQRIAVELKMSPEKIRARKEVDEFNSHNRWRKRGIAMIPNKFGISFTTKLMNQFLAQDWVAAVRELQSLFLT

SEQ ID NO: 169767 - protein, 350 aa, Glycine max
  Coding DNA Sequence Number=SeqID_78082
  Gene Ontology: Mol. function=nucleic acid binding; Cellular component= intracellular; Biological process=regulation of transcription
  Homolog annotation: Hit_ID=A7NZT3; Match level="QueryCoverage=98%, HitCoverage=99%, E-value=1e-114, Identity=61%"; Hit description =Chromosome chr6 scaffold_3, whole genome shotgun sequence
  Pfam annotation: Domain name=zf-C2H2; Domain location=183-205; Score =14.4; E_value=0.32; Accession=PF00096.17; Description=Zinc finger, C2H2 type
  Pfam annotation: Domain name=zf-C2H2; Domain location=267-289; Score =13.1; E_value=0.43; Accession=PF00096.17; Description=Zinc finger, C2H2 type
  Pfam annotation: Domain name=zf-C2H2; Domain location=293-318; Score =7.7; E_value=1.7; Accession=PF00096.17; Description=Zinc finger, C2H2 type
  Pfam module annotation: Pfam domain module=zf-C2H2::zf-C2H2::zf-C2H2; Domain location=183-205::267-289::293-318
  Subcellular localization annotation: CTP_CleavageSite=93; ConfidenceScore=5.48e-01
MTHPYCSNDLNAWFDLNSPCLFSNSSSPCSNNPPFYFPTTNISYRHNCTNNGISFTQHIQSSPSSFPPPKEALTLLNLSPARGEDLDLESSFSAMKVNKEKEKELLSIMSSNNNSLDDETVTVALHLGLPSTTATSSADLTSNMYSEKEEKATFASEYSPTRINKGQYWIPTPAQILIGPTRFSCPLCCKTFNRYNNMQMHMWGHGSQYRKGPESLRGTQPTAMLRLPCYCCAQGCKNNIDHPRAKPLKDFRTLQTHYKRKHGIKPFMCRKCCKAFAVRGDWRTHEKNCGKLWYCSCGSDFKHKRSLKDHIKAFGNGHRAYGIDSCLDQDDEPGSEIEQENNESLISNHS

SEQ ID NO: 169768 - protein, 84 aa, Glycine max
  Coding DNA Sequence Number=SeqID_78083
MDHGGRGLYHVNIDPLREVENTLHITTSSLEYRLTWVVNVPKCSFGSEVPSYLSMFREFHVMGRGMGSEVELVVVGVVEVGAGL

SEQ ID NO: 169769 - protein, 694 aa, Glycine max
  Coding DNA Sequence Number=SeqID_78084
  Gene Ontology: Mol. function=transferase activity, transferring glycosyl groups; Cellular component=endoplasmic reticulum
  Homolog annotation: Hit_ID=Q9LXU2; Match level="QueryCoverage=93%, HitCoverage=90%, E-value=0.0, Identity=73%"; Hit description =Anthranilate phosphoribosyltransferase-like protein
  Pfam annotation: Domain name=C2; Domain location=203-285; Score=76.9; E_value=6.7e-20; Accession=PF00168.21; Description=C2 domain
  Pfam annotation: Domain name=C2; Domain location=366-457; Score=84.5; E_value=3.3e-22; Accession=PF00168.21; Description=C2 domain
  Pfam annotation: Domain name=C2; Domain location=42-122; Score=97.5; E_value=4.2e-26; Accession=PF00168.21; Description=C2 domain
  Pfam annotation: Domain name=PRT_C; Domain location=574-689; Score =98.5; E_value=2.1e-26; Accession=PF08372.1; Description=Plant phosphoribosyltransferase C-ter
  Pfam module annotation: Pfam domain module=C2::C2::C2::PRT_C; Domain location=203-285::366-457::42-122::574-689
MHKPAEALDFALKETSPNIGAGAVMRDKLSCTYDLVEQMQYLYVRVVKAKDLPGKDVTGGVDPYVEVKLGNYKGLTKHFEKNSNPQWNQVFAFSKERIQASVLEVVIKDKDVVVDDFVGRVMFDINEIPKRVPPDSPLAPQWYRLEDRRGGKAKGELMLAVWMGTQADEAFPDAWHSDAATVGPEAVANIRSKVYLSPKLWYVRVNVIEAQDLVPSDKTRYPEVFVKANLGVQFLRTRVSQSKTINPMWNEDLMFVAAEPFEEPLVLTAEDRVGPSKDEILGRCVIPLHNVQRRLDHKPVNTKWFNLEKHVVVEGEQKKKEIKFSSRIHLRVCLEGGYHVLDESTHYSSDLRPTAKQLWKASIGILEVGIISAQGLMPMKTRDGRGTTDAYCVAKYGQKWIRTRTIVDSLAPRWNEQYIWEVFDPCTVITVGVFDNGHLHGGDKSGGSKDSRIGKVRIRLSTLEADRVYTHSYPLLVLHNSGVKKMGEVQLAVRFTSLSLINMLCMYSQPLLPKLHYIHPLSVIQLDTLRHQAIKIVSMRLSRAEPPLRKEVVEYMLDVDSHMWSMRRSKANFFRITKVLGGLLAFGRPRHPPHMDTRLSHADAAHPDELDEEFDTFPTSRSSDMVRMRYDRLRSIAGKVQTVVGDLATQGESSSLCHSLPSCVPSNWLLFAKAPQIPPETSFSPIQLLQEVAS

SEQ ID NO: 169770 - protein, 169 aa, Glycine max
  Coding DNA Sequence Number=SeqID_78085
MGTATAGGWEWHLEWRRFFREVEVDIVAKLMKDIEAVTVQVNQQDNWGWRILPLWWESLTWLNIKAVFPKSPRDHFLQHDHGYIKGFIYQRWQIWWTSLTWCIWFQRNRIIFENERFTDQKLMEDAIFYCWSWLKNLEKGFDIPFHSWESNIRVGFVIGGGGGDCSIGF

SEQ ID NO: 169771 - protein, 361 aa, Glycine max
  Coding DNA Sequence Number=SeqID_78086
  Gene Ontology: Mol. function=oxidoreductase activity; Cellular component=cytoplasm; Biological process=electron transport
  Homolog annotation: Hit_ID=A9PIU4; Match level="QueryCoverage=98%, HitCoverage=96%, E-value=1e-127, Identity=64%"; Hit description =Putative uncharacterized protein
  Pfam annotation: Domain name=GFO_IDH_MocA; Domain location=9-123; Score=-15.6; E_value=0.025; Accession=PF01408.13; Description =Oxidoreductase family, NAD-binding Rossmann fold
  Pfam annotation: Domain name=GFO_IDH_MocA_C; Domain location=147-271; Score=11.0; E_value=0.072; Accession=PF02894.8; Description =Oxidoreductase family, C-terminal alphabeta domain
  Pfam module annotation: Pfam domain module=GFO_IDH_MocA::GFO_IDH_MocA_ C; Domain location=9-123::147-271
MATKQLPQIAILGAGIFVKTQYLPRLSEISHLFILKSIWSRTQESATAAVDIARKHFPQVETKWGDNGFDDIIHDGSIDAVAVVLAGQNQVDISLRLLKAGKHVLQGTSELEAALSSYKSISSDAPGQLIWSVAENYRFEPGLVECKKLIAGIGKMMSVQVIIEGSMNSSNPYFSSSWRRNFTGGFILDMGVHFIAGLRMLVGCEIVSVSAMTSHVDLTLPPPDNISSVFHLENGCSGVFVMTLWRVVGLNGTLQVERGFQGQHGYLVGSELYFKITEVATYFNQSTVSFYGTDGQNKSSFFPFSGVTEELKAFINDVSEITLKQKRNQFVTEPRLSYVEGARDVAVLEAMLESGARQGFA

SEQ ID NO: 169772 - protein, 449 aa, Glycine max
  Coding DNA Sequence Number=SeqID_78087
MSLTANGTVFCMEPEHKMTGHHFCNLRNQVDVIFPRVSSDGNMKLRHSLSVEDKSYAVNSFHLFANVLVAFWLFLVAISFFLLSKDVNVFGGFRGKHAEKVSSSDRRTISNATTEDDTNDTFSWSELCTKCDAYCEISDFDKPSYMHSLLSLEGEDSEWLSDSMPYGLSYEDPSTPPSYKCDAYYEISDFEQGSYFHSLLSLEDEDSEWLSDSNSFGWSSENPSTPLNSKCDAFSDILDLNKSSYMHPLISLEDEDSDWLSDSKSCGFSSENSTPLSYKYDAYYEISDLDKASYLLSLLILEDEDSEWLSDSSSWSIVVPPSVSTSSSFTGVQCGNSEEEFSADEPLFWPFEGKLNWNSEEPWSNEALCIVNYETSKLSMWAKSSAKIVPLLECEHFDSNKDQLLLGKEYFDLCQELTIETLVGLKEFDGHEGLDSEFDDVSLLDEYLQ

SEQ ID NO: 169773 - protein, 196 aa, Glycine max
  Coding DNA Sequence Number=SeqID_78088
  Gene Ontology: Mol. function=fructokinase activity; Cellular component=cytoplasm; Biological process=carbohydrate metabolic process
  Homolog annotation: Hit_ID=P37829; Match level="QueryCoverage=71%, HitCoverage=43%, E-value=3e-62, Identity=86%"; Hit description =Fructokinase
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSGRIREVTRVREHVGLGWTMDYALGGVMYLTVAGLDFCVCLVTVLYLAVLALTNTPTRF

SEQ ID NO: 169774 - protein, 569 aa, Glycine max
  Coding DNA Sequence Number=SeqID_78089
  Gene Ontology: Mol. function=Rab GTPase activator activity; Cellular component=intracellular; Biological process=regulation of Rab GTPase activity
  Homolog annotation: Hit_ID=A7QAM3; Match level="QueryCoverage=89%, HitCoverage=78%, E-value=1e-145, Identity=53%"; Hit description =Chromosome chr5 scaffold_72, whole genome shotgun sequence
  Pfam annotation: Domain name=TBC; Domain location=319-512; Score= -30.3; E_value=2e-05; Accession=PF00566.9; Description=TBC domain
MELWKSWGSKFAESEFHRARHWGSLPFAVACKVFFMEQVNRMLKPDKWQAMSDSEGKVFGFRKALKLIVLGGVDPSIRPEVWEFLLGCYSLSSTAEYRRRLRAARSVGTGSLAYVVGSKLMDLRTSSKDGRKSQAKIEESTYNDNNVEVGKCYDRNIICTEGENSSHWESSNNGVDLVSLRVCTDNAACDSSGQRNSSSPKLGGEVEESDCVTECSFDFPPLSVTNLFEKSGKDKNSGTEHGDKLPAPGQSRFEVDSMRSFRINNNVDLVIESNCQQPLATLHPMDSEIGIASPDEEEPELLSENQVYEAQMVTQLKISDVPQPAMIRSPISQGWPISEERVSEWLWTLHRIVVDVVRTDSHLEFYEDTRNLARMSDILAVYAWVDPSTGYCQGMSDLLSPFVVIFEDNADAFWCFEMLLRRMRENFQMEGPTRVMKQLRALWHILELLDKEMFAHLSKIGAESLHFAFRMLLVLFRRELSFNEALSMWEMMWAADFDEFMAYDLEENCLEALELHLPRDSSNGMREEIADSDGGSVKNGSHRSHPIPFVAWQGISGLEVIKFKRAVFP

SEQ ID NO: 169775 - protein, 566 aa, Glycine max
  Coding DNA Sequence Number=SeqID_78090
  Homolog annotation: Hit_ID=A5C240; Match level="QueryCoverage=66%, HitCoverage=73%, E-value=1e-118, Identity=58%"; Hit description =Putative uncharacterized protein
  Pfam annotation: Domain name=Synaptobrevin; Domain location=210-300; Score=-4.4; E_value=0.076; Accession=PF00957.12; Description =Synaptobrevin
MVIVNVTNGLVSTVVIIVLIFPEVASQALSPSDSVADNVSEAIIQPDNTIRVDPLDHFQKYRGGFNITNKHYWSVNLYCPFSFLNSAIFTGVYGYAIGVLCILCGIVCGTFLAISTACHKNDGGRRMKKARVKIVFQIENGMVIDLSQLGHGGHRYKERHELCNISTIDKFSFESNSESDQYIYLIAATGLVLAGSARFHSEAKNSVNIIIKTANEASETIHNTTGVLKDMESNFMEANVKADASVNLDSTTERLDDASANIEKQARKNRRLIYKSLKLVFIITTVIISLNLAAVIALSVSGVLRLRRALYLLVVLCWLMTVICWLFFGAYFFLEKFSGDVCTALDSFQENPYNNSLSSILPCDELLSAKSVLSDVSAGIYVLVNKVNANISAMQATSAVNLVQVCNPFSAPPKYSYQPENCPANTIRIGDIPKVLKPFSCLNVTDGTCDNGDLIPGSEYMRVEAYTSSIQDLLNVYPSMEALLKCQVVKDAFSQVLVNHCKPLKKYAKMVWLGLLFLAVIMVLLVVLWTIKASHEHRYHLSDGSVEPHSAPTKALESGPIKEIEI

SEQ ID NO: 169776 - protein, 460 aa, Glycine max
  Coding DNA Sequence Number=SeqID_78091
  Gene Ontology: Mol. function=Rab GTPase activator activity; Cellular component=intracellular; Biological process=regulation of Rab GTPase activity
  Homolog annotation: Hit_ID=A7QAM9; Match level="QueryCoverage=100%, HitCoverage=100%, E-value=0.0, Identity=72%"; Hit description =Chromosome chr5 scaffold_72, whole genome shotgun sequence
  Pfam annotation: Domain name=TBC; Domain location=151-414; Score= -23.3; E_value=6.3e-06; Accession=PF00566.9; Description=TBC domain
MKNDHNNNAEHNKDTTVGILDSRFNQTLRNVQGLLKGRNIPGKILLSQRVESPDYTSLSSPTYIRSSSYSETGTSDQTSETVEEEVHSTSKPFGIPNENKLKISASNVESSSEELRKSSMGARATDSARVMKFTKVLSETMVKLEKLREFSWRGVPDYMRPTVWRLLLGYAPPNSDRREGVLKRKRLEYLDCVSQYYDIPDTERSDDEINMLRQIAVDCPRTVPEVSFFQQQQVQKSLERILYTCFLIFARAIRHPASGYVQGINDLVTPFLVVFLSEYLEGGIDNWSMSDLSSDEISNVEADCYWCLSKLLDSMQDHYTFAQPGIQRLVFKLKELVRRIDVPPDPVSNHMEEQGLEFLQFAFRWFNCLLIREIPFHLVTRLWDTYLAEGDALPDFLVYISASFLLTWSDNLQKLDFQELVMFLQHLPTKNWTDQELEMVLSRAFMWHSMFNNSPSHLAN

SEQ ID NO: 169777 - protein, 353 aa, Glycine max
  Coding DNA Sequence Number=SeqID_78092
  Gene Ontology: Mol. function=oxidoreductase activity, acting on single donors with incorporation of molecular oxygen, incorporation of two atoms of oxygen; Cellular component=cytoplasm; Biological process=fatty acid biosynthetic process
  Homolog annotation: Hit_ID=P38417; Match level="QueryCoverage=39%, HitCoverage=18%, E-value=2e-70, Identity=81%"; Hit description =Lipoxygenase-4
  Pfam annotation: Domain name=PLAT; Domain location=196-291; Score =65.3; E_value=2e-16; Accession=PF01477.14; Description=PLATLH2 domain
MFGIIGGNKGHKIKGNLVIMRKNVLDINSITSVKGVIGTGINIIGGVVDTVTALASHISIQLISATKADVARQYLECREITHQKVDVRVDSTQPDPNRFKSTHFLLLFMVNTITLSLLQHVLTIPSMKFWILDIVVVAILDFDSINQSKFPIRIIDFIVVSVNRNFRSEKEEGEEEAEVEVSIEGRVNDTINGGGAELDESGHGKGKVGKATNLRGQVSLPTLGAGEDAYDVNFEWDSDFGIPGAFYIKNFMQVEFYLKSLTLEDIPNHGTIHFTYLPSETPAPLLKYREEELKNVRGDGTGERKEWDRIYDYDVYNDLGNPDSGDKYARPVLGGSALPYPRRGRTGRGKTRK

SEQ ID NO: 169778 - protein, 773 aa, Glycine max
  Coding DNA Sequence Number=SeqID_78093
  Gene Ontology: Mol. function=phosphoprotein phosphatase activity; Cellular component=nucleus; Biological process=protein amino acid dephosphorylation
  Homolog annotation: Hit_ID=A9NUQ6; Match level="QueryCoverage=55%, HitCoverage=89%, E-value=1e-105, Identity=45%"; Hit description =Putative uncharacterized protein
  Pfam annotation: Domain name=Metallophos; Domain location=298-532; Score=84.6; E_value=3.1e-22; Accession=PF00149.19; Description =Calcineurin-like phosphoesterase
MVVEAGNCERPGTLFPEECIEPVGSQQCDYLCRIGEALLGALSALVMDPRKERIKNGCLKILEGINSMSLVNLDDQQVHSLVMMREIARGVVDDRDRKVTKSDVITALRHSIEKMVQSGSFEGLIRGLDDQSMHLVMRMKEIANGVIDKQPRVAITRPDLLAEQVGFVDEGMRDSPVVESTKISNGYVPIGGAQSMTNEDEMLDVEHVLRFENGIDEVHESLLPCFQQFLLWPPDDCVTLEWVQDMMVILEQASQKMLPSEFCHIVPAILVDKLADAACSILCKEPNCVEINCQGEDSKVIVVGDVHGQFHDLMFLFKHAGVPSENRIYVFNGNYVDKGAWGIEVFLFLLAWKVLMPHRVYLLRGNHESRYCTARYGFKKEVWAKYGDQGEDVYNKFLACFKELPLASVIANCVYTTHGGLFRSIHAAPSQKPKRNKTHRVDLGSLAELSEVKRSFVDCPYEGPNILLSDVLWSRPSNRDGLRDNTGQKLGLLWGPDCTEAFLKQYNLKNKSGLFQYFIGFLIVYHGGVSDWSGSSLPFLLFTGFQSPQKSALLSSQDSPVSLAHLGPDARAGRDDDFGDMLSGYSIDHDGESGRLYTLFSAPDYPQFGKRRYNNKGAYAVLKSPDFASPSFHSFKAAERPMVDPYFDFDANYMESSKLDSSQSASTSTLSAPQRFYSDGMRPEFDFGALGIYNAPGWRVELPDGSGGTQAVEVPRAPLAEGLPLPPNIQEPHKAAYEYLFELVAGLKHMIVTRETENRAPVSALRSRTRKRE

SEQ ID NO: 169779 - protein, 77 aa, Glycine max
  Coding DNA Sequence Number=SeqID_78094
MLRVRGLNNRKWMSEYTEVCHTATIVGLIMDPLLAHSGMGSVGNVSHMQGRGAHPVNRCTSIYADEESFSTGLVGDT

SEQ ID NO: 169780 - protein, 88 aa, Glycine max
  Coding DNA Sequence Number=SeqID_78095
MFVPETHMFFLAVFGFVCTFGAWLNLTCQEMLVKMHLHDCTNTLTELNSLQGSIGGVVDLATIIWLLGSSNCRPSGMFYYHSSWFDDV

SEQ ID NO: 169781 - protein, 48 aa, Glycine max
  Coding DNA Sequence Number=SeqID_78096
MAVPEIKYFQGGVSWESKEVGVMKWLAEEDEKDKIIILFLEGRKDEIM

SEQ ID NO: 169782 - protein, 438 aa, Glycine max
  Coding DNA Sequence Number=SeqID_78097
  Gene Ontology: Mol. function=hydrolase activity, acting on glycosyl bonds; Cellular component=beta-galactosidase complex; Biological process=carbohydrate metabolic process
  Homolog annotation: Hit_ID=Q2HVE8; Match level="QueryCoverage=93%, HitCoverage=88%, E-value=0.0, Identity=75%"; Hit description =Galactose-binding like
  Pfam annotation: Domain name=Glyco_hydro_35; Domain location=2-155; Score=-43.4; E_value=1.9e-12; Accession=PF01301.10; Description =Glycosyl hydrolases family 35
MSALRGGAKIGIWVLWGVPHQVVWNACWTVDFGTGEDPWPIFKLQKEFNAPGKSPPLSAEFYTGWLTHWGEKNAQTDADFTAAALEKILQKNGSAVLYMAHGGTNFGFYNGANTGVDEADYKPDLTSYDYDAPIRESGDVDNSKFNAIRRVIARYSSVPLPSIPSNNEKARYGPIHLQREAFVFDMFDFTNSTNVFKSETPMSMEYVGQLHDRAQVFISCPSEESGARPTYIGTIERWLNNKVTLPDIKCHSKINLFILVENMGRVNYGSFIFDRKGILSSVYLDKEQVKGWKMFPIPLHNLNEMSTYNPITQVAYSAFSGISSFRKKLIYKNGNTSKEPAFYSGHFLIDKSSQVKDTFISFNNWGKGIVFVNDFNIGRYWPLRGPQCNLYVPAPLLKQGDNFLVILELESPDPELVVHTVDEPDFTCGSSGTSLHQL

SEQ ID NO: 169783 - protein, 445 aa, Glycine max
  Coding DNA Sequence Number=SeqID_78098
  Gene Ontology: Mol. function=protein binding; Cellular component =nucleus; Biological process=regulation of transcription, DNA -dependent
  Homolog annotation: Hit_ID=Q52ZH8; Match level="QueryCoverage=99%, HitCoverage=87%, E-value=0.0, Identity=75%"; Hit description=FVE
  Pfam annotation: Domain name=WD40; Domain location=152-191; Score =11.9; E_value=1.1; Accession=PF00400.23; Description=WD domain, G -beta repeat
  Pfam annotation: Domain name=WD40; Domain location=226-265; Score =29.9; E_value=9.3e-06; Accession=PF00400.23; Description=WD domain, G-beta repeat
  Pfam annotation: Domain name=WD40; Domain location=312-351; Score =39.4; E_value=1.3e-08; Accession=PF00400.23; Description=WD domain, G-beta repeat
  Pfam annotation: Domain name=WD40; Domain location=97-136; Score=0.2; E_value=30; Accession=PF00400.23; Description=WD domain, G-beta repeat
  Pfam module annotation: Pfam domain module=WD40::WD40::WD40::WD40; Domain location=152-191::226-265::312-351::97-136
MKEKEKVEERYTQWKSLVPVLYDWLANHNLVWPSLSCRWGPQLEQATYKNRHRLYLSEQTDGSVPNTLVIANCEVVKPRVAAAEHISQFNEEARSPFVKKHKTILHPGEVNRIREFQQNNKIVATHTDSPEVLIWDVETQPNRHAVLGATTSRPDLVLTGHKDNAEFALAMCPTEPFVLSGGKDKCVVLWSVHDHISTLAVETASNVKQGSKTGGNNTKATESPCIEPRGIYQGHEDTVEDVQFCPSSALEFCSVGDDSRLILWDARVGSAPVVKFIGLLNPHSNFCCFGSSSADNTIHMFDRRNLTSSGVGSPVYKFEGHDAAVLCVQWSPDKSSVFGSTAEDGILNIWDHDKVGKTTDSADSKASNAPPGLFFRHAGHRDKVVDFHWNASDPWTIVSVSDDCESSGGGGTLQIWRMMDLIYRPEEEVLTELDKFRSHIFGCNS

SEQ ID NO: 169784 - protein, 897 aa, Glycine max
  Coding DNA Sequence Number=SeqID_78099
  Gene Ontology: Mol. function=hydrolase activity, acting on glycosyl bonds; Cellular component=beta-galactosidase complex; Biological process=carbohydrate metabolic process
  Homolog annotation: Hit_ID=A2Q448; Match level="QueryCoverage=98%, HitCoverage=98%, E-value=0.0, Identity=81%"; Hit description=Beta -galactosidase
  Pfam annotation: Domain name=Gal_Lectin; Domain location=819-896; Score=172.2; E_value=1.3e-48; Accession=PF02140.9; Description =Galactose binding lectin domain
  Pfam annotation: Domain name=Glyco_hydro_2_N; Domain location=437 -575; Score=-57.9; E_value=0.07; Accession=PF02837.9; Description =Glycosyl hydrolases family 2, sugar binding domain
  Pfam annotation: Domain name=Glyco_hydro_35; Domain location=36-342; Score=667.4; E_value=1.1e-197; Accession=PF01301.10; Description =Glycosyl hydrolases family 35
  Pfam annotation: Domain name=Glyco_hydro_42; Domain location=58-427; Score=-239.3; E_value=0.011; Accession=PF02449.6; Description=Beta -galactosidase
  Pfam module annotation: Pfam domain module=Gal_Lectin::Glyco_hydro_2 _N::Glyco_hydro_35::Glyco_hydro_42; Domain location=819-896::437 -575::36-342::58-427
MVMCLKLKLIMWNVALLLAFSLIGSAKASVSYDSKAITINGQRRILISGSIHYPRSTPEMWPDLIQKAKDGGLDVIQTYVFWNGHEPSPGKYYFEGNYDLVKFIKLVQQAGLYVHLRIGPYVCAEWNFGGFPVWLKYIPGISFRTDNEPFKVQMQKFTTKIVDLMKAERLYESQGGPIIMSQIENEYGPMEYEIGAAGKAYTKWAAEMAMELGTGVPWIMCKQDDTPDPLINTCNGFYCDYFSPNKAYKPKMWTEAWTGWFTEFGGPVPHRPAEDLAFSVARFIQKGGSFINYYMYHGGTNFGRTAGGPFIATSYDYDAPLDEYGLLRQPKWGHLKDLHRAIKLCEPALVSGDPTVTKIGNYQEAHVFKSMSGACAAFLANYNPKSYATVAFGNMHYNLPPWSISILPNCKNTVYNTARVGSQSAQMKMTRVPIHGGLSWLSFNEETTTTDDSSFTMTGLLEQLNTTRDLSDYLWYSTDVVLDPNEGFLRNGKDPVLTVFSAGHALHVFINGQLSGTAYGSLEFPKLTFNEGVKLRTGVNKISLLSVAVGLPNVGPHFETWNAGVLGPISLSGLNEGRRDLSWQKWSYKVGLKGETLSLHSLGGSSSVEWIQGSLVSQRQPLTWYKYSFVIIIINSIIIIIEEAENVPYGKRTCFTFFLFLNPTLSFVFSMGTPNVMPCTYQTTFDAPDGTAPLALDMNSMGKGQVWLNGQNLGRYWPAYKASGTCDYCDYAGTYNENKCRSNCGEASQRWYHVPQSWLKPTGNLLVVFEELGGDLNGISLVRRDIDSVCADIYEWQPNLISYQMQTSGKAPVRPKVHLSCSPGQKISSIKFASFGTPVGSCGNFHEGSCHAHMSYDAFERNCVGQNLCTVAVSPENFGGDPCPNVLKKLSVEAICS

SEQ ID NO: 169785 - protein, 169 aa, Glycine max
  Coding DNA Sequence Number=SeqID_78100
  Gene Ontology: Mol. function=phospholipase D activity; Cellular component=cytoplasm; Biological process=phosphatidylcholine metabolic process
  Homolog annotation: Hit_ID=A2Q468; Match level="QueryCoverage=91%, HitCoverage=31%, E-value=6e-34, Identity=71%"; Hit description =Phospholipase D/Transphosphatidylase; C2 calcium/lipid-binding region, CaLB
MEEKPKLLFHGTIQATIFNATPYSPSFPFNCVCTNGKPAYVTINIDNKKVAKTTQEREYMEPSWTKLLSNGKFQELRDATFPQRSNCQVKLYHDAHHSSTFHPPFDLCGAPRKLWEDVYKAIEANVPLVQVRDPQTEIPHAREIKLGELLKKKAEEGVAVRVNKIVKNI

SEQ ID NO: 169786 - protein, 122 aa, Glycine max
  Coding DNA Sequence Number=SeqID_78101
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=A9P8J3; Match level="QueryCoverage=100%, HitCoverage=100%, E-value=2e-46, Identity=73%"; Hit description =Putative uncharacterized protein
  Pfam annotation: Domain name=ATP-synt_G; Domain location=8-122; Score= 110.0; E_value=7.1e-30; Accession=PF04718.6; Description =Mitochondrial ATP synthase g subunit
MASKIPQLQSKVNQASQAAKNHGASYYRLLLDQNKHYIQDPPTIEKCQSLAKQLFYTRLASIPHRYNSFWKELDHAKNLVKNRQDLNMEKVGFAALFGLECFAWFWGGEIVGRGFTFTGYYV

SEQ ID NO: 169787 - protein, 533 aa, Glycine max
  Coding DNA Sequence Number=SeqID_78102
  Gene Ontology: Mol. function=RNA methyltransferase activity; Cellular component=endoplasmic reticulum; Biological process=RNA processing
  Homolog annotation: Hit_ID=A7P6V9; Match level="QueryCoverage=93%, HitCoverage=86%, E-value=0.0, Identity=75%"; Hit description =Chromosome chr9 scaffold_7, whole genome shotgun sequence
  Pfam annotation: Domain name=MTS; Domain location=343-511; Score= -76.5; E_value=0.0047; Accession=PF05175.5; Description =Methyltransferase small domain
  Pfam annotation: Domain name=UPF0020; Domain location=359-510; Score=- 47.1; E_value=0.004; Accession=PF01170.9; Description=Putative RNA methylase family UPF0020
  Pfam annotation: Domain name=tRNA_U5-meth_tr; Domain location=130 -533; Score=-118.1; E_value=9.8e-07; Accession=PF05958.2; Description= tRNA (Uracil-5-)-methyltransferase
  Pfam module annotation: Pfam domain module=MTS::UPF0020::tRNA_U5-meth_ tr; Domain location=343-511::359-510::130-533
  Subcellular localization annotation: CTP_CleavageSite=27; ConfidenceScore=5.03e-01
MTSISYLTNTLLPLHIRRFRPSLSTLSCSLASDVDPTPNSYFPKRGQTLELVCESLAFKGKGLCKVTQTGFVVLCDRALPGEHFIGRVTRKKGNYAEVTKVKTITPPRDIVDAPCVYAPYCGGCKTQNLSYEAQLRAKEEQVRDLLIHVGKFSLQHLQLHAVLKPIVPCRIQFHYRNKMEFSFGPQRWLPKESLQDRIVDDDTNENYALGLHAPGFFDKILNVDNCLLQSHPANKVLAAVQECWRDPQLGFSPYNVHSHKGFLKHLMLRTGRDVTTDQPEVMVNFVTSSYKPELLKFLVDKVSVFPEVVSVINNVNTSVGNTSVGEEEYTLYGKSSITETLRGLTFQISANSFFQTNTYQAEVLYKLIEDCAGVKGDDSEIVLDLFCGTGTIGLTLARSVRHVYGYEVVPQAITDARLNAKINGIQNATFVQGDLNKIDENFGKNFPKPDIVISDPNRPGMHIKLIKFLLNLRAPRIVYVSCNPATCARDLDYLCHGVEEKNIEGCYKLISLQPVDMFPHTPHIECVCLLELQ

SEQ ID NO: 169788 - protein, 114 aa, Glycine max
  Coding DNA Sequence Number=SeqID_78103
  Subcellular localization annotation: CTP_CleavageSite=19; ConfidenceScore=5.04e-01
MVLSASITIPPSMRSHPIYKAVGNPPKTYSWRLVQLNLLLDSWRLVQLMNLLLDRHQLMCLDRANSVSKVSFSSVTIIFMTDLSLGFGERQAIAIFTTFQAELMSKSPLNLSPQ

SEQ ID NO: 169789 - protein, 168 aa, Glycine max
  Coding DNA Sequence Number=SeqID_78104
  Gene Ontology: Mol. function=protein serine/threonine kinase activity; Cellular component=integral to membrane; Biological process=protein amino acid phosphorylation
  Homolog annotation: Hit_ID=A7P6X1; Match level="QueryCoverage=61%, HitCoverage=14%, E-value=5e-15, Identity=43%"; Hit description =Chromosome chr9 scaffold_7, whole genome shotgun sequence
MADQFRDLVVESEKERVDAGEITEEKEGVAKWWLSSEGTTGSEYEAVANGGGDGRPIVVGGILSAVVFFIALGIVLNIIWRRRCNRKPALKQAVRSNEEIVLKTNNTQYTYSQILTITDNFDKMIGKGGCGIVYLGSLQDGTQVAVKMLLPKCPQGSQQFQTEACFSP

SEQ ID NO: 169790 - protein, 67 aa, Glycine max
  Coding DNA Sequence Number=SeqID_78105
MEVLKVLKHCPNLQHLVIDQGRVAILTVFLNASHRILEHVVFISMVATKQYLNLKDISCRMQDYYKT

SEQ ID NO: 169791 - protein, 92 aa, Glycine max
  Coding DNA Sequence Number=SeqID_78106
MVVIEQEESEHPNANPFNASNDPTDGFQTAVDADLGSDGEGSGSYCREEQNHAEKQQQTEQEPEHVVPRSTESSENNAKINEEESRLVRFRN

SEQ ID NO: 169792 - protein, 92 aa, Glycine max
  Coding DNA Sequence Number=SeqID_78107
  Subcellular localization annotation: CTP_CleavageSite=38; ConfidenceScore=5.38e-01
MGSSLVEIQVPGQKLVNGVPFPAVVSPPPATASSVPLRDSVKTQKAFLESLFLAAWVLGEDDNPNSPIGRGLKSTFLTNHKTLAQQSGNSLD

SEQ ID NO: 169793 - protein, 40 aa, Glycine max
  Coding DNA Sequence Number=SeqID_78108
MERLESTVWKTLLKAASMATKGNFSSVRQNFIRMHETRSL

SEQ ID NO: 169794 - protein, 90 aa, Glycine max
  Coding DNA Sequence Number=SeqID_78109
SVKVKVPVFITAVVGSSAVTYEKWKHERKRDNALTSTSMEQHNQKKNTQSPGEEHFHHAANNGEEARTTPPGTIEVAEARTTRSRKKKMN

SEQ ID NO: 169795 - protein, 150 aa, Glycine max
  Coding DNA Sequence Number=SeqID_78110
  Gene Ontology: Mol. function=RNA-directed DNA polymerase activity; Cellular component=exocyst; Biological process=exocytosis
  Homolog annotation: Hit_ID=A7NZ80; Match level="QueryCoverage=98%, HitCoverage=24%, E-value=1e-44, Identity=55%"; Hit description =Chromosome chr6 scaffold_3, whole genome shotgun sequence
MLNNFESAIQKESSKIPMPGGEIHPLTRYVMNYIAFLGDYGDGLAEIVGDWRKNSLPECYYRSPDREGKKGSSEIAERMAWLILVLLCKLDRKAELYKEVALSYLFLANNVQYVVVKVRNTNLGLILGEDWLTKHELKVKEYVSKYDQAS

SEQ ID NO: 169796 - protein, 121 aa, Glycine max
  Coding DNA Sequence Number=SeqID_78111
MTVVVVITVTLTTTTTRVIVIIVVMAAMVVVIVMILTFSLHIEFLQAISVPIPEKETKICFYSLTVGILKIITFGLPLSEEGALSVIPTEGNCVERPKAALSPIPTERKCAERLEGALSEP

SEQ ID NO: 169797 - protein, 345 aa, Glycine max
  Coding DNA Sequence Number=SeqID_78112
MGVKRLKVINQDLHADKNCPRTKLGYDSADNRKVSLHAIGLSSRWIAKGANNRKVSPHATRILGLWIAKGTDNRKVSLHATGLLGRWIAKWVRITVRCFCVSSNLPSPDDEVQITVRCLRVSSDLPSPDDEDDHLGLCVSSDLPSLNDEGAENCETLRSPTKGADDYIGLCVSLDLPSPDDKGADNREVSPCVSDLPSPNYERSLTKGANDHVSLFVSSGFPSPNDEGADNHEGADDHLCLCVSSDLPSLDDEDVDNHEMSPRVIRIAACRLRMTRAWITMRCLRVSSDLPSLDDEDDHIGLCVSSDLPSLDDEGANNCEDKGKNCYPGSRLRADGLRFWPKKAL

SEQ ID NO: 169798 - protein, 39 aa, Glycine max
  Coding DNA Sequence Number=SeqID_78113
MEVEEPWLGLWPPLNYRAGFVSDLVMAFVDDWVVGNEKG

SEQ ID NO: 169799 - protein, 117 aa, Glycine max
  Coding DNA Sequence Number=SeqID_78114
MATSPNNHTTEMHMTFRRRLYLSMVSRDIIPFDINVVAVGTTSDNISSKRKTLDEGDAKAHGSVFQGRKTRGVSNNVYLRKKLEKPKHGLGTLSMKGSEVVFTHGEGISTSRTHHKG

SEQ ID NO: 169800 - protein, 117 aa, Glycine max
  Coding DNA Sequence Number=SeqID_78115
MAWIDLFVAISYVIEHASCSGHAKQKSFSSSNTFFTYEGSHGLSKDGGERGVYKRDDAQNEHSKVVVNGLSKSKSHIPPKSRKRESSITIATNMEEEVDPYKVIPFNMSFSKCLVEP

SEQ ID NO: 169801 - protein, 65 aa, Glycine max
  Coding DNA Sequence Number=SeqID_78116
MEELEDAMIYTSRPWIFFINGVLSFLKIMAVERRRKKDDWRRHFKEKMSQEEAHHHRKTWIRSWR

SEQ ID NO: 169802 - protein, 152 aa, Glycine max
  Coding DNA Sequence Number=SeqID_78117
  Gene Ontology: Mol. function=oxidoreductase activity; Cellular component=integral to membrane; Biological process=electron transport
  Homolog annotation: Hit_ID=Q2MJ13; Match level="QueryCoverage=54%, HitCoverage=16%, E-value=2e-24, Identity=66%"; Hit description =Cytochrome P450 monooxygenase CYP83E9
MLPLAYILIALHALLQLILFRAKNNPPCPLGPRGLPIMGNLHQLDVSKLHFQLRQLSKTYGPLFSIRIGFKKAIVVSSLKLAKEVLKDHDLDVRNRPPSLGTLKLTCNSLEQRLLERNKKNLCCPSLQWPCARLIFIKTLEILPGSHTSNPT

SEQ ID NO: 169803 - protein, 266 aa, Glycine max
  Coding DNA Sequence Number=SeqID_78118
MMAHHISIQRVNNPPFKMMLLLTPLYLMFNQFARRLQLFNSLKEAYEELRQYSLRKKSELSPILTWTMNEAKLQPKIDWTQFPLEVEEEEVTCPPSKHQEPYVTSKAFEKDPPTGIEVLPPPKWKQLHPKVFKPSSLTAQRKDVYKISSGAYIQKVSYDKDTICWFYYGHQALSLTKDNDATCTHMCRNVPFAGERGRGSRVRFPKEERGTESPPTFICGKRRKNRRKPVKNKILSSGFVFTLEEGRQKRGFCSYVPSFGEEIRPT

SEQ ID NO: 169804 - protein, 250 aa, Glycine max
  Coding DNA Sequence Number=SeqID_78119
  Gene Ontology: Mol. function=aspartic-type endopeptidase activity; Cellular component=nucleus; Biological process=DNA integration
  Homolog annotation: Hit_ID=Q2QUC6; Match level="QueryCoverage=30%, HitCoverage=10%, E-value=2e-09, Identity=41%"; Hit description =Retrotransposon protein, putative, Ty1-copia subclass
  Pfam annotation: Domain name=RVT_2; Domain location=104-245; Score= -179.4; E_value=0.0072; Accession=PF07727.5; Description=Reverse transcriptase (RNA-dependent DNA pol
MVNTIKIEKFTGKNSFNLWRTKMRALMKEHVIWALSLVLYEVYWKQDCPKKAKKYFVAALVQNDSSSENDLILKKFGGNTLIGNDAPCKSIGIGIVRLQDPYGAIEMESKDFESGLHLNILSRDVVFDKIYMLNSKSDEDLGKAEDVATLDMELEQLDVKTSFLHGRLEEDILMQQPEDFERFDEFSVSHGYIKSDVAPCVACRPWIFFINGVLCFLKIMATEWRRKKDDWRRHFKEKMSQEEAHHHRKS

SEQ ID NO: 169805 - protein, 147 aa, Glycine max
  Coding DNA Sequence Number=SeqID_78120
  Homolog annotation: Hit_ID=A5AQM5; Match level="QueryCoverage=59%, HitCoverage=8%, E-value=5e-10, Identity=39%"; Hit description =Putative uncharacterized protein
MGDVQKRFTHIVNHLKGLGKVFGEDKLNVKILKSLNRTWQSKVMIISDSKDLSSITHVELLKKLREYEIDTTWMTEEVAKENKSRGLVVKSSIRSSDESDEENGKGRRVTRGMRVPRKEYARSRHQRLFEESVGKTGKDEIYELFSE

SEQ ID NO: 169806 - protein, 205 aa, Glycine max
  Coding DNA Sequence Number=SeqID_78121
MGEVDEVQEWIKADIEALKEKMATMMEAMMSMKKKMEVNAAAVAATSIVAKVNLTPPSDNNQINHPTSDRVGQGGKELGSTGAPHFVQVQNRHPFPPYGLPPNYTPPNVVHTLDENVNNFSPTLIESQQTQLDHAHIPQPMEETHEIPHHNLVDFEPCLGYAIEGQAVGGVPLPNTSEGPQFRPQRQPLHFAAGRSLLLWRKKGN

SEQ ID NO: 169807 - protein, 136 aa, Glycine max
  Coding DNA Sequence Number=SeqID_78122
  Subcellular localization annotation: CTP_CleavageSite=55; ConfidenceScore=5.19e-01
MGSQAQFAIFQHSVLCVTGPNRDKERMLQHGGSLRRQSSEFVATYPSAGGRRETRGMRVPRKEYARSRHQRLFEENVGKTGKDAIYELFSERFGSCIYARGRRETLRHRTINDLLGWSTKAGLLLLRILNEELRPT

SEQ ID NO: 169808 - protein, 224 aa, Glycine max
  Coding DNA Sequence Number=SeqID_78123
MVWCLQSPFLLLHSAVIDLQEAKDSIDEEDPRPTSSTWSYIKGQPLMVKEECKEVSVFFKRLAKKESHFVIKTNIKETYLLRQPPHLVLCKKTLVSTATPLRLEVIPHVNELLDEGIIRHQIPKIGDLMNVLSGATLFCKITHAPTIFMICVHRDSLGSDQEVPTYPKRITVIPLWPTPSSVEGRNLEFQEPLDLRALDIRLKEDWVRDAKEGHRVLMKLRVDF

SEQ ID NO: 169809 - protein, 106 aa, Glycine max
  Coding DNA Sequence Number=SeqID_78124
MSQFQGSKQRRLVVAIDGRGWWRRSELISLSEFSPRVGIALSALVSLISEISGCYQRYLMGNFSFKNNIENKKVRIKSLGIFFDNLLEVEVVEEFKKEEAFSQYLD

SEQ ID NO: 169810 - protein, 77 aa, Glycine max
  Coding DNA Sequence Number=SeqID_78125
MGSEKWDCHHQKRGDCGSNDFQDYFDDAKESKVKQVPKNQASRIMSQRIKIHEQLSFKFQDSRTIKIKIQDSRFKRS

SEQ ID NO: 169811 - protein, 97 aa, Glycine max
  Coding DNA Sequence Number=SeqID_78126
MEGVVIVVCYDGDVVSTSKGVLFESPNGPKVIKISEEMSLSALRKAVTDAIESDDCVEYDCMELKDDNEMGKMFFIFSQFSSKGPIKLYAMVGRSPK

SEQ ID NO: 169812 - protein, 109 aa, Glycine max
  Coding DNA Sequence Number=SeqID_78127
MPSKIILMMSKNQESNKFQESRSRFKNNQDQDSRFKAYIYLGCYTENKRGYIYYGFVQVERTSTWLFKENKGGYIPCGSLLVKDFTRLLEISRTGGCLGTGCRHGLWPN

SEQ ID NO: 169813 - protein, 70 aa, Glycine max
  Coding DNA Sequence Number=SeqID_78128
MTDQGSLLQRPSKGEGQRSSSEVDEDALNTFLKTPVIIKEGETLSAYSRFALLRPDPQELAAKLYILGGI

SEQ ID NO: 169814 - protein, 95 aa, Glycine max
  Coding DNA Sequence Number=SeqID_78129
MITKDDDKGDDKKLKGQSKNEFKKFKIESRTLQDSRGKLNSRIKNQDSRDQGSRLKIQESRKGYSRIKKKLNQDKYEKGTSFVVQVEGTSTWVVD

SEQ ID NO: 169815 - protein, 108 aa, Glycine max
  Coding DNA Sequence Number=SeqID_78130
MVAIVVNNGRDDDGGGGGIVMVMIVVWNGSGGGNGVVVVAVALAVVVAIAMVERWCGMVVVEIAKARCGGGGMVEATIVRCGGGDGGNGGGGDCGRMVARAMTVVVVW

SEQ ID NO: 169816 - protein, 96 aa, Glycine max
  Coding DNA Sequence Number=SeqID_78131
MAAMAWEVKREVHLGGSRRFTATIMTRMKKMQKLKKMQKNEEAQRFEEEETYGAGERESTKFRALLFLSLHSPPSSSKLLSMASYGGELLLDSSSP

SEQ ID NO: 169817 - protein, 159 aa, Glycine max
  Coding DNA Sequence Number=SeqID_78132
MGTNQNGKRFYKVKVKSLDVTSLKELGRLMGPLQRQAFRKVYGKILDLAAAEVFTEAAVSLAQYYDQPLSKGVGSHEANSERRSGPQKYLEGKARDMASQEKWGPFPDILALLIFGVVLFPNVDGLVDLAAIDAFLAYHHSKESPVVAILADLFDTFDR

SEQ ID NO: 169818 - protein, 151 aa, Glycine max
  Coding DNA Sequence Number=SeqID_78133
MYNYHEKGRAPNLESVLVVFMTYQASSKAEGLSNMDDLLMQFKDTVDSMQQAFKRIETQIGKLVDDMTKVVVRREEQYAEIEAHQESILQVTTIHHQLINEEEKDEVSSTPKYLYMATVGYVVGKDKGRLELSVEDHKIYFDLFEAMNTQI

SEQ ID NO: 169819 - protein, 190 aa, Glycine max
  Coding DNA Sequence Number=SeqID_78134
MEAITNGMMNMNRQRHQHLVALRMIFSHETAGNRRGIHSRAMKTFQFVHGKRCNKGEHYPISPAHRLSLPYEIPDEHSSGGQECRNIQMNGPVKVEPLRADQRLIFAKSGQGSLVLQWLLFLSAVPPVSATDGVVRNGKSTAGHQRWQAAQLLGRAIGAGLFAITPAGERGMCCKAIKLGNARVFPVTTL

SEQ ID NO: 169820 - protein, 71 aa, Glycine max
  Coding DNA Sequence Number=SeqID_78135
MPISPCKSIGWSVSSRHGDRTHKTPSGPEKVEQGPGVSSSGYGPLSVLQGARTPRQGHVIIGKYAHCSTDF

SEQ ID NO: 169821 - protein, 68 aa, Glycine max
  Coding DNA Sequence Number=SeqID_78136
MINDGELIQSELPPTTQYQLPKVKESNDKPVIATPFKIKDVNEDITSKDIKGLMEQANYTNKYLQVLG

SEQ ID NO: 169822 - protein, 19 aa, Glycine max
  Coding DNA Sequence Number=SeqID_78137
MVQGKFVPNLGELVSRYES

SEQ ID NO: 169823 - protein, 51 aa, Glycine max
  Coding DNA Sequence Number=SeqID_78138
MNLGTLYSASLTPIYSKKGDLVDFQLSQASKVTSALSHLGAQASQRLAWES

SEQ ID NO: 169824 - protein, 63 aa, Glycine max
  Coding DNA Sequence Number=SeqID_78139
MAVVIHFWALIAMTAQLIHDRVVMECLEGVWETLKDNERCQFYGTVRLTATSLVHPEQPARTL

SEQ ID NO: 169825 - protein, 79 aa, Glycine max
  Coding DNA Sequence Number=SeqID_78140
MARNVFAPCPYLKGPIWEGTKRAFSDNSKGGHISLDGLGSSSSMDSFASWKINGSGMEKEEREETPLQGEDESRRSSPP

SEQ ID NO: 169826 - protein, 212 aa, Glycine max
  Coding DNA Sequence Number=SeqID_78141
  Gene Ontology: Mol. function=motor activity; Cellular component=cell projection
  Homolog annotation: Hit_ID=UPI00016621D1; Match level="QueryCoverage =64%, HitCoverage=40%, E-value=1e-12, Identity=35%"; Hit description =UPI00016621D1 related cluster
GGPLGTSTLTFGGLHVLPFRGPHALAFRGPHVLAFRGLHALTFRGLYVLAFRGLHALAFKGLHALAFRGLHVLTFRGLHILAFRGLHILAIRGLHILTFRGLHVLTFGGPHVLIFRGLHVLAFRGVHILDFRGIHILTFRGLIHDVGYNVQDILPENTGIAKSIEAAGSHDVGYNVQDILPENTRVAKSIEAAGSTMSDTMSRTSGPKILDI

SEQ ID NO: 169827 - protein, 166 aa, Glycine max
  Coding DNA Sequence Number=SeqID_78142
  Gene Ontology: Mol. function=pyridoxal phosphate binding; Biological process=amino acid metabolic process
  Homolog annotation: Hit_ID=A9PET3; Match level="QueryCoverage=74%, HitCoverage=27%, E-value=1e-37, Identity=66%"; Hit description =Putative uncharacterized protein
MCIVSSVISAYPIRASTPIVTSPLSIPRNVINAHQAIANPFVPEVVKAVDALHSEFRAVDNLVACNTTRVLKAFQNARVGSHHFGGSTGYGHDEPGGRGALDQAFAEIFGAESAIVRSQMSLGSTVAIFSYLDIMGSYPRNIFIACGIKIACIYPPCTPLGGSLVL

SEQ ID NO: 169828 - protein, 19 aa, Glycine max
  Coding DNA Sequence Number=SeqID_78143
FDTEDFFWGLLEEDIKERQ

SEQ ID NO: 169829 - protein, 52 aa, Glycine max
  Coding DNA Sequence Number=SeqID_78144
MHIVVVRQGQDHLELPSGVETKLEQQKPIKVHRDGCKWGWGHDRPIVAPSLR

SEQ ID NO: 169830 - protein, 93 aa, Glycine max
  Coding DNA Sequence Number=SeqID_78145
CVSGLQQLALDEIYHSPENSALKDLKDKDVLDIVSDIVDPAQSVKAITDLCVQYCRAGCPGHCIRHRGSCSFNSSLDILSCLVHCAARSDSLT

SEQ ID NO: 169831 - protein, 535 aa, Glycine max
  Coding DNA Sequence Number=SeqID_78146
RLRAERGRRRQLPRFFEPEIGVALPGRRLPVSLVFRHHVAERRERRRFQRVAAANMGVNRRHAASDGGEAETVHQQMVIALIPEPAVIRQAHHHMAIQRCAAAGAQIARQIDVHQRARGGFGIRRRRQIDKFRLVHRQRVIQPLHRHAVAFRKTQAQHVHLAQALDDGLQQRLYGNGAVEFDGVGHRVGIAMRGDLIGDPDAGLRRDQRPFARKRRAAERVRECLANAVPATRCTRLSIMCSSCRRRCRISGGESGGPDRLQPVGQAAAPAQRVVPAFHHPVVHPMAGVAQASRHFAADPMHQLFLRTGFHKYLQRTVVAQAMPFHLLHQPAGVVGDARQLQHVAPRPPVGTGLGNYRAEALRPAQPGIQGSQAAKALPRHHRIGRFVAVRRPVGQLRHQFFLHRQPEIVLADRHLLRPELTVEQDSQRTLGRLAVAGGVDPNVAAVAQALALPAPAGDLILVERTPYRLRRRIRHVQAGDAVAAGALPGAIRVEQIGGGAGEHLVPPVAQVVHVGVRIVAAERRRPLVKAGNKA

SEQ ID NO: 169832 - protein, 125 aa, Glycine max
  Coding DNA Sequence Number=SeqID_78147
MYPPLFSLNLVDVPFTRTDPQEMYPLLFSVKPKEKGDIKEFRRLVLRSFGKRRRETQKEFRRLVLDEFFLAKGEENGKMNSTSFQGLENQKTSESFWYKEEEEVQRDSRLVKDCKKLIGKLFKIE

SEQ ID NO: 169833 - protein, 103 aa, Glycine max
  Coding DNA Sequence Number=SeqID_78148
MAYERGGDFLEDARKILNREAFPPGGSLVRSPVPAFRFTGVIPLLWPRLSHSTPDTQFRVGSSLQAGLYARTPRSSDRCALSGNYRLESNPERHAKAPLAAAT

SEQ ID NO: 169834 - protein, 167 aa, Glycine max
  Coding DNA Sequence Number=SeqID_78149
ALGFPALITGLCQSFGVPVTPSKVIRPPITRAFIEKYCTQRQVQGDAPQATDAPPPHQASPAGSFNTKQYLWHLVRQQAANHRAHVQTHDCLYQMSLSLQSQGFTSFSCPTPDQFRAEVAWPGDWPDAQAGEAPAGAPAEAPDEADEAREDEEMTDLLDFLGGSDAT

SEQ ID NO: 169835 - protein, 137 aa, Glycine max
  Coding DNA Sequence Number=SeqID_78150
  Homolog annotation: Hit_ID=Q6UUU1; Match level="QueryCoverage=43%, HitCoverage=40%, E-value=1e-18, Identity=78%"; Hit description =Putative uncharacterized protein
MTNKERRNKRELQELARVQGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169836 - protein, 84 aa, Glycine max
  Coding DNA Sequence Number=SeqID_78151
MTRSKTKQSVDTLQQMVSDILNKAKVEKDEGPEAKLLSGFLVEPISDLSRYDVYPDLSSLSGSGIIQNSVTCIKRSAPSKDHIT

SEQ ID NO: 169837 - protein, 70 aa, Glycine max
  Coding DNA Sequence Number=SeqID_78152
MSLAVFGDGEVAYPFVEAIPTRKVNAQKYWVCTWVRQSVNRVVYNLTMVVNDNDEAMVMFGGCEWEGYES

SEQ ID NO: 169838 - protein, 128 aa, Glycine max
  Coding DNA Sequence Number=SeqID_78153
  Subcellular localization annotation: CTP_CleavageSite=51; ConfidenceScore=5.42e-01
MALQLEKNKETFKKKGGSSFKSHEKGVALGKNNSNPTPTSSKSRKGKNQKNSQAVSPLNLLSRGGRENQKNSQAISPLNLLAIGRRDEKIAHFCFLQNFHLQKNKVLKQSLESFLAKKKQWAMVRERL

SEQ ID NO: 169839 - protein, 74 aa, Glycine max
  Coding DNA Sequence Number=SeqID_78154
MEVDLSQQPHSEKVEEKVVSEEEKKSNEQATNKELSLHGLGTSLFFRRRMKTWQILLIISLKETELLNHDHQGE

SEQ ID NO: 169840 - protein, 81 aa, Glycine max
  Coding DNA Sequence Number=SeqID_78155
MHKALRANAPLPYPQLVTLFLRHFQIPLDDEPFVQVKRSFAIGAGAVTSFGYRIDIRLTQLEEDVGYIRQSFDLPPPPPLS

SEQ ID NO: 169841 - protein, 246 aa, Glycine max
  Coding DNA Sequence Number=SeqID_78156
MIMRGQDIYSSQDEATTSPSSSKSEEAKGEESSEEIYPQEEGQPLMVKEECKEVNVSSKRLAKKERHFEIKTNIKEISLLRQPPHFLLCKKTLVSIATSLRLEFIPQVKELLDEGLVRKRLNPCALLVPKIGIIRHQIPKIGGVMNALGGATLFCKITREPNIFMICVHRDSLGVPMNPKRIKVIPEWPAPPSHHSLRPLELVGLGSSSSMDSFASWKMNGSGMEKEEREETPLQGEDESRRSSPP

SEQ ID NO: 169842 - protein, 21 aa, Glycine max
  Coding DNA Sequence Number=SeqID_78157
GAGSKILVRNRRADVMTLALF

SEQ ID NO: 169843 - protein, 125 aa, Glycine max
  Coding DNA Sequence Number=SeqID_78158
  Subcellular localization annotation: CTP_CleavageSite=100; ConfidenceScore=5.37e-01
MSFAPSLTVESVHFLVKSFRDFKFRLKNNKLGFIVSYVTPTLSRATFPKYVLNFFLWGPSALPIAGSTLTTGHSAPGGLVANDRSRVALRVRFNVDGDADASTGGGGVDAIGFDVLMMIMMVCCN

SEQ ID NO: 169844 - protein, 169 aa, Glycine max
  Coding DNA Sequence Number=SeqID_78159
MGERELEPLEINDEAGPIARDPGKKANEALIKKSEKEKFVRIVGARDIRLKVDDNRGHAAVETEDAFGLEGFHNCVASVFVNLCCALGLHLGFDGVEGEEADVSEGADEATRGGVDEDMIKDKEGFEEGLWAGLWAGPGPFGGGGEGESGGRPREDEKVWCTCVGCNEI

SEQ ID NO: 169845 - protein, 465 aa, Glycine max
  Coding DNA Sequence Number=SeqID_78160
  Pfam annotation: Domain name=Peptidase_C48; Domain location=250-447; Score=-28.7; E_value=0.028; Accession=PF02902.10; Description=Ulp1 protease family, C-terminal catalytic domain
MGTSPHQKDEGGVRHTSATATLDDVVGAIKHLTQTLENMDNQNRTRLNAIENTNHTMLKAICNFVRQDQHESTKDAMDDVAMSGTQNTCVNDQRLPCENPKKPVSTPTVKSTKNEAYSKSTGSFKNIETIFIPGDDDDEFINPLPMGMKGSKSSYSSPRTLNLSGPNQVNTTDNSSPPEPFMSNYVTGLTTKDMPCCFKPTVDMNLTFEETQVCAYVFNPNLDPSGKEILYRVGNNLGTRQTFHSLCPNKPVREEIILFMCLKVAYSQLYRTRSVWCMPPAFAVDVINGSPVETLIEHYGKDWMPPFSDLKLIYIPIIQNSAHWYLMVIDMNDRNIYHLDCDLTSQTAYQRKDTIKIMANVMLSVLEIVFPTQEFVIGFDGMDCWDIIEARGIPNCGSSEKSTLWVLEWMQMEESFVSLLYGVLEEKAVRMKVAMILLLGTHNQCRGELITNAERNWHDSIHGKH

SEQ ID NO: 169846 - protein, 279 aa, Glycine max
  Coding DNA Sequence Number=SeqID_78161
  Subcellular localization annotation: CTP_CleavageSite=29; ConfidenceScore=5.06e-01
MASFSQLQSQMQSQAPPEPLVGPGPSIPRVSTKGSCVDPSGNDSETGDSDRYGLYIEADPARLVAVGRVYEGSTLVHNTPLLPSQVKLSVDEVKDADAPVHVPTAEVAVSPPKPPPKPDPEVDDPLYLMTLTIPELFLRPYQVRWDATVFGVVNPYFPLYIKHEDLSKIAHGGQCLSISMLQLWILFHCSGHWQMVVILPKEHLVVWFCSLHNRPDNYLKGIINSAIKGLDDAPQPKSKALARWIVVKYFNNPRPLEPERLKALRIQSAQFYLQVRDQA

SEQ ID NO: 169847 - protein, 263 aa, Glycine max
  Coding DNA Sequence Number=SeqID_78162
  Homolog annotation: Hit_ID=Q2A9I2; Match level="QueryCoverage=37%, HitCoverage=59%, E-value=8e-09, Identity=33%"; Hit description=GRF zinc finger containing protein
  Pfam annotation: Domain name=zf-GRF; Domain location=170-216; Score =49.1; E_value=1.5e-11; Accession=PF06839.3; Description=GRF zinc finger
MEYQSFGRVPTAKGANIMQALKHSTNNTENYSDQTKLDEGHGVLLLGEKKMPSRLDEMAFPDSGNADFAAEAKESSNGRNDESDGAKEDKAQQELLRQKYRKMCMNGCLVFSVWFPPRAIEEPKLPWTTFLLSSKGFFKSKGNNQPLLENDGGAMERSSSSYTFEARSRVFCLCNIEAPLVTSWTEENPGRRFYGCGLYKDIGTKGCNFFQWHDPVGNNRQKKIIVGLMKEVDELKLREKDLQTMISEMKMKEKCLWIVLVVC

SEQ ID NO: 169848 - protein, 133 aa, Glycine max
  Coding DNA Sequence Number=SeqID_78163
MSVKNLVGRLGVHDKTNHTIGDQSGSQCFARMFQPYGINIGLKEHSNRVTPKAYTPKSPSGLLPPDSASDSNISSGFLRFFQLFLPLTAPIEFPSVRETEKRLKPPLILSSCESFFSLNENYLENPNGESVRN

SEQ ID NO: 169849 - protein, 56 aa, Glycine max
  Coding DNA Sequence Number=SeqID_78164
MSVKNHPGTLRRRPVRVIVFYENAPTVWDQHRVKGALKPGDPQGLHSEESIRASPS

SEQ ID NO: 169850 - protein, 212 aa, Glycine max
  Coding DNA Sequence Number=SeqID_78165
  Homolog annotation: Hit_ID=A7QDW6; Match level="QueryCoverage=27%, HitCoverage=26%, E-value=7e-11, Identity=41%"; Hit description =Chromosome chr4 scaffold_83, whole genome shotgun sequence
MEEEHATKVPLPDAFLQFLETNGLDPSIYTAIDSTPRYIRAYREGKIYGIDAAFGAVVMALNTWGSCSRPVCYSCTEQVSLGWKEEWMCSRSGHLEDHGKRGKRQIKVETLDIVKALLDKSLTTGFPAARPMESDFPAKALYLNCPQLNDLNLNSCRNLHPGSHFTPCSIAIISQKFDATLQIIQMYGLGFVSTGGFGMPSYFPFFLYTLLS

SEQ ID NO: 169851 - protein, 282 aa, Glycine max
  Coding DNA Sequence Number=SeqID_78166
  Gene Ontology: Mol. function=cation transmembrane transporter activity; Cellular component=integral to membrane; Biological process=potassium ion transport
  Homolog annotation: Hit_ID=A6TFY7; Match level="QueryCoverage=100%, HitCoverage=50%, E-value=1e-123, Identity=84%"; Hit description =Putative transport protein KPN78578_40470
  Pfam annotation: Domain name=Asp-Al_Ex; Domain location=102-276; Score=219.8; E_value=6.3e-63; Accession=PF06826.3; Description =Predicted Permease Membrane Region
  Pfam annotation: Domain name=TrkA_C; Domain location=19-89; Score =56.7; E_value=8.2e-14; Accession=PF02080.12; Description=TrkA-C domain
  Pfam module annotation: Pfam domain module=Asp-Al_Ex::TrkA_C; Domain location=102-276::19-89
LVIGKEVATSLSTRGTDLKVERVVVTNEKVLGKKIRDLHFKQRYDVVISRLNRAGVELVASSHASLQFGDILNLVGRPQAIDAVANELGNAQQKLQQVQMLPVFIGIGLGVLLGSIPLFIPGFPAALKLGLAGGPLIMALILGRIGSIGKLYWFMPPSANLALRELGIVLFLAVVGLKSGGDFVDTLLHGEGLSWIAYGIFITAIPLLTVGILARMLAKMNYLTLCGMLAGSMTDPPALAFANNLHATSGAAALSYATVYPLVMFLRIITPQLLAVLFWGLS

SEQ ID NO: 169852 - protein, 107 aa, Glycine max
  Coding DNA Sequence Number=SeqID_78167
MDNHQHGNHSDTAQTRIKKKGTRQHKVNDQAQNIDSNIRDSSEDESSESTQGSASVSSPENQNYMSSANEPAINREGYSDLGGQLIHGATVMQICGMMKESQNVKEL

SEQ ID NO: 169853 - protein, 141 aa, Glycine max
  Coding DNA Sequence Number=SeqID_78168
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=71%, E-value=3e-24, Identity=68%"; Hit description=LacZ protein
MKHFTDTLISANIDKHSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 169854 - protein, 384 aa, Glycine max
  Coding DNA Sequence Number=SeqID_78169
AVLRAPPEINRAAAVVGEAAAVAGEQHAGSGAARAGAVDAHIDIAAVAGLRIGIKADARHAVGQIAAGGTEVKHAIVCEIAAILHRYRRGVVAGRADAGAINTVEEAAVDDAAAAVGGRRAIQRQRGAAARQFPVDGGIGPAGHAYRAIAGPYHFQRFTGGDSDLRTGAFGIDHHAATYRLRHFIRRSGADVIDNIAVGDSDRLIERAEGGGFAVQRLHAKAAVIGGEVLYRQAVGHLAAGNVGRRTVKGDAVVVVPVEGAAVTDLKQRGVFGRHGPGVGAGAAIGVSLTNADIQRTAAAADIGDARVDILIVIHVLQIRYHRAGGNRCLRHQAGGIKHLKGGVAAGSGIRHGDGEVLCARRDGHLAERGVDRPVNARLKRLIT

SEQ ID NO: 169855 - protein, 82 aa, Glycine max
  Coding DNA Sequence Number=SeqID_78170
DRELRGSSNGSIGGYHKWLRVRTQGLDWLPNLKTMRDDAVKASEESDEGLYRAAIVSSSSEEVKGIITGQRHDLEGRAKGLP

SEQ ID NO: 169856 - protein, 104 aa, Glycine max
  Coding DNA Sequence Number=SeqID_78171
MKKKIEMMKKTFPSLLRNFRNSSRKEELTGVRISIMEENHKMILKSLGVTNATKLVTSRPTVLQMKNGRRKVKREDLMKEELRKHTLHGMIMIHPMVEKRRLIF

SEQ ID NO: 169857 - protein, 102 aa, Glycine max
  Coding DNA Sequence Number=SeqID_78172
  Subcellular localization annotation: CTP_CleavageSite=52; ConfidenceScore=5.50e-01
MVVFSSVERVSGSVKVKLLSGGVFFRWRRRSSLRSLRKNFFRKKLAEELLLFANMVSQPTLRQEGNAGLTGASFKKGKCAESPPRLIRGKRQKNRKGVVYKL

SEQ ID NO: 169858 - protein, 132 aa, Glycine max
  Coding DNA Sequence Number=SeqID_78173
MYCRKMGAYVKDEELLIHSFQESLTGVAVTCFADLVFASERIDVGPKRGKFSHPAWTNEKTGTNEEDEDEVEAHAVTAIPIWPSFPPTQQCHYSASNNPSPYPPHSYPQRPSLNHTTKPTYYTTNAETPLLA

SEQ ID NO: 169859 - protein, 168 aa, Glycine max
  Coding DNA Sequence Number=SeqID_78174
  Pfam annotation: Domain name=G-patch; Domain location=4-45; Score =22.0; E_value=0.00042; Accession=PF01585.14; Description=G-patch domain
MAMMVAQVMLGNGYEPGMGLGKNNGDRTILVSTKGNHGKFGLGYKPTQADIRKSVTGMKSRSQGHEGQVIAICEDDSLSESDLVRPCPLSFQLGNWRVEERPDIYATSIISDYESLEGTNTWDPTINFKQKAGQTESEEDEDVELPLELEKIVAREDQEMGLIKKRRN

SEQ ID NO: 169860 - protein, 71 aa, Glycine max
  Coding DNA Sequence Number=SeqID_78175
THLLLEVASPLSLPFSIPLPFIFQEAKESIDEEDPRPRSSNGACIKSAGLASHPLSTPFPWLSVRKNLEEG

SEQ ID NO: 169861 - protein, 69 aa, Glycine max
  Coding DNA Sequence Number=SeqID_78176
TYQGNPCDVYPDLSSFTGSGVYPDLSSFTGSGVYPDLSSFTGSGVYPDLYSFTGSGDIQIFVTCIKRST

SEQ ID NO: 169862 - protein, 115 aa, Glycine max
  Coding DNA Sequence Number=SeqID_78177
MASRKLPAKRSRKDTTGKGSSAAPQGEIAYRHWAPLVTPMAKFDPKIVMEFYANAWPTEEGVRDMHSRVRGQWIPFNGDALSQFLGHPLILGEDQQYEYSQRRSQASGFDEEAIV

SEQ ID NO: 169863 - protein, 85 aa, Glycine max
  Coding DNA Sequence Number=SeqID_78178
MEDWGNFLHRILEEDSEDSAPIKVFLLVWGFGGSWQPLVVVGGGERGVRESTFLAQHANSCSVQLPLHYGSLSGPILAQRNSLSG

SEQ ID NO: 169864 - protein, 283 aa, Glycine max
  Coding DNA Sequence Number=SeqID_78179
  Gene Ontology: Mol. function=serine-type endopeptidase activity; Cellular component=cytoplasm; Biological process=proteolysis
  Homolog annotation: Hit_ID=A8GHH5; Match level="QueryCoverage=91%, HitCoverage=36%, E-value=1e-124, Identity=80%"; Hit description =Oligopeptidase B precursor
  Pfam annotation: Domain name=Peptidase_S9_N; Domain location=1-281; Score=35.4; E_value=1.2e-13; Accession=PF02897.6; Description=Prolyl oligopeptidase, N-terminal beta-propeller domain
MAPYQKLRATLYQEMLGRMNPDDRSVPYQLNGYRYQESYAAGKDFARYQRQALTADAPWQTLLDANQRAAGHAYYRLGAMDVSQDNRRLAVAEDLQGRRQYRISLREIGSERWSPETLENTSGNMVWANDNQTLFYVRNHPQTLLPYQVYRHQYGTPTAEDKLVYQENDPAFYLSLGRSSSRDYLILTISGNTTSEVRLIDANQPQREPQLFAARQNGREYYLDHYRGEFYLRSNHQDPNFGLYRTAAAGKPWQTLIAPQRSTRWRASACSATGWWCRARQRA

SEQ ID NO: 169865 - protein, 273 aa, Glycine max
  Coding DNA Sequence Number=SeqID_78180
  Gene Ontology: Mol. function=coproporphyrinogen oxidase activity; Cellular component=cytoplasm; Biological process=porphyrin biosynthetic process
  Homolog annotation: Hit_ID=A8GHH2; Match level="QueryCoverage=100%, HitCoverage=89%, E-value=1e-145, Identity=88%"; Hit description =Coproporphyrinogen III oxidase, aerobic
  Pfam annotation: Domain name=Coprogen_oxidas; Domain location=2-273; Score=635.5; E_value=4.7e-188; Accession=PF01218.9; Description =Coproporphyrinogen III oxidase
MSLPNIAEVKSFLLALQDHICAQLAQAGDGAAFTEDQWTREEGGGGRSRVLTNGAVFEQAGVNFSHVSGATLPASATAHRPELAGRSFQAMGVSLVIHPLSPYVPTSHANVRFFIAEKPGEAPVWWFGGGFDLTPFYGFAEDAVHWHRTAAELCAPFGDEVYPKYKQWCDDYFFIKHRNEARGIGGLFYDDLNTPDFDHCFAFTRAVGQGFLDAYLPIVEKRKALTWGERERQFQLYRRGRYVEFNLVWDRGTLFGLQTGGRTESILMSMPPL

SEQ ID NO: 169866 - protein, 695 aa, Glycine max
  Coding DNA Sequence Number=SeqID_78181
  Gene Ontology: Mol. function=secondary active sulfate transmembrane transporter activity; Cellular component=outer membrane-bounded periplasmic space; Biological process=sulfate transport
  Homolog annotation: Hit_ID=A8GHG5; Match level="QueryCoverage=45%, HitCoverage=93%, E-value=1e-163, Identity=89%"; Hit description =Sulfate ABC transporter, periplasmic sulfate-binding protein precursor
  Pfam annotation: Domain name=Dyp_perox; Domain location=6-271; Score =404.2; E_value=1.9e-118; Accession=PF04261.3; Description=Dyp-type peroxidase family
  Pfam annotation: Domain name=SBP_bac_1; Domain location=292-560; Score=70.5; E_value=5.5e-18; Accession=PF01547.16; Description =Bacterial extracellular solute-binding protein
  Pfam module annotation: Pfam domain module=Dyp_perox::SBP_bac_1; Domain location=6-271::292-560
RIRRLAPGLQAVLSDAERAAAAVPDARLGAVIAFGYDVWHDLSSGQGAQELKPFTPLGKGLAPATQRDMLIHIQSLRHDVNFTLAQAALAAFGNAIKIEEETHGFRWVEERDLSGFIDGTENPQGEQRPAVATIAEGEEDAGGSYVLVQRYEHNLRQWQRFTTEQQEQIIGRTKHDSEELPADQRPDTSHVSRVDLKEDGKGLKILRQSLPYGTASGKHGLFFIAYCARLHNIEQQLLSMFGDLDGKRDAMLRFSRAVTGSYYFAPSLTRLLNDSVIRCRMKQNRVKNLVLKGWLAAALLASGAASAAELLNSSYDVSRELFVALNPGFEQQWNQQHPNDKLTIKQSHAGSSKQALAILQGLRADVVTYNQVTDVQILHDRGQLIPADWQARLPNNSSPFYSTMAFLVRKDNPKGIHTWNDLVRDDVKLVFPNPKTSGNGRYTYLAAWGAASQADGNDAAKTRAFMTRFLKNVLVFDTGGRGATTTFVERGLGDVLISFESEVNNIRKQYGEDKYEVIVPPVDILAEFPVAWVDKNVERNGTEQAAKAYLNYLYSPAAQQVITSFYYRVYDQKAMAAAKGQFPDTQLFRVEDQFGGWPQPRQQPVLYLFDPAVAAHRAGDAAGTDEPGAILGSDFQPAGGGGPVQRGVRHADGLDPDALPFSRPFAAGRPDRSAVRTADRSGRPDAGGAVFHHWL

SEQ ID NO: 169867 - protein, 109 aa, Glycine max
  Coding DNA Sequence Number=SeqID_78182
MGKGRIKRISDCVVLNSLTREKGDTKEFRRLVLRSFGKGRKETQKGGLVRARALSASSEVASRDFSEVTAASCVSSAFFLLTKGSGVVVLDDSSSICCGTWAVGPASSL

SEQ ID NO: 169868 - protein, 70 aa, Glycine max
  Coding DNA Sequence Number=SeqID_78183
MGAKYLEAVKQRLHAIKQWSPDEIRRDFFFFSSFYFSKGIRDRESLVVKKSEHKGRLSLCGSELVKGFAR

SEQ ID NO: 169869 - protein, 189 aa, Glycine max
  Coding DNA Sequence Number=SeqID_78184
  Gene Ontology: Mol. function=phosphoprotein phosphatase activity; Biological process=intracellular signaling cascade
  Homolog annotation: Hit_ID=Q9LNG5; Match level="QueryCoverage=98%, HitCoverage=17%, E-value=1e-22, Identity=30%"; Hit description =Serine/threonine protein phosphatase 7 long form homolog
MRCGGCTITLQDVSVLLGLRVDGAPLIGQTNLDWAELCEELLSVRPQEGELQGSVIKLSWLAHHFLQINIHDGNVEHLQSTYAWAPAVLAYLYREMFNTADYKIKSIRSMYILIQMWAWKRCTTLTPKRTPPVIENKPLRHRWLRRGNQHIGNDDLIVFHRRLDIMKRHEFLWEPYTTTVMSTLPLICL

SEQ ID NO: 169870 - protein, 73 aa, Glycine max
  Coding DNA Sequence Number=SeqID_78185
MTNCLRILCPKTLEGTSFVRRYISYGSVQLEGTSTWFFKDKKGGYIPCGSLACKGFYKVERNLKNRGFLGDWM

SEQ ID NO: 169871 - protein, 211 aa, Glycine max
  Coding DNA Sequence Number=SeqID_78186
NVILHHTEFDEFTEELECRNWHKELTNFMDSSRAISIVKEFYANLYDPDDKPPKQVNVRGCLVKFDANTLNSFLKTPEILEEGKNFPVYSRFCCSKPEPQESAARLCIPGREFELNADGLPLKILRKNLTTLAQTWSFLSFSNLSLGPAINVAYVKKNCWNPYDLSITFRGPRKAKGKRFEAPPSSKVAWPGHQSSSSGKGGASAAQEPDT

SEQ ID NO: 169872 - protein, 78 aa, Glycine max
  Coding DNA Sequence Number=SeqID_78187
MSGKGRMLLPEVHLIGDSFNDDPSHHHGGSNTMIAFLMCCPPTGGVIAAKGGLSPISGVCPNPKENEVESPHSSLQHH

SEQ ID NO: 169873 - protein, 516 aa, Glycine max
  Coding DNA Sequence Number=SeqID_78188
  Gene Ontology: Mol. function=oxidoreductase activity; Cellular component=integral to membrane; Biological process=potassium ion transport
  Homolog annotation: Hit_ID=A6T7Q7; Match level="QueryCoverage=47%, HitCoverage=95%, E-value=4e-76, Identity=52%"; Hit description =Putative an aldehyde reductase
  Pfam annotation: Domain name=Aldo_ket_red; Domain location=6-238; Score=146.4; E_value=8.2e-41; Accession=PF00248.12; Description =Aldoketo reductase family
MKTIQFNDDTPLAAIGQGTWYMGENPAQRAQEIAALQAGLDAGLKLIDTAEMYAEGGAEEVVGAALRGRRDQAWLVSKVYPWNAGEVDAIDACERSLRRLQTDYLDLYLLHWRGNVPLEETVRAMQTLQQQGKIRHWGVSNFDSDDLQELWSEAGGMGCATNQAGRLRQALFDDATLQQIAQQKGISIAQLLLSWVIRQPGVMAIPKAGSVAHVQENAAALNITLTSDELALLDRAFPPPQHKLALDVRDAKAGRGFSGTFHRLVNPRRLHAHHRFITIIRHIGHAAGQCRARIPGDNVTLIMVIDFNLALTGAIVNHAAVFRCGMNAINPLGIGLFPVRCAADGIVLHLIDVAVAEPADFNLRNVRHLKIAVQRSRGFIIAPGFQLNLTVFSNAEARQQREIVRPQFFRLCITSQRERQHDRIFVLIMRRQRPRLITGKAMRRFTCRTKPRPADRHAAANGFAADEWRLVAEPDGGLLTGRLPCQQVRTLQGNGGAYFRMADHQNWQFTHLTLRQ

SEQ ID NO: 169874 - protein, 192 aa, Glycine max
  Coding DNA Sequence Number=SeqID_78189
  Pfam annotation: Domain name=Transposase_23; Domain location=5-75; Score=-16.0; E_value=0.067; Accession=PF03017.5; Description =TNP1ENSPM transposase
NNPDTGDSNKYGLYIKENLHRLVALGRLYEGSTTVHNIPLLHDQVKVGVKEIRDANAPIPIPTEEVKLVGQTLNTFLAWLTHLVKRLSEQVKWDATMFGVYNDNFPLYIKHEDPSEIAHGGQCLDIFIIQLRIFAHWQMVVILPKENVVIWFCSLHNRPDNYLKGINNSALKGLDDTPQSKSKAATRWIVVK

SEQ ID NO: 169875 - protein, 67 aa, Glycine max
  Coding DNA Sequence Number=SeqID_78190
MKPRAKKGVFMGYGDKVKGFKILSLSERKDVTKQVNFESPIIRNISHQKQFEALDETDQELQMQPQH

SEQ ID NO: 169876 - protein, 126 aa, Glycine max
  Coding DNA Sequence Number=SeqID_78191
  Subcellular localization annotation: CTP_CleavageSite=48; ConfidenceScore=5.26e-01
MYPPLFSLNNLVDVPSTRIDPQEMYPLLFSVTTTQVDVPSTCTTKDVSSNVLRQSSQAVSPSKLCEGGNKRILRREKGDTKEFRRLVLRSFGTGRRKTQKEFRRLVLGEFFLAKGEGNDQMNSTSF

SEQ ID NO: 169877 - protein, 126 aa, Glycine max
  Coding DNA Sequence Number=SeqID_78192
MVDNSEYKREERYQTTDFPGRNYCSDASLYDVKLEGFIHASLLTGHRQSKEERKETKPVVDKKGVATYPSAGGRRETRGMRVPRKEYARSRRQRLFEENVGKTGKDAIYELLSERFGSCIYARGRY

SEQ ID NO: 169878 - protein, 49 aa, Glycine max
  Coding DNA Sequence Number=SeqID_78193
MRKAEREKRKAESEKRRVVCDTSRVLRWLGVKSSGVAGKLLKSNGWLVQ

SEQ ID NO: 169879 - protein, 74 aa, Glycine max
  Coding DNA Sequence Number=SeqID_78194
MTLAYHSFSSSKLDRMSISAPREKKESYEDNTNGGFNPFSVSLTFGNSIGAVEGKNWKNLKEPLEMVLSLAEDT

SEQ ID NO: 169880 - protein, 285 aa, Glycine max
  Coding DNA Sequence Number=SeqID_78195
MVIFPLCRRLKCLSTETIAVSLCHPETVESDDTHRQIMVIRTLLAIQRQSGLMACRDHHGHLHHFCYPETIKSDGMRRPSWSSAPVLLFRDNQIRWHAKTIMVIRFHCFRDYFSLLFHPETIKFDGIQRPLWSYAFFYISKTTMSSVIACFQKATMTLIYILKTTMSLVIACFQKVTMTSIYISKTTISSVIECFQKATMTLIYISKTTMSSVIACFQKADNDLHLHFEETMSSSFMLSKGDNDPHLISKTTMSLVIACLQKATMPSFTFKRQCLQSLHAFKRQQ

SEQ ID NO: 169881 - protein, 16 aa, Glycine max
  Coding DNA Sequence Number=SeqID_78196
MDLGRFQISIPGDGYP

SEQ ID NO: 169882 - protein, 108 aa, Glycine max
  Coding DNA Sequence Number=SeqID_78197
MQQGQADILIARFPDLNYGVKMGFSKEAQNIQWGFQSQKGCKDKLKLTRNKHRIMVTSRKTTKVRPGFVLNRNREASLEDSASVEGFLSVWGFNEEQWRFEVATGGCG

SEQ ID NO: 169883 - protein, 170 aa, Glycine max
  Coding DNA Sequence Number=SeqID_78198
  Homolog annotation: Hit_ID=Q2HW90; Match level="QueryCoverage=39%, HitCoverage=14%, E-value=2e-07, Identity=37%"; Hit description =Putative uncharacterized protein
MTCASLLHVLTESITLILRLDRDTKPCAFSPCRVIMLALYVWSRHVVTRSRKQSIGSSQTPPLKKRFYQVKIMGLEVMSLQELGELIGQLQRQAFRKAYGKIWELAMIEVSTKAIASITQYYYQPLGCFTFEDFQLVPTIEEFKEILGCPLEGRKPYLFSGFYPSMSRIT

SEQ ID NO: 169884 - protein, 140 aa, Glycine max
  Coding DNA Sequence Number=SeqID_78199
  Homolog annotation: Hit_ID=Q9LHC7; Match level="QueryCoverage=59%, HitCoverage=10%, E-value=5e-07, Identity=34%"; Hit description =Retroelement pol polyprotein-like
MAERGEGNRPPRRTLGDYAYQQGPKHYNSIVIPPFSNKVMELKPTLLSLIGSHPFARMDHEDPYTHLSTFMELCSTMGAYNEDVKAVYLRAFPFLLAGLGSSSSMDSFASSNMNGNGMEKEHREETPLQGADESRRSSPP

SEQ ID NO: 169885 - protein, 418 aa, Glycine max
  Coding DNA Sequence Number=SeqID_78200
  Gene Ontology: Mol. function=protein binding; Cellular component =intracellular; Biological process=proteolysis
  Homolog annotation: Hit_ID=A7PK60; Match level="QueryCoverage=73%, HitCoverage=70%, E-value=1e-74, Identity=48%"; Hit description =Chromosome chr15 scaffold_19, whole genome shotgun sequence
  Pfam annotation: Domain name=MORN; Domain location=208-230; Score =28.0; E_value=3.5e-05; Accession=PF02493.11; Description=MORN repeat
  Pfam annotation: Domain name=MORN; Domain location=231-253; Score =36.2; E_value=1.2e-07; Accession=PF02493.11; Description=MORN repeat
  Pfam annotation: Domain name=MORN; Domain location=254-276; Score =27.4; E_value=5.3e-05; Accession=PF02493.11; Description=MORN repeat
  Pfam annotation: Domain name=MORN; Domain location=277-299; Score =33.8; E_value=6.1e-07; Accession=PF02493.11; Description=MORN repeat
  Pfam annotation: Domain name=MORN; Domain location=300-322; Score =24.3; E_value=0.00044; Accession=PF02493.11; Description=MORN repeat
  Pfam module annotation: Pfam domain module=MORN::MORN::MORN::MORN::MOR N; Domain location=208-230::231-253::254-276::277-299::300-322
PDIRVSFPYVMHQKKSEVQIGKESVGVSSDFNPQFQKHPYHRHQQFYPQIEIDISPSLPPQQHNTAPQRTTPPSLSKQKHIFKPQNAAFFSVTVAAKSAAFRMLRRVRRQRALLLLAIPLLYLYFLVSRSFLLDLLSAIAFSAALVFSLNLAFPLPFRSIRLKAAKNSASRPAAALPVFWTIGSRQKTEKRAAASGCWVQVFGNGDVYEGEFHRGKCSGSGVYYYSRSGRYEGDWVDGKYDGYGVETWARGSRYRGCYWQGLRHGFGVYRFYTGDVYAGEWSNGQSHGCGVHTCEDGSRYVGEFKWGVKHGHGHYHFSGKSLALESHCRPLLLTAGKFSGKLRLAFLSHAAFLSLDSRSIATSPIYPFSATPTITTEKLNWKSYRSWSDSVELWFCGQGYYDHMKKDVNEVPVENRAQ

SEQ ID NO: 169886 - protein, 216 aa, Glycine max
  Coding DNA Sequence Number=SeqID_78201
MGKGYLQKGIMKLKNIRAQGPGLGWRADEDYSMPCMRGSDSRGSVRQPMVEREVVPIEDSSSEEVPHEVSDNGSSPFERLISFDNVGEDDSIKVSNLLGTCKLGDQVCPSVVFLQHVMHFKTIEVIDKSLGDMIVPKENCFLVNSTKNSTINWDFIGPRGLYCRFSEHLLDGVVRLDNDLVALKVGPKAPSRGYGVELMVSSTIERYKSRGDPGLG

SEQ ID NO: 169887 - protein, 373 aa, Glycine max
  Coding DNA Sequence Number=SeqID_78202
MGDFEWRPLVKQLGIASEDMPSPLTITPESSGEEGGQARVDPPRSSEADDDEVVKVTLDVLPSTTTKRKCNEGARGSGQHKKSRAPFSLRALKEATELMSSSIMFASLVVPVAVPVSTPFSLVLLLSVGVATTSVSSPPPSALPPSAPTVMPSTMPSSSLRPSVSLDCVYTSQEANSIRGTKLDRCCEGLPSTDFCYLGGKWAKTYTEALNKIESLEVDVIKWKATVRTVLQPERPKVATATVALVEAVSTRLDNEKVFEHCQDFLKKRNHLASKVEHTTEEKEKLIVIVAKSAKVIADLEARLKELELNEVMEQHEKGFFKAIKQARFFIEGLNLGLFDPFRDVKDDELLDEEEIDVGEEDINEEENDGTNV

SEQ ID NO: 169888 - protein, 61 aa, Glycine max
  Coding DNA Sequence Number=SeqID_78203
MEADLPLGWKTLNLELYDRTTDPDEHLDVCFASGYYLFVWMRNLPASTPGRQAQVLNTDVS

SEQ ID NO: 169889 - protein, 38 aa, Glycine max
  Coding DNA Sequence Number=SeqID_78204
MDSRNNKKLKKTNRHAKKGKKRTEQKRLVGWPKRLPEY

SEQ ID NO: 169890 - protein, 414 aa, Glycine max
  Coding DNA Sequence Number=SeqID_78205
MAKRHLCELSHQNSKRDNTRAKRPYHLDNLEVLTSAKPALLSLAQFIATIFGLSASNALSHSQLVALSQFVALPKMASRKKKSTASRPQAQNVKIYHTEFDEFKAELERRNLHKRLANLQEGSIDVAVVKEFYANLYSPEDQSPKQVRDGETLPTYSRFSRMRIDPQEFAARLCIPARLVYGLVIGMDMKIGALISGVTSDSLTYESLSPTINLAYIKKNCWNVDDLAVNFRGARKVKARPTDVPSSSAPPAPPTSATPTPATHDSQRFEAMLQKRVRAPVPRSRDEADEAVFPEPIVPVIHETVEAGESQLKQEVATPERTPQTPKDPPSPGIELSFAQQVADPPTPVHERPANPSTPILEIPEDPTTPALTLNTTLPATPELQFSDEEGGRITTPPGTPVLHFDDEEQDQDE

SEQ ID NO: 169891 - protein, 100 aa, Glycine max
  Coding DNA Sequence Number=SeqID_78206
MAELEDAAARAERDEMIGFMSWRIEDEGLGGREREVYGKKSGFKKKKMKWWGPLLGAWKKRATFSSYLNAWIGGGKKIVDPHDVSQFSRMLCYLLIEGVA

SEQ ID NO: 169892 - protein, 128 aa, Glycine max
  Coding DNA Sequence Number=SeqID_78207
  Subcellular localization annotation: CTP_CleavageSite=42; ConfidenceScore=5.18e-01
MGDFTYSVNVVQQNKVTKSLSGNGVLPNKFKGEAYPSSWRVEASPKPLNPLVGLRQTGHMTRGSESGKVTGTQRRRAWKPIEKRRHPINRGRACKHGGTEVVRDQGVDAGGIRRLKLGDEGGFRGTRG

SEQ ID NO: 169893 - protein, 179 aa, Glycine max
  Coding DNA Sequence Number=SeqID_78208
  Gene Ontology: Mol. function=nucleotide binding; Biological process =defense response
  Homolog annotation: Hit_ID=Q6L477; Match level="QueryCoverage=55%, HitCoverage=20%, E-value=7e-10, Identity=27%"; Hit description =Putative uncharacterized protein OSJNBa0009L15.8
TMATPPTLPPPPLPPPLADASASPPPGVERPLVNIDPATGKADVDVTYESWKEVPTAQKDLIWEDIQAEFQIPEASDSRTKKKILQTVGERWRQFKSDLTRKWALTADKDGVDDIDVQKKAQAIQKQNTAPHVLSHGGYQYLEQKLMAEKTKKRKDWKKLPSPEALRASLTLHLPLDAM

SEQ ID NO: 169894 - protein, 188 aa, Glycine max
  Coding DNA Sequence Number=SeqID_78209
MTDLVSAEDYINLRVSTDSKKVYTDNHSGISARQRDSKVSMTDLVSAEDDVNLRVSTGLSAAIDEGRRDDIEKKNVYTDNHSGISARQRDSNVSMTDLVSAEDDVNLRVSTGLSARLTKGAETTLVSACYQAFRLKIAKKNVYTDNHSGISARQRDSNVSMTDLVSAKWPTKARLCVLVSSHEELRPT

SEQ ID NO: 169895 - protein, 165 aa, Glycine max
  Coding DNA Sequence Number=SeqID_78210
  Gene Ontology: Mol. function=nucleic acid binding; Biological process= DNA integration
  Homolog annotation: Hit_ID=A5B3J2; Match level="QueryCoverage=60%, HitCoverage=22%, E-value=5e-12, Identity=38%"; Hit description =Putative uncharacterized protein
LEIKATCRRRNAERNRNFLQDLEVAVIPREEPQSSEASSSFPILGQSHTDLLVEVIMAEQPWRVTLEDYSSSSVPHFFTSIAQPEVQAQTITYPSSLIQLIQNNLFHGLSNEDPYTYLATYIEICNTIRLASVPEEAIRLSLFSFSISREAKRWLHSFKGNSLKT

SEQ ID NO: 169896 - protein, 32 aa, Glycine max
  Coding DNA Sequence Number=SeqID_78211
NWRCGMNRKLGYGAQLRANLDPTKGVGRLRPT

SEQ ID NO: 169897 - protein, 384 aa, Glycine max
  Coding DNA Sequence Number=SeqID_78212
  Gene Ontology: Mol. function=motor activity; Cellular component=cell projection
  Homolog annotation: Hit_ID=P15305; Match level="QueryCoverage=91%, HitCoverage=74%, E-value=8e-23, Identity=23%"; Hit description =Dynein heavy chain
RGLHVLTFGGLRVLAFKGLPVLLLRGLHVLTFRGLHALTFRGLHVLAIRGLHVLAFRGLQALTFRGLHVHPIKGLHVLQIRGLQILTFRKLHVLPFRGLHVLTFRGLHVLAFIGLHVLAIRGLHILSFRRLHVFTIRGPHVLTFRGLHVLAFRGLHLLAFRGLRVLPFRGLHILVFRGLHALTSRGLHVLAIRGLHVLPLRGVHVLTFRGLHVLAFRGLHVLAFRGLNVLLFRGLHVLAIIGFHVLSFRGLHVLPIIGLHVLAFKGLHVLAIRGLHVLAFIGLHVLAFRGLHLLPLKGLLILTFRGLHDLTFRGLYILAFRVLHVLPFKGLHAVAIRGLHVLAFRGLHSLTFRRLHVLSFRGLHVLAFEGLHVLAFRGLHVLSF

SEQ ID NO: 169898 - protein, 123 aa, Glycine max
  Coding DNA Sequence Number=SeqID_78213
  Homolog annotation: Hit_ID=A5AUB4; Match level="QueryCoverage=60%, HitCoverage=7%, E-value=2e-07, Identity=40%"; Hit description =Putative uncharacterized protein
MDDFSEDENQQTCDHIDHQSDDQSDDEGLGRPTTPLSHPLQYHQPSLGACNSKRHNKLIINSIRDHHTCLAPMLIQDHRQLDKHVIAQIIQSIVKTNSTLSIKTLIAEIKTFMNYTPSYKKTG

SEQ ID NO: 169899 - protein, 388 aa, Glycine max
  Coding DNA Sequence Number=SeqID_78214
FDEFKIELERRNWHKEMTNFLDGSIDVAIVKEFYANLYDPEDKSPKKVRVRGHLIKFDEDALNTFHKTPVIIEEGEILSAYSRFCRLRPDPQELAAQLCIPGRGFELNADGLPLKILWKNLTTLAQTWSILSFSNLAPTSHTSNITLDRARLIYGIIQKMDMNLGYIISSQISMIAQHDSSRLGFPVLITTLCKARGVTFDSLSFESLSPAINLAYVKKNCWNLDDPTVTFRGAHKAKGKRSETPPSSAFPTSAPSTSNVAPSTPASSLPAPASAPVYSGPSTFSFETLFPMLQSLHKGQIIIMQSLGQQQPVLSIEEFLSQVTWPGVQPSPLGGEVASPEPVPQSSPALALDDPQPLAPTSVPNQPIVQDPSVAPVLDLNEHSQDHS

SEQ ID NO: 169900 - protein, 79 aa, Glycine max
  Coding DNA Sequence Number=SeqID_78215
MEISVRDLSAETELFLQNLHIATTERETKDIELVEEEQERIGANPSSETSNKSENYKEEARNATQKHKPKKVESVNTDA

SEQ ID NO: 169901 - protein, 56 aa, Glycine max
  Coding DNA Sequence Number=SeqID_78216
MEITSWQLANSRIMEWSKGVAGSKKHETHAAGIIVKEDIIVLSRRYVGSGIREYGC

SEQ ID NO: 169902 - protein, 199 aa, Glycine max
  Coding DNA Sequence Number=SeqID_78217
  Subcellular localization annotation: CTP_CleavageSite=91; ConfidenceScore=5.13e-01
MSSAPDRPAEADLGSKKRGSAPLPIHGITPTYPTPLKSFHKSRTRVKLNRVFLSPADSPKPRSLGLCRIPLVRTSSELTVRRPGKRPRRARSQSVPRPARDDPLSPRKQLEQSTDSRRVRDWDPRAQPSEPILFPRGCSPWRPDAVMSTTGRGRHSVLRIFKGRRGRTGHHATCGALPAAGPYLRLSRFQGGQAVKQKR

SEQ ID NO: 169903 - protein, 150 aa, Glycine max
  Coding DNA Sequence Number=SeqID_78218
MTLLLSNILPQRPQCRSPPAEVSVGLCRPDIGIAPTRHPVDPKEPNRALGFPALVMGLYQSYRVPVPPARSCHRDIGIAPARHPVDPEKSNRVLGFPALITGIYQFYGVPVAPSKVIKHPISRAFIKKVLCPPGRHRARHHSNLEMTGSR

SEQ ID NO: 169904 - protein, 91 aa, Glycine max
  Coding DNA Sequence Number=SeqID_78219
  Gene Ontology: Biological process=transposition, DNA-mediated
  Homolog annotation: Hit_ID=Q1J7G7; Match level="QueryCoverage=35%, HitCoverage=45%, E-value=3e-11, Identity=100%"; Hit description =Transposase
MVKVGTSYGKINLSFSPKVGPGLPGINRDTRIYSLCEVIFRHRVLQWLLFLSAVPPVQLLTGWCVTAKAPPDISAGKCSGHAARNHHTRRA

SEQ ID NO: 169905 - protein, 99 aa, Glycine max
  Coding DNA Sequence Number=SeqID_78220
MIRGDTLRLSAPLAIQTQSCSMDKQRPKTKFGHSAHMIRGDTLRLSAPLCHSDTVVSDGTQRPKTKFGHSAHMIRGDTLRLSAPLCHSDTVVFDGKQRP

SEQ ID NO: 169906 - protein, 154 aa, Glycine max
  Coding DNA Sequence Number=SeqID_78221
MVKVGTSYVPINVSFSPKSWPGLPGINRDTRIYFFLRSDLPSQVLQWLLFLSAVPPVQLLTGVVRNGKKHRRTSALASVAGPAARNHHPAALNAPLQGASHSPFRLRNCWEGRSVRASSLLRQLAKGGCAARRLSWVTPGFSQSRRCKTTASEL

SEQ ID NO: 169907 - protein, 139 aa, Glycine max
  Coding DNA Sequence Number=SeqID_78222
MYYPGHHQHQSYAEPNVPRVHVLGFMSQHHPSQAQYQSTSFSGHASEGCQQSFQPLRFSSYIPQYSFQVYYISNVFYGSSQMFVTTFNTPPSTYNVAPSSFCYCPSLPTQIRDMSHEYEDEDEDNNNNNDDDNDDVDSF

SEQ ID NO: 169908 - protein, 261 aa, Glycine max
  Coding DNA Sequence Number=SeqID_78223
  Homolog annotation: Hit_ID=A5B5G7; Match level="QueryCoverage=75%, HitCoverage=13%, E-value=5e-11, Identity=28%"; Hit description =Putative uncharacterized protein
AKHHFASVVSPLNKAKCNCCAKPLLCVKEAKCALCAKPERHSGEMASKKRKSLASSSSQIRFDKSRFHSQEAWDRYNDIVVPRKLLPERNVVVYYTEFDEFKEELKIRKWDEELTSFANGSINVAIVKEFYANLYDPEDKSPKQVRVRGHLIKFDEDTLNIFLKTPVIVEEGENLYAYSRFALLRPDPQELAAKLCILGRGFKLNVDGQPLKILRKNMTTLAQTWSVLSFSNLVPTSHTSDVTLDRAMLIYVIIMEMDMNV

SEQ ID NO: 169909 - protein, 66 aa, Glycine max
  Coding DNA Sequence Number=SeqID_78224
MEKPDKKNFKDKKGKKAYITWEDNDMDSSSDLENKIVNLGLMAKDYESEEEMHSMICIENLSNLPN

SEQ ID NO: 169910 - protein, 64 aa, Glycine max
  Coding DNA Sequence Number=SeqID_78225
MVFGVGMGCCVLLIGKPQWLVRMVGGQLNKKVKRKTRMRSNENVIKTGGVTSKKARKIEEKKKI

SEQ ID NO: 169911 - protein, 104 aa, Glycine max
  Coding DNA Sequence Number=SeqID_78226
  Gene Ontology: Mol. function=enzyme regulator activity; Biological process=regulation of transcription, DNA-dependent
  Homolog annotation: Hit_ID=Q9ARI4; Match level="QueryCoverage=49%, HitCoverage=26%, E-value=3e-19, Identity=92%"; Hit description=PII protein
  Pfam annotation: Domain name=P-II; Domain location=33-95; Score= -18.5; E_value=0.00033; Accession=PF00543.13; Description=Nitrogen regulatory protein P-II
MGGDAAATESATTERNAANAFRKVATVSQTCYKLVLLKMGIRGVTVSDVRGFGAQGGSKERQGSSEFPEDNFVAKVKMEVVVRKDQCNKARWGMRDSSVTVYML

SEQ ID NO: 169912 - protein, 428 aa, Glycine max
  Coding DNA Sequence Number=SeqID_78227
  Gene Ontology: Mol. function=L-aspartate oxidase activity; Cellular component=cytoplasm; Biological process=pyridine nucleotide biosynthetic process
  Homolog annotation: Hit_ID=A4WDE5; Match level="QueryCoverage=99%, HitCoverage=79%, E-value=0.0, Identity=81%"; Hit description=L -aspartate oxidase
  Pfam annotation: Domain name=FAD_binding_2; Domain location=1-285; Score=170.8; E_value=3.6e-48; Accession=PF00890.15; Description=FAD binding domain
  Pfam annotation: Domain name=Succ_DH_flav_C; Domain location=333-428; Score=-25.9; E_value=8.2e-06; Accession=PF02910.11; Description =Fumarate reductasesuccinate dehydroge
  Pfam module annotation: Pfam domain module=FAD_binding_2::Succ_DH _flav_C; Domain location=1-285::333-428
PQDNGNARYHLTREGGHSHRLILHNADATGRAVETTLVSQALIHPNILVIERANAVDLILSDKIGLPGTRRVVGAWIWNRNREQVETCRARSVVLATGGAAKVYQYTTNPDVASGDGIAMAWRAGCRVANLEFNQFHPTCLFHPQAQNFLLTEALRGEGAWLLRPDGSRFMPDFDARAELAPRDIVARAIDHEMKRLGVDCMYLDISHQPASFVRAHFPMIYDKLLTFGLDLTQQPIPIVPAAHYTCGGVMVDQHGRTDVDGLYAIGEVSYTGLHGANRMASNSLLECLVYGWSAAEDIVRRLPQMRAVDHLPAWDESRVDDADERVVIQHNWHELRLLMWDYMGIVRTTKRLERALRRITLLQQEIDEYYAHFRLSNNLLELRNLVQVAELMVRCALARKESRGLHFTRDYPHMLPEAQPTVLQPVA

SEQ ID NO: 169913 - protein, 123 aa, Glycine max
  Coding DNA Sequence Number=SeqID_78228
  Subcellular localization annotation: CTP_CleavageSite=53; ConfidenceScore=5.44e-01
MTMQNMQFQQETRASIQSLTNQMGQFATQLNQQQSQNSDRLPSQSVQNPKNVSAITLRSGKQCQGPQPATSSSSTNEPAQLHSTPENEDDKNLKKAAYPSSVPSKSNFQQKNGRGREGDLGNI

SEQ ID NO: 169914 - protein, 311 aa, Glycine max
  Coding DNA Sequence Number=SeqID_78229
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIKSWIQSRYQSRSCVSFEKQVAQIDQYWLAFFPALRQVEVHHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169915 - protein, 339 aa, Glycine max
  Coding DNA Sequence Number=SeqID_78230
PEVQASKQARVRGHLINIDVDNLNEFLQTPVEIEVRLYIPRKGFVLNVEGQPWKLLRKDMTTLAQTWSVFSYSNLAPTSYTSDLNMDRARLVYGLVTHMDMNIGALILGQISSIAQSNSSKLGFSALITTFCRGRGVTSDSLTYESLSPAINFAYIKKNCWNVDDLTINFRGVRKARARPASVPSSSTPPASSTFATPTPAPSGPSAQDSQRFKSMLQRTILTVEQFMEKVAWPGTQPSLVRKGGGPSAQVPQQVDHASLEATIPEPFVFKEGGTQQLADPPTPVHEMPADPSTPLLEILEDLSTLVLGLTTTPPATPMLHFIDEEGTQDQDTQQDDQS

SEQ ID NO: 169916 - protein, 211 aa, Glycine max
  Coding DNA Sequence Number=SeqID_78231
QRPGDSAGGGRTQRAGPAGDGPGGGMAQLPDGPPGTPGRCLSHVTGQRPALDAGTVPPAAAGGDARPGRTGGGGAGPGPGWQPPLDRGRTAVGQWFRAVAGAGRNGQPVPAAERVVEVATGPGGGLGHRTGDADRGGLRGHRTCPVRGTGQRTRTGRRAAGADPPAFPVQQHEPDRQPAASRPGGGRAGGAGPVRSVLPRCGAGDGLIHPA

SEQ ID NO: 169917 - protein, 134 aa, Glycine max
  Coding DNA Sequence Number=SeqID_78232
  Subcellular localization annotation: CTP_CleavageSite=48; ConfidenceScore=5.42e-01
MLARQKLSRARRAAGSSAARSRRLWRLGGDRPCKPQVRPPGRERSRPSASAAVRRTGRWKNWWSLAGPHNTTGQLAAGAEPCWHAIAAPAFTRWKLRFGLTTSEAKDMAKIAMRNAKIASRLISFVMSIPLYRS

SEQ ID NO: 169918 - protein, 93 aa, Glycine max
  Coding DNA Sequence Number=SeqID_78233
MRASSAYDTGIWGGSYRLFAAKFPFGWWVLWFDLGMAFVDNWVVGKEMGCYWLSNDIVGLVGSFHVGMVIAAWISLSSSPSSFAPVFSFVEAG

SEQ ID NO: 169919 - protein, 125 aa, Glycine max
  Coding DNA Sequence Number=SeqID_78234
  Subcellular localization annotation: CTP_CleavageSite=39; ConfidenceScore=5.06e-01
MTGGMINCSGGWGSAIANASATRPPRLWPKKISAIGVGRAALRAPAPLDRGIARHRVRCPDATRGSIAERQWLRRRRGEKRSAAGCPGVPASAVSGRGGRWGSGCNAWRKSVFSGVPRKPELPWR

SEQ ID NO: 169920 - protein, 170 aa, Glycine max
  Coding DNA Sequence Number=SeqID_78235
MLDAEFDDARQSLMAEVGRAGCGAEIARRLDRYHQSLQVVARQRRQRVIERRPGNQPIFRGSAGVIALRGPVRALRPDANQGGGDERFKRQIRHVVRFRKNMADAFGVRAVAVWHQADTLGVADPAMTHAGDGIAVTQRRRIGGGHAIKVDRVIGEVQPGREPQRLSVVK

SEQ ID NO: 169921 - protein, 274 aa, Glycine max
  Coding DNA Sequence Number=SeqID_78236
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFGSQSSGDFLFKPVYIRWACAYHHSVRFQVVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169922 - protein, 227 aa, Glycine max
  Coding DNA Sequence Number=SeqID_78237
MTLTILELFLRPYQVRWDVTVFGVFNPDFPLYIKHKDLSKIAHGGQCLSISVLQLWILHLTETCMRVGNSDIYGFLEPQSIQRSRQSQFESESYIKSWMQSSQRDVYLGAYLNGFHCSGHWQMVVILPKEHLVVWFWSYYLKGIINSALKGLDDAPQLKSKASTRWIVVKCNRQKGSTKCGYYVMHRMSTIILGTFRNNWEAYFNDPRPLEPERLKALRIQWAQFYL

SEQ ID NO: 169923 - protein, 325 aa, Glycine max
  Coding DNA Sequence Number=SeqID_78238
  Homolog annotation: Hit_ID=Q6WAY6; Match level="QueryCoverage=88%, HitCoverage=51%, E-value=4e-38, Identity=35%"; Hit description =Putative uncharacterized protein
MIESGASLKKRFYKVKVKSLGVTSLKELGQLMGQLQRQAFRKAYGKIWDLAMAEVSTEAIASLVQYYDQLLRCFTFGDSQLSPTVEEFEEILGCPLGERKPYLFSGFYPSLARIFKIVQILTQELDHRKQVENGVVGVPRKCLEAKARVLAGKGEWALFIDILALLIFGGVLFPNMDGLVDQAAIDAFLAFHDRKESPVVAILADLYDTFDRRCEKNSTRIVCCTPALYATANAQKKEASWDRLLASKEGASINWFPRWKEGRIEILISCGGFPNVPLMGTRGCINYNPVLTIRQLGYPMRGAPLEEDLTLIIARGFNGTNAEAL

SEQ ID NO: 169924 - protein, 160 aa, Glycine max
  Coding DNA Sequence Number=SeqID_78239
MVMLHTNCFYSSCCFIFALLDIIEVPSFYHQQWAPEYPEFVNFRYDGTIYQIRLRQHRAKVYFAEGLKEFRKDLSIYEFVIIKFLACNNKSMFDLYFVPSLECQTCGRLEVMSRQHIWTLEITQSILGASGPLRLPNCAMTHVNSCGQHMTILRRFGPPL

SEQ ID NO: 169925 - protein, 74 aa, Glycine max
  Coding DNA Sequence Number=SeqID_78240
MACSSLKARTCRPLKARMCSHLKARACSPLKVKIGCPFESSDNSCNLILSFVNLSGNSLKVHLRLIYGAPHCPM

SEQ ID NO: 169926 - protein, 102 aa, Glycine max
  Coding DNA Sequence Number=SeqID_78241
  Gene Ontology: Mol. function=hydrogen ion transmembrane transporter activity; Cellular component=proton-transporting two-sector ATPase complex; Biological process=transcription termination
  Homolog annotation: Hit_ID=P0AG32; Match level="QueryCoverage=76%, HitCoverage=18%, E-value=5e-36, Identity=96%"; Hit description =Transcription termination factor rho
  Pfam annotation: Domain name=Rho_N; Domain location=29-71; Score =76.3; E_value=9.9e-20; Accession=PF07498.3; Description=Rho termination factor, N-terminal domai
  Pfam annotation: Domain name=Rho_RNA_bind; Domain location=73-102; Score=-2.9; E_value=0.0014; Accession=PF07497.3; Description=Rho termination factor, RNA-binding doma
  Pfam module annotation: Pfam domain module=Rho_N::Rho_RNA_bind; Domain location=29-71::73-102
MDDPAIPFTTLSSRITPSLRTHTIMNLTELKNTPVSELITLGENMGLENLARMRKQDIIFAILKQHSKSGEDIFGEGVLEIVQDGFGFLRSADSSYLAGPDD

SEQ ID NO: 169927 - protein, 176 aa, Glycine max
  Coding DNA Sequence Number=SeqID_78242
ADGVPAGARAAGTADTVDIVFAVIRQVIVKDMGDGWDMQAASGYVGRNQNIEIAAGELFENTQAFFLRHVAGQQADAMSICRQMAPDIFTTMLGVGENNSAVGPLFFQQRLQQAHFFVVGRIEQLFFNAVAGFLFRFDFNVLGVVHLFECQFAYAIRQRGGEQHVQALSGRRHAAE

SEQ ID NO: 169928 - protein, 134 aa, Glycine max
  Coding DNA Sequence Number=SeqID_78243
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=91%, HitCoverage=96%, E-value=1e-24, Identity=54%"; Hit description =Putative uncharacterized protein
MTMITPSSKLTLTKGNKSWYRAPPRADYAALTSKVCELPAARISPGDPLVLERPPPRWSSNSPYSESYYNSLAVVLQRRDWENPGVTQLNRLAAHPPFASWRNSEEARTDRPSQQLRSLNGEWDAPCSGALSAA

SEQ ID NO: 169929 - protein, 59 aa, Glycine max
  Coding DNA Sequence Number=SeqID_78244
  Subcellular localization annotation: CTP_CleavageSite=52; ConfidenceScore=5.40e-01
MVIRTFRQPGANELVGTQRLTSSSAPFVIPRQRVRWFLLLSSRDIQVRRRTRFFSARRG

SEQ ID NO: 169930 - protein, 72 aa, Glycine max
  Coding DNA Sequence Number=SeqID_78245
MALTFWDLDRLRRQLPIVPSNWLSSEWSFWSLVETACSCRCKCLWCFDDDHDEEKQMMQMIQEYKPQHQDDH

SEQ ID NO: 169931 - protein, 167 aa, Glycine max
  Coding DNA Sequence Number=SeqID_78246
  Homolog annotation: Hit_ID=Q6WAY6; Match level="QueryCoverage=26%, HitCoverage=7%, E-value=4e-07, Identity=54%"; Hit description =Putative uncharacterized protein
MEGLVDLAAIDAFLAFHHGKESPVVAILAMYDTFPRGCEKSDARIVCCALALYVWLEGRIRILSSCEGCPNVPLMGTRVCINYNPVLAIRQHGYPMRGVPSDESITPFIARGFGDHNARDRELRGSSNGIIGGYHKWLRVRTQGLDWLPNLKTVRDNEVKASEESDE

SEQ ID NO: 169932 - protein, 124 aa, Glycine max
  Coding DNA Sequence Number=SeqID_78247
MPGVLQKVHKAWELVQKKDKELRGSSNGPIGGYQRWLKAYTQGLDWLPNLRTTKGMEVETPEEDEEIQALKIELEKAQTVKKKFKLVAVRIQKENAELRDVNIATTKALEQETKRARREEHGQN

SEQ ID NO: 169933 - protein, 201 aa, Glycine max
  Coding DNA Sequence Number=SeqID_78248
MISIRVRKECDKLRDANMATDEALERETKRARKVEWGRNKFRGALWGSNSELKLRRAERDQSRVEVMILEDKLKACQRSKRSLSEQLSRTEENMWAIIDQYREKLSLVAGHEQRLEDEHEKVSALQAETEVREKVIDSLHGEAMMWMDRFAFTLNGSQELPRLLAKAKATVDVYLLLEEVRRLFDYCQHMIDLMAHIIRSC

SEQ ID NO: 169934 - protein, 140 aa, Glycine max
  Coding DNA Sequence Number=SeqID_78249
MAPHDSIPIVKQFNEMVAWPETQPSLHKEDEGPTAQVPQHMEDESSEATIPEPFDIGEEAEETQVRRVASTTPEQSLEATSEPSALVVNLPSPHHAADPSTPLLQMPKDPTTPVIAVDTSPPTTPVLQLTDDEDGQTQDT

SEQ ID NO: 169935 - protein, 32 aa, Glycine max
  Coding DNA Sequence Number=SeqID_78250
FMEKGCISESIIDTTIALKHKEFLPPLPEPIL

SEQ ID NO: 169936 - protein, 218 aa, Glycine max
  Coding DNA Sequence Number=SeqID_78251
MQENFFQPVAWLEDRPSSTEGNELAATAKVETVVATTAEVEPVADIATETEARPSIAEDLKLDKFTLDPYKRFASQQLDEVLASSEVPEPSNNVKKIVKKKPNTKVTKKVSNEENSDTSDKETDEEESEEDEYVEESFRIEIKYLTSKYVFGNSKEEAQIGVDRSSATSNKCEIYKEEARNAAQKHKTKRVESVNADAEAFGDHWKIQIALCILKLKH

SEQ ID NO: 169937 - protein, 154 aa, Glycine max
  Coding DNA Sequence Number=SeqID_78252
MVGPTSTMCSCGKSWDITMSDIKLLLHTILRQMAMPRLKLFPRRLRSKWSSPFTIKDVKLYGAMELMDPSSADLKHSCIVNGQRVKVYNGGDIKRLTTIIELHEPCGRRRHPLENKPRKEKLHHQESVLDKKLKEEASMEEENERERGMGIEGD

SEQ ID NO: 169938 - protein, 452 aa, Glycine max
  Coding DNA Sequence Number=SeqID_78253
  Gene Ontology: Mol. function=aspartic-type endopeptidase activity; Cellular component=integral to membrane; Biological process=DNA integration
  Homolog annotation: Hit_ID=A4PY46; Match level="QueryCoverage=81%, HitCoverage=96%, E-value=4e-96, Identity=50%"; Hit description =Ankyrin
  Pfam annotation: Domain name=Ank; Domain location=107-137; Score =12.4; E_value=0.54; Accession=PF00023.21; Description=Ankyrin repeat
  Pfam annotation: Domain name=Ank; Domain location=141-180; Score=6.8; E_value=3.5; Accession=PF00023.21; Description=Ankyrin repeat
  Pfam annotation: Domain name=Ank; Domain location=187-219; Score =28.0; E_value=3.6e-05; Accession=PF00023.21; Description=Ankyrin repeat
  Pfam annotation: Domain name=Ank; Domain location=39-71; Score=4.1; E_ value=8.5; Accession=PF00023.21; Description=Ankyrin repeat
  Pfam annotation: Domain name=Ank; Domain location=412-444; Score=0.8; E_value=25; Accession=PF00023.21; Description=Ankyrin repeat
  Pfam annotation: Domain name=Ank; Domain location=73-103; Score=5.8; E_value=4.8; Accession=PF00023.21; Description=Ankyrin repeat
  Pfam module annotation: Pfam domain module=Ank::Ank::Ank::Ank::Ank::An k; Domain location=107-137::141-180::187-219::39-71::412-444::73-103
MNTSDDKLKVAAQEGDISLLYTLIQEDLHVLDHMDLTPFAETPLHIVACVGHLQFATEIMRLKPSFASKLNQQGFTPIHLDMQHGQKRMVLRFVDINKDLVRVKGREGLTPFHFASQKGEIDLLANFLLACPDSIEDVTVRCETALHIALRSQQYEAFRVLVGWLQRTRQRGATTLEKTILNWRNEEGNTILHVSALMNDSKAIRLLVKTKVDLNAKNWENLTALDIAANAEVKIVLAKAGAKHGSSITNAPTFPDKLRSNITLMEKIIIFILRIRRDITEDQRNAFLIVAALVATATYQSALSPPGGVYQANAGDNNTNSTPSLNSTVATTATHGNAGKSVMTVGDFLTLSIFNTLSLLVSIMTMFILTPSGTVGSILSAPMFLFVSCYLHSMKVISPDNATSFGHYITASLFSILYLAASWSMAKVYKRLQHHDKNREMKTWNSIAGNRW

SEQ ID NO: 169939 - protein, 121 aa, Glycine max
  Coding DNA Sequence Number=SeqID_78254
MEHQIFAQPYLQNTTVLRPLQKGVLTGFGGAATRRDTGRGDGGAGKRHSNVFEIQNFNDGVLKCTVLSYQRATYKDGHPRPTSLNVSRGMHVAHKMLTYLWNCHHYSYYDVFDKNDVERAS

SEQ ID NO: 169940 - protein, 202 aa, Glycine max
  Coding DNA Sequence Number=SeqID_78255
  Homolog annotation: Hit_ID=Q6ATS9; Match level="QueryCoverage=64%, HitCoverage=15%, E-value=3e-07, Identity=27%"; Hit description =Putative uncharacterized protein OSJNBb0056O10.12
  Subcellular localization annotation: CTP_CleavageSite=46; ConfidenceScore=5.28e-01
MATPPASPPQSNQQSEAMSRNTRRSTQLRMLTRRTLDQPQPIVTVDAATGRGSGPHKEKFHSYLGVVAREKVPIVHNSWKDVPDTLKELVWNEILAKFDISEALDAKKKIWEEFAATRKTPSWQGIRKKMQEIQKNNDCPYLLSRGGYELLEKKLLDEKMKKRQHDTLMTENPALIEDPPISHSKTCQVEDGPHESIWEDDI

SEQ ID NO: 169941 - protein, 97 aa, Glycine max
  Coding DNA Sequence Number=SeqID_78256
MGEESRKDFRKEVAKLLMDQSILEVKYTTWLTNVVMGEARLEGASSKKRKHSGVATNVYSREILEKPKKGSTNFKNKGSGVDYMREGICTPHVYHKG

SEQ ID NO: 169942 - protein, 105 aa, Glycine max
  Coding DNA Sequence Number=SeqID_78257
MSYPNFVRGPLFIGMRPSFDHLKMFNTHRDGIRKVLRCFGEKPAKNTKMGVYLAKWGTIVDHFERLNTHRGGIRKVLGRFGKKTVKNTKVGVNLSNTGSALRKLH

SEQ ID NO: 169943 - protein, 106 aa, Glycine max
  Coding DNA Sequence Number=SeqID_78258
MRGTMHEPQANLGADQKFLLGSGKSNANNACIKLGVATYPSAGGRRGAHECIFQGRKAHGVATNIYFRKTSEKPERFSLRTLIAKGSGVVFAHGEGINTPRVRHKG

SEQ ID NO: 169944 - protein, 163 aa, Glycine max
  Coding DNA Sequence Number=SeqID_78259
MDQYLYHRRPGTVTQIMCLPGTFCQKEMSSFISMNNKFPKQVRVRGHLIKFDIDSLNTFLETPVVVEQWESFPSYSRFARLRPDLQELAAQLCILGRGFVLNVEGLLWKLLRKDLTTLAQTWSALPYSNLAPTSHTSDLNLDRAKLVYRLIMKMNMNLGSLIS

SEQ ID NO: 169945 - protein, 103 aa, Glycine max
  Coding DNA Sequence Number=SeqID_78260
  Pfam annotation: Domain name=Transposase_23; Domain location=30-97; Score=-8.9; E_value=0.011; Accession=PF03017.5; Description =TNP1ENSPM transposase
MALEAKVGPSIACFSIKESCVNPSRQDPKIGDSDKCGLYVDENPPYLVALGRLYEGSTTVHNIPLGNDQVKVGVEEVQDANARILVPTQEVQLLRINRELRDR

SEQ ID NO: 169946 - protein, 178 aa, Glycine max
  Coding DNA Sequence Number=SeqID_78261
MGSNQAHAFKKRFSSSQGQVWRLHCSLYSFLEIRTVIIFIKRKGRALQCPYRTHVRARVMSEIEEVQEKTKADMEAMKEKMTTMMEVMMSVRKMMEVNTATIIATSTATKVDPTHPSSNQNKHSFPPYGLPPNYTPPNVAHAPDENIDNSAPIPIESQQPQSDHAHVAQPMGETHEAP

SEQ ID NO: 169947 - protein, 249 aa, Glycine max
  Coding DNA Sequence Number=SeqID_78262
MIGRLLASSLALESRILHYLIVRILLPRSSNLAQVSEEDLIVMWAFHTGQIIDWAHLVRYCIHKALQLNAPLPYPHLVTLFLQHFNIPLDSEPYIPIKRSFLIGALWLRPLVTTKSMMAFGFDGLQTYVGERFDALERQVDMRFDAMDSRITKVEEDVTIIRDCLDLPPPPPSDCHHQKGGDCGSNAFQDYFDDAKESRVKQIPKFQDTRFKNQVSRIKIEDQDSRLKIQESREDSIKISTKKVFQNIE

SEQ ID NO: 169948 - protein, 309 aa, Glycine max
  Coding DNA Sequence Number=SeqID_78263
MASKKRKAPATPSQAWERYTDIVVPRKIIPERNVVIYHTEFDEFKEELEIRKWDEELTSFDEGNIDVAIVKEFYANLYDPEDKSPKQVRVRGHLVNFDVDTLNTFLKTLVIIEEGEELPAYSRFALFRPDPQELAAKLCIAGRAFELNVLSYFNLVPTSHTFDITLDRAKLIYGIIMKMDMNLRYLISHQISIIAQHDFSRLGFPALIITLCKARGVTSDSRSLESLSPAINLAYIKKNCWNLDDPTVTFRGPRKARGMKPEAPPTSATIDASTPSSFALPDPSAPSTLTPHLPQLPASALTPLLARPT

SEQ ID NO: 169949 - protein, 79 aa, Glycine max
  Coding DNA Sequence Number=SeqID_78264
MVVVKIVLVVGGSNGYDHDDSGGDGGNCASGGNDNDDGDSDNDEVNGGGDNRGNDNNNSAGNDASGGGGNSSGCGDTGG

SEQ ID NO: 169950 - protein, 178 aa, Glycine max
  Coding DNA Sequence Number=SeqID_78265
MAILELNDLITMMVAIIGKLRENDLELGRLKDEEVDKKNNELALKISTSHHEASDEDPSVNLVDANMNLLVKKFSKFMKKKGKDKGNFQKKSTKKSDFITPKSYTCFECRKQGHIKGDSPTCLKKQQGDETKSNVSDSFSESNTNYDNLLDAFKELHEEAKLDGILRNLLFYKRNPMI

SEQ ID NO: 169951 - protein, 79 aa, Glycine max
  Coding DNA Sequence Number=SeqID_78266
MIFPFFSSPNATQTLTPPSPPPTTTGGHHEAPLLAIEPPHQEEFCNQSKILRILLKDLVEKIPPILRFVAPLRVFLHFL

SEQ ID NO: 169952 - protein, 162 aa, Glycine max
  Coding DNA Sequence Number=SeqID_78267
MWAFHTGRQLDWAHLVRYHMHKALRLNAQLPYPHLVTLFFRHFQIPLDSEPYVPIKRSFLIGTAVIASFGYRKEHDGSWVKKGAQPIDDEGNLPIEDNSSLLRRLLDKFDGLQTFVGDKFDAMELQVDMRFDAMESRITKVEEDVSFIRTCFDPPPPPPSSS

SEQ ID NO: 169953 - protein, 224 aa, Glycine max
  Coding DNA Sequence Number=SeqID_78268
MTEREMITIMVDTLPTFYYEKLIGYMPANFEDLVFVRERIESGLRKGKFEYASNIAPNNNRRAPVVGTREKEGDTHAVTTALTWMKVPQNAQNSYQHNHPNFSIRAGSSLPTQEGPNVKTNPLASHGGASINAIKKDGPSGAKRLEDVATSRRFIYQSLQAACMVSCGGDESEEYLFHLGESHDMETCPAVEELLQRLMDWGQLEVSKGDREEPQICMQSKEKK

SEQ ID NO: 169954 - protein, 102 aa, Glycine max
  Coding DNA Sequence Number=SeqID_78269
  Gene Ontology: Mol. function=aspartic-type endopeptidase activity; Cellular component=chromatin; Biological process=chromatin assembly or disassembly
  Homolog annotation: Hit_ID=Q9C7H8; Match level="QueryCoverage=95%, HitCoverage=8%, E-value=7e-11, Identity=33%"; Hit description =Gypsy/Ty3 element polyprotein, putative
  Pfam annotation: Domain name=Chromo; Domain location=52-102; Score =25.6; E_value=0.00019; Accession=PF00385.15; Description='chromo' (CHRromatin Organisation MOdi
MKKAHDRMKQLADRGRSDRSFQIGDLVYLKKFNGTATAGNFSPSPLLDTSQKEPAAIIDRMTVKRGNCAVTKVLVQWKHQLPEDATWELFYDSKQKFPHFNP

SEQ ID NO: 169955 - protein, 297 aa, Glycine max
  Coding DNA Sequence Number=SeqID_78270
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSISRVTPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 169956 - protein, 59 aa, Glycine max
  Coding DNA Sequence Number=SeqID_78271
MQNSGVTLRVESQHFASVHDDNPCVASIPDFGFIEEIWELNYVKFTICVFKCVEAMSSK

SEQ ID NO: 169957 - protein, 249 aa, Glycine max
  Coding DNA Sequence Number=SeqID_78272
MEWKEMLSNGASGTFPGTFFPDVLALLMSGTSGSTSSSESDEEISFLFLEGIATLLLLDVVGVIGVLFFCAIVLIRPDLLMGVLPFRLCNLSAMPGANLLARGSSSDSTSSRSMRSPGAERTFSIWGGRCWNIFINIRHRNIWGGRCWNIFISIRDRSIFQNATHNTADLLVHLRVYFPRTCCKARVFRNLHSLLSFGDQFFRNRGLNQESFVWVGYGIQVVPGLMVLWWMMEMMVQRVNQEMKYLLVR

SEQ ID NO: 169958 - protein, 143 aa, Glycine max
  Coding DNA Sequence Number=SeqID_78273
MAAQFIHDRVEMECLEGVWETLEGNARCRFRGTIRLMATSLVHPEEPSRTLQHTVEWILPTPTPYLLVEPVQVIEVTSSEEDPEEDPEELPSEPAVDALDFLEGDEDPLPEVDSPEDVMSASEADSTEESGPGGIATSGGSSS

SEQ ID NO: 169959 - protein, 128 aa, Glycine max
  Coding DNA Sequence Number=SeqID_78274
  Subcellular localization annotation: CTP_CleavageSite=40; ConfidenceScore=5.78e-01
MATSPTLPPPPSHSPPPLSPPPAVASASLSMLKQTCKPTRVQSLATRPPGAERPVVHVDPATRKADGPQKKKLRTYLGIVARDKFKSDLMRKWALAADKDGVDDIVCEKYDISKEKWAKFCQTRKDPS

SEQ ID NO: 169960 - protein, 125 aa, Glycine max
  Coding DNA Sequence Number=SeqID_78275
MATARWVLNHPVYGIVILRLGIYTSRPNISKLCSFIGSMNPFILISNDVPKGKLYKVSEFQQTLSTITKQKRKHKREYESVDPTVMWLRMPPDSWVTVTKGRVVDKSRVFATTYPQFRDEELRST

SEQ ID NO: 169961 - protein, 38 aa, Glycine max
  Coding DNA Sequence Number=SeqID_78276
MALYRILGYLVATFSTCPAPGRDDDLSVVTLSSICIRL

SEQ ID NO: 169962 - protein, 83 aa, Glycine max
  Coding DNA Sequence Number=SeqID_78277
AQGDAHQVIDAPPPPRQADPAGSLGVEHYLQHLVRQQAANHRGQVQIHECLYRFSLSQQGQGSAPFACPTPEQFWAEVAWPGD

SEQ ID NO: 169963 - protein, 92 aa, Glycine max
  Coding DNA Sequence Number=SeqID_78278
  Pfam annotation: Domain name=zf-CCHC; Domain location=54-71; Score =19.3; E_value=0.0018; Accession=PF00098.14; Description=Zinc knuckle
MRLKNQGSHSVHYASHQGNQGAEKKFVKKHDKGKGSLKINDDSLQIQKKVSKGNSCQFCRKSGHFQKDCLKCKSWFEKKGELNAYVTFLEKG

SEQ ID NO: 169964 - protein, 187 aa, Glycine max
  Coding DNA Sequence Number=SeqID_78279
  Homolog annotation: Hit_ID=Q6UUU1; Match level="QueryCoverage=45%, HitCoverage=55%, E-value=1e-18, Identity=61%"; Hit description =Putative uncharacterized protein
GDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMGRVLSHSTPDTHS

SEQ ID NO: 169965 - protein, 87 aa, Glycine max
  Coding DNA Sequence Number=SeqID_78280
  Homolog annotation: Hit_ID=A5AZ88; Match level="QueryCoverage=65%, HitCoverage=5%, E-value=7e-07, Identity=38%"; Hit description =Putative uncharacterized protein
MPLYTKFLKDLFTKKGKYINNENIVVEEEDAEISLILGRPFMLMTKCVVDMGNGNLEMSANDQKVTFNLFDTIKHPNDHKACFKMSS

SEQ ID NO: 169966 - protein, 60 aa, Glycine max
  Coding DNA Sequence Number=SeqID_78281
MDTRHGKKIRTRGYPFESVITLTDNIRVDRVWVRFQVFPDNQKSGTGTGMRICRGVGIRD

SEQ ID NO: 169967 - protein, 172 aa, Glycine max
  Coding DNA Sequence Number=SeqID_78282
MGEVEEIQEKMKADMEAIKEKMATMMEAMMSVKKIMEANAVAIAATSVVAKVNLMSPSGINQMNHPTSNMHAFPSYGLPPNYTPPNVAYTLNENLNNSTPILIKSQQPQSDHAHVSRPMEETHEIPHHDLANFEPCLGYAAEGQAVGAIPLQNTLEGPQYHPQLHLLAFHSG

SEQ ID NO: 169968 - protein, 157 aa, Glycine max
  Coding DNA Sequence Number=SeqID_78283
MWLPPKPWNEKPRGLVGKNSVGTSSEGLCGVAIACSRSKRSLSQRLCETETNMLANITKYQEELNLAAVHEHRVADEYAQLYAKKEARGKVIDSLHQEATMWVDRFSLTLNGSQEFPRLLAKAKAMADTYSAPEEIHGLLSYCQHMIDLMTHIIRNR

SEQ ID NO: 169969 - protein, 116 aa, Glycine max
  Coding DNA Sequence Number=SeqID_78284
MPISPCGWIAPTRHPVDPEKSNRALGFPALVTGLCQSYRVPVPPARSCHRDIGIPPARRQVDPKKSNRVLRFSALITDLCQFYGEPIAPNKDIRPPTNQAFIKKYCAPRQVQGEVS

SEQ ID NO: 169970 - protein, 153 aa, Glycine max
  Coding DNA Sequence Number=SeqID_78285
  Gene Ontology: Mol. function=aspartic-type endopeptidase activity; Biological process=RNA-dependent DNA replication
  Homolog annotation: Hit_ID=Q6WAY3; Match level="QueryCoverage=99%, HitCoverage=6%, E-value=9e-09, Identity=33%"; Hit description =Gag/pol polyprotein
  Pfam annotation: Domain name=G-patch; Domain location=62-104; Score =14.4; E_value=0.0034; Accession=PF01585.14; Description=G-patch domain
MFVVEGHLVIVSGEEDVLVSCPSSMPYVEAAEESLETTFQSFEVVSIAFVDSLSGQPYRSDTAMMVARVMLGYGYEPGMGLGKNNGGITSLNKGQSPRLGQQAEGAPPCHISRSFISAGLRHEGQVAAICEDDSPRRSYLVRPCPPGFRLGNW

SEQ ID NO: 169971 - protein, 162 aa, Glycine max
  Coding DNA Sequence Number=SeqID_78286
LTFERLISVNKLAYIKKNYWNLEDLIFSIRGARRVRARPTELPSTFAAPTPASTSVAPSVPVVVPPGSIASIEQFTEMVAWPGTQPSFHREDEGPTTQVPQQVEDESSEATIPEPFVIREEAKETQDPTTSVLAMDTSPLATPVLHLTDEEDVQTQDTQDQS

SEQ ID NO: 169972 - protein, 206 aa, Glycine max
  Coding DNA Sequence Number=SeqID_78287
  Gene Ontology: Biological process=transposition, DNA-mediated
  Homolog annotation: Hit_ID=Q1J7G7; Match level="QueryCoverage=18%, HitCoverage=67%, E-value=2e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGNARVFPVTTLNSMSSHRLFLAVTVCQAFHLMMTLTVLRRIELLFVRFLHCEVIFPPCPYCMIKLIDTVDLEGGPVGKPVVPAALMNRPTRGERRFAYWALAECILAYYVGTDEGVSEVLHVAGEKRLH

SEQ ID NO: 169973 - protein, 40 aa, Glycine max
  Coding DNA Sequence Number=SeqID_78288
MMHDMGHEGEEKDDDNNNNNNDNDDDDNDDHDGDDVPQQH

SEQ ID NO: 169974 - protein, 276 aa, Glycine max
  Coding DNA Sequence Number=SeqID_78289
  Gene Ontology: Mol. function=binding; Cellular component =intracellular; Biological process=RNA processing
  Homolog annotation: Hit_ID=A7Q1K9; Match level="QueryCoverage=89%, HitCoverage=43%, E-value=2e-73, Identity=55%"; Hit description =Chromosome chr7 scaffold_44, whole genome shotgun sequence
  Pfam annotation: Domain name=DUF946; Domain location=3-275; Score =0.3; E_value=5.2e-22; Accession=PF06101.2; Description=Plant protein of unknown function (DUF946)
  Subcellular localization annotation: CTP_CleavageSite=47; ConfidenceScore=5.32e-01
MVQTFSLPAPISQWPQGQGFASGLVNLGEIQVSKVTRFEFISSSSVMLDTKKAVTFFRPVGVPESFHILGHYCQPSGKPLHGFVLVAKICSPQNADTIPPLKNPLDFKLVWSHNAASMEIPSVYFWLPEPPEGYKALGYLVTNKHDKPLLDEMCCVRADLTDKCEPYRQIFATGSRIPEFSFQVWSLRTCDRGMLGKGVSIGTFFCSNGWTMGEELLPVACLKNLNLVLPAMPDSQQIHALIKHYGPTVPQLAVAASHPSLLSPPIPPVPKAGLPT

SEQ ID NO: 169975 - protein, 448 aa, Glycine max
  Coding DNA Sequence Number=SeqID_78290
  Gene Ontology: Mol. function=hydrolase activity; Cellular component =cellulose and pectin-containing cell wall; Biological process =negative regulation of Wnt receptor signaling pathway
  Homolog annotation: Hit_ID=A7PRH0; Match level="QueryCoverage=99%, HitCoverage=100%, E-value=0.0, Identity=70%"; Hit description =Chromosome chr14 scaffold_27, whole genome shotgun sequence
  Pfam annotation: Domain name=PAE; Domain location=40-432; Score =907.6; E_value=5.9e-270; Accession=PF03283.4; Description =Pectinacetylesterase
MEMERVLWVGIAIGLVFSNWVVGYEQYHFNETELSLLEAHEASLSYAGTERNNLLLVGLTLIQNAAAKGAVCLDGTLPGYHWHRGYGSGANSWLINLEGGGWCNNIRTCVYRKKTRRGSSDFMEKEIPFTGILSNKAEENPDFFNWNRVKLRYCDGASFTGDSEDETAELQFRGQRIWAAAMEDLMSKGMRFANQALLSGCSAGGLATIIHCDEFRGLFPRTTKVKCLSDAGLFLDVIDVSGGHTLRNLYSGVVGLQGAQKNLPQICTNHLDPISCFFPQNLIASVKTPLFILNAAYDSWQIQSSLAPPSADPHGYWQQCRLNHAKCTGPQIQFLQGFRNHMLNAIKYFSRSKQNGLFINSCFSHCQTERQDTWFADNSPVIRNKCLLRSLSKHDLNPIALTIEHRFTCRNIMAIALAVGDWYFDRAGVKAIDCPYPCDNTCHHLIFR

SEQ ID NO: 169976 - protein, 409 aa, Glycine max
  Coding DNA Sequence Number=SeqID_78291
  Gene Ontology: Mol. function=hydrolase activity; Cellular component =cellulose and pectin-containing cell wall; Biological process =negative regulation of Wnt receptor signaling pathway
  Homolog annotation: Hit_ID=A7PRH0; Match level="QueryCoverage=92%, HitCoverage=89%, E-value=1e-177, Identity=75%"; Hit description =Chromosome chr14 scaffold_27, whole genome shotgun sequence
  Pfam annotation: Domain name=PAE; Domain location=30-393; Score =917.4; E_value=6.5e-273; Accession=PF03283.4; Description =Pectinacetylesterase
MKKLILILIAAFTFVSVARSASDHFFENDGVSLAVAATPGPPPLMVPLTLIQGAASKGAVCLDGTLPGYHFHPGFGSGANSWLIQLEGGGWCNTIRSCVFRKTTRRGSSKYMEKQLAFTGILSNKAEENPDFFNWNRVIVRYCDGASFSGDSQNEAAQLQFRGQKIWQAAMQELLFKGMQKANQALLSGCSAGGLASIIHCDEFRSLFPTSTKVKCLSDAGFFLDAVDISGGHTLRNLFGGVVKLQEVQKNLPNSCLNQLDPTSCFFPQNLINHVETPLFLLNAAYDAWQVQESLAPHSADPHGSWNDCKSNHARCNSSQIQFLQDFRNQMLNDVKGFSGTSQTGLFINSCFAHCQSERQDTWFADDSPLINNMPIAIAVGDWFFDRKTVKAIDCAYPCDNTCHNLVFK

SEQ ID NO: 169977 - protein, 181 aa, Glycine max
  Coding DNA Sequence Number=SeqID_78292
MTIKIPVVIVMTMTVTMWMVVTMTMLVVIEVMKVVVIVVTIDSDNKGDIVGSGSDNNDNGDNDIGVKGVATCTQHYCWGTQQTVKWRNCPSTIILPEEGSSGKQFPEERHPECFRKKLLPEEFHCLPEEASSGNIPDDVLPEIVCEYFRKTQIILPEEDSSGNFPEKLFPETFRKNLLPEE

SEQ ID NO: 169978 - protein, 469 aa, Glycine max
  Coding DNA Sequence Number=SeqID_78293
  Gene Ontology: Mol. function=glucose-1-phosphate adenylyltransferase activity; Cellular component=chloroplast; Biological process =glycogen biosynthetic process
  Homolog annotation: Hit_ID=A5ATJ3; Match level="QueryCoverage=83%, HitCoverage=99%, E-value=1e-170, Identity=69%"; Hit description =Glucose-1-phosphate adenylyltransferase
  Pfam annotation: Domain name=Hexapep; Domain location=364-381; Score =3.8; E_value=51; Accession=PF00132.15; Description=Bacterial transferase hexapeptide (three rep
  Pfam annotation: Domain name=Hexapep; Domain location=417-434; Score =17.5; E_value=0.049; Accession=PF00132.15; Description=Bacterial transferase hexapeptide (three rep
  Pfam annotation: Domain name=NTP_transferase; Domain location=96-316; Score=217.2; E_value=3.9e-62; Accession=PF00483.14; Description =Nucleotidyl transferase
  Pfam module annotation: Pfam domain module=Hexapep::Hexapep::NTP _transferase; Domain location=364-381::417-434::96-316
  Subcellular localization annotation: CTP_CleavageSite=70; ConfidenceScore=5.79e-01
MVASELQGFFMSLGSKKTSFHRDRNLPSSFTGSRVNLLHSKSVASGFRLGKYFSVTQRNTTRRFLATSTLADVANDFMALQSPILTGREANPKTVASIILGGGAGTRLFPLTQRRAKPAVPFGGCYRLVDIPMSNCINSGINKIYVLTQFNSQSLNRHIARTYNWGGCINFGGGFVEVLAATQTPGESGKKWFQGTADADADHKNIENILILCGDQLYRMDYMEIVQHVDTSIFGLSAQEARKFPYIASMGIYVFKIDVLLKVLRGCYPNANDFGSEVIPMAAKDFNVQACLFNGYWEDIGTIKSFFDANLALMDQRPKFQLYDQSKPIFTCPRFLPPTKMEKCEVINSLISDGCFLKECTVEHSIVGIRSRLDSGVQLKDTMIMGADYYQTEAEIASLLAAGNVPIGIGKNTKIVNCIIDKNARIGNNVIIANKDNVQEADRPSEGFYIRSGITVVLKESVISNGTII

SEQ ID NO: 169979 - protein, 161 aa, Glycine max
  Coding DNA Sequence Number=SeqID_78294
  Gene Ontology: Mol. function=nutrient reservoir activity; Cellular component=extracellular region; Biological process=cell wall organization and biogenesis
  Homolog annotation: Hit_ID=A9PA01; Match level="QueryCoverage=96%, HitCoverage=81%, E-value=3e-59, Identity=64%"; Hit description =Putative uncharacterized protein
  Pfam annotation: Domain name=Cupin_1; Domain location=12-154; Score =121.2; E_value=3.1e-33; Accession=PF00190.13; Description=Cupin
  Pfam annotation: Domain name=Cupin_2; Domain location=41-116; Score =44.3; E_value=4.3e-10; Accession=PF07883.2; Description=Cupin domain
  Pfam module annotation: Pfam domain module=Cupin_1::Cupin_2; Domain location=12-154::41-116
MVNWRRVKMNGFACKEEANVTEADFFFAGLANPGVINNATGSVVTAANTSNPPHTHPRATEILFVLEGELDVGFITTANKLISKTVKEGEVFVFPKALVHFQKNNGDKPAAVISAFDSQLPGTFSIVAVLFNSTPSVPDDVLTHAFQIDTQDVDKIKNSLS

SEQ ID NO: 169980 - protein, 834 aa, Glycine max
  Coding DNA Sequence Number=SeqID_78295
  Gene Ontology: Mol. function=ATP-dependent helicase activity; Cellular component=nucleus; Biological process=regulation of transcription, DNA-dependent
  Homolog annotation: Hit_ID=Q2HUZ8; Match level="QueryCoverage=76%, HitCoverage=84%, E-value=0.0, Identity=79%"; Hit description =Helicase, C-terminal; Zinc finger, CCHC-type; GUCT
  Pfam annotation: Domain name=DEAD; Domain location=134-307; Score =241.6; E_value=1.8e-69; Accession=PF00270.20; Description=DEADDEAH box helicase
  Pfam annotation: Domain name=GUCT; Domain location=539-639; Score =156.2; E_value=9e-44; Accession=PF08152.3; Description=GUCT (NUC152) domain
  Pfam annotation: Domain name=Helicase_C; Domain location=376-452; Score=122.0; E_value=1.8e-33; Accession=PF00271.22; Description =Helicase conserved C-terminal domain
  Pfam annotation: Domain name=ResIII; Domain location=130-302; Score= -24.4; E_value=0.0053; Accession=PF04851.6; Description=Type III restriction enzyme, res subunit
  Pfam module annotation: Pfam domain module=DEAD::GUCT::Helicase _C::ResIII; Domain location=134-307::539-639::376-452::130-302
  Subcellular localization annotation: CTP_CleavageSite=66; ConfidenceScore=5.39e-01
MASSIIGVSSIYQTPPLELYQRPSTASTSSVRLQSLDSKSHFNNLLRAHRHSTGPGLKPTPSFVPSAVATPNSSLLSEEAFKGLAREFDQNDDQFTRASSAAESVNPDELDISKLDLPSRLVESLRSRGITQLFPIQRAVLVPALEGRDIIARAKTGTGKTLAFGIPIIKGLTEDEHAPSHRRSGRLPRFLVLAPTRELAKQVEKEIKESAPYLSTVCVYGGVSYVTQQSALSRGVDVVVGTPGRIIDLINGNSLKLSEVQYLVLDEADQMLAVGFEEDVEMILENLPSQRQSMLFSATMPSWVKKLARKYLNNPLTIDLVGDEEEKLAEGIKLYAIAATATSKRTILSDLVTVYAKGGKTIVFTQTKRDADEVSLSLTNSIMSEALHGDISQHQRERTLNGFRQGKFTVLVATDVAARGLDIPNVDLIIHYELPNDPETFVHRSGRTGRAGKQGNAILLYTSSQRRTVRSLERDVGCKFEFVSSPAMEEVLEASAEQVVATLCGVHPESVQFFTPTAQKLIEEQGTSALAAALAQLSGFSRPPSSRSLITHEQGWITLQLTRDSDSRRYFSARSVTGFLSDVYSAAADEVGKIHLIADERVQGAVFDLPEEIAKELLNRDIPPGNTISKITKLPPLQDDGPPSDFYGRFSDRDRSSRRGSSTSRGGFSSRGGSSSRDRRGFKSSRGWDGEDSDDDDFGDRSSWRGGRNFKTGNSWSRAAGRSSGDDWLIGGSRRSSRPSSSDRFDLEGPVLIAENPGIVHQIVQTLQTDEAFKFPHIYFWAPLCSRRELLAATVFGLMGSGKLKDASQKSYRIDINLHLTCWRDLHRDLCFSS

SEQ ID NO: 169981 - protein, 417 aa, Glycine max
  Coding DNA Sequence Number=SeqID_78296
  Gene Ontology: Mol. function=receptor activity; Cellular component =integral to membrane
  Homolog annotation: Hit_ID=Q2HUZ5; Match level="QueryCoverage=100%, HitCoverage=100%, E-value=1e-117, Identity=55%"; Hit description =Putative uncharacterized protein
  Pfam annotation: Domain name=DUF300; Domain location=6-280; Score =15.3; E_value=1.3e-13; Accession=PF03619.7; Description=Domain of unknown function
MGILVPLFFHVVAFICTVAAIALAVLHIYRHLLSYTEPTYQRYIVRIIFMVPVYALMSFLSLVIPESSIYFNSIREVNFQEIWEKWVKAVCDCKVPTKLKGKLYCIAIQLFSGTDGKCWVFKGITGIKASVALVRMWFVHIQRRLLEALVRRVDWSCEKGERILGEVKRDLMASSFVSNFQTMLKKSNILPLLMGLSYEAWVIYNFLSLCLAWVGGPGAVGVLFFLAAKSGFIEDADEAALLQNFIICVEMLVAAVGLFYAFPYKEYSSANIGGSRGVTASLGHALKLNDFYHDTVHQFAPTYHEYVLYNHSEGEEGTKKYRSRTSVPIGPEMDSVRNKHMSGDKLDDIQLSSLSSTSSTPSNSGSIPDASNSDATNSSLLVDMSNSVSEPYDLTFIDLDVSSYPEEVPAADKAGGR

SEQ ID NO: 169982 - protein, 56 aa, Glycine max
  Coding DNA Sequence Number=SeqID_78297
MEKRQLFLRSYRFCRKKSLKERVKGIKCGFYYRRRSFSRLLSAHNRKIVSSSSCLC

SEQ ID NO: 169983 - protein, 234 aa, Glycine max
  Coding DNA Sequence Number=SeqID_78298
  Homolog annotation: Hit_ID=A5BUF0; Match level="QueryCoverage=79%, HitCoverage=49%, E-value=1e-07, Identity=22%"; Hit description =Putative uncharacterized protein
  Subcellular localization annotation: CTP_CleavageSite=36; ConfidenceScore=5.16e-01
MEESSKKRKGSSSTTVAVGHRRHKPSKGPIAPIHPSLSSPWSSTLFSSYDQRLWYNSQFSSRIILDPKYLDTNFFNDETFDCYQVFQNSGLVDFMSLKLPYYPELVKVFYNNLKIQDDIISSEVHGISMIIDQSLFFSLTKLPSQGAPFEGTIVDDWKIDYSSHDARHMVCNDQAKMTGRLLAGSLTIDCRIIHYIIVRILLPRSSNLAQASEEDLILMWAFLSGCQIDWAHLV

SEQ ID NO: 169984 - protein, 160 aa, Glycine max
  Coding DNA Sequence Number=SeqID_78299
MAPTKHPLDPDKSNRALGFPALIIGLCQSFGVLDAPSKVIRPPITRAFIEKYCTQRQAQGDAPQAADAPPPHQAGPARSFDTEQYLWHLVRQQAANHRAHVQTHDYQFRAEVAWPGDWPEARAGEAPVEAPAEAPGEADEAREDEEMTDLLDFLGGSGAT

SEQ ID NO: 169985 - protein, 92 aa, Glycine max
  Coding DNA Sequence Number=SeqID_78300
MHAGSGFRSDRCREAGADHAHQHDHVDPDVDDIATQQCMSPTKHPLDPDKSNRALGFPALITGLYQSFGVPVTPSKVIRPLITRAFIKKYCI

SEQ ID NO: 169986 - protein, 113 aa, Glycine max
  Coding DNA Sequence Number=SeqID_78301
  Subcellular localization annotation: CTP_CleavageSite=66; ConfidenceScore=5.80e-01
MAAIQMTSLVSMTCWACLSLPLVMGPSSASWSLPFVVSSSLCWACLSLPLVMGPSSASCSLPLVVSSSLVEEEENQESESEQVNNDKATKQGATKMNYGDNTYPLYAGLRTKA

SEQ ID NO: 169987 - protein, 59 aa, Glycine max
  Coding DNA Sequence Number=SeqID_78302
MLVRMIRARLFAAARVKSCPGLHILACRGLHALAFRGLRVLIFSVLHIYTLREYKVLCP

SEQ ID NO: 169988 - protein, 159 aa, Glycine max
  Coding DNA Sequence Number=SeqID_78303
  Gene Ontology: Mol. function=endonuclease activity
  Homolog annotation: Hit_ID=Q9AY32; Match level="QueryCoverage=37%, HitCoverage=90%, E-value=3e-25, Identity=96%"; Hit description=RRNA intron-encoded homing endonuclease
GSIPEREPEKRLPTSKEGSRRANYPILTRGVKKLVVGPWVGSIGPPPVCTGRLVPSAGDALLSLTGRVVPPDSDPIVLAFGIGVMINRDSRGHSYFIVRDTVLVSTINDADQGSADVAFRTPLAPYEKSKSLGSGGSMVARLKLKGIDGRAPPGVEPAA

SEQ ID NO: 169989 - protein, 322 aa, Glycine max
  Coding DNA Sequence Number=SeqID_78304
  Gene Ontology: Cellular component=periplasmic space; Biological process=alginic acid biosynthetic process
  Homolog annotation: Hit_ID=Q1H2L7; Match level="QueryCoverage=96%, HitCoverage=99%, E-value=8e-85, Identity=50%"; Hit description=Sigma E regulatory protein, MucB/RseB
  Pfam annotation: Domain name=MucB_RseB; Domain location=7-321; Score =64.1; E_value=1.4e-18; Accession=PF03888.5; Description=MucBRseB family
MSLKLVFRGYFLPVLLLAVTSQPVVAEEDLWATMQKTASAARELNYQGLFVYQNGAVIRSVQITHIYEGGREFTRNVVLDGRPREVFSEGDDIVIFNAKNDKVVIEKRRGQNLFPAMLPTQLYPLKQNYKLKFVGQERVAGRLTQVLDMIPNDNLRYQYRIWSDSEYGLLLKMSMMDVQGHTLEQIGFNQVSMLQTKDLDWFQPKIDATKPYVMDDTTDLTHTVENLVIPNLPAGYKKIDQIQLKVPGRTTTVQQLIFSDGLASVSLFVEPMIKGMQPRIGKKNMGSTNVYAHVLNGYQLVVVGEVPAQTVEQIAQQVTFKK

SEQ ID NO: 169990 - protein, 1026 aa, Glycine max
  Coding DNA Sequence Number=SeqID_78305
  Gene Ontology: Mol. function=fructose-bisphosphate aldolase activity; Cellular component=chloroplast; Biological process=metabolic process
  Homolog annotation: Hit_ID=Q479X8; Match level="QueryCoverage=32%, HitCoverage=96%, E-value=1e-132, Identity=72%"; Hit description =Fructose-bisphosphate aldolase
  Pfam annotation: Domain name=ACPS; Domain location=5-72; Score=74.3; E_value=4e-19; Accession=PF01648.11; Description=4'-phosphopantethein yl transferase superfamily
  Pfam annotation: Domain name=FBPase; Domain location=217-527; Score =348.3; E_value=1.3e-101; Accession=PF00316.11; Description=Fructose -1-6-bisphosphatase
  Pfam annotation: Domain name=F_bP_aldolase; Domain location=513-840; Score=538.6; E_value=6.6e-159; Accession=PF01116.11; Description =Fructose-bisphosphate aldolase class-II
  Pfam annotation: Domain name=TIM; Domain location=819-1026; Score =151.4; E_value=2.5e-42; Accession=PF00121.9; Description =Triosephosphate isomerase
  Pfam annotation: Domain name=ThiF; Domain location=101-235; Score =179.9; E_value=6.5e-51; Accession=PF00899.12; Description=ThiF family
  Pfam module annotation: Pfam domain module=ACPS::FBPase::F_bP _aldolase::TIM::ThiF; Domain location=5-72::217-527::513-840::819 -1026::101-235
MIYGIGTDIVEVERIQSSLDQFGDAFAKRILADSEWADYQSSQLKARFLAKRFAAKEAFAKAIGTGIRGDRMRSSDHFVDVSRRFSGVRRLYGDQGLASLQNAHVLVIGIGGVGSWTVEALARNAVGKLTLVDLDNIAESNVNRQIHALEDNLGKAKVTAMRERIAAINPQCEVIEVEDFVTPDNLSKMLADSPDIVVDCMDDTKAKIALAAHCKQHKLPLVMVGSAGASWMRHVYAWRICHRYKATACWQRYASPGGTQMQLDIRSHEIAVAQLRTSAVVAAVLSEEEDDPVLFETLDAPFLVSMDPLDGSSNLAINGVVGSIFSVLPNTGVATLGEQAFLQPGQDQRAAAYIMYGPATLLVLTIGQGTHVFTLDHSKQVFVLTQQTVNIPEETSEFAINASNQRYWQPGVQRYIAECLQGAEGPRARDFNMRWCASMVMDVHRILTRGGVFLYPRDSKQPVKAGRLRLLYEANPMSLLVTQAGGESIDGLEDVLAIRPSACHQRVPECYMALISLRQLLDHAAENSYGYPAFNINNMEQILSIMKAADEVDSAVILQASAGARGYAGESFLRKMVEAAIEQYPHIPVCMHQDHGTSPKICQMAIRSGFSSVMMDGSLKEDHKTPATYEYNVDVTRRVVEFAHAVGVSVEGELGVLGSLETGMAGEEDGVGAEGKLDESQLLTDPDEAAAFVEATKVDALAIAIGTSHGAYKFTRPPSDDTLSIERIREIHAKIPNTHLVMHGSSSVPQSLLEQIRHYGGNIKETYGVPVSQIVEGIKNGVRKVNIDTDIRLAMTAAIRAHLAQHPEDFDPRQYFKEATIAAQHLCKERFEAFGSAGQASKIKGLLNRLKQELHDLPGVDTAARSPPGISAKMVAEFGCTYTIIGHSERRALKLESNQVATKRMLNALHAGLTPIFCVGETLDERDGNMAELIVRNQMLNVVYGLDDEAFALAKKFNMVIAYEPVWAIGTGEHASPEQAQRMHAFIRMMIAERDREFAENIRIVYGGSMAPQNAGSLLSMPDIDG

SEQ ID NO: 169991 - protein, 218 aa, Glycine max
  Coding DNA Sequence Number=SeqID_78306
MELDTHSAILAQNKVLTQQVEASTKQIGQLPQQYHQGGPQKMNQAHQVQRIFRCDFYGGSYKGYRGGSSSNQPYGWRPQNFGPTNTSLVGPSNNSNGDSSNKGPQQQQAQLDRLSKMEDTLNQFMQDNDEKKNKKGVEKENEKKDEVVTSEEVEEKMINIPFSEVLEQIPTYAKFMKDLLMKKKRIMDAIIAWPGDMPIFQEEDEDMADHVDYFIEED

SEQ ID NO: 169992 - protein, 66 aa, Glycine max
  Coding DNA Sequence Number=SeqID_78307
MASSNAMNILDFVEAGEGNNLTNAFLRLAKKINENPNPVWESLGGKVIVPAGTYSITKQIVFLKPG

SEQ ID NO: 169993 - protein, 52 aa, Glycine max
  Coding DNA Sequence Number=SeqID_78308
  Subcellular localization annotation: CTP_CleavageSite=36; ConfidenceScore=5.27e-01
MCFREENPSRGASVTLLRRFRKRFCGNSSSFFIVLRSSTVAVKTKSNRSFML

SEQ ID NO: 169994 - protein, 220 aa, Glycine max
  Coding DNA Sequence Number=SeqID_78309
MPSSFVDLVFVGERIKVGLKRGKFDYVSPVGTNNRRIRAVGAKRKEGDAHAVTSAPAWPKPQQTLHGTHQYAQHHLSFLARAGNSSNSAPVQPRTSAPSQQQCQSWHEFQHGKKPSDKEAFRVHPNPNVIWGPIAITNHQPVGSGDPWKDLPVSLPKVVEPQRDLRVSWGNSREFNRAMHGLQAQGPELDRGEMVDIPRRWAKCEDEPALQPWKIGCKCN

SEQ ID NO: 169995 - protein, 32 aa, Glycine max
  Coding DNA Sequence Number=SeqID_78310
IGGLLIEFPSGNKEFAEAIFLEASKLYTRMKL

SEQ ID NO: 169996 - protein, 139 aa, Glycine max
  Coding DNA Sequence Number=SeqID_78311
MWTTGLLAPTGLVDKDRRRETLRVRFTEYGEADASEIGRGGGGGEGGGEAEKYRHQQFIVFKNYKINIKLRLETRRIRPLPLPRRFVVTQTKKSIIGVVHDPLNSVEGQNYVLFEIESILHALGFAASKDYTTQGVAVL

SEQ ID NO: 169997 - protein, 108 aa, Glycine max
  Coding DNA Sequence Number=SeqID_78312
  Homolog annotation: Hit_ID=Q5CEG7; Match level="QueryCoverage=43%, HitCoverage=44%, E-value=4e-18, Identity=91%"; Hit description =Senescence-associated protein
MARHKVTRTHTHTHSRRHKGEEGLGRFVGDLEGRDESKRQGLNLSGSWQQGHSATYNTPSRRADIEGSKSNVAMNAWLPQASYPCGNFSDTSSFKFRRTKGSIGHAFT

SEQ ID NO: 169998 - protein, 274 aa, Glycine max
  Coding DNA Sequence Number=SeqID_78313
  Gene Ontology: Mol. function=motor activity; Cellular component=cell projection
  Homolog annotation: Hit_ID=UPI00006A2D9E; Match level="QueryCoverage =87%, HitCoverage=97%, E-value=8e-16, Identity=18%"; Hit description =UPI00006A2D9E related cluster
DYTSSPSEGYTPSPLEDYRSSPLEDYVSSPSKGYTPSPSRGYTSSPSEDYTSSPLEDYMSSTLEGYTPSPLEVYTRLHALSFRGLHGLTFKGLHALAFKGLHALTFKGLHALAFRGLHVFTLRGLQVLSFRGLHALTFRGLHILAFRWLHALAIRGLHVLNFRGLQASPSEDYTSSPSEGYHALAIRGLHVLAFRGLHALTFRGLHVLAFRGLHALAIRGLHALAFIRLHVLTFRGLHVFAFRGLHTLAFRGLRVLAFNGLRVLAFNGLHALAF

SEQ ID NO: 169999 - protein, 546 aa, Glycine max
  Coding DNA Sequence Number=SeqID_78314
  Homolog annotation: Hit_ID=Q84VH5; Match level="QueryCoverage=91%, HitCoverage=84%, E-value=0.0, Identity=71%"; Hit description =Envelope-like protein
MASSPKETSAPGSPAVPSSPHQEQPEFNIQPIQIIPGQASVPEKLVPRRQQGVKIAENPSSATSSSEVDTEMDKKIRSIVSSILKDASVPDAEKDVPTSSTPNVSVPDVEKDVPTSSAPNAEADQAAEETPAPRAPEPAPGDLIDLEEVASDEEPIANKLAPGIAERLQSRKGKTPIKRYGRIKTMAQKKSTPITPTTSRWSKVAIPSKKRKEISSSDSDDDVEPDVPDIKRTKTSGKKVPGNVPDAPLDNISFHSIGNAERWKFVYQRRLALERELGRAALDCKEIMDLIKAAGLLKTVTKLGDCYESLVREFIVNIPSDITNRKNGVVDITVSEHQIAKEITAKQVQHWPKKGKLSAGKLSVKYAILHRIGTANWVPTNHTSTVATESFAVKLPIAFPTVLCGIMLSQHPNILNNIDSVKKRESALSLHYKLFEGTHVPDIVSTSGKAAASGAVSNDALIAELKDTCKVLEATIKATTEKKMELERLIKRLSDSGIDDGEAAEEEEEAAEEEEEAAEEEEEAAEEEEDAAEDKESDDDDSDATP

SEQ ID NO: 170000 - protein, 174 aa, Glycine max
  Coding DNA Sequence Number=SeqID_78315
  Homolog annotation: Hit_ID=UPI00006A2D9E; Match level="QueryCoverage =98%, HitCoverage=86%, E-value=6e-19, Identity=19%"; Hit description =UPI00006A2D9E related cluster
LHGLTFRELQVLTFRGLHALTFRGPHVLAIKGLHALTFRGLHVLTFRGPHVLTFRGLHALTLRGLHALTFRGLHALAFVGLHALTFKGLHVLTIGGLHALAFRGLHVLAIRGLHALTFRGLHVLSFRGLHALAFRGLHVLSFRGLHALAFRGLRVLTFSGLHIHALSLFKVLCP

SEQ ID NO: 170001 - protein, 114 aa, Glycine max
  Coding DNA Sequence Number=SeqID_78316
MQDSPQTLFLETPVVLEPGETLPGYSRFCRLRPGPEELAAQLCIPGRGFFLNAEGLPWKLLRKDLTTLAHTWSVLSYFNLAPTSHTSDQNLDRARLVYGLVMKMGMNVGALISG

SEQ ID NO: 170002 - protein, 346 aa, Glycine max
  Coding DNA Sequence Number=SeqID_78317
MASATASTCACARSAALDWDVLRRASLAAARIRHQAWRRWHPREIEFLCQALQLIRGGREPALRERRLRALDALVAAGQIAPEDGSALREAYLSCAGWKTSLALLDEQPSVLPAGRCAGPQRTAGRTPGGVSAAVGRTAGRARVRADARCRRHAGRVPAGAGGGGSRICAALAQRDAAGAELPHGDGHAGRAPGGGGQHPATGRAGAGGGGHRAGNGRGGHARRTRRDSRWPLRDHRLRQPGWPGTGLRLRSGPGVPARQSGRRGRQRRRASAGAGALVCAPGAEGDGAARCGHCCGPPVRHRRAPAPGRWQGFAGVFVGQLHRIPARTRMDLGTPGLGARTRRGR

SEQ ID NO: 170003 - protein, 76 aa, Glycine max
  Coding DNA Sequence Number=SeqID_78318
MPFCGQSEGEAHGCAFQKEGKMRGVATNVYLWENVGKTEGNWSTKAGAFAPTYPPLERKSDLRSSFLCVNQVILFT

SEQ ID NO: 170004 - protein, 199 aa, Glycine max
  Coding DNA Sequence Number=SeqID_78319
QSGVNEQPEAYAANIYNRPPQQQNQQQQNNYDLSSNRYNPGWRNHPNLRWTSPQQQQQSVPPFQNVVGPSKPYVPPPIQQQQSQQRQQETEAPLQPSLESEANDHPEYAISARDKSLHSESSKQIQVPPPVAAPTPEKEDEIVEQKRKLPNKNFHAGGPSSSDFDLQQPYIPLPFPPRAIPNKKMEEAEKEILETFRKV

SEQ ID NO: 170005 - protein, 104 aa, Glycine max
  Coding DNA Sequence Number=SeqID_78320
MAQVQENPESRVKQVSRIKIKIQDSRIIKIKIQDSRIQIQDSSKESRLKIQESREDSIKISIKRVFQKLLNITILFKRFFQKKNFTEEFYSLVLNCQKAAIDYQ

SEQ ID NO: 170006 - protein, 215 aa, Glycine max
  Coding DNA Sequence Number=SeqID_78321
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=Q8L796; Match level="QueryCoverage=35%, HitCoverage=9%, E-value=6e-19, Identity=59%"; Hit description =Phosphatidylinositol-4-phosphate 5-kinase 2 (EC 2.7.1.68) (AtPIP5K2) ...
  Homolog annotation: Hit description=(1-phosphatidylinositol-4 -phosphate kinase 2) (PtdIns(4)P-5-kinase 2)
  Pfam annotation: Domain name=MORN; Domain location=55-78; Score=18.0; E_value=0.036; Accession=PF02493.11; Description=MORN repeat
  Pfam annotation: Domain name=MORN; Domain location=79-101; Score=6.7; E_value=1.7; Accession=PF02493.11; Description=MORN repeat
  Pfam module annotation: Pfam domain module=MORN::MORN; Domain location=55-78::79-101
MYLSLSIRKSNEISSVMFIFFTTLPKNDIYSRSRSLSGNVSQMSGKYLWSNGCMYEGEWKKGKACGGKGRFSLPSGVTYEGEFTVGRMHCHSTFIGIDDDMSPIESAYWARNAMPTLQRSPCGSVDGDVKESGHTEPMELAAICGIIPMTVVLKDDAEMVKELNVVNMAGEGVRHSWRQSRQHFGFIISWRGSRGDYLGRIQGGMGYTLLYNCEW

SEQ ID NO: 170007 - protein, 106 aa, Glycine max
  Coding DNA Sequence Number=SeqID_78322
MGFLTVCGLVCSSLPCILVIVRVRALCQVGAGEHVGAGEQRDAGEQGDADAGEQRDGGEQRDTDAAGEQRDGSEQRDVDAGEQRDAGGEERDVADSEEEKEVDSDE

SEQ ID NO: 170008 - protein, 141 aa, Glycine max
  Coding DNA Sequence Number=SeqID_78323
MYVGVKGVTTIVWRQISPFGVVLQTISPDGVVFEYFPGGGSFIRKMHGACSQTARTTGEFGLREGLATASGDMPMQGRNRHSKWRYAHAHREPPVKLASSNRLRVQGAGKIATTIGGLPFTGIASMAGELLDFEIFHPLPL

SEQ ID NO: 170009 - protein, 178 aa, Glycine max
  Coding DNA Sequence Number=SeqID_78324
  Homolog annotation: Hit_ID=Q6UUU1; Match level="QueryCoverage=33%, HitCoverage=40%, E-value=4e-18, Identity=76%"; Hit description =Putative uncharacterized protein
MESRRRTGTRRRIPLHPTTTFSQQRKAWPRLSALSNTSAMWWIAIVAPVAIGLGCLMSELTHINCVALTARFPVGKPVVPTALMNLPTPGERRFAYWALAECILAYYVGTDDGVSEMLHVAGEKRLHRCVSRICDTGYIPLPRSLTRYARSFDCGERKWLTNGAEISWKMPGRYLTGK

SEQ ID NO: 170010 - protein, 81 aa, Glycine max
  Coding DNA Sequence Number=SeqID_78325
  Gene Ontology: Mol. function=transporter activity; Cellular component= mitochondrial inner membrane; Biological process=transport
  Homolog annotation: Hit_ID=A7P5R3; Match level="QueryCoverage=88%, HitCoverage=18%, E-value=5e-22, Identity=70%"; Hit description =Chromosome chr4 scaffold_6, whole genome shotgun sequence
  Pfam annotation: Domain name=Mito_carr; Domain location=4-77; Score =28.2; E_value=7.5e-06; Accession=PF00153.18; Description =Mitochondrial carrier protein
VVLPLHSKVARTHTQVRALTGRKNKKNVIHAHARTLEQEGILGLYIGLGPSCMNLVPTAGISFMCYEACKRILVEDDDDEE

SEQ ID NO: 170011 - protein, 367 aa, Glycine max
  Coding DNA Sequence Number=SeqID_78326
  Gene Ontology: Mol. function=DNA binding; Cellular component=nucleus; Biological process=regulation of transcription
  Homolog annotation: Hit_ID=A5BS05; Match level="QueryCoverage=99%, HitCoverage=96%, E-value=8e-95, Identity=54%"; Hit description =Putative uncharacterized protein
  Pfam annotation: Domain name=Myb_DNA-binding; Domain location=246 -297; Score=40.1; E_value=8.1e-09; Accession=PF00249.22; Description =Myb-like DNA-binding domain
MGLVIPEEELSLDLRPSFVPKTITDFLCHLSTTPNASVKVSLLDDFVHRLQLELAKIQAFKRELPLCMFLLNDAISALKVESEKCMACKSEPVLEEFIPLKKECDQREESEKEKECRDKKSWMSSFQLWNTDDKADINNNAYECDKKQNYGVEDKNNREERKSVAKDLFQYGGIRNGEKGFVMPFSTYPASKEVKEDCVFNGLSLQTPGTAVKNTREGSGCRTSSCRVVSSAPSPLRQPQSGRKQRRCWSPELHSRFVKALEELGGSQATTPKQIRELMRVDGLTNDEVKSHLQKYRLHTQRVPVAKAANSNRSAVALGGLWMHNESLKGRSSGSPQGPLQLATQSGEATSRTEGDNMIDDDVKSDL

SEQ ID NO: 170012 - protein, 363 aa, Glycine max
  Coding DNA Sequence Number=SeqID_78327
  Gene Ontology: Mol. function=fructose-2,6-bisphosphate 2-phosphatase activity; Biological process=fructose 2,6-bisphosphate metabolic process
  Homolog annotation: Hit_ID=Q2HTB8; Match level="QueryCoverage=15%, HitCoverage=24%, E-value=6e-12, Identity=64%"; Hit description =Harpin-induced 1
  Pfam annotation: Domain name=6PF2K; Domain location=109-280; Score= -80.9; E_value=0.0046; Accession=PF01591.9; Description=6 -phosphofructo-2-kinase
MTSNFEIKKVLWKTVLEIPNSKTVFKNVFEAQVSNAAVEGDHCRRRRCPGQPLKLPSGEEGYWLHMGDDSRTIENTREHDETVCKPDDDEEPGYNASGFAAASTPGEAKLGVVSPLIEGMPLPVLVEVSHWLAVDEAYGVVGLRLIFQGRVRLKAGAIKIAHYGFYVKRTPKTGGEHLAFEDMISWMREGGQVGIFDATNSSKERRNMLMKLVEEDARCKVLGSVEDRLHKCLTTKRLNLQAFKAIVYMLTFITITSPERAPGVQQQQVPPLSVNTLITPQCAGNDLAALAISSSFSMRDSEKKLNNKGSKKSRPLKVHKKGQGKKEEVKVGSKSHTKTACTDISRKRVISSLKVKGPRKEES

SEQ ID NO: 170013 - protein, 59 aa, Glycine max
  Coding DNA Sequence Number=SeqID_78328
MGNVENFILAAEKHHIHWRSLVLQIRMAPCRACRPWIFFINGVFCFLKINVSGMEKEER

SEQ ID NO: 170014 - protein, 27 aa, Glycine max
  Coding DNA Sequence Number=SeqID_78329
MARKLQEDWAKDVGEGPIVLMSFNIDF

SEQ ID NO: 170015 - protein, 142 aa, Glycine max
  Coding DNA Sequence Number=SeqID_78330
MHKALRLNAPLPYPHLVTLFLQHFSIPLDSEPYVPIKRSFLIGSAVVASYGYRKERDGSWVKKGAQPNDDEGHLPFEEDSSLLQSILDRFDGLQTYVGERFDSLGHQVDTRFEEMNSRIAKVEEDVPIIRDCFDLPPPPPLV

SEQ ID NO: 170016 - protein, 255 aa, Glycine max
  Coding DNA Sequence Number=SeqID_78331
MEDLFKRWNEHLDNTRLRVSQPPLINCDFCGGEHYNDNCHLYSMNNSGWGRELSPYNQYEEERTPSLESVFEEFMAYHASSKANQNLMQNQEIPFGKSYSIEDYQGGPELQPYNQMKQKEETTESTQRAFESAEIQVGKLAEEVTQFVARREEDFVEVEAQEESPVKAHDSREKEEEKGEEKAQQWEEYSTVEINKKEERQGEDEKTLSVIPSLITDTSPTMSWNLLPKYMKFMEFLAKRRNCKEDVFYVTFMPP

SEQ ID NO: 170017 - protein, 41 aa, Glycine max
  Coding DNA Sequence Number=SeqID_78332
MEEEVALESVGLNNKPDVNLDVEQTPTRKISTKRTTKSWKV

SEQ ID NO: 170018 - protein, 246 aa, Glycine max
  Coding DNA Sequence Number=SeqID_78333
  Gene Ontology: Mol. function=nucleic acid binding; Cellular component= ribosome
  Homolog annotation: Hit_ID=Q2HSY3; Match level="QueryCoverage=57%, HitCoverage=64%, E-value=3e-16, Identity=32%"; Hit description =Nucleic acid-binding, OB-fold, subgroup
  Pfam annotation: Domain name=DUF223; Domain location=39-135; Score =0.9; E_value=0.0025; Accession=PF02721.5; Description=Domain of unknown function DUF223
MSRKENLISELHTRKGTWKIVVRITDLWQARKQNSKQTIEMVLIDQTGSKIGATLWQELFTELRDKLQCGSSYLIQNLRIVDNQSEYRVSPAPYLVYFLKTTSVKEIHRPEIPSNIYLITPFSDIISGLAPRHTLVDIVGVVADFIDVKTVNPPHRMTVRLRDNSNCDILITVWEDYAIQLDDAIDKNLMLQEPLVVMLTLGKIKDATSVSGVDGSQSQSSQSNVVEKFMQNAQVVSIGEINNLRQ

SEQ ID NO: 170019 - protein, 64 aa, Glycine max
  Coding DNA Sequence Number=SeqID_78334
MEVGETKKQRKQNMKEDEWRGTKKEDGETKKTNIYLAPFVAQYVKSRDVPKNQKEAAYAIRKIP

SEQ ID NO: 170020 - protein, 30 aa, Glycine max
  Coding DNA Sequence Number=SeqID_78335
MAICFALRDTTCLCGCEIYWQVHRVVKLKY

SEQ ID NO: 170021 - protein, 134 aa, Glycine max
  Coding DNA Sequence Number=SeqID_78336
  Gene Ontology: Mol. function=transferase activity, transferring phosphorus-containing groups; Cellular component=chloroplast; Biological process=phosphorylation
  Homolog annotation: Hit_ID=A1IM62; Match level="QueryCoverage=61%, HitCoverage=6%, E-value=4e-11, Identity=48%"; Hit description =Pyruvate orthophosphate dikinase
NNYSYRPVDPNLPSSSQRPKDSYPTDRIILQNTDDGQIRTEIYVPKPEFQKVEDLVDDHSALEQDWEDYNAQLMEELLHKKRYPYHHPVYGSLARSKDPSTYKDKVIAIGLPASPGAAVGQVVFTANDAEEWHA

SEQ ID NO: 170022 - protein, 121 aa, Glycine max
  Coding DNA Sequence Number=SeqID_78337
MLRLHCFWSMQLMMHGSLEALEESDETRIESDESKEQFEESLTEAEKSYSDKEEEVIYMDISNILMARSTEEPFYDSPIEEKEPVISKGSSSKPNAGPWFTLDDTPPRGWRKKLICDGSMA

SEQ ID NO: 170023 - protein, 85 aa, Glycine max
  Coding DNA Sequence Number=SeqID_78338
  Gene Ontology: Mol. function=aspartic-type endopeptidase activity; Biological process=DNA integration
  Homolog annotation: Hit_ID=A5BQ49; Match level="QueryCoverage=100%, HitCoverage=29%, E-value=2e-12, Identity=60%"; Hit description =Putative uncharacterized protein
MEIARCMLHEKELPKTFGAEAANMAVFLQNCLPTKVLKDKTPFEAWKYAKEILKKFQMEEWKSISTPMNQKEKFNKEDSADKIDE

SEQ ID NO: 170024 - protein, 79 aa, Glycine max
  Coding DNA Sequence Number=SeqID_78339
  Subcellular localization annotation: CTP_CleavageSite=31; ConfidenceScore=5.10e-01
MLVPKLWFFLIGGLKTKASMRSFNGDFPPWRCSGRQRRRGERRRHPLGNKPWKKELHHQDEPWIRSLERMLQWRKRKRE

SEQ ID NO: 170025 - protein, 201 aa, Glycine max
  Coding DNA Sequence Number=SeqID_78340
  Homolog annotation: Hit_ID=Q2AA10; Match level="QueryCoverage=60%, HitCoverage=28%, E-value=3e-08, Identity=35%"; Hit description =Putative uncharacterized protein
VVPSMLRLMKQANGPYSQQGQWRSHLGNQFNKDQGGPSNRPIQQGPNIFQRTTKLEETLTQFMQFCGKYREESQGECKAMMTRSKRFVENEEENSVGLKKKAVEEKGTDGKKNDESEKAVNEVAEVPYPVVPSKKEKDCHLARFLDIFRKLEITIPFGEALQQITVIQKILPPKHKDPESVTIPCSIGEVTVGKALIDLGA

SEQ ID NO: 170026 - protein, 99 aa, Glycine max
  Coding DNA Sequence Number=SeqID_78341
  Homolog annotation: Hit_ID=Q949K7; Match level="QueryCoverage=34%, HitCoverage=38%, E-value=2e-08, Identity=73%"; Hit description =Putative gag polyprotein
MVEREKFDHIKERPRAIEGGRDYPFADMEELCLVSDVVIPPKFKVLDFDKYKGTTCPKNHLKMFSLSCPPLAERMIRWAHKRTWKKMTCTGALSESQTR

SEQ ID NO: 170027 - protein, 111 aa, Glycine max
  Coding DNA Sequence Number=SeqID_78342
TYQGNPCGVYPDLSSFTGSGVYPDLSSFIGSGVYPDLSSFTGSGVYPDLSSFIGSGVYPDLSSLTGSGVIQTFVTCIKRSTPYGSHHLVSELWLLIQVLSYPILSYFIYSS

SEQ ID NO: 170028 - protein, 112 aa, Glycine max
  Coding DNA Sequence Number=SeqID_78343
MAVSKLRNDAKVRLGFLSLPKSRAKLEGSASVEGFLSAWGLNGEQRRFVVATGGCSKSTSEQFSREQKPRAPSKYLLKDPNGLIVDKYPLKLKTEFREDPTINKGWTTFLPR

SEQ ID NO: 170029 - protein, 191 aa, Glycine max
  Coding DNA Sequence Number=SeqID_78344
  Homolog annotation: Hit_ID=A7QS54; Match level="QueryCoverage=19%, HitCoverage=13%, E-value=2e-08, Identity=67%"; Hit description =Chromosome chr5 scaffold_156, whole genome shotgun sequence
VPPVQLLTGWCVTAKAPPDISAGKCSGHAARRVPFAIQAAQLLGRAIGAGLFAITPAGERGMCCKAIKLGNARVFPEFDQSAYMPQIPDIANCPEYLLPLKEWEDVFLAEFSALRRLLFPLVRVNFELGVIMVIAVSFGKPVVPAALMNRPTRGERRFAYWALAECILAYYVGTDEGVSEVLHVAGEKRLH

SEQ ID NO: 170030 - protein, 86 aa, Glycine max
  Coding DNA Sequence Number=SeqID_78345
MDSTLGLPSTLLLVTIWYTCQRVNSKHAPLQSNVGPGIYSNTPHGAMTVARKPHEHVWSQLEPPRRIPLEAPLTTRLPRPRPEAQT

SEQ ID NO: 170031 - protein, 180 aa, Glycine max
  Coding DNA Sequence Number=SeqID_78346
  Homolog annotation: Hit_ID=A5BSW9; Match level="QueryCoverage=85%, HitCoverage=15%, E-value=4e-15, Identity=27%"; Hit description =Putative uncharacterized protein
  Pfam annotation: Domain name=zf-CCHC; Domain location=125-142; Score =10.1; E_value=0.045; Accession=PF00098.14; Description=Zinc knuckle
MKIEKVFTCYNYNEEKKIKLASLEFKGYALVWWNQVRSDVERMRRPLINTWLKLRSLKRPPWQGFCMQLKRKQIYNKSPYCSLTWKDKETFKKKGGTSFKSHEKGVALGKNNSNPTLTSSKMSSIKCFKCLGKGYIASQCLNERTMVVLGNGDITSASSSTSSSSSSESKSECDVQPLEM

SEQ ID NO: 170032 - protein, 91 aa, Glycine max
  Coding DNA Sequence Number=SeqID_78347
MTPVNPKGRKQESARGSRQGETPGIFIVLSGFATTDLSVRFRDAGQGGGAYGKTALPRPSHFPVKYLPGIFQEISAPFVSHFRSPQSNDRA

SEQ ID NO: 170033 - protein, 140 aa, Glycine max
  Coding DNA Sequence Number=SeqID_78348
  Homolog annotation: Hit_ID=A4WF80; Match level="QueryCoverage=32%, HitCoverage=20%, E-value=1e-12, Identity=84%"; Hit description =Transcriptional regulator, TetR family
  Pfam annotation: Domain name=TetR_N; Domain location=16-50; Score =6.2; E_value=0.044; Accession=PF00440.14; Description=Bacterial regulatory proteins, tetR f
MARKKKEEAQQTRQQLIEAAIGQFATRGVANTTLTDIADAARVTRVLISTSRRPPSSIAFWRHSRSFAYRLMMITAPRQPSSVKKFCCASVSTPSATTFRLSVFARATIAETMVASSLSPLNSFTNALSILSSQAGKRLR

SEQ ID NO: 170034 - protein, 147 aa, Glycine max
  Coding DNA Sequence Number=SeqID_78349
  Homolog annotation: Hit_ID=Q6UUU1; Match level="QueryCoverage=40%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPLSGNYRLESNPERHAKAPLAAAT

SEQ ID NO: 170035 - protein, 174 aa, Glycine max
  Coding DNA Sequence Number=SeqID_78350
  Subcellular localization annotation: CTP_CleavageSite=63; ConfidenceScore=5.03e-01
MKGRRHKYGFNNNKREKAEKIMGSPPASPPPPPSPPSPPPPPSPPSPPPPPPSDASTSPSAVKQTRKASRPLDLLVLRDQWSMLILLPGRLTAEFDIPEASDSRTKRKLLQTVGERWRQFKLDLTRKWALAAEQDGVEDTVCEKYGISKEKWAQFCQTRRDPSWEDVRKKAQAI

SEQ ID NO: 170036 - protein, 86 aa, Glycine max
  Coding DNA Sequence Number=SeqID_78351
  Homolog annotation: Hit_ID=Q84VH5; Match level="QueryCoverage=51%, HitCoverage=6%, E-value=7e-14, Identity=90%"; Hit description =Envelope-like protein
AVTKDTLIAELKDTCKVLEATIKANTEKKMELERLIKRLSESGIDDGEAAEEEEEAAEEEEEAAEAEEDAAEDTDSDDDDDSEATP

SEQ ID NO: 170037 - protein, 114 aa, Glycine max
  Coding DNA Sequence Number=SeqID_78352
  Subcellular localization annotation: CTP_CleavageSite=51; ConfidenceScore=5.15e-01
WAVPPWAAPWQPWATPPCPYPTTPNWQHQSTPRQQGILGPKPPQAHMAATSANNAQPSYASTDIQAAMHTLSMAPPDDQWYMDTGATSHMTANGVIFGRPLCSAQVDIVIMLCS

SEQ ID NO: 170038 - protein, 184 aa, Glycine max
  Coding DNA Sequence Number=SeqID_78353
MTGRLLTGSLAFESRILHYLIVRILLPRSSNLAQVSEEDLIVMWAFHKGLQIDWAHLFRYRMHKTLRLNAPLPYPYLVTLFLQHFNIPLDSEPCVPIKRSFLIGVAVIASFEGHLHGGEDSSLLQKILDGFDSLQTFVGERFDTLELQVDMRFNEMESRITKVEEDVSYIRTSFDLPPPPPPSS

SEQ ID NO: 170039 - protein, 87 aa, Glycine max
  Coding DNA Sequence Number=SeqID_78354
MQMPYTRCPIRPQFKRCLWNCLTRNLIQQIHDSFQGKHPQRYGHCLLRTNGMFLKEFSKWTWVLPNFIVSSIILTTSIRPDNFHLSV

SEQ ID NO: 170040 - protein, 63 aa, Glycine max
  Coding DNA Sequence Number=SeqID_78355
MEVEWRWKRERRCHFKEKMSLEEAHHHRRPWIRASRKKEMNVMVQPTNPRSIPRFSTKCAYVS

SEQ ID NO: 170041 - protein, 21 aa, Glycine max
  Coding DNA Sequence Number=SeqID_78356
MLSYSVCKVGLAVKEPAKPKA

SEQ ID NO: 170042 - protein, 135 aa, Glycine max
  Coding DNA Sequence Number=SeqID_78357
MAPPDSVPIVEQFTDMVAWSGTQSSLHKEDEGPTAQIPQHTENESSEATILEPFDIGEEAEETQVRQVATTTPERSLEATLEPSAPGVNLPSPQPAAEPSTPLLQMPKDLTTPVLAVDTSPPATPVLQLTDEEDG

SEQ ID NO: 170043 - protein, 191 aa, Glycine max
  Coding DNA Sequence Number=SeqID_78358
EGQTLPAYCRYYRLPINFREIEAALCIPGRGFILNSEGHPGKILMKDLTTLAQVWSVLSYSKLAPTSHTSDLTVDRARLIFGLVSHLDMNIGALISGLMTSIAQSNTSRLGFPALITALCWAKGVVSYSLTFERLSLVINLAYIKKNCWNPDDLTVSIQGARRVRARPTKLPSTSIAPTPASTLVDPFVPA

SEQ ID NO: 170044 - protein, 141 aa, Glycine max
  Coding DNA Sequence Number=SeqID_78359
MKEFYENLYDPEDKSPKQVRVRGQLIKFDEDTLNTFLKTPIIVEQVETLCAYSRFALLRPDPQELAAKLCILGRGFELNADGYPLKILRKNMTTQAQTWSVLSFSNLIPTSHTSDVTLDRAKLIYGIIMKMDMNLGYLISH

SEQ ID NO: 170045 - protein, 75 aa, Glycine max
  Coding DNA Sequence Number=SeqID_78360
MAEINQGKTMTAHDWSHIILALTCRYIGTDASGARVTTDRSLPLPGAKQAENVAARQPSILCVRSFFYYFFVLNK

SEQ ID NO: 170046 - protein, 205 aa, Glycine max
  Coding DNA Sequence Number=SeqID_78361
MRDDAGHVPSPILEGEPPRQSDEVHEDRREYAQGDINFYPLVPVEGPAPNTLPQPNLMGEPRNLPAQPIFLSTEGSSPAAEEKRKLNLICHTLISSGDHCLMACNLHLTASRNLTPIVKQTVKFRDMSGVERKHYYAIRKSVFRSWIASGGSNPSRLGELGGNRLPLFLIKRQNGAVLRVPDLPGYVFQLFWVKKIVSVKKIEAE

SEQ ID NO: 170047 - protein, 81 aa, Glycine max
  Coding DNA Sequence Number=SeqID_78362
MDFEALEVVSNAYVESPPMQPCSFSAALMVACVMLGHGGVALTHDEVPQEQSNWVRPCPPEFELGNWQIIEQPETSVANVM

SEQ ID NO: 170048 - protein, 161 aa, Glycine max
  Coding DNA Sequence Number=SeqID_78363
ELNVASKNLMDPIPEDIMVNVVEMEIKTVGNVDPPSKPPTELDEEAQEKEQATRESESSPNKTMHEEGYVNMQAQSNPSSILQKCTPTHVTSTIQSNPMEKEPSSIAHTNNKATVRVQEVTKNPFLLLKLISSDSTISKGSDTSVPKPTSNQIFEQAITYF

SEQ ID NO: 170049 - protein, 83 aa, Glycine max
  Coding DNA Sequence Number=SeqID_78364
MSAMVEGWKGELTKLREKVVMARKSLFSKGKEGSEEEERVVEKEAHKAIMAVQRDSTHETMSEATEVCNGNDVLSVNYWKCAN

SEQ ID NO: 170050 - protein, 165 aa, Glycine max
  Coding DNA Sequence Number=SeqID_78365
MKGIRHKYGFNNNKCEKAEKIMGSPPASPPSPPPPSDASTSPSAVNRTRKASLVHVDPATGKADGPHRKKLRTYLGIVARDKVDVTYENWKEAEFDIPEASESRTKKKLLQTARERWRQFKSDLTRKWALVADQDGVKDTVCEKYGFSKEKWARFCQTHRDPSWE

SEQ ID NO: 170051 - protein, 42 aa, Glycine max
  Coding DNA Sequence Number=SeqID_78366
MSSQIQVVVLALVVVEFHVLVVVNELLSLTLMDFEYDIEREC

SEQ ID NO: 170052 - protein, 97 aa, Glycine max
  Coding DNA Sequence Number=SeqID_78367
MAYQLSGLKSGGENKLVETRARHCVRVIGDLEKKEKKITTFRDLGFAIIALERSGNGTGIVKLLWHGGVGEEGSKKEGAGSKIQAGVVLTHCKDREI

SEQ ID NO: 170053 - protein, 63 aa, Glycine max
  Coding DNA Sequence Number=SeqID_78368
  Subcellular localization annotation: CTP_CleavageSite=8; ConfidenceScore=5.00e-01
MSHTFAVAAVAVVAIAIRSSCARCVGAVSLVRHPAAVVALEAGVLRHRHQTCRRCTEALLSLE

SEQ ID NO: 170054 - protein, 55 aa, Glycine max
  Coding DNA Sequence Number=SeqID_78369
MVPPMNGGVETEHSGEKGLQKLTKMRKEAKHSRTTTMVTRRWRSQVTNDGHRSCG

SEQ ID NO: 170055 - protein, 104 aa, Glycine max
  Coding DNA Sequence Number=SeqID_78370
MDKSLKVGEYEWRERERRGTKFCTSNEVWFSPLIKDQVQDSPLSVLRCHKACSYLSHGPKIYHKAHENPRAFSCITGPIFLESSIQCPCGVGLHHLPLTMLQAQ

SEQ ID NO: 170056 - protein, 37 aa, Glycine max
  Coding DNA Sequence Number=SeqID_78371
MAAEWRRKKDEWRERERRGMVQPTNPRSSPRFSTKCA

SEQ ID NO: 170057 - protein, 131 aa, Glycine max
  Coding DNA Sequence Number=SeqID_78372
MVSLASHYHERLTNTKGLPRWLLALSGLLGLSGPDALSEEKSFVTIAIILNDVSSIGACRPRIFFINGFLCFLEDEWQRNGERKREMRRHFKEKMSLEEAHHHRRPWIRAWRKKEMNEGRGREEHEILCSK

SEQ ID NO: 170058 - protein, 232 aa, Glycine max
  Coding DNA Sequence Number=SeqID_78373
  Gene Ontology: Mol. function=phosphoinositide binding; Cellular component=intracellular; Biological process=intracellular signaling cascade
  Homolog annotation: Hit_ID=A7P9B0; Match level="QueryCoverage=81%, HitCoverage=20%, E-value=8e-66, Identity=63%"; Hit description =Chromosome chr3 scaffold_8, whole genome shotgun sequence
  Pfam annotation: Domain name=PXA; Domain location=53-207; Score= -15.2; E_value=0.0012; Accession=PF02194.6; Description=PXA domain
MWMSLPMSILFVSCLCILLNKVEFHWKKNQLPLNDGHLTYSPPPPKWKKKINSPIVEAALNDFVDLILKDFVINMWYANITPDMEFPELVHDLIMHAIAEVSARVKEINLVDLLTRDIVDLIGDHIDLFRRNQAAIGVDVMLTLSSEERDGRLKFCLLNSKELHLALMSPKSEYKVLRRLMRGLLAMISKNEFKMFKIESRTLQDSRGKLNSRIKNQDSRIKKRLFKNQEKA

SEQ ID NO: 170059 - protein, 52 aa, Glycine max
  Coding DNA Sequence Number=SeqID_78374
  Subcellular localization annotation: CTP_CleavageSite=31; ConfidenceScore=5.16e-01
MKDAIHGHFSTAPAPLFSLLSLSFVVLLSISALLPSSSGARPTLLGELYSPR

SEQ ID NO: 170060 - protein, 406 aa, Glycine max
  Coding DNA Sequence Number=SeqID_78375
  Pfam annotation: Domain name=Transposase_23; Domain location=90-160; Score=17.1; E_value=1.6e-05; Accession=PF03017.5; Description =TNP1ENSPM transposase
MPWTNICVLYRILWRSRHHRNTLVVCVLLEPVSPSSNTSDQLHEAPAVPPPSLPKNSSSSLNKSGTSWRSRSQKNTKGSCVDPSPTDPETGDSEKCGLYIEENPSRLVALGRVYERSIVVHNIPLLHGQVKVGVEVVKDAEAPIPIPTDEVQLVGQALNTFLAWLTCLMKRVSEHATVSPTKPPYWSDPEADDPLYLMTLTIPQLFLKPLQVMWDATMFRVFNSDFPLYIKHKDLFKIAHGGQCLSIFVIQLWILHLTETSMRVGNFDVYGFLEPQSIQRSRQSQFESESYIKSWMQSSKRDVYLGAYLNGGNWQMVAILPKENLVVWFCSLHNRPDNYLKGVINRQKGSTECGYYVMHWMSMIILGTFKNNWETYFNDVRPLEAERLKVLRIQWAQFYLKVRNES

SEQ ID NO: 170061 - protein, 56 aa, Glycine max
  Coding DNA Sequence Number=SeqID_78376
MKTKLIQKSLKLVGLGSSSSMDSFAPWKMNGSGMEKEEREETPLQGEDESRRSSPP

SEQ ID NO: 170062 - protein, 124 aa, Glycine max
  Coding DNA Sequence Number=SeqID_78377
  Gene Ontology: Mol. function=ATPase activity, coupled to transmembrane movement of substances; Cellular component=integral to membrane; Biological process=transport
  Homolog annotation: Hit_ID=A7P6T7; Match level="QueryCoverage=84%, HitCoverage=8%, E-value=3e-34, Identity=63%"; Hit description =Chromosome chr9 scaffold_7, whole genome shotgun sequence
MEWLVLRIEALQNLTAITAALLLVLVPQGYVSPGLVGLSLSYTFTLTGTQIFFTRWYCNLLNYIISVERIKQFIQLPKEPPVIVEDNRPPSSWPSKGRIDLQALEPWLTSHSLKYDMAKYNSYT

SEQ ID NO: 170063 - protein, 39 aa, Glycine max
  Coding DNA Sequence Number=SeqID_78378
MALPKKIPENHDASNDASSDEEPKQGKEVFFQTKEQYCH

SEQ ID NO: 170064 - protein, 707 aa, Glycine max
  Coding DNA Sequence Number=SeqID_78379
  Homolog annotation: Hit_ID=Q5NRP4; Match level="QueryCoverage=13%, HitCoverage=6%, E-value=3e-08, Identity=34%"; Hit description =Putative gag-pol polyprotein, identical
  Pfam annotation: Domain name=zf-CCHC; Domain location=132-149; Score =22.6; E_value=0.00058; Accession=PF00098.14; Description=Zinc knuckle
MKREKHASYSSHNSCKSLREELRDYYEGRHRSHLRPHSHRREKERKPQEANIKFSYFHGKDNVEANLDWEIRVEQQLKKKSTSKSYGSHSYPKKDQGQGILGVTPSKPKDDKGKTIEKQDHKASMQEKTSSIKCFKCLGRGHITSQCPTTKTMIMRGQDIYSSQDEATTSPSSSESEKAKEEESSEEIYPQEEGQPLVVKEKCKEVLASIATPLGLEFISQVKKLLDEGLVRKSLNPCALLVPKIGIIRYQVPKIGGMMNVLSGATLFCKITCTPNIFMGRSPEYEEPRDLRSNPFQGGGNDAILSRKGIGNLLKEAFQGGELSYERASSPSFLSKAHLGGEAPSSMAYSLVDGATSYLFSFDFRCISMNLHKQASISIRADLLADECAAITYHDTEGGDVGGGQREEMGQPSLHEIMGMPERALRLNCGVSGSETKGSSPSEGGGESMDNVGLSLANSSGERHHTGSLVRGGVGWVVCGGGRGGVWDGMSGKRVGGKARNEAAQKEWVREPDGTIGQAFKFREHRVDHRSTTGQTELRELEASLAMKSRDCYGSSTDTNIESGPPYRRKLQSNARCQECSDTRRTGVARILVKWEGGLLTLSEAEHDLLESLYGSLPGIVVRHAGRDRAGITECKKQNNRNARAVGKGHYNAVENFRSCGGAHMAVVAVAEEPPRKSSNLWSPVNIKRLVYHVPVVRLHTKLCDGC

SEQ ID NO: 170065 - protein, 135 aa, Glycine max
  Coding DNA Sequence Number=SeqID_78380
MGEVEEVQEQMEADMEAMKEQMAVMIEAMISMKKIMEANVVVVAATSAVAKVSPTSPSGINQMNHPTSDMVGKDLGSTGGPHDVQIQNEHAFPPYGLPLNYTPPNVAYTPNKNVNNSTPIPIRSQQPQTDHAHVS

SEQ ID NO: 170066 - protein, 36 aa, Glycine max
  Coding DNA Sequence Number=SeqID_78381
MSQVAGGDTLWSSRPFVNRGKCVRRFLLSSSGDIQA

SEQ ID NO: 170067 - protein, 104 aa, Glycine max
  Coding DNA Sequence Number=SeqID_78382
MGCSILRAKSKSIQPRTISTASFQTLKFVSFSIGIEFTWAITFAALIHHKIPVATCPLARLTGALSKGGKMRGVATNVYLWETSEKSKETGQNENSKFGSCIYA

SEQ ID NO: 170068 - protein, 145 aa, Glycine max
  Coding DNA Sequence Number=SeqID_78383
  Homolog annotation: Hit_ID=A5AK77; Match level="QueryCoverage=75%, HitCoverage=13%, E-value=5e-09, Identity=32%"; Hit description =Putative uncharacterized protein
MTRDRTFHRLVRHSVHLDYPKHFVPFEHPEHSVIGESEHSVVGNFEHSKNMAQPPPRERTLREMVAPDFTYESLCIQYPDEDVPYVLKIGLIHLLPKFHGLAGEDPHKHLKQFHIFCSTMKPPDVQEDHIFLKAFPHSLEGVAKD

SEQ ID NO: 170069 - protein, 93 aa, Glycine max
  Coding DNA Sequence Number=SeqID_78384
MDKLHKIDMRGRTDTNWAKKHAKWIRYWQQRQSMVLQGQPIIGHANHSQEYMSCQDVQDNNPSLHDIPDERPRQNLGRNKRCLPCGTGHHYGD

SEQ ID NO: 170070 - protein, 46 aa, Glycine max
  Coding DNA Sequence Number=SeqID_78385
MASMMDAMLGMRQLMENNATTAAAVSSAAEADPTLPATAHHPIPNV

SEQ ID NO: 170071 - protein, 231 aa, Glycine max
  Coding DNA Sequence Number=SeqID_78386
MVLGTSRPFILVEVRHFEFWGDNNIWYQTKIRHVREQIVTKAFNNPQSLLEEIEFPSFFGRRGWSFCGQDYWLCCEVGPRLSVGCWPLDGDQGVELDIPLGILLMIFVDLVGLSRRLPFKDGGRDMTRIILHDWWRVIRWQSIRVSRPVVSQMGVVVVPQCAPSSSYCAFGGGWCAVARRVGSASAAELTAAAVATFFSMSCLIPNMASIMEAICSFRADMSAFMCSCVSS

SEQ ID NO: 170072 - protein, 127 aa, Glycine max
  Coding DNA Sequence Number=SeqID_78387
MDNILGRHILPERKVEIYHTELDEFKAELERRNFHKCLTNLVDSRIDLALVKEFYANLYSSEDPSPKQVRVRGHLVRIDADSLNTLLETHVILAEGETLPAYSRYCRLPIDIKRLRLPYVYQAEGLF

SEQ ID NO: 170073 - protein, 157 aa, Glycine max
  Coding DNA Sequence Number=SeqID_78388
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQKAVIRLSTESGDNAGKN

SEQ ID NO: 170074 - protein, 126 aa, Glycine max
  Coding DNA Sequence Number=SeqID_78389
MSHHSSSVTREGTSHKDPLSRILDELSSLKLWKEKLEIKEKGKERVEINQDKREQIREEERRKILKELRKEKHATYSEELRDYYEGRHRSHLRPHFHRREKERKPQEANINLPYFHRKDNVDAYLD

SEQ ID NO: 170075 - protein, 74 aa, Glycine max
  Coding DNA Sequence Number=SeqID_78390
MAPKHRTWITHEHANHRDTAQARIKNKGIRQHKVNDQAQNIDFSSPENQNYMSSANEPAINREGYSDLGDQLMQ

SEQ ID NO: 170076 - protein, 36 aa, Glycine max
  Coding DNA Sequence Number=SeqID_78391
ELEGGLVPSLEEFESIRNKGANHLKSYWTKKHSKIE

SEQ ID NO: 170077 - protein, 132 aa, Glycine max
  Coding DNA Sequence Number=SeqID_78392
MTLLLSNILPIDRNADLPLLKYRGRAHKTPSGPEEVQQGPGISSFGYGPLSVLQGACSPQEGIAPARHPMDPEKSNRVLGFPALITGLCQFDGVPVTPSKVIRPPTNQSFIKKYCAPRQAQGETPRQPGDGR

SEQ ID NO: 170078 - protein, 53 aa, Glycine max
  Coding DNA Sequence Number=SeqID_78393
MCKIRMLRIKMLKIIMLQIRMFKITNNRMHRFTSNGMLNDQKDQRVVSQMDCL

SEQ ID NO: 170079 - protein, 132 aa, Glycine max
  Coding DNA Sequence Number=SeqID_78394
  Gene Ontology: Biological process=transposition, DNA-mediated
  Homolog annotation: Hit_ID=Q1J7G7; Match level="QueryCoverage=25%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRFKLIDTVDLEGGP

SEQ ID NO: 170080 - protein, 43 aa, Glycine max
  Coding DNA Sequence Number=SeqID_78395
MDALLGSFNNGNCSDSKVFDSTGLSCRTITSNRVQQEESADDA

SEQ ID NO: 170081 - protein, 65 aa, Glycine max
  Coding DNA Sequence Number=SeqID_78396
MTTHPSSRFFLVLSQRSVALSGWLAKPEDWLSERMKISTSQTFLINLKLRGNGVCTKVIDCMIKE

SEQ ID NO: 170082 - protein, 118 aa, Glycine max
  Coding DNA Sequence Number=SeqID_78397
  Subcellular localization annotation: CTP_CleavageSite=14; ConfidenceScore=5.09e-01
MPSSFRGLHVLAIRGLHALAFRGLCVLTFRTSSFPLTVLGPPPDIGGGPTVRAQPEREAITQLLCIPGQDFTCAVAKRRGSHPQDTQWTRKSPTGPWGFQLWLRASISPIGCPYPPGK

SEQ ID NO: 170083 - protein, 63 aa, Glycine max
  Coding DNA Sequence Number=SeqID_78398
MNVEERLKTFVNFERIRSARRLNLMQSYSVRALGRKLQVDWARDPREGPRVLMSLRVDFEPMG

SEQ ID NO: 170084 - protein, 162 aa, Glycine max
  Coding DNA Sequence Number=SeqID_78399
MLQPYEISIGLKEHSNPVTPKAYTPKSPSGPLPPDSVIPPTASIEFPNVRETEKRLKPPLILSSCDSFFSLHFYQDSSGFLRERKRLQCEGCFSQFRNDIKIPNGENSQNCVANMIRKFHDDPTVNGFKIVVFLRLVWWAAGKRKGFERRRGKTKMRPKGGS

SEQ ID NO: 170085 - protein, 165 aa, Glycine max
  Coding DNA Sequence Number=SeqID_78400
  Homolog annotation: Hit_ID=A5AK77; Match level="QueryCoverage=56%, HitCoverage=11%, E-value=9e-11, Identity=38%"; Hit description =Putative uncharacterized protein
MTRDNPGDLKPFDPEIDRTFHRLVRHSVHPGHSVHFEHSEHSVEGDSEYSNFEHSTTNFYTENMDQPPPRERTLREMAAPDFTYESLCIQYPDEGVPYVLKTELIHLQPKFHGLAGEDPLKHLKEFHIVCSTMKPPDVQEDHIFLKAFPHSLEGVAKDWLYYLAP

SEQ ID NO: 170086 - protein, 20 aa, Glycine max
  Coding DNA Sequence Number=SeqID_78401
MAREKVQIKKIDNATARQGL

SEQ ID NO: 170087 - protein, 21 aa, Glycine max
  Coding DNA Sequence Number=SeqID_78402
MKEKPKKKVKFTEIFLAMAFD

SEQ ID NO: 170088 - protein, 95 aa, Glycine max
  Coding DNA Sequence Number=SeqID_78403
MQPRHYGSNLNQPKKFSAPFDPAGYNYWDYIDDEDMTKSKGKDPLEGLGGPMTRARARKAKEALQQVLSILFEYKPKFQGEKSKVVSCIMAQMED

SEQ ID NO: 170089 - protein, 60 aa, Glycine max
  Coding DNA Sequence Number=SeqID_78404
MAMNCHTLQSQACVGSIPEPKLKSKISHSLIRMGFIGLVTWSGAMKVWMTPLPMKEDKSG

SEQ ID NO: 170090 - protein, 132 aa, Glycine max
  Coding DNA Sequence Number=SeqID_78405
MPFDLKITKTERKNRKKKKQSTTITPNLTSSEEVYPHEEGDLLMVRRLLGVSKLNLTIIPHPKPYKLQWLKEQGKMIVNCHTLISSGDHPLLGCDPRLTTSRYLAPIVRQFVKFCDMPEVKRKHCSTIREVP

SEQ ID NO: 170091 - protein, 67 aa, Glycine max
  Coding DNA Sequence Number=SeqID_78406
MAIRKIIYNGLTNEITLTHLGTKFVLHPQTPSHVAKDQIQIKLKWDERKNRKRKEEQPLMIKEECKE

SEQ ID NO: 170092 - protein, 87 aa, Glycine max
  Coding DNA Sequence Number=SeqID_78407
MSEFTSNSTQISASPHQLDFAPYVSGSYNAQWNALELLRDKHMLRSSHILRKMEVEEPWLGLWLPLNYQVDMGASFFAGKFPPWLVF

SEQ ID NO: 170093 - protein, 24 aa, Glycine max
  Coding DNA Sequence Number=SeqID_78408
MSSKGINEALGLNLELGLDLKRAD

SEQ ID NO: 170094 - protein, 65 aa, Glycine max
  Coding DNA Sequence Number=SeqID_78409
  Subcellular localization annotation: CTP_CleavageSite=45; ConfidenceScore=5.24e-01
MMGGTPMFQCLTPYHGGTVTFTGNQKGRIIGMVDMVYPSTRMNVSSSVRMGLAYFLQREKETSTR

SEQ ID NO: 170095 - protein, 98 aa, Glycine max
  Coding DNA Sequence Number=SeqID_78410
KAHIYACKADLPGQKEEEARAQSADGKVFKIVPWHHLEHSTSNSLSIQALSHDLTGLDSCSCHCMQCLLSPKGVAFAPIDKDDSNLPLDTAPIKHVTQ

SEQ ID NO: 170096 - protein, 116 aa, Glycine max
  Coding DNA Sequence Number=SeqID_78411
MEKNEETSMEENLSMEARSLSFNGDFPPWRCSGRQRRRGEGRHHPHGNKPWKKELHHQECALDKKLEEDALMKEKKERRGEHEMEGIKEGEKWNFEVSHKTFIHQSYNKCYTCFYL

SEQ ID NO: 170097 - protein, 87 aa, Glycine max
  Coding DNA Sequence Number=SeqID_78412
YILCGTSRGYIYFGLTENKRGYISCGSVLVEGTSTRKLEVGSWKLGVEIGSWKLKIEIGSWKLEVVSGSWKLEVEIGSGSCKLELEI

SEQ ID NO: 170098 - protein, 445 aa, Glycine max
  Coding DNA Sequence Number=SeqID_78413
  Gene Ontology: Mol. function=methyltransferase activity; Biological process=methylation
  Homolog annotation: Hit_ID=Q1H1Y3; Match level="QueryCoverage=60%, HitCoverage=69%, E-value=1e-112, Identity=72%"; Hit description =Putative RNA methylase
  Pfam annotation: Domain name=UPF0020; Domain location=48-255; Score =220.5; E_value=3.8e-63; Accession=PF01170.9; Description=Putative RNA methylase family UPF0020
AICDKFRQVVGSRPNIDTREPAIRVHVYLTSDSYQLYVDTSGLPLYQRGNRKNSIEAPLRENLAAGILKLTGWQPGQALLDPMCGSGTFLLEAVMMALNIAPGLNRNFGFEKLKNFESDTFRKIRNAAAKAVKPVTFQSIYGSDMDLRAVRVTKQNLEMAGWLEAVQLTHWEFTQVVPPAESGVLVANPPYGVRIGEDETLAALYPQMAATLKQKFSGWNTYFLTNDLRLPKLMRLSPSKKTPLYNGPLECRLFEIKMVAGSNRREKADSPAVDDFVEERDWAQFHSPKNLAMAMIVEAAEVVEHFQWMTEADSRQLDDATKEKVGQELADTFVYLMRIAEVCGIDLIAATNAKIELNAQKYPADKCKGWLTMVANVHSPVTDLLKQQQIAFQVIEIPLSEDKKPIRHLEELLFAQGLDPQSVVRSVVFKGENSGFCLLAVAGGG

SEQ ID NO: 170099 - protein, 94 aa, Glycine max
  Coding DNA Sequence Number=SeqID_78414
MADEHQQRVTLEDYSSSSVPQFFTSIARPEVQAHNINYPHSLIHLIQGNLFQGLPNEDPYAHLVCQMKPLDSVYFHFPWQEKPKGGSTHLRVTV

SEQ ID NO: 170100 - protein, 202 aa, Glycine max
  Coding DNA Sequence Number=SeqID_78415
MTGRILFGSLAFESRIIHYLIVRILLPRSSDLAQVSEEDLIVMWAFHKGRQIDWAHLVRYRMHKALRLNASLPYPHLVTLFLQHFNVPLDSEPYVPIKRSFLIGAAVIASFGYKKEHDGSWVKKGARPVDEEGHGGEDSSLLQKILDRFDGLQTFVGERFDTLELQVDMRFNEMESRITKVGEDVSYICTSFDLPPLLPPSS

SEQ ID NO: 170101 - protein, 292 aa, Glycine max
  Coding DNA Sequence Number=SeqID_78416
  Gene Ontology: Mol. function=methyltransferase activity; Cellular component=cytosol
  Homolog annotation: Hit_ID=A8GBT4; Match level="QueryCoverage=86%, HitCoverage=75%, E-value=1e-132, Identity=88%"; Hit description =Putative uncharacterized protein
  Pfam annotation: Domain name=Methyltransf_10; Domain location=48-288; Score=359.0; E_value=7.8e-105; Accession=PF05971.3; Description =Protein of unknown function (DUF890)
MGDPVVIDEVFIVPGFPPLRHCGRDVLSYAPEIPSREPVTVEKKKTFPQQKSGLHPRNRHRSRYDFPALIASCPALAPFVKPNAWGDVSVDFADPAAVKMLNRALLQHFYGIEHWDIPADYLCPPIPGRADYLHHLADLLATSNGGEIPRGKGVAILDVGVGANCIYPIVGLREYGWRFTGSEIDSVSLNAAKMIVEMNPTLRNSVRLRLQKQPELIFSGIIGAAEKFDATLCNPPFHASEQEARASTRRKLHKLGKGEVADKPVQNFGGKNNELWCERWRRSLRAQDGGRE

SEQ ID NO: 170102 - protein, 400 aa, Glycine max
  Coding DNA Sequence Number=SeqID_78417
  Gene Ontology: Mol. function=hydrolase activity; Biological process =proteolysis
  Homolog annotation: Hit_ID=A8GBT9; Match level="QueryCoverage=83%, HitCoverage=99%, E-value=1e-143, Identity=73%"; Hit description =Hydrolase family protein precursor
  Pfam annotation: Domain name=Abhydrolase_1; Domain location=153-374; Score=-8.6; E_value=0.026; Accession=PF00561.11; Description =alphabeta hydrolase fold
  Pfam annotation: Domain name=Peptidase_S15; Domain location=103-322; Score=-95.4; E_value=0.0051; Accession=PF02129.9; Description=X-Pro dipeptidyl-peptidase (S15 family)
  Pfam annotation: Domain name=Peptidase_S9; Domain location=141-375; Score=-78.8; E_value=0.07; Accession=PF00326.12; Description=Prolyl oligopeptidase family
  Pfam module annotation: Pfam domain module=Abhydrolase_1::Peptidase _S15::Peptidase_S9; Domain location=153-374::103-322::141-375
MDERLRCRAMRGPVPEPARQPAQRGCAAPVSALRFSGAARRALRCVGMAVRSGRLGVDGETLRGGDVRKIGLCSVVLFLLAFGWVIFVNDFRFVTEPVTVTAGGNRLTGTLVLPQHAPVKPGVVVFVHGDGPANASRDEGYYGIWEAMAQQGYAVLSFDKPGVGGSGGNWLHQTMADRARETADIIDWARRDGRFDARCVGLWGTSQAGWVMPAVARLRPDIAFTLALAPAINWLRQGRYNTRAAMAAAGDDEALIQAREAHWRHIQTLLEQPDGYAQYRREYGAAAALSADRWHFIRANMASDATAELRHFTTPVHLILGGRDVNVDADETERVYRQTIPASLLTVTRIDEADHVMIKPLFARHPWLINVVGLFAPRSVQYDAYRQDVAAFLAAQPCGR

SEQ ID NO: 170103 - protein, 106 aa, Glycine max
  Coding DNA Sequence Number=SeqID_78418
MVMGDPISRLSFPENTETFSSLTSYPELRRSEFLIGGYVGARASLLSTTPSFVAMTQELVARGDTLRLSAPRHSVTPSVRWHAETKFGHSAPMIRGDTLRLSAPLC

SEQ ID NO: 170104 - protein, 50 aa, Glycine max
  Coding DNA Sequence Number=SeqID_78419
MEEIHGEEDEEQGIKALDLLHQWSPLLLEDQWQRNVEGRKMIGDATSRRR

SEQ ID NO: 170105 - protein, 57 aa, Glycine max
  Coding DNA Sequence Number=SeqID_78420
MERCASRFRKWLPFAIWNRNGVQRLKLCWSFNGEEEERNSNVRKRSQEEKNLTFLKR

SEQ ID NO: 170106 - protein, 104 aa, Glycine max
  Coding DNA Sequence Number=SeqID_78421
  Homolog annotation: Hit_ID=A6FJQ2; Match level="QueryCoverage=36%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVSIAEEAMLKCLGELCLVKN

SEQ ID NO: 170107 - protein, 144 aa, Glycine max
  Coding DNA Sequence Number=SeqID_78422
  Subcellular localization annotation: CTP_CleavageSite=25; ConfidenceScore=5.55e-01
MASPPASPPPPLAPSDAPASPFAVKRTRKASRLRSLSTRPLGAERPVVHVDPAIDKADGPHRKKLRTYLGIVAHDKVDVTYENWKEVPTAQKDLIWEDIQDVCKKAQAIQKQNTVPHVLSRGGYDYLEQKLLAEKTKKKLEEAA

SEQ ID NO: 170108 - protein, 60 aa, Glycine max
  Coding DNA Sequence Number=SeqID_78423
MPKDRGTCLDFRDCHHQKGGDCGQRIKLNVLMMPKFHMRLKALFKTKKLKIFKMDDQDSL

SEQ ID NO: 170109 - protein, 129 aa, Glycine max
  Coding DNA Sequence Number=SeqID_78424
MSDGFCGTHLQIMVNTRGLGRALGQVTLRGVGRGDHDDSDDAPQRRRPTASARRQRVAVTADHIDEPVIADPDVQDDPMEAPAAVEDIHADAGAEAAEDQPQGFSGGPSDPSVLTAYEDHVACSVWTGE

SEQ ID NO: 170110 - protein, 98 aa, Glycine max
  Coding DNA Sequence Number=SeqID_78425
MKQALLKCIRVGPSPIWHNRVWKLVRGETIRLVFCHMGGVWNCKFYAEFGNRTGSSESLSQAWGSICSHLVKQVKPDVLLGLSAVGGLFSKEVSRLML

SEQ ID NO: 170111 - protein, 98 aa, Glycine max
  Coding DNA Sequence Number=SeqID_78426
MAPKKLSTKRSRRDAAAEGSSAAPEFDSHHFRSAEHQQRFEAIRGWSFCRERRVQLREDEYTDFQKEIARRQEGVRDMRSWVRGQWIPFDADALSQFL

SEQ ID NO: 170112 - protein, 132 aa, Glycine max
  Coding DNA Sequence Number=SeqID_78427
MPISPCGRIAPTKTPSGPGEVQQGPGVSNSGIAPARHPADPKKSNRVLELPALITGLYQFYGVPVAPSKSSGPLLIEFHQEVLRPQAGAGLNTTAAWGWSAAGNRRTAITSRVHLSSSTKRLERCLRPMDDQ

SEQ ID NO: 170113 - protein, 128 aa, Glycine max
  Coding DNA Sequence Number=SeqID_78428
LVTLFFRHFQIPFDYEPYVPIKRSFLIGAAVIASFGYLKERDGSWVKKSVPPADDEGHIPVEDNSTLLQRLMDKFDGLQTFVGDKFDAMELQVDMRFDAMESRTTRVEEDVSFIRTCFDPPPPPPSSS

SEQ ID NO: 170114 - protein, 122 aa, Glycine max
  Coding DNA Sequence Number=SeqID_78429
MGKEHFRQEGTPVQIQRGRPVMQSYPTRALDRKLQVDWARDAREGPRVLMSLRVGYPRNIGSKDQRTTQVNQRTSQVNQEQVKSSRIKKNSRLKKKAYNQESRFKIQDLKNQDQDSRLKIQE

SEQ ID NO: 170115 - protein, 368 aa, Glycine max
  Coding DNA Sequence Number=SeqID_78430
SYRFILLARSGALAEFEQKATTSWPHKPYETTRFTSEGAWERYSQNIHSRNILSERNVNLFVTEYDEFRRELIRRNCHKALTQHMDGHIDVALVKEFYSNLYNPKDKSPKQVQVRRKLIKFDAASLNAFLETPPLIQPGEQSTLEALEEGSDYTSPDLECVIILQPCPNFSYGEVSLWASFEDGHGCGLPHITPDFSDGLVQLLAARLPSPHHRLMHRPRSYLGFSNFRARARGSEGPSSSAPALASTSAHASSDPTTSTSHPPSSVPAPSGTSAQSLDLTVPMLQSLHHGLRLVMQSIHDLAQHQPIMSMEEFTTQVAWPGVQPSPLRGGEASAAQEPHSQPEVSEEEENGAADLDYVADMTAAQST

SEQ ID NO: 170116 - protein, 426 aa, Glycine max
  Coding DNA Sequence Number=SeqID_78431
  Homolog annotation: Hit_ID=A8GCQ3; Match level="QueryCoverage=79%, HitCoverage=42%, E-value=1e-128, Identity=66%"; Hit description=Rhs element Vgr protein
  Pfam annotation: Domain name=DUF586; Domain location=102-180; Score =46.2; E_value=1.1e-10; Accession=PF04524.3; Description=Protein of unknown function, DUF586
HTPDPESGAFYARIRHERYLNQQTRLNGETNCAALAPGQQLKVSGGEEVTDVWRQGVAIAAIHCRARRDRSFVMTFQAIPCVETYCFRPAVISKPRMAGTLPARVTSTKINDLYGHIDRDGRYRVNLLFDRDRWQPGEESLWVRQARPYAGETFGLHLPLLAGTEVAIAFEQGDPDRPYIAGALHDSTHQDHVTLYNYKRNVLRTPANNKIRLDDTRGKEHVKVSTEYGGKSQLNLGHLVDHQNTPRGEGFELRTDSYGAIRGGKGIFITADEQLKAMGATVEMDPASQLLGSAVVQLNDWQEIARTHYNTPPDVSTLKQFVGKAVNLASPVLLMSAPKGIGIQKRNLAAVPPGRDAHGIGERTAGDRVARRHTGAHFTEGYYRSVNAGTSAAYRQKWHHPGLRRRLHSPDAAGRNSSSQPESAQF

SEQ ID NO: 170117 - protein, 167 aa, Glycine max
  Coding DNA Sequence Number=SeqID_78432
MSTSLWWGHHKIVCRILGSSIFVRAGSNYFLVYCAMHNVNNFNIKEMKRCPLTNKEDRLTGISVPHLRSASQANALPVIGVNLVESIILLLCDLLRLCHPNGLILLFVVVKTKSSKGFPLTKDFSFHSKLMFNLRMNDNQPLVPVHNSHGIALSQICPNNLNGNVLT

SEQ ID NO: 170118 - protein, 62 aa, Glycine max
  Coding DNA Sequence Number=SeqID_78433
MTEATGNNGRDELAVTWNRSHTKHCKLKQKEGHDNRVKSMRKYATDNNCKKKQYSNTRLGST

SEQ ID NO: 170119 - protein, 599 aa, Glycine max
  Coding DNA Sequence Number=SeqID_78434
  Gene Ontology: Mol. function=aminoacyl-tRNA ligase activity; Cellular component=cytoplasm; Biological process=tRNA aminoacylation for protein translation
  Homolog annotation: Hit_ID=A2Q1N3; Match level="QueryCoverage=100%, HitCoverage=97%, E-value=0.0, Identity=82%"; Hit description=Lysyl -tRNA synthetase
  Pfam annotation: Domain name=tRNA-synt_2; Domain location=245-597; Score=438.0; E_value=1.3e-128; Accession=PF00152.11; Description =tRNA synthetases class II (D, K and N)
  Pfam annotation: Domain name=tRNA-synt_2d; Domain location=254-594; Score=-173.6; E_value=0.06; Accession=PF01409.11; Description=tRNA synthetases class II core domain (F)
  Pfam annotation: Domain name=tRNA_anti; Domain location=123-204; Score=58.8; E_value=1.8e-14; Accession=PF01336.16; Description=OB -fold nucleic acid binding domain
  Pfam module annotation: Pfam domain module=tRNA-synt_2::tRNA-synt _2d::tRNA_anti; Domain location=245-597::254-594::123-204
MEVPSEAPPSTGTGETISKNALKRELKNKQREEDRKRKEEEKAKKAAEKLEMQKDKDNKSAPADEDDMDPTQYLENRLKYLAVQKAEGNNPYPHKFSVTMSLDQYIKEYGGLSNGQHLEDVSVSLAGRIMHKRTSGSKLVFYDLHGGGFKVQLMADASKSDLDEAEFSKFHSNVKRGDIVGITGFPGKSKKGELSIFPKTFVLLSHCLHMMPRQKSAAAADNANLKRNPWVPGSTRNPETYILKDQETRYRLRHLDLMLNPEVREIFKTRSKIISYIRRFLDDLDFLEVETPMMNMIAGGAAARPFVTHHNDLNMRLFMRIAPELYLKELVVGGLDRVYEIGKQFRNEGIDLTHNPEFTTCEFYMAYKDYNDLMDITEQMLSGMVKELTKGSYKIKYHADGIDKEPIEIDFTPPFRRIDMIDELEKMAGLSIPKDLSSEEANQYLKDVCLKYEIKCPPPETTARLLDKLVGHFLEETCVNPTFIINHPEIMSPLAKWHRSKPGLTERFELFVNKHELCNAYTELNDPVVQRQRFAEQLKDRQSGDDEAMAFDETFCTALEYGLPPTGGWGLGIDRLTMLLTDSQNIKEVLLFPAMKPQD

SEQ ID NO: 170120 - protein, 148 aa, Glycine max
  Coding DNA Sequence Number=SeqID_78435
  Gene Ontology: Mol. function=protein binding; Cellular component =cytoplasm; Biological process=multicellular organismal development
  Homolog annotation: Hit_ID=A9LDB5; Match level="QueryCoverage=100%, HitCoverage=100%, E-value=4e-62, Identity=67%"; Hit description=TFL1
  Pfam annotation: Domain name=PBP; Domain location=20-140; Score =159.6; E_value=8.7e-45; Accession=PF01161.11; Description =Phosphatidylethanolamine-binding protein
MAKMWTDPLFIGRVIGDVLDSFTPTIKMTVTYKKQVYNGHEFFPSTITTRPKVEIGGGDMRSFYTLIMTDPDVPGPSDPYLREHLHWMVTDIPGTTNASFGNVLVSYEMPKPNIGIHSTRKFSAENDLGLPVASVYFNAQRETAARRR

SEQ ID NO: 170121 - protein, 94 aa, Glycine max
  Coding DNA Sequence Number=SeqID_78436
MDYQNEQECGVNEPHVDCSDAFNTSQARSVAHKNGFVAVIMRKKDFVRRDTESRKCECPFKLRGKPVIGGKMLGAPAIVLGAPSNTLKGVMKLA

SEQ ID NO: 170122 - protein, 78 aa, Glycine max
  Coding DNA Sequence Number=SeqID_78437
MIYARLEASSMDGAVGETTILKRLTLEGEIVGVQSMLATMARRARVATVKLYGSLLDTRGLKMAFTRRVDYHVEETHT

SEQ ID NO: 170123 - protein, 68 aa, Glycine max
  Coding DNA Sequence Number=SeqID_78438
MTVRLCDQLIWRKVANTGREGGAMTDSKVVKAKDSVDGSLVVGGCCRWCFGSWRMSLTMCSGRMLRVS

SEQ ID NO: 170124 - protein, 182 aa, Glycine max
  Coding DNA Sequence Number=SeqID_78439
GIAQAERHPPIGKSVEGAGECGLFLILKSNSDLHITRKTIKETVVRFTCQEFQHLVNEWQGKMVLFGNLVQPPIVDANSKTVLHPSRNQLLLLIFYHGEASFLRDYLDGTQPLAVGDKINDSSLQKLGYLLLHYIKNHQVESSLVHPISFDAILPPRALDRRLQEDWVKDAREGPRVLMSLR

SEQ ID NO: 170125 - protein, 257 aa, Glycine max
  Coding DNA Sequence Number=SeqID_78440
MYEYPRRTRALTRRHSFQNSYGYSCFVGKREMAPKKLSTKRSRRDATGEGSSTAPEFDSHRFRSAEHQQRFEAIKGWSFHRERRVHLREDEYADFQEEIARRRWTPLVTPMAKFDPEIVQEFYANAWPTEEGVRDMRSWERGQWIPFDADALSQFLGDPLVFEEGQQCEFSQRRNRVDGFDEEAIAQLLCTPGQDFARTAAGRRVQIMRTIMTTLTQTWMTLLLSNFLPSDHNFDLPLPKCQLVYAILTRMSAHVAQ

SEQ ID NO: 170126 - protein, 233 aa, Glycine max
  Coding DNA Sequence Number=SeqID_78441
  Gene Ontology: Mol. function=motor activity; Cellular component=cell projection
  Homolog annotation: Hit_ID=UPI00006A2D9E; Match level="QueryCoverage =75%, HitCoverage=85%, E-value=1e-18, Identity=18%"; Hit description =UPI00006A2D9E related cluster
MTKDNSKPYTGEMRGILHEPQRASRLHLQRTTPPRHQRATRPRLRRASTPSPSEDYMSSPSEGYTPSPFIGLHALTFRGLHVLTFRRLYALTFRGLHVLAFRGLHVLAFRGQHVLAIRGLHALTFRGLHAIAFVGLHALTFRGLHVLTFRRLHALAFIGLHALTFRGLHVLTFRGLHILAIRGLHALTFRGLHALTFVWLHALTFRGLHVLTFRGLHALAFVGLHTLTLRGLH

SEQ ID NO: 170127 - protein, 114 aa, Glycine max
  Coding DNA Sequence Number=SeqID_78442
MSFGSRLCTTSSSEVKLLSLHPYLAFTLTRLNTIDNRVKEFLHPVYKGFFESLCNPSYTGGVCLLKRLLSKVTNHVLQAISHFYIKWFRLGPTLHVCHFTMPYPRRVILLNPIT

SEQ ID NO: 170128 - protein, 96 aa, Glycine max
  Coding DNA Sequence Number=SeqID_78443
MKLASTTPSKPKDDKGKTIEKQAPKASMQEKTSSIKYFKCLGRGHITSQYPTTKTMIMRGQDIYSNQDEATTSPSSSESEEAKGEESSEEIYPQEE

SEQ ID NO: 170129 - protein, 154 aa, Glycine max
  Coding DNA Sequence Number=SeqID_78444
  Homolog annotation: Hit_ID=A2Q4S5; Match level="QueryCoverage=75%, HitCoverage=20%, E-value=2e-10, Identity=31%"; Hit description=IMP dehydrogenase/GMP reductase, putative
MVDHMYAYSGCETYTNTDVRRNTGQMPLMLIFCIFLGCTLFANKSATHVHVIHLQALRDLTLAGRLMMPVSALIDSLLCWIYEHFPSFAECNADLDYDEVSPRACRWIVTKKTVNKVSTTTNRQHLDRLRIPDVCWMPYAEHRPVQDFHPISCF

SEQ ID NO: 170130 - protein, 95 aa, Glycine max
  Coding DNA Sequence Number=SeqID_78445
GDVLGYKCEVKSHIGSPYVVARGPQVYPSNLPNNWYQSRWFKLVTGSDEYASTAVVARGPQVYPSNLPNNWYQSRWFKLVTDSDEYASTAGGQNG

SEQ ID NO: 170131 - protein, 160 aa, Glycine max
  Coding DNA Sequence Number=SeqID_78446
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=2e-25, Identity=54%"; Hit description =Putative uncharacterized protein
  Subcellular localization annotation: CTP_CleavageSite=24; ConfidenceScore=5.06e-01
MTMITPSSKLTLTKGNKSWIIFVSEAKVGYWISFKVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 170132 - protein, 200 aa, Glycine max
  Coding DNA Sequence Number=SeqID_78447
  Homolog annotation: Hit_ID=Q6UUU1; Match level="QueryCoverage=56%, HitCoverage=95%, E-value=7e-37, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPVSFRCYGRVCLIPRPDTQFRVGSSLPSWTVCTNPPFSPTAAPYPVTIVLSPTRKDMQKHHWQQPL

SEQ ID NO: 170133 - protein, 75 aa, Glycine max
  Coding DNA Sequence Number=SeqID_78448
MMQYVQFQLSLAHQWAKRASTAKRSFSALSEKEESGKALASRPHAKCEISALSAAGVFSQAQRTTNAKPESTYSR

SEQ ID NO: 170134 - protein, 268 aa, Glycine max
  Coding DNA Sequence Number=SeqID_78449
MSKSCEFGMTGPLDESISCFLIRVDPWRTARPQLQRIARPRHQRTTHPRLQRTTRSRHQRATRPRLQRTTRPHLQRASRPRLKRAAHPRLQRTTRLHAFTFRGLHVLAFRGLLSSPSEEYTSSPSEDYTSSPSEDCTSSPPEDYLSSPSEDSTSSPSEGYTPSPSEDYTSPPSEDYTSSPCRATRLHLQRTTRPRLQRTPVLAFRGIHVLAFRGLHVLAFRGLHVLASRGLPVLAFRGLHMLTFRGLHALTFRGLHILTVGGLHALAF

SEQ ID NO: 170135 - protein, 227 aa, Glycine max
  Coding DNA Sequence Number=SeqID_78450
MGVKHLKVINQGPHANNNCPWTKLGYDTDDPVRGSVYTSTNPIFIDVNRSITFTQFIQKINSLLPTRATEKVAVPISFHKGQTRYISAQLQDNDDLRGAMETILHNPQLNSTEFKAVSDLIPQPQPSSPQPSCPQQQLPPPQQLPYNNIDLNNPVSSYNNLETQDPFDIYTSYTQLLSENPSSFDAQQTSFDQQNHPSYPFTPPSQQPQMQTSNQNEHPIANEDPII

SEQ ID NO: 170136 - protein, 62 aa, Glycine max
  Coding DNA Sequence Number=SeqID_78451
MLAIITKYQEEQSLATAHEHRVADEYAQVYVEKEARGREKHHNLTCHKASLSDAILPCKGIG

SEQ ID NO: 170137 - protein, 95 aa, Glycine max
  Coding DNA Sequence Number=SeqID_78452
  Homolog annotation: Hit_ID=A5C693; Match level="QueryCoverage=70%, HitCoverage=30%, E-value=2e-10, Identity=43%"; Hit description =Putative uncharacterized protein
MASLDSLSFKSIFRNRIFQDDDEDQVNLCLMTKSDENNKEESARKKWYIYSGCFKHMTGDVSKFTTIFPKKSGHVTYGDNNIGKISKEVTSKPSL

SEQ ID NO: 170138 - protein, 296 aa, Glycine max
  Coding DNA Sequence Number=SeqID_78453
MAEVSMEAIASLAQYYDQPLRCFTFGDFQLTPVVEEFEEILGCPMGGRKSKDAITKCAPRHPYCTRCKSRTMGDLEEVQEQMKADMSALKEQMGSMMDAMLGMKQQMESNAATAAAISSVAEAYPTLPTVAHHPIPNMVGRERSTPGHISNPRLRYNRGTYPYDLPPNYTPPTILDDAGHVPPLILEGEPPRHPDEVHEDHREHTQGDVDSYSPFPTEGPTPNALPQANITGEPRSHPTQPMFLSVEGPPPAVEGKGKLDLIEERLRAVEGFGNYPFADMTGLCLVPDVVILPKFK

SEQ ID NO: 170139 - protein, 127 aa, Glycine max
  Coding DNA Sequence Number=SeqID_78454
MRTTHGLPCACELSKYVVGCIPLDSFHMFWRRLSFSDQGLSEPEVSIKEETETISKRFEELNVCGAPKKPMNRNPRSTKRDPSYWEYVDAFHSVQNSNSSVRRSASSSDQPNPRKVMPMLDQFQPFM

SEQ ID NO: 170140 - protein, 97 aa, Glycine max
  Coding DNA Sequence Number=SeqID_78455
KTSLSTAIPLELEVIPQVKELLDEGLVRKSLNPCALLVPKIGIMRHQIPMIGGIINMKIKKKVLRKESLEFQEPLDLRSNPFQGGGNDAILPPKDIG

SEQ ID NO: 170141 - protein, 278 aa, Glycine max
  Coding DNA Sequence Number=SeqID_78456
  Gene Ontology: Mol. function=chloramphenicol O-acetyltransferase activity; Biological process=response to antibiotic
  Homolog annotation: Hit_ID=P62577; Match level="QueryCoverage=67%, HitCoverage=86%, E-value=1e-110, Identity=100%"; Hit description =Chloramphenicol acetyltransferase
  Pfam annotation: Domain name=CAT; Domain location=11-201; Score =430.3; E_value=2.7e-126; Accession=PF00302.9; Description =Chloramphenicol acetyltransferase
AKEAKKEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQFIMPFVMASMSAECLMNYNSTAMSGRRGWLLPVVLLHVFPGWTQDDSYRIRRSDKRGHNSGMTPVNRKAGTGERTREPPGGNA

SEQ ID NO: 170142 - protein, 266 aa, Glycine max
  Coding DNA Sequence Number=SeqID_78457
MRGAPTEESLSLFLVGDFGAQSFKVIQRVHKAWKSPLRKDKELRGIRNGIIGGYHEWLKVHTRGLDWLAKLMIVNEENFEAPEEDEEVRALKAELGKMRLAKEKFKLVAIDVRKECVELREENAATARALEQETKRTRKEEHGRDKFRGALWGSNSELKLRREERDQSRAHSMVLKKELAACSSKYQEELNLATAYEHKVADEYAQVYAEKEARGRVIDSLHQEATMWMDRFALTLNGSQELPLTRAKAMADTYSAPEEIYGLLNY

SEQ ID NO: 170143 - protein, 316 aa, Glycine max
  Coding DNA Sequence Number=SeqID_78458
  Gene Ontology: Mol. function=intramolecular oxidoreductase activity, interconverting aldoses and ketoses; Cellular component=cytoplasm; Biological process=carbohydrate metabolic process
  Homolog annotation: Hit_ID=A8GIU3; Match level="QueryCoverage=55%, HitCoverage=61%, E-value=1e-89, Identity=90%"; Hit description =Putative hexulose-6-phosphate isomerase
  Pfam annotation: Domain name=AP_endonuc_2; Domain location=2-173; Score=109.9; E_value=7.7e-30; Accession=PF01261.15; Description=AP endonuclease family 2
  Pfam annotation: Domain name=Aldolase_II; Domain location=176-316; Score=159.9; E_value=6.8e-45; Accession=PF00596.12; Description =Class II Aldolase and Adducin N-terminal domain
  Pfam module annotation: Pfam domain module=AP_endonuc_2::Aldolase_II; Domain location=2-173::176-316
MLETGIRIPSMCLSGHRRFPFGSHDPALRQRAFDVMEQAIQLAQDVGIRTIQLAGYDVYYEEQDEGTLARFSEGMQWAVDRAAAAQVMLAVEIMDTAFMNSIGKWKAWDALLASPWFTVYPDVGNLSAWGNDVPRELELGIDRIAAIHLKDTYPVTATSPGQFRDVPFGEGCVDFVEVLEANLDLPRHKLVTFTWGNVSAVDRERGLVVIKPSGVEYEHMTAEDMVVVDLASGRTVEGAKKPSSDTATHLALYREFADIGGIVHTHSRHATIWAQAGLDIPAWGTTHADYFYGAIPCTRLMTQDEIEHDYELETGK

SEQ ID NO: 170144 - protein, 105 aa, Glycine max
  Coding DNA Sequence Number=SeqID_78459
  Gene Ontology: Mol. function=pseudouridine synthase activity; Biological process=pseudouridine synthesis
  Homolog annotation: Hit_ID=A8GIU5; Match level="QueryCoverage=100%, HitCoverage=45%, E-value=3e-45, Identity=82%"; Hit description =Pseudouridine synthase
MSICALHGKPARSHYRVVERFYREAEGGISLPLTRVQLTPETGRTHQLRIHSRQLGHPILGCDLYGGRLLPGTEQTPRLMLHASELDFVHPISGERIAARHAAPF

SEQ ID NO: 170145 - protein, 325 aa, Glycine max
  Coding DNA Sequence Number=SeqID_78460
  Homolog annotation: Hit_ID=A8GGN5; Match level="QueryCoverage=100%, HitCoverage=100%, E-value=1e-158, Identity=84%"; Hit description =Putative uncharacterized protein
  Pfam annotation: Domain name=DUF1852; Domain location=1-323; Score =778.1; E_value=5.3e-231; Accession=PF08908.2; Description=Domain of unknown function (DUF1852)
MNRDFAFTIKSSSFDEDYNPSESTRITTNFANLARGENRRENLRNTLVMINNRFNSLAHWDNPKADRYSVELEIISVEMRVEDQGASFPVIEILKTNIIDKKTQKRLEGIVGNNFSSYVRDYDFSVLLPAHNKNTAEFNIPDDFGDLHGNIFKHFVNSNAYHENFSKPPVICLSVSSKDTYHRTGNQHPVFGDEYRQDGASLTDRYFKKMGLQVRYFMPKNSVAPLAFYFPGDLLSDYTDLELIGTISTMETFQKIYRPEIYNANSAAGQCYQPSLNNQDYSLTKIVYDREERSQLAIEQGKFTEEQFIKPYKPILEQWSAHYAL

SEQ ID NO: 170146 - protein, 114 aa, Glycine max
  Coding DNA Sequence Number=SeqID_78461
MECLEGVWETLEGNTRCRFRGTIRFTATSLVHLDEPARTLQRTVEWILPTPTPYRLLEPVQVIEVTSSEEDPEEDLEELPLEPAVDALDFLEGDEDPLLEVDPLQCLGKEFSDG

SEQ ID NO: 170147 - protein, 256 aa, Glycine max
  Coding DNA Sequence Number=SeqID_78462
  Pfam annotation: Domain name=Transposase_23; Domain location=37-107; Score=-11.0; E_value=0.019; Accession=PF03017.5; Description =TNP1ENSPM transposase
MQSQGLALPPEPLVGPSGPRVSTKGSYVDPSGNDLETGDSDRCGLYIEADHARLVALGRVYEGSTVVHNTHLLPSQVKVGVEEGTDADAPVPVSTDEVSLVGQALHTFLAWPTHLVKSLSQQVTWDATVFGVFNLDFPLYIKYEDLSEIAHGGQCLSISLLQLWILHLTETSMRAGNSDIYGFLEPQSIQRSGQSQFESESYIKTWMQSSKCDVYLGAYLNGGHWQMVVILPKEHLVVWFCSLHNRPDNYLKGIIN

SEQ ID NO: 170148 - protein, 388 aa, Glycine max
  Coding DNA Sequence Number=SeqID_78463
  Gene Ontology: Mol. function=4 iron, 4 sulfur cluster binding; Cellular component=integral to membrane; Biological process=protein -chromophore linkage
  Homolog annotation: Hit_ID=P56767; Match level="QueryCoverage=100%, HitCoverage=67%, E-value=0.0, Identity=83%"; Hit description =Photosystem I P700 chlorophyll a apoprotein A2
  Pfam annotation: Domain name=PsaA_PsaB; Domain location=1-388; Score =490.1; E_value=2.7e-144; Accession=PF00223.10; Description =Photosystem I psaApsaB protein
WQGNFEAWVQDPLHVRPIAHAIWDPHFGQPAVEAFTRGGALGPVNIAYSGHLVHVAIPGSRGEYVRWNNLLSILPHPEGLGPFFTGQWNLYAQNPDSNSHIFGTPQGAGTAILTLLGGFHPQTQSLWLTDIAHHHLAIAFLFLVAGHMYRTNFGIGHSLALASLGVITSLVAQHMYSLPAYAFIAQDFTTQAALYTHHQYIAGFIMTGAFAHGAIFFIRDYNPEQNEDNVLARMLDHKEAIISHLSWASLFLGFHTLGLYVHNDVMLAFGTPETQILIEPIFAQWIQSAHGKTSYGFDILLSSTNSPAFNAGRSIWLPGWLNAVNENSNSLFLTIGPGDFLVHHAIALGLHTTTLILVKGALDARGSKLMPDKKDFGYSFPCDGPGRG

SEQ ID NO: 170149 - protein, 1020 aa, Glycine max
  Coding DNA Sequence Number=SeqID_78464
  Gene Ontology: Mol. function=serine-type endopeptidase activity; Cellular component=extracellular region; Biological process=negative regulation of catalytic activity
  Homolog annotation: Hit_ID=A7PLM3; Match level="QueryCoverage=72%, HitCoverage=97%, E-value=0.0, Identity=75%"; Hit description =Chromosome chr7 scaffold_20, whole genome shotgun sequence
  Pfam annotation: Domain name=PA; Domain location=360-460; Score =106.4; E_value=8.6e-29; Accession=PF02225.13; Description=PA domain
  Pfam annotation: Domain name=Peptidase_S8; Domain location=116-601; Score=60.8; E_value=4.8e-15; Accession=PF00082.13; Description =Subtilase family
  Pfam annotation: Domain name=Subtilisin_N; Domain location=29-105; Score=71.1; E_value=3.8e-18; Accession=PF05922.7; Description =Subtilisin N-terminal Region
  Pfam module annotation: Pfam domain module=PA::Peptidase _S8::Subtilisin_N; Domain location=360-460::116-601::29-105
MSSFRKPFVAILWVVLFLGLHEAAEPEKSTYIVHVAKSEMPESFEHHALWYESSLKTVSDSAEIMYTYDNAIHGYATRLTAEEARLLETQAGILAVLPETRYELHTTRTPMFLGLDKSADMFPESSSGSDVIIGVLDTGVWPESKSFDDTGLGPVPSTWKGACETGTNFTASNCNRKLIGARFFSKGVEAILGPINETEESRSARDDDGHGTHTASTAAGSVVSDASLFGYASGTARGMATRARVAAYKVCWKGGCFSSDILAAIERAILDNVNVLSLSLGGGMSDYYRDSVAIGAFSAMENGILVSCSAGNAGPSPYSLSNVAPWITTVGAGTLDRDFPAYVALGNGLNFSGVSLYRGNAVPDSPLPFVYAGNVSNGAMNGNLCITGTLSPEKVAGKIVLCDRGLTARVQKGSVVKSAGALGMVLSNTAANGEELVADAHLLPATAVGQKAGDAIKKYLFSDAKPTVKILFEGTKLGIQPSPVVAAFSSRGPNSITPQILKPDLIAPGVNILAGWSKAVGPTGLPVDNRRVDFNIISGTSMSCPHVSGLAALIKSAHPDWSPAAVRSALMTTAYTVYKTGEKLQDSATGKPSTPFDHGSGHVDPVAALNPGLVYDLTVDDYLGFLCALNYSASEINTLAKRKFQCDAGKQYSVTDLNYPSFAVLFESGGVVKHTRTLTNVGPAGTYKASVTSDMASVKISVEPQVLSFKENEKKSFTVTFSSSGSPQQRVNAFGRVEWSDGKHVVDIDDSGDLVLDWCWFCLFPGRNVAKGKKCLAHVFLFFPDEDQRTLKKSSRKRKTLSSSNTDDKKATKTKSDDRVKFPPRSPKFQQPLKSTSSQPSKSKVSKGLDDYDEDMPTNSSFKLTSFAKTKRKDSDIHVSTTDASNVEASEDLEEQEDAQSHGESSPIEISVTLRANEEGLGFIDPVDVFVSILVVKTNEPLIDQTIVKESPIVDVGNPQGETDPLDVDPLSFIDVWLVFDQPLKDSLSNPDYKPQLQYVRAKGALSRSADTSSLLKRSL

SEQ ID NO: 170150 - protein, 249 aa, Glycine max
  Coding DNA Sequence Number=SeqID_78465
  Gene Ontology: Mol. function=catalytic activity; Biological process =cellular metabolic process
  Homolog annotation: Hit_ID=O64438; Match level="QueryCoverage=51%, HitCoverage=38%, E-value=2e-27, Identity=54%"; Hit description=ARG10
  Pfam annotation: Domain name=RNA_pol_III_C17; Domain location=5-114; Score=54.5; E_value=3.7e-13; Accession=PF09417.1; Description=RNA polymerase III subunit C17
LCHSLEGNVGALTNFEVLDFLRAKGASKDPTRVITKVAQSEYKVYDYLVNTPASIQTRESINEFLTSVKQYDLAKVEVLNILNIEPVADFELYPVIYYQTVFDKSTSTLFVASDQAGKVPLFWGITTDGYVAFADDVDLLKGSCAYHNPQHFGNYLFQVIPDWIISSLPFKMMIIHNMRIFTLTLSMFCFFFVPRNSVGGLRCNENPKNKITKIPVEEEEIWGAFFKVILELKKLELNIHYVTRIASCN

SEQ ID NO: 170151 - protein, 77 aa, Glycine max
  Coding DNA Sequence Number=SeqID_78466
MVVVKTPISSSVNDEDMTKSKGKDPLEGLGGPMTRARARKAKEALQQVLSILFEYKPKFQGEKSKVVSCIMAQMEED

SEQ ID NO: 170152 - protein, 88 aa, Glycine max
  Coding DNA Sequence Number=SeqID_78467
MPSEAAKKARTWVMKWRSPSLRVAQWQRSCDRIIKQGCIQDYFNKHLKLKHCFKINTRLLQQTSIASRLIQDQTLSQNKVFSRHPRLW

SEQ ID NO: 170153 - protein, 78 aa, Glycine max
  Coding DNA Sequence Number=SeqID_78468
  Subcellular localization annotation: CTP_CleavageSite=29; ConfidenceScore=5.14e-01
MKQGSANNQQVLFLSTMNLCMASFCMLVRVGVLGSFGQEWLCANGLTRLVMIASASNEPNYTADPDDDSEDDPEPKCD

SEQ ID NO: 170154 - protein, 73 aa, Glycine max
  Coding DNA Sequence Number=SeqID_78469
  Gene Ontology: Biological process=regulation of transcription
  Homolog annotation: Hit_ID=A5ANJ0; Match level="QueryCoverage=98%, HitCoverage=15%, E-value=7e-28, Identity=76%"; Hit description =Putative uncharacterized protein
VQRVERVEPKNRWEQRMKNASFQGVAFSEDSVAEVKAMLDEHAAGWGLKKEDEHIVLTWKGHNVVFASAWLPA

SEQ ID NO: 170155 - protein, 300 aa, Glycine max
  Coding DNA Sequence Number=SeqID_78470
  Gene Ontology: Mol. function=amine oxidase activity; Cellular component=cytoplasm; Biological process=amine metabolic process
  Homolog annotation: Hit_ID=A7QXZ7; Match level="QueryCoverage=73%, HitCoverage=45%, E-value=2e-38, Identity=57%"; Hit description =Chromosome undetermined scaffold_235, whole genome shotgun sequence
  Pfam annotation: Domain name=Cu_amine_oxid; Domain location=48-271; Score=-199.6; E_value=3.8e-06; Accession=PF01179.11; Description =Copper amine oxidase, enzyme domain
  Pfam annotation: Domain name=Cu_amine_oxidN3; Domain location=4-103; Score=0.2; E_value=0.0054; Accession=PF02728.7; Description=Copper amine oxidase, N3 domain
  Pfam module annotation: Pfam domain module=Cu_amine_oxid::Cu_amine _oxidN3; Domain location=48-271::4-103
MEGCSVRVEVVCDALHEHQVLLGFDLAALASDLDFRGTSEADAPRKRLAKPLIFCQTESDCPMENGYAQPVEGIHVLVDMQNTMGCDCLGYIKYFDAYFKNFTGGGETIENYVCLHEKDHEMLWKHQDWRTGLAEVQRSRRLTISFICKVANYEYGFFWHFNQASRVHTKRRNHLHQKKMNDLVYVMYNLKLKSGQIRKLVLELPFEDMESSDEWITGNGDDIFYEDNVQVEQPLGESGSGNNIDLIGESLSDTTLDAFDIDNLVLNDNVEDHFSTKEELEDDGGGGDIGDDLIRGLINI

SEQ ID NO: 170156 - protein, 299 aa, Glycine max
  Coding DNA Sequence Number=SeqID_78471
  Gene Ontology: Mol. function=DNA binding; Cellular component=nucleus; Biological process=regulation of transcription
  Homolog annotation: Hit_ID=A5BJQ5; Match level="QueryCoverage=66%, HitCoverage=49%, E-value=3e-66, Identity=58%"; Hit description =Putative uncharacterized protein
  Pfam annotation: Domain name=NAM; Domain location=2-89; Score=-14.4; E_value=3.9e-06; Accession=PF02365.6; Description=No apical meristem (NAM) protein
MEAKNMKSHPLIDEFIPAIEGEDGICYTHPEKLLGVTRDGLSKHFFHGPSKAYTTGTRKRRKIQNECDLQGGETLWHKPVMVMHQYHLGQHEEEKGEVMVSKIFYQTQPRQCNWSNKSAITSEGSGEPNNNSTGRRDSGSRSCSSKEIVTHRYEMSVVVGVPPMTSFTTHHPLDIQQLKLDHFSFIPFKKTFDEISSGNNNNTLDRFNNSITSFDMMGMGYFPFQHLNYGPNMGLTITPNNTPLCFIPSSTSSQMMSELNFTMFHSMFPTHVKPTVSLHSNNNNNNNNPSSISSDDVQN

SEQ ID NO: 170157 - protein, 480 aa, Glycine max
  Coding DNA Sequence Number=SeqID_78472
  Gene Ontology: Mol. function=transferase activity, transferring nitrogenous groups; Cellular component=cytoplasm; Biological process= biosynthetic process
  Homolog annotation: Hit_ID=Q41688; Match level="QueryCoverage=100%, HitCoverage=100%, E-value=0.0, Identity=87%"; Hit description=1 -aminocyclopropane-1-carboxylic acid synthase
  Pfam annotation: Domain name=Aminotran_1_2; Domain location=40-427; Score=443.9; E_value=2.3e-130; Accession=PF00155.12; Description =Aminotransferase class I and II
MRLLSTKATCNSHGQDSSYFLGWQEYEKNPYDKVHNPKGIIQMGLAENQLSFDLLESWLAKNLDVAGFKRDGKTIFRELALFQDYHGLPSFKKALVDFMAEIRGNKVTFDPNHIVLTAGATSANETLMFCLAEQGEAFLLPTPYYPGFDRDLKWRTGVEIVPIQCNSSNSFQITEAALRQAYEDAKKRNLRVKGVLVTNPSNPLGTTMSRSELNLLVDFIKEKNDMHLISDEIYSGTVFSSPGFVSVMEVLKERNDVVTDNGVWNRVHVVYSLSKDLGLPGFRVGAIYSENDTVVAAATKMSSFGLVSSQTQYLLSAMLGDKKFTRNYIAENKKRLKRQQRMLVSGLLKTGISCLDSNAGLFCWVDMRQLLHSNTFKAEMELWKKIVYQVGLNISPGSSCHCTEPGWFRVCFANMSEETLALAMKRLKNFVAAESQRNSSSGCSAGALLNNNNGSFKRKSLTKWVFRLSSRDHHREQEER

SEQ ID NO: 170158 - protein, 299 aa, Glycine max
  Coding DNA Sequence Number=SeqID_78473
  Gene Ontology: Mol. function=molecular_function; Cellular component =membrane; Biological process=auxin mediated signaling pathway
  Homolog annotation: Hit_ID=A7PTC6; Match level="QueryCoverage=57%, HitCoverage=53%, E-value=3e-49, Identity=52%"; Hit description =Chromosome chr8 scaffold_29, whole genome shotgun sequence
MEKLNVRKVRCQPKVIGTVVTVVGAMLMTLYKGQVISFFGSKYMHHPTNYVPKNNTDSCEKDWFKGSVLLVLATLSWASSSFRQAATLRKYPAQLSLTALVCALGITYYVQGIVMQKKGPVFVTAFSPLMMIIVAIMGAFILAKKIYLGGVIRAIAIVMGLHSFSGNAQEWKMHWLNSKKLTTSKKKGGLGFHMSMAFNQHLLAKQWLTKAIVLAALGQVFTRPKVLWTMLDQPTWKYAKDGRYMVKSGYYRAMVGLTNEENSTIKKNLKAKIESFDPTCPFCGKEEEMVEHEFLFRKE

SEQ ID NO: 170159 - protein, 266 aa, Glycine max
  Coding DNA Sequence Number=SeqID_78474
MILDASTGGTMMSKSPEEAIIGQLPQQCHQGGPQKTHQAHQVQQILRCDFCGDNHQNGHCSTLGDGKQEEKAHYLQNQARPQQNFQGSYQGYRGGSGSNQPYGRRPQNSSPTNTSCAGPSNNSYGGSSSRGPQQHQAQPDRMSKMEDTLTQFMQVSISNQKNTNASIKNLEVWVGELTKQLSEHGSGSFLANTQDNDEKKNKEGVEKENKKNDEVVTSGKVEEKVITISFFEALEQMPTYAKFMKDLLTKKKRIMDDEIVNPQPQQ

SEQ ID NO: 170160 - protein, 58 aa, Glycine max
  Coding DNA Sequence Number=SeqID_78475
MSITDRQKHLSGWRGKQVNVQRDGLRLSIFWILYPNDAKPQAVHSTEAMEPHRGAHQV

SEQ ID NO: 170161 - protein, 421 aa, Glycine max
  Coding DNA Sequence Number=SeqID_78476
  Gene Ontology: Mol. function=nucleoside-triphosphatase activity; Cellular component=nucleus; Biological process=ribosome biogenesis and assembly
  Homolog annotation: Hit_ID=A7QHJ9; Match level="QueryCoverage=31%, HitCoverage=11%, E-value=6e-33, Identity=60%"; Hit description =Chromosome chr5 scaffold_98, whole genome shotgun sequence
  Pfam annotation: Domain name=MMR_HSR1; Domain location=40-146; Score=- 16.0; E_value=0.031; Accession=PF01926.14; Description=GTPase of unknown function
MGVVMEHGEWKVQHLQLINSEKRRLHAPIIDRSYDGPAPYVVVVQGPPQVGKSLLIKSLVKHYTKHNFPDGSKGGCSLQFVECPNDINGMIDAAKFADLTLLLIDGSYGFEMDAIFEILLHLQETFEFLNILQVHGLPRVMNDKIEALDKYQPGTGSDEDEDAPNSTAKNGVHLQEHIDFHDGRWRRRAIFGNDCVDSEGDEDGATSDDDIESSEEEEEDGNDNHDTNGVSFFVRVVAMEEAVLVLAFVGKLRRHLLLLVVAMVLVLLVSSFASPLSDEEKQEFLLHSCMWVSVRITFGYAGGLKIQDGLLYGWYLCRLFQLNELFLMESQKARIYHYYVPVFLWCEQQITEHQSKFKDGEDIPPLVDVSSKAIINRAELSYNYRTSSGSDMTLSSSDDRVQDVAELLDMMVEDIPFSGIC

SEQ ID NO: 170162 - protein, 98 aa, Glycine max
  Coding DNA Sequence Number=SeqID_78477
MESNPWNIDRRLVVLAKMQNNRNQKRYNCLCAPFGSKKIAKIIPRWDEGGEDKFGKAMTSGSYIYVFKPLNNALPLKSSSSMSGLVTFSMRVGASPKL

SEQ ID NO: 170163 - protein, 146 aa, Glycine max
  Coding DNA Sequence Number=SeqID_78478
  Gene Ontology: Mol. function=oxidoreductase activity; Cellular component=chloroplast
  Homolog annotation: Hit_ID=A9PEL1; Match level="QueryCoverage=25%, HitCoverage=13%, E-value=4e-15, Identity=97%"; Hit description =Putative uncharacterized protein
MATELGQQTVEGGCSPRDSVVDSCQTIRGMIMLAFCLLAQNIGSSDKEKSFPHFDDLVLVYGKKKGTRMQMLKNLGDAVEEMNEYESSKESKTTWVTSLAASGMENKSKALQYVQENPDEVCPAGWKPGEKSMKPDPKLSKDYFAG

SEQ ID NO: 170164 - protein, 129 aa, Glycine max
  Coding DNA Sequence Number=SeqID_78479
  Gene Ontology: Mol. function=aspartic-type endopeptidase activity; Biological process=RNA-dependent DNA replication
  Homolog annotation: Hit_ID=Q69F85; Match level="QueryCoverage=60%, HitCoverage=4%, E-value=1e-10, Identity=43%"; Hit description=Gag -pol polyprotein
  Pfam annotation: Domain name=Retrotrans_gag; Domain location=47-126; Score=3.8; E_value=0.023; Accession=PF03732.8; Description =Retrotransposon gag protein
MVANNNDTNAIIQGNRPREQESTVKGYLPWVPLKKGAKQMWVQHYIGIFDCRKNSIDSFAMLIMNFRAQNATSRPHHLTVVAFANIRKEKEESLHDFMERFSSVSIRIRNLNLEVTLTSMIMALKSGPI

SEQ ID NO: 170165 - protein, 117 aa, Glycine max
  Coding DNA Sequence Number=SeqID_78480
MMPKYLKLLKDLITKKKSLKDYGVVTLERDCNAILENPNKLEECILQVDDEEITFDVREAMKHPKGKRVCFKVDITDEVIEEQTPQIIIPTPLELALTNIMEDLTLEYNEELGGCIH

SEQ ID NO: 170166 - protein, 55 aa, Glycine max
  Coding DNA Sequence Number=SeqID_78481
MVCRQDKSKEYANCESSIVMKDARIIIGQPELFTFALPSSESESGLYDIKDAYAV

SEQ ID NO: 170167 - protein, 69 aa, Glycine max
  Coding DNA Sequence Number=SeqID_78482
  Subcellular localization annotation: CTP_CleavageSite=40; ConfidenceScore=5.05e-01
TEAQPNLRQTRTHAEGETRPGSTLSRTLSFPTFLRPVKVSKFMEAQETLTQGERRRTIGFKRKEKEEER

SEQ ID NO: 170168 - protein, 68 aa, Glycine max
  Coding DNA Sequence Number=SeqID_78483
MTRSRVKLLQEEMTKRIKDGLLIKGKEGENHKELNWSRSSRMVVLEFASGTIRTKRPWLGLHLVVVRA

SEQ ID NO: 170169 - protein, 212 aa, Glycine max
  Coding DNA Sequence Number=SeqID_78484
MALSGFWDKRRKEDREVKEASMSPLTSTTELPTPHSHPKWGEHISQRENCEPEWKAQLGHELQLNEVMSAPAIYKEHYVVAGNSGDETKVQTGYKRGVRYGYGVTVFSEKEEYPRGTLVSSMVFLITVEAKTSFPAKGNLVREGEGKEGGQGERRGGAEKKGAEGGRGRLDNPNRATRGGRALESTRKATIANGERLRDYVEVRDELFTLED

SEQ ID NO: 170170 - protein, 77 aa, Glycine max
  Coding DNA Sequence Number=SeqID_78485
MWYHFSVKNLVGRLGVHDRTCLTMGLQEHSNRMTPKAYTPKSPSGPLPPDSVRLKWLTRRVPTVDLITTHRALTRRP

SEQ ID NO: 170171 - protein, 179 aa, Glycine max
  Coding DNA Sequence Number=SeqID_78486
MVEIPVMVAVAITIVVVVKVALVVVVKVALVVMTINDIGGISGGGGSNVGGDGGMVVAMTIIVMEVVLLLLMVVVIVMLTMVVAMLMVMMVVAPSGSNVVIVVVVAITLAVVVVATVVVAMPVMMMMLVAMMVIMVVATSCDGDNDSDSDNNGGDIGIGNGDRGGGSSDGSSKKCHCQI

SEQ ID NO: 170172 - protein, 133 aa, Glycine max
  Coding DNA Sequence Number=SeqID_78487
MVQPVIIVQPRQDEIQNPFWNDVFHYNNINWSHPDEEDICGLERPSTFNVGQKLYVGMDFDSKDALKNALKQYVMKVHQCFKVPETKSHKYIVCCPNKSAKCPCPFYMRAILSKKTDSLESDTMALDYTHVRL

SEQ ID NO: 170173 - protein, 343 aa, Glycine max
  Coding DNA Sequence Number=SeqID_78488
VHLLGLLTENKRGYISCGSVLVEGTSTRLFKENKGGYIPCGSLLVKEFYKVEKKSQGPQVAWGLDVATGTDSAIGKSDYQLKYSVAPLAGYKYHPSMPSIQPVAYAACIQILIPPLGEAITNQKILVAGIVGLEFLLIDTSSRIGVFHRAEGAGIQRSVVRVHACCMLCSFCRVSACIQVLIPPLGKGITNQKISDAGTGGIHMPSIPAIHLANEPCNMHPGCTDSAWAWFVLIDTASRTNVFQKAEGAWIQRSVAGVPACCMLCSFFRVSDTHAIHPANDPCSMHLGTDSAIGKSDYQPKDSAAGTGGIHMSSIHAIHPANDPCSMHPGCTDSASEPGVFAH

SEQ ID NO: 170174 - protein, 448 aa, Glycine max
  Coding DNA Sequence Number=SeqID_78489
MTLGGGVLPLVLAEYTSTDSAIGKNDYQPKDSGCWHWRDTHAIHLANDPCSMHPGFKYRVRVAEHTCTDSAIGKSDYQPKDSAAGTGGIHMPSIQSMIHATCIQVALIPPVGLTFLLIDTASRTGVFQRAEGVGIQRSVAGRVRVAEHTCTDSAIGKSDYQPKDSAVGIGGIHMSSIQPLTHATCIQVALIPPVGLTFLLIDTASRTGVFQRQEGARIQRRVAGVHACCMLCNLCRVSGTDSAIGKSDYQPNDFAAGTGGIHMPSIQPMTHAASIQVALIPPVGLTFLLIHTASGTSVFQRAEGAGIQRKHTCTNSVIGKSDYQPKDSSVGTGGIHMRSIQPISHAACTQVLIPPLGKAITNLKIPAGGTGGIHMPSIQPMTHVACIQVLIPPLGKVITNLKILLLALAGYTCHPSSQGAMQHASRYRVRVAEHPCIDSAIGKSDYQP

SEQ ID NO: 170175 - protein, 50 aa, Glycine max
  Coding DNA Sequence Number=SeqID_78490
MIYLSCPLMLDHRMSMLKLWLKAQVEKDEGPSGEGQSPRVEKDEGPSGEG

SEQ ID NO: 170176 - protein, 91 aa, Glycine max
  Coding DNA Sequence Number=SeqID_78491
MMTCIKTNSFHFLQELESEVGLDGVDRSEEMKEKRRDLALKNLRQARRGRRRELRDDDTWVWSHQKKEKRVMGSELRGLHERMERMRERVR

SEQ ID NO: 170177 - protein, 201 aa, Glycine max
  Coding DNA Sequence Number=SeqID_78492
  Gene Ontology: Mol. function=transferase activity; Cellular component= integral to membrane; Biological process=glycolysis
  Homolog annotation: Hit_ID=A7QZG5; Match level="QueryCoverage=85%, HitCoverage=35%, E-value=2e-47, Identity=56%"; Hit description =Chromosome chr7 scaffold_275, whole genome shotgun sequence
  Pfam annotation: Domain name=Hexokinase_1; Domain location=30-201; Score=-47.8; E_value=2.2e-07; Accession=PF00349.12; Description =Hexokinase
MRKNVVVAVSTTLAVVVVGALIRRWKQWKEQQLRKTNQIIRKFASECATPVTKLWQVADDLVSSMKISLVSSHETTTLNMVISNVTSLPLGDEEGFFYGVNLQGKHLLMLCARLGGKNKPISALQREEISIPDAVLAGASEEIIDYVATEIAKFVSSHPEIDDGAPAKKKKLGFTLSYPVDEILPFAATTFQRKSANNPVE

SEQ ID NO: 170178 - protein, 42 aa, Glycine max
  Coding DNA Sequence Number=SeqID_78493
LQTQVEKDKAPKWRRMKAQVEKDEGPEAETLSKLLIVAEDPD

SEQ ID NO: 170179 - protein, 84 aa, Glycine max
  Coding DNA Sequence Number=SeqID_78494
  Subcellular localization annotation: CTP_CleavageSite=30; ConfidenceScore=5.12e-01
MYPLLFSVTTIQVDVPSTCTTKDVPSNVLRQSSQMGRIKRILRLCLFEFFDKGEGRHKRIQAVSPSFFWKREKRDTKRIQTVSP

SEQ ID NO: 170180 - protein, 93 aa, Glycine max
  Coding DNA Sequence Number=SeqID_78495
MKVHCTDQTTSRRTHSGHGACEMPFYRYLQASSRFGGTLVEGQALKTNRLPLIHRVTHQWISIGSNIDGFRVGYQVYGGIGGVGWWEGHWCVE

SEQ ID NO: 170181 - protein, 46 aa, Glycine max
  Coding DNA Sequence Number=SeqID_78496
MFEEINMNGDNEKEPSVCYLDDVLHRARSVVYDTDFVVVIMRSDTY

SEQ ID NO: 170182 - protein, 226 aa, Glycine max
  Coding DNA Sequence Number=SeqID_78497
  Gene Ontology: Mol. function=hydrolase activity; Cellular component =cytoplasm; Biological process=mRNA catabolic process, nonsense -mediated decay
  Homolog annotation: Hit_ID=A7PCF0; Match level="QueryCoverage=40%, HitCoverage=6%, E-value=4e-31, Identity=79%"; Hit description =Chromosome chr2 scaffold_11, whole genome shotgun sequence
MSWNFTDCATMPSFDFRHVTEHHELPNDGCQVPRSGQRVIGEPAASGLVLDESWLWHLDFETSTKLVPLLGNEDMIRPQLRTEATNVAKIVTTFLKSGVVPSQIGVITPYEGQKTYIVNYMSRNGVSRQQLYKEIELLHEFYSFPVASVDSFIGREKYYIILSCVRSNVHQGKTIGVNVEDDDSYMDTYVSPLTAQITRNVVGEEEADDVHSNRNDHDEGELINIV

SEQ ID NO: 170183 - protein, 205 aa, Glycine max
  Coding DNA Sequence Number=SeqID_78498
  Homolog annotation: Hit_ID=A7PFT8; Match level="QueryCoverage=17%, HitCoverage=11%, E-value=9e-08, Identity=85%"; Hit description =Chromosome chr6 scaffold_15, whole genome shotgun sequence
  Subcellular localization annotation: CTP_CleavageSite=46; ConfidenceScore=5.31e-01
MTLKQEIKDGSLLGISPSALKKKNLVSLFVQHQWLPHVAAISRPKCASSRFSTRFFVAIPHPQTNNSEGFLEKSVEVSEKLDNNNNISNHEEPSVVVPVRRLSCGTVEMCHSFVETVVNHNEVSCGRFVPRAMLMDLEPRTMDSVDMSETRNELQETIRVTKDAKNDAAAGEATPCAIHLADFVNTPLYVVHVMSIDVMEEIAKA

SEQ ID NO: 170184 - protein, 226 aa, Glycine max
  Coding DNA Sequence Number=SeqID_78499
MASCKRKALASVSQARYDRSRFLSQNVWDCYANNVLGWKVLPERNVKLYITKFDEFKREIERRNWHKELTNFFEGSIDMALVKEFYANLYDLEDKSPKQVKVRGHLIKFDDDALNTFLKTPVAIEEGESLPSYSRFYITLDRAKLIYGHVIQMNMNLGSLISAPPTSSPSTSPLPPPPIAPVLLGPSAQSSKLRAFLVYAAEPASGPALDHAEFVGCCPTTASYER

SEQ ID NO: 170185 - protein, 52 aa, Glycine max
  Coding DNA Sequence Number=SeqID_78500
MTTTVTTIKDDGDEDNLNDGGVLFGGLGKHEKENLIHQNRKRKLRCTTTIVD

SEQ ID NO: 170186 - protein, 240 aa, Glycine max
  Coding DNA Sequence Number=SeqID_78501
  Homolog annotation: Hit_ID=Q69F85; Match level="QueryCoverage=49%, HitCoverage=8%, E-value=5e-08, Identity=27%"; Hit description=Gag -pol polyprotein
  Pfam annotation: Domain name=Retrotrans_gag; Domain location=71-153; Score=5.4; E_value=0.016; Accession=PF03732.8; Description =Retrotransposon gag protein
MERRHEEGLRKLKADHDQLEARNTADDLSPSYKHYPAKWTDRRHAFIDHIMEADIPLCWKPLNLEQYGGTTGTTLTWYGGLPPKSLDSFDPFVKQFSAQYATRRCHFMTSTALASLRQADDESLKKFMDRFGSMTIQIQNLNLEKRDKHEANTKADLQKSNKRHKSDKRQPLSKGPRYERYTPLTTNRTIIHEEAFNLEGPLFGGMQRSLNRLKAVPSGGSNPARLGELGGNHLPIFSYK

SEQ ID NO: 170187 - protein, 142 aa, Glycine max
  Coding DNA Sequence Number=SeqID_78502
MEKSNRALGFPALITGLCQSYRVPVTPSKDAGTPSPPWQAVGSLGVERYLQHLVRQQAANHRGQVQIHECLYRFSLSQQGQGSVPFVCLTPEQFGAEVTWPGDWPDAQAGEEPAESPGEADESRMDEDMTDLLNFLGGSEAT

SEQ ID NO: 170188 - protein, 81 aa, Glycine max
  Coding DNA Sequence Number=SeqID_78503
  Subcellular localization annotation: CTP_CleavageSite=68; ConfidenceScore=5.35e-01
MRVHCYQASRRPSMTTDSPPLLMFPWTRSPVESPTVATYPSVGGQRGAHGCVFQGRKARGVTTNVYSRKMSEKQERVVYEL

SEQ ID NO: 170189 - protein, 77 aa, Glycine max
  Coding DNA Sequence Number=SeqID_78504
MGTEVGASEADIMARDQPRREAKKWLHSFKGNSLKTWDEVVENLLKKYFLESKTAEGKVAISSFHQFSDESLSEALD

SEQ ID NO: 170190 - protein, 414 aa, Glycine max
  Coding DNA Sequence Number=SeqID_78505
MTEDIFVFEMCVDYRIGRLRMLSNLIVSDDKRDFDSLRIGRVWATICCLHASSDLSSLDDEGADNYEVSPHAIGPSSHDSRIETFLRSRPEDVDISGKGADDHIGLCVSMRSLASELRLFRGLDWKTLTSPGRVQMTILVSACQQARLPLVNKGADSHKVCPCATEPLGHDSRIETFSRSQPKDADISGKGADNHEVSPHGIRPSSHDSRIETFSRSRPEDVDIFGKGADNQEVSPHAIGPSSHDSRIETFLRSRLGDADISGNGADDHIGLCVSTSSLASGCQKVRITIRCVRMSPDSHRTVCVRITVGYILLPPNSWVRINRCCVCTDNHLGYFRLPPDAWSGLTDVVFVWITTRVSLPATELHGSGLIDVVFVWITTRVSLPAPGLHGSGLTDVFVRIITRGISACHLTSR

SEQ ID NO: 170191 - protein, 68 aa, Glycine max
  Coding DNA Sequence Number=SeqID_78506
MEFMVPTPIVDVPPVARYKLNIRRPKQKNISDTSTVDAPVVDGPPTAPLLFMPTPRFTRRKAANKDLV

SEQ ID NO: 170192 - protein, 241 aa, Glycine max
  Coding DNA Sequence Number=SeqID_78507
  Gene Ontology: Mol. function=endonuclease activity
  Homolog annotation: Hit_ID=Q2HUP4; Match level="QueryCoverage=38%, HitCoverage=31%, E-value=3e-25, Identity=64%"; Hit description =Endonuclease/exonuclease/phosphatase
  Pfam annotation: Domain name=Exo_endo_phos; Domain location=5-235; Score=-0.0; E_value=0.0032; Accession=PF03372.14; Description =EndonucleaseExonucleasephosphatase family
MESLLKSIKVNFRNLYYRGQEKKERCGLHDYIQQRPRTLLIAANITINFFNFLKRVTRKRSRNGVGIIVDKEWKKDVVDVRRVGNRIIALKLVVGQDTFNVISGYAPQVGLAEHFKVKFWEDLEGVLQDIPQGEKVFLGGDLNGHVGSVARGFEGVHGGFGLGEMNGEGKSILEFSEALDLSIANTWFKKREEHLITYKSGGTCSQIDFFLIRKSDRKYCLNCKVIPGESLTTQHRVLVMD

SEQ ID NO: 170193 - protein, 100 aa, Glycine max
  Coding DNA Sequence Number=SeqID_78508
MKNIPNNMGGEVYFWEMRMIRIANSRKSEKLRWNLRRNNKSKKIVSLDNWLDLLMPQQKILIIELFRDLMRKLNSSGGHSHPHPLSLAKDSQMLAIIDND

SEQ ID NO: 170194 - protein, 667 aa, Glycine max
  Coding DNA Sequence Number=SeqID_78509
  Homolog annotation: Hit_ID=Q2HVW1; Match level="QueryCoverage=19%, HitCoverage=53%, E-value=3e-07, Identity=29%"; Hit description =Putative uncharacterized protein
  Pfam annotation: Domain name=RRM_1; Domain location=81-146; Score =29.0; E_value=1.8e-05; Accession=PF00076.13; Description=RNA recognition motif. (a.k.a. RRM, RB
MDEAIFLCWSWFRNLEKGEGSIHRTWVAYSLTISRKTTKDTKKILIADKQTLNLEARGNSTRCHLNWRNKDNITSYYFTHFPDEANEELLWKYFKKWGDVREVYIVKRRNREGRRYGFVRFKGVSDAKGLEVKLDNIFINDYKLFVNLPRFTRTAWTEELQQKTIVGRNPFKVPCKPCEVTTGPFRRSYAEVTTKGELPGDRTRGEVLTPTISITPNEGRGYWCNEAWVGKLKKVMAVETLEDRIAWDLGYNIRTIFLGDDMILLTGLSDEKAQLIIQMEMESGNSLFYSLEKWRPGCRPNNWVVWLQVWGFPIEVWEVDHLKKAVSTISDVIELDDDIEDRCRLDRARLLVRTPLPPSIRRDVIVRVGEIEYRVWIVEEIGVDGGSNQKGSSTSDVWSEEITSDDGGDVGDVDDNSDTNFSFSPELSNNKPRSPNIQRSEGGTNGCYRETRPLGKTQSDEIHRDKSKDIEEGTQGLDMAKFDLGESKAETKKVKAFIKEAACYKTQAAARKQSSQQEGNNLNGGDKVPFDQPYNGEAEGDTRRVEPHSDLHPVQPQEDVGPSHNMGPLWKNKGCNKEELFPVAQSSKETPDKYSKVYVRQRHLQYKARLLQPVEDQSQLQEGDNDMAAMIDNRDKAQNQGHFGAERRLKKSKIECNTEVLEEAQQL

SEQ ID NO: 170195 - protein, 350 aa, Glycine max
  Coding DNA Sequence Number=SeqID_78510
MFDRVKDEISWDEGVDISPKYLGDDMVLLLSLTDARAEQMGKEETMNGSSLFHSLEKWNSRMRIGYRLIWVQCLGILLLAWDMVQIQKIVAAIGEMVEVDDDVEEAQRLDRARRKRMGPAPENAIVDLGVSLGHQRKSIPRRGNILMPNSQNEQDRPQGKNPCLWTHCPTQNRCRTEGMGEKETKHRTPRRGSKMTKVEEGKRKVNMEGRVQCFHESGNDDFEVGQKLSGKQNLNEKGSSDTQEADGKFRTLLGWCKKQLDLGNVNKKGLTKDTKSSTQNNGHQQHSDDPGKDESLSLEIRDNGQKEVNTWVDPNLVQNEIEVVTPANNSDINVQLEEATSYWTMAKDLG

SEQ ID NO: 170196 - protein, 87 aa, Glycine max
  Coding DNA Sequence Number=SeqID_78511
MGAHEKACFWVLRLMRIMKLAKYRLKAQVEKEEGLSGEGQSPRVEKDEGPSNPCGVYPDLSSFTGSGVIQNLRSLYQTIRSYSGSHH

SEQ ID NO: 170197 - protein, 109 aa, Glycine max
  Coding DNA Sequence Number=SeqID_78512
MTRGNPGNLQLFDPEIDITFHRLVRHSVHPDHFVHFEHSEYFVASDPEYSDFEHSTANFYTENMTQPPPRERTLREMVAPDFTYESLCIQYPDEGVPYVLKTGLIHLLP

SEQ ID NO: 170198 - protein, 222 aa, Glycine max
  Coding DNA Sequence Number=SeqID_78513
  Gene Ontology: Mol. function=protein kinase activity; Cellular component=protein kinase CK2 complex; Biological process=protein amino acid phosphorylation
  Homolog annotation: Hit_ID=Q94F17; Match level="QueryCoverage=64%, HitCoverage=77%, E-value=7e-76, Identity=94%"; Hit description =Casein kinase II alpha subunit
  Pfam annotation: Domain name=Pkinase; Domain location=2-208; Score= -45.4; E_value=6.7e-06; Accession=PF00069.16; Description=Protein kinase domain
MKVAKEINCDGCGSDSGSSNESCNGGGFGGNCIRNSGGWTSGGDVPAKQFKGILSVLGIAEDIKNITMSHLLPCMRTVRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMAHPYFSQVRAAESSRMRTQ

SEQ ID NO: 170199 - protein, 224 aa, Glycine max
  Coding DNA Sequence Number=SeqID_78514
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=A7QL45; Match level="QueryCoverage=58%, HitCoverage=46%, E-value=1e-41, Identity=66%"; Hit description =Chromosome chr3 scaffold_117, whole genome shotgun sequence
  Subcellular localization annotation: CTP_CleavageSite=56; ConfidenceScore=5.43e-01
MKAKTVKGNWSLRTNKLSFPYVFLVCIFFFLAGFFGFTLFSHSQVFLLSFNYFAVSDFLVFCFLLENIDIISIAENSQGDGDGLRPRQRLLEPGNEAEYNLMPVRDLGDDSITSIPFQVLSWRPRALYFPNFATAEQCENIIDVAKDGLKPSTLALRQGETEENTKGIRTSSGVFVSASEDKTGTLAVIEEKIARATMIPRSHGEVTSLLSRKGILEGLINLIY

SEQ ID NO: 170200 - protein, 268 aa, Glycine max
  Coding DNA Sequence Number=SeqID_78515
  Gene Ontology: Mol. function=phosphoprotein phosphatase activity; Biological process=intracellular signaling cascade
  Homolog annotation: Hit_ID=A7R8Y3; Match level="QueryCoverage=45%, HitCoverage=35%, E-value=2e-22, Identity=43%"; Hit description =Chromosome undetermined scaffold_3090, whole genome shotgun sequence
MAALPPICVVGSVAWFVVVPLICFHVVEWHQPDRVLRQFGLQQPIPGCLSQPQNLHGITLKGKQDENWFHLLAPIISQWNNRAEFRVDVYPRQEGLLGFNSDYMVWYRRKTKIFVDPNNSNTTTLGEVVETLQYMVSPQGRNTWTVDDLVPYVEKLVIISEEQERIIELVLHGPASEREFPTQEFHILQSSVETRGIGRGRESVEAEQYSQQIMERGHGIFLLRLSKQKRGDNAAEEILIVKREDGIDHVAHPHDIMDTIMTDFDVSV

SEQ ID NO: 170201 - protein, 173 aa, Glycine max
  Coding DNA Sequence Number=SeqID_78516
  Subcellular localization annotation: CTP_CleavageSite=92; ConfidenceScore=5.50e-01
MVIEATVGTKQRTYKTKRKAKCRKSKQRQKLSNSNTQGNRAHQTPPSSPAAQRINMDKRLAFVSTWRWRRKQQWRVEEGASQTGVLALGCSRAGTRRVLCCSNAAGSAIGGCTLQLQGGGAIMRSDLLLYMQFSSTALLLTLLSLRLSSWLSRKLASLLPLLLSFLLLVTSWL

SEQ ID NO: 170202 - protein, 95 aa, Glycine max
  Coding DNA Sequence Number=SeqID_78517
  Homolog annotation: Hit_ID=A7PWY1; Match level="QueryCoverage=89%, HitCoverage=11%, E-value=4e-10, Identity=38%"; Hit description =Chromosome chr12 scaffold_36, whole genome shotgun sequence
MECPKDVEKYNNMINSQRVYVFLAGLDSHLDAIHSRILATTPLPNVQPVYATVYVEANRQEAMLDSESTMGTAFAVKKYSKKGIHNCTHLHGDTH

SEQ ID NO: 170203 - protein, 135 aa, Glycine max
  Coding DNA Sequence Number=SeqID_78518
MQFKELIEYTQQAFKSLEIQVEVEAHEESLVEERDSREKDKEKSEEKAQQWEKCSQVEIQQESILQVNTPPHQLIVKEERHGEHEKALSVILSLITSTSLAMIWMVFPEYMSFMESLAKKQKCKEDVFYVTFMPP

SEQ ID NO: 170204 - protein, 64 aa, Glycine max
  Coding DNA Sequence Number=SeqID_78519
MALNYSGPNATCMHASGAPSSVCELRWTLEVVADVEAVVVLMWPAAATGLAPTVVPALACNISQ

SEQ ID NO: 170205 - protein, 129 aa, Glycine max
  Coding DNA Sequence Number=SeqID_78520
MEKLEKVRNTIHPVTRIEVATFAANMRNVEESCGAFVTDVYRPSTTNLANLEGEKREKERREMRNQTQPTVPFVRMEIRMEIDKPTPTCPAAIRIWVSRMVTNAGIHKPVSNNQNWVSQEPSNLKISNG

SEQ ID NO: 170206 - protein, 120 aa, Glycine max
  Coding DNA Sequence Number=SeqID_78521
  Subcellular localization annotation: CTP_CleavageSite=54; ConfidenceScore=5.66e-01
MATPPSSPPPPPPSGAASHSPSTLKRTRKATRLRSLATRPVGAERPLVHVDPITGKVGSPHRKKFRTYLGIVACDKVDVTYENWKQPTKIVSTTLYAKSMTLARRSGPNFVRPAETIRGR

SEQ ID NO: 170207 - protein, 78 aa, Glycine max
  Coding DNA Sequence Number=SeqID_78522
  Subcellular localization annotation: CTP_CleavageSite=33; ConfidenceScore=5.26e-01
MSHFQGFFKGSVKTSNNGFYYVRWSDGKQWRLVAVTGGCGWRRMRFRVWGKRRRIPLSELVSLSEISLLALSETLHAK

SEQ ID NO: 170208 - protein, 211 aa, Glycine max
  Coding DNA Sequence Number=SeqID_78523
  Subcellular localization annotation: CTP_CleavageSite=73; ConfidenceScore=5.08e-01
MTRTKKTGQMTSEATKDFANKIASQGFFVAHRRQGVLTAAIRQPKHPGGVRATGVDVTIKQYFGSAPRTSHMSSSMVPEDLENLMQKIRDQLEESITEKVTRQLMLSFNQMQSQFQSYMQSQGLALSLEPEGSTTVHNILFHNDQVKVGVEEVRDADAPIPTPIQEGVVGLIKLADRPNHDVDDPLYLMTLTIPQLFLKSLQVMRDATVFG

SEQ ID NO: 170209 - protein, 137 aa, Glycine max
  Coding DNA Sequence Number=SeqID_78524
MIGRYHNTFAGGPSLNFRHYHTRHHPSLCIVIPKPRAFVHFFKLMSVQYAIIRRHMLAKKTLVQNHESYPLSDLPFLHQTVQIGTCHNLPFGGRPTQGSRVRLPRKVLTATMFDIKEDDISRNLCKLDATTLGIITK

SEQ ID NO: 170210 - protein, 194 aa, Glycine max
  Coding DNA Sequence Number=SeqID_78525
MGDIEEVQEQMKADMKALKEQMTSMIEAMLSMKRMIESNTTTTAITSAAAEVDPTHPSAINQANQPIPDVLGQGREVLGSTGGPHGQQPQPIGGAREEPREHAQGGPPPAVEGKEKLDLIEERLRDVEGFGDYPSTDMAELCLVLDAVIPPKFKGREIVNAFLLRKFGLSGGHLVYQFGGFSYLHMEGLDYCLH

SEQ ID NO: 170211 - protein, 170 aa, Glycine max
  Coding DNA Sequence Number=SeqID_78526
MPLEKVPMRPHRWTWSLMGTGSEVKNTSDDLRPLKVGRSSRREEEVRDKRSWVRGQWIPFDEDVINQFLGHPLVLEEGQRCVGSGVVAARGGPAAASCRCTVATPIGDTIPGSQDPSPFPWPTPEQFGATVAWPGDEADFETRARPVGALGDDEGAQEDDNMADVLDFFT

SEQ ID NO: 170212 - protein, 398 aa, Glycine max
  Coding DNA Sequence Number=SeqID_78527
  Gene Ontology: Mol. function=transferase activity, transferring phosphorus-containing groups; Cellular component=chloroplast; Biological process=amino acid biosynthetic process
  Homolog annotation: Hit_ID=O49204; Match level="QueryCoverage=60%, HitCoverage=68%, E-value=1e-85, Identity=66%"; Hit description =Adenylyl-sulfate kinase, chloroplast precursor
  Pfam annotation: Domain name=APS_kinase; Domain location=196-375; Score=341.5; E_value=1.4e-99; Accession=PF01583.11; Description =Adenylylsulphate kinase
MTTAKAPRPPCRSGVFRNIVCGPSPAAETLGFPRLRGISVAGLHRSHRNLVLRARSKPIKVKENATVSASLIDDWFKPITAKEDSDAGAFSGSAIFVFSSLSRSGINVFFFSFEMRIFKTRCYSWSRANKFNDIIIMGKDGEKNEHILVEWLLIADKGDFSGKNLSQMSNVANSTNIMWHDCPIQKQDRQQLLQQKGCVIWLTGLSGSDQLPSQNEFSLLIIYAALPLSLIQGKSTIACALSRSLHSKGKLSYILDGDNIRHGLNQDLSFRAEDRSENIRRIGEVAKLFADAGVICITSLISPYQKDRDACRALMPKGDFIEVFIDVPLHVCEARDPKGLYKLARAGKIKGFTGIDDPYEPPSSCEIVLQQKGSNCKSPSDMAEEVISYLEENGYLRA

SEQ ID NO: 170213 - protein, 364 aa, Glycine max
  Coding DNA Sequence Number=SeqID_78528
  Homolog annotation: Hit_ID=A7R7Y0; Match level="QueryCoverage=74%, HitCoverage=97%, E-value=2e-17, Identity=48%"; Hit description =Chromosome undetermined scaffold_2095, whole genome shotgun sequence
MPEGEPTNGYCSSSSGEEDGDAAWRAAIDSIAQTTTYVSSTTKHTHPNHDDDDDYDGHKPKTRQLKHYQLKAQNLLNEILENSIEIVRKPVPVVDEDPESNECGIRLFKHAQPGIVFDHIWGSFVGFYFAMVSWLLCGSVVGGSRSLVTIVLDLNMKNLRTSLKYEKSCIVVKAASGADEPQPPRKRPRILPGGDIDEKSKKQFRKQIRSVAVNGIEIIAAANDAYKKSLARLEAKDAAAKAKAKREDERVENLKKIRGEKWLPSMAQEMQDKDELSTMIVGIISLHWSGTCNSLSNDIHSRICWSSLSILAIDDTHVCAIEVGFEYFGLARGVVPGCAIKGSNGSVVCWANNGQFSMAPCISK

SEQ ID NO: 170214 - protein, 63 aa, Glycine max
  Coding DNA Sequence Number=SeqID_78529
MGTYLDCREVTSKTETKKQRTRKHSADECQMIASATVSLSETPSANGWGLAHLAQGATCSAHK

SEQ ID NO: 170215 - protein, 113 aa, Glycine max
  Coding DNA Sequence Number=SeqID_78530
MDSEIYPEAHENRKAFFSSSSPILLEPLAHGSSDWSFPREDCISSWPRWPAQESSLLLSGEQIWQQRRAPGTLGPLQHRTHLCQPRMLLPHLKTTLHRHRRAEDMIHLHFLLF

SEQ ID NO: 170216 - protein, 54 aa, Glycine max
  Coding DNA Sequence Number=SeqID_78531
MEVEEPWLGLWLPLNYQVDMGARWCLATNMRQADFEADLGMTFVDDWVVGNEKG

SEQ ID NO: 170217 - protein, 154 aa, Glycine max
  Coding DNA Sequence Number=SeqID_78532
MTGRLFVGSLALESRILHYLIVRILLPRSSNLAQFNIPLDSEPYVPIKRSFLIGAAVIASFGYCKERDGSWVKKGAQPHDDEGHLPIREDSSLLQSILDRFDGLQTYVGERFDALEQQVDMRFDEMDSRITKVEGDVTYICTCFDLPPPLPPSS

SEQ ID NO: 170218 - protein, 343 aa, Glycine max
  Coding DNA Sequence Number=SeqID_78533
MASRKRKSTASRPQEPYETTRFISEGAWERYAQNVHSRNILLERNPDGHIDVALVKKFYANLYDPEDKSLRQVRVWGKLIKFDAETLNTFLETPMVLEPREHYTLYSRFYHSHPGPKEMASRLCIPGVRLVYGLVMKMDMDLGSLISGQISQMAQSNSSRLGFPTLITTLCVARGVVSDSLTFESLSPAINLAYIRKNCWNLDDPTITFPGTHKARARGPSNASTSAPSSSAPLAPAAAPTPATQPPPWLMLGDAEYTRPGSGLADYEHGGFHGLGALARSPAFTFWGGGVTPEATPETTPAATPLVEVTEDEDGTANTDYAADMVAAQSTWDPWPTTAQETP

SEQ ID NO: 170219 - protein, 143 aa, Glycine max
  Coding DNA Sequence Number=SeqID_78534
  Gene Ontology: Mol. function=nucleotide binding; Cellular component =cytoplasm; Biological process=small GTPase mediated signal transduction
  Homolog annotation: Hit_ID=Q8VY57; Match level="QueryCoverage=81%, HitCoverage=80%, E-value=4e-44, Identity=65%"; Hit description=ADP -RIBOSYLATION FACTOR-like protein
  Pfam annotation: Domain name=Arf; Domain location=7-134; Score=-30.0; E_value=3.2e-07; Accession=PF00025.12; Description=ADP-ribosylation factor family
  Pfam annotation: Domain name=MMR_HSR1; Domain location=20-100; Score=- 16.9; E_value=0.038; Accession=PF01926.14; Description=GTPase of unknown function
  Pfam annotation: Domain name=Miro; Domain location=21-100; Score= -10.8; E_value=0.1; Accession=PF08477.4; Description=Miro-like protein
  Pfam module annotation: Pfam domain module=Arf::MMR_HSR1::Miro; Domain location=7-134::20-100::21-100
MGLWESFLNWLRSLFFKQEMELSLIGLQNAGKTSLVNVIATGGYSEDMIPTVGFNMRKLEQFVQRENPDNLSISKSELHDLLSKPSLSGIPLLVLGNKIDKPGVLSKEALTDQIDIYLEVAGGICMANLVADYFIPALFSFAS

SEQ ID NO: 170220 - protein, 123 aa, Glycine max
  Coding DNA Sequence Number=SeqID_78535
  Homolog annotation: Hit_ID=Q1SMZ7; Match level="QueryCoverage=52%, HitCoverage=14%, E-value=2e-07, Identity=38%"; Hit description =Ribonuclease H
MGKRGVNSDQETILHCLRDCRFTHSIWMKLGCNDLGFFSTNISCDWIKYALAAPEVNSPLFLAGLWEVVWHRDHEEGAILNVDGSCLTNSGKGDFSPVYFDFLGRAEKQDFTPLTILSASLHL

SEQ ID NO: 170221 - protein, 99 aa, Glycine max
  Coding DNA Sequence Number=SeqID_78536
METEILFFNVLKLPQRSSPPTIVVQESTIVQDQVNEPILELIQQPMNQVHEPSRKSTQVHRVPDRLNLMVLDNTSNEVYHDDDDPRNYEEAMQSLNCKK

SEQ ID NO: 170222 - protein, 91 aa, Glycine max
  Coding DNA Sequence Number=SeqID_78537
MFHVANSVTSYGHNVPYHESELPRNISNLHDDEDDDDDYLASNSYVEESFDEGDSVDEISDTDDEVTDIVEPVSIVHPTEGLRVYREGFKA

SEQ ID NO: 170223 - protein, 69 aa, Glycine max
  Coding DNA Sequence Number=SeqID_78538
MQVPSKSLVKLASSWQERHSLHAGYMCRLRAAAGHRLGAEGRTRHWCRRDAALDQGRTRHFDWRVEVKF

SEQ ID NO: 170224 - protein, 51 aa, Glycine max
  Coding DNA Sequence Number=SeqID_78539
MASLLSISHVARKTPVVMAISYHLQVANSSGESGLRVVPAFSDEREGTFFR

SEQ ID NO: 170225 - protein, 194 aa, Glycine max
  Coding DNA Sequence Number=SeqID_78540
MAASDIAILRDKAHIPTKKKPARAFITRCIAVTKQAAIQATGSIDRNIKLQVASYVVEHMSPAAVFPKKKHHMKSTTWGTSQDTISMQMDSLDSSMANSIINNRDNGEITLEILATKTRVDHPQGRNNKGLVSMIGQRSWKRLWLNLCRVKALSASNRGLAREDMALSARVAFSARVALSARVALSGWTTKKNF

SEQ ID NO: 170226 - protein, 404 aa, Glycine max
  Coding DNA Sequence Number=SeqID_78541
MAFEELVGILKFHEQKLAQDKRTKKRKSLAIKVQRLKCNSASKEYSFKAFVANDAFEEESDDDDFDDELSLIRFNGSFKRSFHKKEKSLIICYECKKLTLQDLDDSSSDEDNKEEANLCLMVDVPTSKVEPTLDMSSENEDSQLEDTVNSDGEEHDDLKKAHQIHIVDFVLETNLPGSVQDASVCDVVKVLMDKKEERVKSLTIALEDTEEGRKEMLEQKLLLQKECTLANDELDKIKRKNSNLWTKCLEGTTFEIVKLYEEIETLRDKLGKFIGGHEALNKIIKVQRNPKDKFGHGFKGKKIIHGKKHQAWYLDSGCLQHMTGKKSMFQSVSPMSGGVATFEGNRKEMRIENIIKFASASNQDELASNTSVDDQPKEARELTRCLLRKHYPESHIIGDPMDKV

SEQ ID NO: 170227 - protein, 41 aa, Glycine max
  Coding DNA Sequence Number=SeqID_78542
  Gene Ontology: Mol. function=amino-acid N-acetyltransferase activity; Cellular component=cytoplasm; Biological process=amino acid biosynthetic process
  Homolog annotation: Hit_ID=Q9SZF9; Match level="QueryCoverage=82%, HitCoverage=5%, E-value=2e-10, Identity=94%"; Hit description =Putative uncharacterized protein F19F18.160
MVEKRGRKGGVQRVHLLDGTISGVLLLELFKRDGMGTMVAR

SEQ ID NO: 170228 - protein, 154 aa, Glycine max
  Coding DNA Sequence Number=SeqID_78543
  Gene Ontology: Mol. function=amino-acid N-acetyltransferase activity; Cellular component=cytoplasm; Biological process=amino acid biosynthetic process
  Homolog annotation: Hit_ID=Q84JF4; Match level="QueryCoverage=90%, HitCoverage=23%, E-value=7e-46, Identity=67%"; Hit description =Putative amino acid acetyltransferase
MLKYWILMSFVFHSTYEVATACALAVRADKLICITDGPILDESGHLIRFLTLQEADMLIRKRLEQSETTANYVKAVAEESFKSLKNFNGAVHSSQNGKPFSECHNSTFHNGVGFDNGNGLSEEQGFAIGGQESLCRTNGYLSELAAAAFVCRVS

SEQ ID NO: 170229 - protein, 106 aa, Glycine max
  Coding DNA Sequence Number=SeqID_78544
  Homolog annotation: Hit_ID=A5C2Q1; Match level="QueryCoverage=100%, HitCoverage=20%, E-value=1e-30, Identity=59%"; Hit description =Putative uncharacterized protein
MVFRSFTNTLESYEAELRTDIGKGFEVDKILDLIFSLYVPKFHADCLLALLGFFKHYLSSSSDAPLASTLSKLETSLLRFYVIHVVQCNRNDNVVNFFTLYGVELL

SEQ ID NO: 170230 - protein, 86 aa, Glycine max
  Coding DNA Sequence Number=SeqID_78545
MSNHNHQQQPSTAAPAPQESPTKDKDLDTRSACPPPGGAAQFVQPPLTPTEEIGCLEKWYAILFLLTRSVSINLKNRSSKIKRCSI

SEQ ID NO: 170231 - protein, 143 aa, Glycine max
  Coding DNA Sequence Number=SeqID_78546
  Homolog annotation: Hit_ID=A9P9K9; Match level="QueryCoverage=28%, HitCoverage=14%, E-value=2e-07, Identity=69%"; Hit description =Putative uncharacterized protein
MALIFAKNMAILTALNNTVSKVIRELVKILVDKVALDDTLLSLDDVLEQQGFDSGKKGDDDVVLTCINKANSKLLSHQKIFKVDNHIGVAIVGLTIATVSSLATCDPSLHIEHDVVVLLQVLSGSSLKKERGSYHYYGMTISE

SEQ ID NO: 170232 - protein, 243 aa, Glycine max
  Coding DNA Sequence Number=SeqID_78547
  Subcellular localization annotation: CTP_CleavageSite=41; ConfidenceScore=5.28e-01
MAESSKKRKGSSTSSGAAAHRHHRPSEAPTAPLPPSLSSPRSSILFSSDDECLRQGAPFEDTIVDDWKFNYSSHDARHMVCNDQADMTGRLLAGSLTFDCRIMHYIIVRILLPRSSNLAQASEENLILMRAFLTGRQIDWAHLVRYRMHKALRANAPLPYPQLWLKKDAQPPQDEHTPSPPPQRDDSSTLMNEVLSELRGLRTYVGERFDSLDGRFEGMDTHITQLEEDVSYLRRCFDLPPPS

SEQ ID NO: 170233 - protein, 182 aa, Glycine max
  Coding DNA Sequence Number=SeqID_78548
MEDNLNPMDFGNPQNESSLFWDVVFRTSIHNHMHNIPKVTHIDMEKLNFVNYVKGPHVEANRVCTILCAVEDRGKDLLNKKMLENDKARLTVEVEKLRKQMVDAEENREKLTTLEVQLTSTKNEVDKVKFDLTMVDTKLAQQIVEGFKDAIVQVKIVVEDVDFDVVDPSKEVVNYEIVEVVE

SEQ ID NO: 170234 - protein, 372 aa, Glycine max
  Coding DNA Sequence Number=SeqID_78549
MRNNLEIFFSHPLAQRALCAKRIILHTLSESSLALSSSTPTHWLKGELERRQWHKALTRQPDGHIDVALVKEFYANLYDPEDKSPRQVRVWGKLIKFGGDSLNTFLETLVGVSWKLLRKDLTTLAQTWSVLSYSNLAPTSHTFDLNVDRARLISQIAQSNFSRLGFPALITALCIARGVVPNSLTFKSLSPAINLAYIRKNCWNPDDPMITFLGTCKARAQGPSDASAPSSSTPPAPAPPAPPTPIPTPLVPSDTSAQSSDTMVPMLKSLHHGLCLPSPLGGGEAPTAQEPNPEPEATPEATLEETPEITPAATPSEAPEERDGAADTDYVVDMAATQSSWDPWPTPALDTSLLAQDAPSIPQDDPTQVKDD

SEQ ID NO: 170235 - protein, 78 aa, Glycine max
  Coding DNA Sequence Number=SeqID_78550
MTIVTCYVMVGNELWCHKKDLVGKVEGIAAEKDELAKVVADLQDVKNDVMHDEEDIATEEEATEEKDGEEEQDVRASV

SEQ ID NO: 170236 - protein, 428 aa, Glycine max
  Coding DNA Sequence Number=SeqID_78551
  Gene Ontology: Mol. function=transferase activity, transferring glycosyl groups; Cellular component=integral to membrane; Biological process=cell wall organization and biogenesis
  Homolog annotation: Hit_ID=Q564G7; Match level="QueryCoverage=99%, HitCoverage=99%, E-value=0.0, Identity=76%"; Hit description =Galactomannan galactosyltransferase 1
  Pfam annotation: Domain name=Glyco_transf_34; Domain location=108 -380; Score=448.9; E_value=7e-132; Accession=PF05637.3; Description =galactosyl transferase GMA12MNN10 family
MAKFSSRKKSSIWVPNGCIFFLGGALTTLLLLWGLSSFIIPIPNSDPELNPVSTKLSSLQFPTNTDSPETTFYDDPETSYTMDKPMHNWDEKRKQWLLHHPSFTVTTHDSKILVVTGSQPKRCHNPIGDHLLLRFFKNKVDYCRLHNYDIIYNNALLHPKMGSYWAKYPVIRAAMVAHPEAEWVWWVDSDAVFTDMEFTLPLNRYKDHNLVVHGWENLVRENRSWTGLNAGVFLMRNCQWSLDFMDVWASMGPMSPEYEKWGETLKSTFKDKVLPDSDDQTALAYLIAVENKWADKIFLESEYYFQGYWLEISKTYYNVSERYDEVERKVKGLRRRHAEKVSESYGLMREEYLNDVGEWKRPFITHFTGCQPCNGHHNPAYDAMDCWNSMERALNFADNQVLRVYGYMRKDLLNKAISPIPFDYPNVV

SEQ ID NO: 170237 - protein, 89 aa, Glycine max
  Coding DNA Sequence Number=SeqID_78552
MTKSQRLVVLKWVKELKLPNGYASNLGRAWILTREKFMEEKSCFHPTIASCGSNVFQGYFDDAKESRVKQIPKIQESSSQESRFKNQVS

SEQ ID NO: 170238 - protein, 188 aa, Glycine max
  Coding DNA Sequence Number=SeqID_78553
  Gene Ontology: Mol. function=transcription factor activity; Cellular component=plastid; Biological process=regulation of transcription, DNA-dependent
  Homolog annotation: Hit_ID=A7PT61; Match level="QueryCoverage=85%, HitCoverage=60%, E-value=4e-60, Identity=66%"; Hit description =Chromosome chr8 scaffold_29, whole genome shotgun sequence
  Pfam annotation: Domain name=Sigma70_r2; Domain location=29-95; Score= 75.0; E_value=2.5e-19; Accession=PF04542.5; Description=Sigma-70 region 2
  Pfam annotation: Domain name=Sigma70_r3; Domain location=93-173; Score=14.6; E_value=0.00076; Accession=PF04539.7; Description=Sigma -70 region 3
  Pfam module annotation: Pfam domain module=Sigma70_r2::Sigma70_r3; Domain location=29-95::93-173
MAEWAEGAGLNCRLLQSQLHSGIRSREKLIQANLRMVVHVAKSYQGRGLSLQDLLQEGSMGLMKSVEKFNPLAGSRFGNYAFWWIRQAIRKAEKVFILLGKVIEAKKLYIQEGNLHPTKEELARRVGVTVEKIDKLLFSARIPISMQQTVWADQNTTFQRLQMEQDATDTRWWLSETMVFVGEDALCS

SEQ ID NO: 170239 - protein, 147 aa, Glycine max
  Coding DNA Sequence Number=SeqID_78554
MISPEIHLIGESSNDDPSHHYSGFNTASDHVSSSPADNTAPIDGMAPPNTGVVAPIGGTATAEGGLRSNSNVCENPGEDEVESPLPNPPPMQVIVPCPFIPPPPPPLRKPSKAKKVFPLVVLLGYTWVHREISKATSFERALESSRS

SEQ ID NO: 170240 - protein, 115 aa, Glycine max
  Coding DNA Sequence Number=SeqID_78555
MKTQLKSMKIKVEKTKTLKKDLANSKEFVAKLQTDFDKHVASLSAKSKENNTLNILVVALDKSVADVKAKFADFSSQFAAEQTKSKTAEEEKKIAKDKLTSANEEVANLKKIVAR

SEQ ID NO: 170241 - protein, 129 aa, Glycine max
  Coding DNA Sequence Number=SeqID_78556
MSYPTQAKVKQYVDRSGLKSLFDVWYMSMNKGIINAFIKRWHNTTYTRIEIKAILFFQEERDACTHLQLVVPQRSRSQPQVFEHLPTIPCSDKVLDYDRKKQLETRWLLLRGNNKVVRTKQFVGSVVND

SEQ ID NO: 170242 - protein, 42 aa, Glycine max
  Coding DNA Sequence Number=SeqID_78557
MGLGLLAACGDACAGVKGGWRCLSGGGQGIYAHEIKDSNEHL

SEQ ID NO: 170243 - protein, 94 aa, Glycine max
  Coding DNA Sequence Number=SeqID_78558
MEPKHMGRIENQNFQRVHTLPTCHVTVVVNVAALCKDVVDNLLRDNVAPRSFTLVLCTQSVTQPHTTNTDGHILFGIGDRNRNPRKRNGCIDLD

SEQ ID NO: 170244 - protein, 205 aa, Glycine max
  Coding DNA Sequence Number=SeqID_78559
  Gene Ontology: Mol. function=protein serine/threonine kinase activity; Cellular component=integral to membrane; Biological process=protein amino acid phosphorylation
  Homolog annotation: Hit_ID=Q9SYM9; Match level="QueryCoverage=60%, HitCoverage=35%, E-value=2e-31, Identity=56%"; Hit description =Putative uncharacterized protein T30F21.14
  Pfam annotation: Domain name=Pkinase; Domain location=15-204; Score= -106.0; E_value=0.029; Accession=PF00069.16; Description=Protein kinase domain
  Pfam annotation: Domain name=Pkinase_Tyr; Domain location=15-163; Score=-144.2; E_value=0.0014; Accession=PF07714.8; Description =Protein tyrosine kinase
  Pfam module annotation: Pfam domain module=Pkinase::Pkinase_Tyr; Domain location=15-204::15-163
MSLKIKSFCLKTQKLNSKDIIGSGGYGVVYELKLDDSTTLAIKRLNRRTAERDKGFERELEAMANIKHHNIVTLHGYYTAPHYNLLIYELMHVNSTPWLSRTVLDRYGIQIAAIVAFQKLYWHYHDITFKIPFLLQPRVVSLLVLLLKGILLRFNFKKVVVFDNSTGRWQKLKVIFLKALCLGMASKHILKELKDLQKDPPTSWR

SEQ ID NO: 170245 - protein, 46 aa, Glycine max
  Coding DNA Sequence Number=SeqID_78560
MKGAVARPKHRGRYRRGGEELDSEDEAATTRVVNKGRPRPLLACHK

SEQ ID NO: 170246 - protein, 77 aa, Glycine max
  Coding DNA Sequence Number=SeqID_78561
GSSRCGVSTVNYGGLQRPLVAVGCVEEAWDIGNGFREEEEKGKGNFTEIALGSFLEKLSREASSRSFLVRLPREAFS

SEQ ID NO: 170247 - protein, 211 aa, Glycine max
  Coding DNA Sequence Number=SeqID_78562
MSNHKSTKSAIKNLEIQGVFVEDESRSNEGELGAEKEKEKEGEQTGERKINEVDEVQNEKNNKKRESEGDKRKKSEEKKTKSELTHLLLEVASLLSLSPFSILLSFIFQEAKESIDEEDPRPTSSIGAYITGSLSFNAVLQCWAQPTMKAKCEHHTKRSFSALSAIENLADHSFQGRALSAQHMRVLSPNPLTHAKREGGAKRSVAILEPI

SEQ ID NO: 170248 - protein, 53 aa, Glycine max
  Coding DNA Sequence Number=SeqID_78563
FDGLQTYVGERFDALEQQVDTRFNEMDSRITKVEEDVTFIRTCFDLPPPPPSS

SEQ ID NO: 170249 - protein, 128 aa, Glycine max
  Coding DNA Sequence Number=SeqID_78564
  Pfam annotation: Domain name=zf-CCHC; Domain location=80-97; Score =23.1; E_value=0.00048; Accession=PF00098.14; Description=Zinc knuckle
EHEMELQRLNQNEETNNRKRSIALKAFSSMQEENEDEESEDEEDFSLFVKKFHKFVKNRRIERRQNFNHGKRSHEGSPTLRCYKCNQLGHIKANFPSNEQWPEKNNKKSHEERRTKKAYISWDNNDSS

SEQ ID NO: 170250 - protein, 75 aa, Glycine max
  Coding DNA Sequence Number=SeqID_78565
MAPRKLASKRSRKDKATEGTSSAPEYDSHRFRSAEHQQRFQAIKGWSFLRERRVQLTHDEYTDFKEETVRRRGHH

SEQ ID NO: 170251 - protein, 75 aa, Glycine max
  Coding DNA Sequence Number=SeqID_78566
MGVKHLKVINQCPQTDKNCPWTKLGYDREHEIEGVKEGEKLNFELCLTRLSFIKVVTSVTHASVYSLSSFLEKLS

SEQ ID NO: 170252 - protein, 123 aa, Glycine max
  Coding DNA Sequence Number=SeqID_78567
MKWRIGGTFSTESLRRIFRIPLRLKCSSWWGGSTAHIGGSRWPPVVVGGGGEHTTLAQASEARLGELIHSSNFLLRTKLHISRSIGYTTNPNGQTVNTCLRNLQKKTYDDPTVNEYRMPISMR

SEQ ID NO: 170253 - protein, 213 aa, Glycine max
  Coding DNA Sequence Number=SeqID_78568
  Homolog annotation: Hit_ID=Q8GWJ8; Match level="QueryCoverage=43%, HitCoverage=74%, E-value=9e-20, Identity=44%"; Hit description =Putative uncharacterized protein At5g58920/k19m22_120
RIAARLPWWHCRMKLPENAQQLPLADMDKSSEQAAGIEPQSRRRRSNSAWEEEEEATSSFVNPNFFGEEEATLHVSPEEQLLLEHVPEDVLPKLLLKVLLEVHLLFPEVISEGRLPERVPEEGLLCTYAVLGALWLYNNNSSLGWGKLKPQLKEHEEALKEFIAKGKMIGTTNSPKGKAESDKENFDEEAQKLWLRMKNELKTELMENGFDVE

SEQ ID NO: 170254 - protein, 150 aa, Glycine max
  Coding DNA Sequence Number=SeqID_78569
MSKAHTLVPMLQSLFRGQFIIMHSLQELAHNRLIIIMDHFLEQVAWPKAQLPLVRPNEVALPKPTPVQVDPEPANPQSPVVNPLSSPEREVVPPSPPLIIIFDASLDEVAAPPDSPAGETTDLPTSLVGGISDLSDLSSGEAVALTDSPV

SEQ ID NO: 170255 - protein, 123 aa, Glycine max
  Coding DNA Sequence Number=SeqID_78570
MTNKERPPSTNKLFDVCQQSRESLKEFLMRFNKVTYHIGAKELMARKRELEKKEYGLKPYRRHFLKPQGIWIKGMVGQFSRRYDDERHRREEEVYGALTVLRQQILKEVYSINLITYTTSTDR

SEQ ID NO: 170256 - protein, 326 aa, Glycine max
  Coding DNA Sequence Number=SeqID_78571
  Subcellular localization annotation: CTP_CleavageSite=63; ConfidenceScore=5.13e-01
MEDAPVRLASLTHKRTTPFRFFRRFPQINIGGDSTHFPFLEDASVSPVSPSRRRVGCNNHSPKQARVKGHLVRIDADSLNEFLETPVVLEEGETLPTYSRFCRLPSDPHEIEVALCIPGKGFTLNAEGHPGKIFRKDLITLAQVWNVISYSNLAPTSHTSDLTVDRARLGFPALITSLCRARGVVFDSLTFKRLSPTINLAYIRKNCWNVDDLTVAFRGARRVGARPTDVPSTSATPALAPAPPSTSNQGSQRVESMLQSIFQAQVEDASFEATLLEPFTFHDEAGELQVRQEVIATLEKSPLVTSDPPTPVWTYPHLSMQQTPPL

SEQ ID NO: 170257 - protein, 226 aa, Glycine max
  Coding DNA Sequence Number=SeqID_78572
MATLMSTTCYLDKDETGQSIDLKKYRGQRRHDTSGDPPAPNPPSFSSPRSLTLFSSDDQRQRYYSQFSNRVILDPKYLDVEFFDGETFDLIPIKSTNLAQASKEDLILLWGLQIDLQIDWAHLVRYQMHKALWANAPLPYTHLVTLFLQHFNVPLEDDPFVNVKRSFSIGACATTSFGYWKDMDGQWLWDLWAFIGDHFDAMDSHITCLEDDMSFIRCCFDPPTDS

SEQ ID NO: 170258 - protein, 157 aa, Glycine max
  Coding DNA Sequence Number=SeqID_78573
  Subcellular localization annotation: CTP_CleavageSite=62; ConfidenceScore=5.51e-01
THKTPSGPGKVQQGPGVSSSGYGPLSVLQGARTSPARSRHHRDRARKTPSGPEEGQQSLGVASSKYGSLSVQGSVCCPQQGHQAPYQSSFHQEVLRPQADAGRNTTTALGWPVAGNRRTAATSRVHLCSSTKRFEYCLHHMADQQATKSKAKDKQKC

SEQ ID NO: 170259 - protein, 281 aa, Glycine max
  Coding DNA Sequence Number=SeqID_78574
MEATLVDGNGMETRHIIVTTIGGKWFYIRRLGFYIATKNISEALRDEGILHGAVVVDRVGDRGLLLNAYIRDLRLRLWCLGGVEALSKFPSMKPSLATSPSKGGNEYLLQMGMASGHRTFHMGSMSAPLYCSSFWLQSPMPFQSEFNEFLKATDTKVAIEEEALKSMMASLEEEMEEGEEAKSSPIPPVQKKAQPKKKAVTSDDVEIVEVRKLVEKRNIPNILNLEDGEFLKESGCFLLGRKIKVAVSTTRRVNSLGMQYFSMKALLIGGWMSLVGVTDTP

SEQ ID NO: 170260 - protein, 62 aa, Glycine max
  Coding DNA Sequence Number=SeqID_78575
MVARGGHQWSWVVEKKISLSKLISLSGSPLFMLSMTILAKHENSRSAQFPLGLELCLARLSR

SEQ ID NO: 170261 - protein, 93 aa, Glycine max
  Coding DNA Sequence Number=SeqID_78576
MPLREKALQQMPFYSKFLKDMLTRKHNNAFQDYFDDAKDSSQESRVKQVSRIKESFNQSKFQESKRRSIEASFKNQDSRKESREDSRYARTIK

SEQ ID NO: 170262 - protein, 85 aa, Glycine max
  Coding DNA Sequence Number=SeqID_78577
MPHQKRKTLYEASPSLLFWLKICSIIGVYFIPILVMKFQLRISVKTSAKNRGNWKGGLVSRLEEFESRSKGPTTLRAIGLICTPN

SEQ ID NO: 170263 - protein, 227 aa, Glycine max
  Coding DNA Sequence Number=SeqID_78578
  Homolog annotation: Hit_ID=A4DID9; Match level="QueryCoverage=24%, HitCoverage=49%, E-value=5e-19, Identity=80%"; Hit description =Putative uncharacterized protein
CRKVKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDETHIDGKVWHLDVGSSPPGAVVCSKGWAVRPLKRYVSWVQNVVRQFGPYPDREGRTSGVPVIVPTVNAGASGSTAETAMGSLPQRGWSERSFENSRE

SEQ ID NO: 170264 - protein, 279 aa, Glycine max
  Coding DNA Sequence Number=SeqID_78579
  Homolog annotation: Hit_ID=UPI00016621D1; Match level="QueryCoverage =83%, HitCoverage=40%, E-value=6e-13, Identity=28%"; Hit description =UPI00016621D1 related cluster
MVGYTPSSFPDLVFAGERIKVGLKRGKSDKPAFINAKTRANEEDENEGETLAMTVIPTRSNFSSAQQCHYSTNNRLHVLAFRGLHVLAFRGLQVLAFRGLQVLAIRGIHTLANRAARPYLQRTAHPRLQRAARPRLQRTTCPRLQRPTRQHVLTFRGVHILAFRGLHVLAFRGLQVLAFRGLQVLPFRGLHALAFRGLHVLAFRALHVLAFRGLDILAFRGLHILAFRGLHVLTFRGLHVLAIRGLNVLTFRGLHALVFRGLHVLPFRGLHILAFRGLH

SEQ ID NO: 170265 - protein, 126 aa, Glycine max
  Coding DNA Sequence Number=SeqID_78580
  Homolog annotation: Hit_ID=A5BXZ6; Match level="QueryCoverage=64%, HitCoverage=9%, E-value=1e-09, Identity=41%"; Hit description =Putative uncharacterized protein
MSRNLTDYAIVPSLASGMLRNFTDCVLTLPFNSRHVAELHGLPNEGCQVPRSGQVKVASHQTDGPRTKLGYDNTDVAGPQRTPSLQAPYTPKQNGVSEMRNRSVIEMARCMLHEKELPKHFGRATT

SEQ ID NO: 170266 - protein, 55 aa, Glycine max
  Coding DNA Sequence Number=SeqID_78581
MTKARQKGVRKENEGGACHPARPSELGCFLQKAVPSGELPGRPKWAWLLFAPPVY

SEQ ID NO: 170267 - protein, 57 aa, Glycine max
  Coding DNA Sequence Number=SeqID_78582
MAGTFFLLKKQNSLEIMSANLLAYRASTKRNTHGLSARKTLEEDELYRFGKRTTSSH

SEQ ID NO: 170268 - protein, 84 aa, Glycine max
  Coding DNA Sequence Number=SeqID_78583
  Subcellular localization annotation: CTP_CleavageSite=57; ConfidenceScore=5.06e-01
MTPLMKTIQGLQAPHGATSFCFDLFWRSTHRVYIRWYCRNLPFDRRATRGSLVRLPRKENAWSRHQRLFEENVGKTGKGVVYEL

SEQ ID NO: 170269 - protein, 96 aa, Glycine max
  Coding DNA Sequence Number=SeqID_78584
MLDKQGVVGPAKPSDRPDHEVDDLLYLMTLTIPQLFLKPLHMTETSMRAGNANVYGFLEPQSIQRYGQSQFESESYMKNWMQNSKWDVYLGAYLNG

SEQ ID NO: 170270 - protein, 70 aa, Glycine max
  Coding DNA Sequence Number=SeqID_78585
MTDPLGLHQVKHLPTDLTSSTSMSANLDSSLYIKHEDLSEIAHGGHLTENMYASGGILDIYGFLEPQSIQ

SEQ ID NO: 170271 - protein, 96 aa, Glycine max
  Coding DNA Sequence Number=SeqID_78586
MRKIVSMEKIQAEALPRRFRERFREDSSSFFIVLRSFFIVLPSSTISLNELTNNQSETKAKINSQMKLCPQKSLKNHFKVQRLKWSSLLLLVNMDF

SEQ ID NO: 170272 - protein, 76 aa, Glycine max
  Coding DNA Sequence Number=SeqID_78587
MAAEWRRKRERRRHFKEKMSLEEAHHHRRPWIRAWRKKEMNEGRGGEEHEILCSKRALKSEPTNPRSIPRFFTKCA

SEQ ID NO: 170273 - protein, 121 aa, Glycine max
  Coding DNA Sequence Number=SeqID_78588
MAVVIHFWALIVMAAQLIHDRVVMECLEGVWETLEGNERCRFRGTVRLTATSLVSSSEEDLEEDPEDLSPEPAMDAPDLPENDEDPLPDVDSPKDIMPASEADSIEESGPGGTTTSDDSSS

SEQ ID NO: 170274 - protein, 284 aa, Glycine max
  Coding DNA Sequence Number=SeqID_78589
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMQHRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 170275 - protein, 163 aa, Glycine max
  Coding DNA Sequence Number=SeqID_78590
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=1e-26, Identity=55%"; Hit description =Putative uncharacterized protein
MTMITPSSKLTLTKGNKSCIDRLCISQIHRIVLLIIEFRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 170276 - protein, 70 aa, Glycine max
  Coding DNA Sequence Number=SeqID_78591
MKISSLVKDARKTVSGDLAAHCGTIIVCPLDPQPQKGMHQGNLNLGKCLQIQLQRPSIESLLEDIHVQQL

SEQ ID NO: 170277 - protein, 60 aa, Glycine max
  Coding DNA Sequence Number=SeqID_78592
MTIRYLRVPPDSLSWMEKGAEDDVSLFASTERLPLVDERTTKGAEDDVILFASTGSFALG

SEQ ID NO: 170278 - protein, 95 aa, Glycine max
  Coding DNA Sequence Number=SeqID_78593
MVKARQKRGKRGRWLPPSSPRRAGLLPPEGTAFCWNTLEGLKCCGTLRIARQCSLSTFGMSRNFTDYLTMGVKYLKAVRQRLQAIKQWSPDEIRV

SEQ ID NO: 170279 - protein, 342 aa, Glycine max
  Coding DNA Sequence Number=SeqID_78594
  Subcellular localization annotation: CTP_CleavageSite=62; ConfidenceScore=5.34e-01
MGHNQKGKWALLALLKWGHLSLSLTLPFSSPSSSIEAPNKAPTFGHHFRSKSRKEGIFGVVKCVATSGTSKTQLVLFECCFAWMLWKLGRIDGDPVLRETRIWATWEYVSSNGGGQQGMETLGTSGGVLLPETKLDQSRPNPGIVGNWEMVEASGNRLPACVIDYTEEWVTGCVIDYQRWKALKYPFYLHVVVMRQMIVMAAQLIRERVEMECLEGAWETLEGNTRCRFRGTIRFMTTSLVHPDEPARTLQRTVEWILPTPTPYRLVEPVQVIEVMSSEEDPKEDLEELPPEPAVDALDFLEGDEDPLLEVDSPEEVMSASEVDSTEDSGPREMAISGGSSS

SEQ ID NO: 170280 - protein, 199 aa, Glycine max
  Coding DNA Sequence Number=SeqID_78595
  Pfam annotation: Domain name=DUF1723; Domain location=106-159; Score =10.4; E_value=0.031; Accession=PF08330.1; Description=Protein of unknown function (DUF1723)
MDATSWLRHHIQDHEYVVYILEHSTGIAKQTVGTPSTTCATPILPFHKIDTDCQSIMVRTRGLSRALGRVIGRAPGREVNCGSNETPQRQRPTASARRQREVAPVTEDECPELKLSSHGRKRLHKKTSNFHLLVGEVTITLGDVASLLHLPITSAFHSFEALHVDEAVLLLVELLEVIPDEARAEIVQCHRAYVQLSWL

SEQ ID NO: 170281 - protein, 199 aa, Glycine max
  Coding DNA Sequence Number=SeqID_78596
MASKKRKAPSTPSQVRYDWSRKLLPERNVVVYYTEFDEFKKELERRHWDEELTDFADGSIDVAIVKEFYANLYDLEDKSPKQVRVRGHLVKFDEDTLNTFLKTPVILEEGENLCAYSRFALLRPDPQELVAKLCIPGRGFELNTDGQPLKILRKNMTTLAQTWSVISFSNLIPTSHTSDVTLDRDKLIYGIIMKMDMTV

SEQ ID NO: 170282 - protein, 99 aa, Glycine max
  Coding DNA Sequence Number=SeqID_78597
  Subcellular localization annotation: CTP_CleavageSite=27; ConfidenceScore=5.77e-01
MATPPVSSPPPSPPPPPPPSDASASPSTMKRTRKATRLRSLATRPPGVERLVVNVYPAIGKADGPQKKKLRTYLGIVARDKAQIEIPEASDNRTKKKIL

SEQ ID NO: 170283 - protein, 342 aa, Glycine max
  Coding DNA Sequence Number=SeqID_78598
  Gene Ontology: Mol. function=transcription factor activity; Cellular component=nucleus; Biological process=regulation of transcription, DNA-dependent
  Homolog annotation: Hit_ID=A7PFK0; Match level="QueryCoverage=92%, HitCoverage=92%, E-value=1e-109, Identity=62%"; Hit description =Chromosome chr11 scaffold_14, whole genome shotgun sequence
  Pfam annotation: Domain name=AP2; Domain location=138-190; Score =61.2; E_value=3.6e-15; Accession=PF00847.11; Description=AP2 domain
  Pfam annotation: Domain name=AP2; Domain location=44-101; Score=49.1; E_value=1.5e-11; Accession=PF00847.11; Description=AP2 domain
  Pfam module annotation: Pfam domain module=AP2::AP2; Domain location =138-190::44-101
  Subcellular localization annotation: CTP_CleavageSite=31; ConfidenceScore=5.70e-01
MAKQQTHKINASTNNNISTTNTVTAKVKRTRRSVPRDSPPQRSSIYRGVTRHRWTGRYEAHLWDKNCWNESQNKKGRQGAYDDEEAAAHAYDLAALKYWGQDTILNFPNELKEMEGQSREEYIGSLRRKSSGFSRGVSKYRGVARHHHNGRWEARIGRVFGNKYLYLGTYATQEEAATAYDMAAIEYRGVNAVTNFDLSRYIKWLKPNNNNTTVNSNLIDSNPNCETNFTSNSNQQQGFNFFNRQESFNNEEAAMTQPRPAVATSALGLLLQSSKFKEMMEMTSATDLSTPPSESELPSCTFPDDIQTYFECEDSHRYGEGDDIMFSVLNGFVPPMFHCDDF

SEQ ID NO: 170284 - protein, 61 aa, Glycine max
  Coding DNA Sequence Number=SeqID_78599
MVDAEYATQTLMVEAEDDLAKASQVIIVVSGVLFLEEFNVIHPVSMIISFSLPLQKDSSSN

SEQ ID NO: 170285 - protein, 181 aa, Glycine max
  Coding DNA Sequence Number=SeqID_78600
MGAKHLTRTKERSHVIKQRSPDEIRCVLFYSYIRGKFPTDKSLFDPEITKTERKIKKKKKQATTKPPTESSSTNSPSTKKPLLIDNMTNRRGEGNRPPRRTLGDYAYQQGPKHYNNIVIPPFSNKVVELKPTLLSLIGSYPFVGMDHEDPYTHLSTFMELCSTMGASDENAKALLELSHSP

SEQ ID NO: 170286 - protein, 66 aa, Glycine max
  Coding DNA Sequence Number=SeqID_78601
MLICSRLKMSKKWCLLSTLLHHSAAIKIQKEKDSIDKEDPRPTSSTWSYIIQLHHGDSDIHWLPWS

SEQ ID NO: 170287 - protein, 282 aa, Glycine max
  Coding DNA Sequence Number=SeqID_78602
  Homolog annotation: Hit_ID=A5BSW9; Match level="QueryCoverage=34%, HitCoverage=9%, E-value=5e-10, Identity=35%"; Hit description =Putative uncharacterized protein
  Pfam annotation: Domain name=zf-CCHC; Domain location=80-97; Score =10.4; E_value=0.041; Accession=PF00098.14; Description=Zinc knuckle
MEEGFSTNKLPMFKSVKYDYWIECMIAHFESILIDLWDVALDLLHQWSPLFLKDQWKWNGEGGKVGEDEWREREKGGARNLCFKCLGRGHIASQSSTKKTMIMRGQDIYSSQEETTSFPSSSGSEDEGVKSLVRKSTPMKKLNLTINEQGEIIVNQQVKVPFSIGTFKDEINCDIVLMEEECKEVSVSSKRTLVSTDIPLELEVIPQVELLDEGLVRKSLNPCALSVPKIAQLIELASSHVPSLEDAHEMGVEERSPEFQEPLDLRSNPFQGGGDDAILPPK

SEQ ID NO: 170288 - protein, 95 aa, Glycine max
  Coding DNA Sequence Number=SeqID_78603
MEEKLRALFSTESLRWILKIPFRLKHSSLYGGRTASNDCSWRPPVVVDGGREGLRIWSDAILPRKGPVTRTMSKRLQEDWARAAEEGPRVFMNLR

SEQ ID NO: 170289 - protein, 141 aa, Glycine max
  Coding DNA Sequence Number=SeqID_78604
MRCEFSRFQGSTNPNPWSDSQEYMISNLEFQVFPPLVLITLLPSFRSPHPLLDQLDLLSSFCTTSGPKVRIKKKRCKKLMMNSLSKADWLSEPHPLRKAVSSLSECKILEEDKSEIGTLSTQQARPIRMLSLHVLSAPKLA

SEQ ID NO: 170290 - protein, 93 aa, Glycine max
  Coding DNA Sequence Number=SeqID_78605
MEEEHARQVTLEDYSSTTTPQFFTSIARPEVQAANISYPHSLIQMIQGNLFHGLPNEDPYTHLVTYIEICNTGKQKGGYTPLKAIACRPGRKL

SEQ ID NO: 170291 - protein, 178 aa, Glycine max
  Coding DNA Sequence Number=SeqID_78606
  Subcellular localization annotation: CTP_CleavageSite=37; ConfidenceScore=5.15e-01
MFQKLVFMKPRFDGSSNEAPSFNKELKRSFTSERTTPVGKKSHEENKSKQGTLFRNNKFMGHASVPLVSQPAEKESLLVESNDDDDDNDTETEDQDVEGGRTVAQNNDRGKGPPVIGGESSKIDGHEGPDVDKKADEFIAKRIESIKRSRRSARNSSSTTCISKIPLGEDYSQILIRC

SEQ ID NO: 170292 - protein, 54 aa, Glycine max
  Coding DNA Sequence Number=SeqID_78607
MLVKNLVGCPRVHDKTDHIGRPVRVTLFCENAPTMWNQHKLKEALKSGVFTSKT

SEQ ID NO: 170293 - protein, 218 aa, Glycine max
  Coding DNA Sequence Number=SeqID_78608
  Homolog annotation: Hit_ID=Q6WAY6; Match level="QueryCoverage=49%, HitCoverage=19%, E-value=3e-15, Identity=41%"; Hit description =Putative uncharacterized protein
CEKSSTRIVYCTPALYVWLVSHLFRQEVRHACLLEGHHSCTEKGGANWDQLLANKEGAFVNWFPRWKEGRVGVLISCGGFPNVPLMGTRGCISYNLVLAIRQLGYPMRGAPLEDELAPVISRGFNKTNVETLQKVRKAWEVLQKKDKELRGSNNGSIDGYRKWLKAHVQGLDWLPSLRTAKREEDEALEEDEEVQALRTKRKQAQTVKERFKSATLKI

SEQ ID NO: 170294 - protein, 43 aa, Glycine max
  Coding DNA Sequence Number=SeqID_78609
MQSSKRDVYLGAYLNSALKGLDDTPQPKSKVAARWIVVKLTFN

SEQ ID NO: 170295 - protein, 124 aa, Glycine max
  Coding DNA Sequence Number=SeqID_78610
MGEENSQHHHQQQSAAPSALRRPPPGMVHASPEECHTADARSQQSHTRRRSPWPVPPEGGSSGEIPQKPIACKKHAGEAQKTTSRDRITITGDAQGTAGYRRSQDIATRQASSELNPDNLPGRQ

SEQ ID NO: 170296 - protein, 84 aa, Glycine max
  Coding DNA Sequence Number=SeqID_78611
MPSLPKRELEICAPERPQSILGPPADLGRGPAVQIQPKEESAIMHTGARFRPDHFRETGADHAHQHDHLYPDMDDVAAQQHPTQ

SEQ ID NO: 170297 - protein, 76 aa, Glycine max
  Coding DNA Sequence Number=SeqID_78612
MGMRDCINYNPALAIRQLGYPMRGAPLEEGLTPFIAQGFNSTNTGVLQKVRKAWERVQKKDEELRGSSNGPISGYS

SEQ ID NO: 170298 - protein, 78 aa, Glycine max
  Coding DNA Sequence Number=SeqID_78613
  Subcellular localization annotation: CTP_CleavageSite=26; ConfidenceScore=5.06e-01
MWLFQNVSCQVSQPTLRREGDAGLTSVSSKKGKRAESPPTFIRGKCQKNQKRRGLRALSVKGSRVVFTHGEVLNVVTA

SEQ ID NO: 170299 - protein, 82 aa, Glycine max
  Coding DNA Sequence Number=SeqID_78614
MLRQVQIHECLYQLSLSQQSQGFAPFACPTPDQFRVEVAWPGDWPEAQAGEAPAEAPGDLEDARMDEEMTNLLGFLGGSRAT

SEQ ID NO: 170300 - protein, 277 aa, Glycine max
  Coding DNA Sequence Number=SeqID_78615
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRRGEDLEVPPNPSTILGEDDKLYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 170301 - protein, 76 aa, Glycine max
  Coding DNA Sequence Number=SeqID_78616
MGVQVATRPTWAFQKIPPEGGCFWRKQPSSPRRAGGRSEEKKGSTLLVIRDHLKLVKKIISVKKIQAEALPERFRG

SEQ ID NO: 170302 - protein, 40 aa, Glycine max
  Coding DNA Sequence Number=SeqID_78617
  Gene Ontology: Mol. function=ribulose-bisphosphate carboxylase activity; Cellular component=chloroplast ribulose bisphosphate carboxylase complex; Biological process=carbon utilization by fixation of carbon dioxide
  Homolog annotation: Hit_ID=O98951; Match level="QueryCoverage=77%, HitCoverage=44%, E-value=3e-10, Identity=96%"; Hit description =Ribulose-bisphosphate carboxylase
EGFMSPQTETKASVGFKAGVKDYKLTYYTPDLVVSRILNS

SEQ ID NO: 170303 - protein, 155 aa, Glycine max
  Coding DNA Sequence Number=SeqID_78618
  Homolog annotation: Hit_ID=Q2AA09; Match level="QueryCoverage=91%, HitCoverage=52%, E-value=4e-07, Identity=28%"; Hit description =Retrotransposon gag protein
MERSMIDAASDGALGDMTLAEARNLIEKMASNSQLFSARNDAIVLRGVHEVAKNSSSSIENKRLEGKLDALVNLVTQLAMNKKSTPVARVCAIWNEQPEAYPANIYNRPPQQQNQQQQNNCHLSSNRYNPGWRNHPNLRWASPPQQQQQQHVPHF

SEQ ID NO: 170304 - protein, 282 aa, Glycine max
  Coding DNA Sequence Number=SeqID_78619
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIFFLVSMVFTFWHDVAAAGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 170305 - protein, 84 aa, Glycine max
  Coding DNA Sequence Number=SeqID_78620
MGGLGIRDLPSLNKALLFKWKWLMFHQPDQLWTRILISMYNGWRGLEYGPRKQYFSTWWADLRALFQQQNVVSADNQIRWKLGR

SEQ ID NO: 170306 - protein, 296 aa, Glycine max
  Coding DNA Sequence Number=SeqID_78621
  Gene Ontology: Mol. function=transferase activity, transferring selenium-containing groups; Biological process=selenium metabolic process
  Homolog annotation: Hit_ID=A4W7H9; Match level="QueryCoverage=100%, HitCoverage=83%, E-value=1e-137, Identity=79%"; Hit description=tRNA 2-selenouridine synthase
MNDGTDYRAILASDTPLIDVRAPSEFAQGAMPAALNLPLMNDDERAAVGTCYKRQGPEAALALGHSLVRGDTREARINVWRDASLAHPDGFLCCARGGQRSHISQAWLKEAGIDYPLIRGGYKALRQTAIQVTIEQSQKPMVLIGGCTGNGKTLLVKQHAQGIDLEGLAHHRGSSFGRTLTPQLSQASFENHLAVELLKKDAARWVLEDEGRMIGSNHLPACLRDRMVEAPIVVVEDPFELRLERLREEYFDHMWADFSAAYGEEAGWKEYSQYLHHGLFAIRRRLGLQRFAEFTA

SEQ ID NO: 170307 - protein, 127 aa, Glycine max
  Coding DNA Sequence Number=SeqID_78622
MEFLELKQGNMIVAEYAAKFEELVRYFPYYQGRDDIEGIFKKDCPYPKKEHNGGGLNDQTGHPKAIGRVFTFNDAEASKSKDLIQGMDWLSSNHVLLNYFDKTVVFDGSEVSKDMVFISAKPVMRHL

SEQ ID NO: 170308 - protein, 50 aa, Glycine max
  Coding DNA Sequence Number=SeqID_78623
MALSAPSREQMMQSYPARALDRRLQVDWARDPREGPRVLMSLRVDFEPMG

SEQ ID NO: 170309 - protein, 65 aa, Glycine max
  Coding DNA Sequence Number=SeqID_78624
  Homolog annotation: Hit_ID=A7PTD9; Match level="QueryCoverage=66%, HitCoverage=11%, E-value=3e-10, Identity=69%"; Hit description =Chromosome chr8 scaffold_29, whole genome shotgun sequence
MKHFTDTLISANIGTKAGTGPPLEVDGIDKLDISGIPGSTLIFNSPKHFVAYYALPRLWVPRYPP

SEQ ID NO: 170310 - protein, 61 aa, Glycine max
  Coding DNA Sequence Number=SeqID_78625
MVLSAPSREDIPTALKSEQGSKDDDKGDDKKLKDQSKDNSSESKINQRKTQVNQEQFKSSR

SEQ ID NO: 170311 - protein, 139 aa, Glycine max
  Coding DNA Sequence Number=SeqID_78626
STWTTGLSAPGGLVDNDHRCEALHVRFTADGEADASEGVGGGGGGETGNYQHQEFFIEIIENNTSNSRGRNDIKTLNDEGMCRNLPFGGRASEARLTGASSMGGKCTESPPTFIERKTLEKPKETGHKEYSRFGSYVYA

SEQ ID NO: 170312 - protein, 46 aa, Glycine max
  Coding DNA Sequence Number=SeqID_78627
MVKVGTSYVPIRTSVSPKVGLSFPLFPPVQLLMVRNGTKHQPDIKV

SEQ ID NO: 170313 - protein, 192 aa, Glycine max
  Coding DNA Sequence Number=SeqID_78628
NDLETDDSDRYDLYIKANPACLVALRRVYKGSTVVHNTSLLPSQVKVGVEEVKDPDAPIPVPTNEVTWDATVFGVFNPDFPLYIKHEDLSEIAHGGQCLSIQHLTETSMRAGNSDLYGFLEPQSIQRLDNYLKGIINNALKGLDDAPQSKSKAPARWIVVKYFNDPRPLEPERLKVLRIQWAQYYLRVRAQS

SEQ ID NO: 170314 - protein, 158 aa, Glycine max
  Coding DNA Sequence Number=SeqID_78629
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
MKHFTDTLISANISQLLRRLRQENGLNLGGGACRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 170315 - protein, 80 aa, Glycine max
  Coding DNA Sequence Number=SeqID_78630
MDPMDSECLSVVSYDVVPCIDRSEYLALERRGGKAFLPPQVVEDILEEQMVWHSTHSDSYMVNSDYKNIDGVCLLDNVKV

SEQ ID NO: 170316 - protein, 115 aa, Glycine max
  Coding DNA Sequence Number=SeqID_78631
MRNELIKELGKWLQDYIKIFGGMERYEQLRLSLHVDGLSKVSMDKWMDITDMEYVIASRYNVYLKDRCPLPPMALLWSSNSYLEGKQWPTAYVGRMQHYLSLMTINTTHVDLSRH

SEQ ID NO: 170317 - protein, 26 aa, Glycine max
  Coding DNA Sequence Number=SeqID_78632
MSHCTKSPAVRYLPVPALVTAQVDTL

SEQ ID NO: 170318 - protein, 490 aa, Glycine max
  Coding DNA Sequence Number=SeqID_78633
  Gene Ontology: Mol. function=transferase activity, transferring glycosyl groups; Cellular component=integral to membrane; Biological process=metabolic process
  Homolog annotation: Hit_ID=Q40287; Match level="QueryCoverage=97%, HitCoverage=95%, E-value=1e-100, Identity=41%"; Hit description =Anthocyanidin 3-O-glucosyltransferase
  Pfam annotation: Domain name=UDPGT; Domain location=10-489; Score= -21.1; E_value=1.5e-09; Accession=PF00201.9; Description=UDP -glucoronosyl and UDP-glucosyl transferase
MAISNNNHHALVLVSPGMGHIIPALELAKRLVTHKIISKLTFFYGSIKTSTPSKAETQILQSAIKENLFDLIQLPPIDLTIHVSPHDTLETKLAIIMHEIPLLFMSTISTMNLNPTMIITDFFFSQVIPLAKNLNLPIFAFAPTNSWLVALGLHTPTLDKEIEGEYSNESKPIPIPGCKSVHPLDLIPMMHDRTQRIYHEFVGACEGAALADGIFVNTFHELEPKTLEALGSGHIIAKVPVYPVGPIVRDQRGPNGSNEGKISDVFEWLDKQEEESVVYVSLGSGYTMSFVEMKEMALGLELSGNKFVWSVRPPVTKAGTGNYLTAGAPLGETGTTLGSNNQPSNSFPDEFYRIQTNGIVITDWAPQLDILKHPSIGGFVSHCGWNSLIESVSCGVPIIGLPLFAEQMMNATMLMEEVGNAIRVEVSPSTNMVGREELSKAIRKIMDKDDKEGCVMRERAKELKHLAERAWSHDGPSYLALSKITHSNGM

SEQ ID NO: 170319 - protein, 54 aa, Glycine max
  Coding DNA Sequence Number=SeqID_78634
MLELRQPKDATTKAFSEAYSVLENELKFLNSDGESCSRPPDRLLPKIIPSLDIS

SEQ ID NO: 170320 - protein, 388 aa, Glycine max
  Coding DNA Sequence Number=SeqID_78635
  Gene Ontology: Mol. function=nucleic acid binding; Cellular component= intracellular; Biological process=regulation of transcription
  Homolog annotation: Hit_ID=O22090; Match level="QueryCoverage=99%, HitCoverage=98%, E-value=3e-45, Identity=36%"; Hit description=ZPT3-3
  Pfam annotation: Domain name=zf-C2H2; Domain location=227-249; Score =21.1; E_value=0.0041; Accession=PF00096.17; Description=Zinc finger, C2H2 type
  Pfam annotation: Domain name=zf-C2H2; Domain location=288-310; Score =19.6; E_value=0.011; Accession=PF00096.17; Description=Zinc finger, C2H2 type
  Pfam annotation: Domain name=zf-C2H2; Domain location=4-26; Score =19.5; E_value=0.013; Accession=PF00096.17; Description=Zinc finger, C2H2 type
  Pfam module annotation: Pfam domain module=zf-C2H2::zf-C2H2::zf-C2H2; Domain location=227-249::288-310::4-26
MEKHKCKLCLRSFANGRALGGHMRSHMMNLPVPPKQSELVPIQLSFEAESSPSQSSSSFYGLRENPKKNFRFADPEFSFAAAETSSVILQDRESETESSRNPTRRRSKRAWQQLGGDSGGGGVSDESEKKMMKVFDAVNKNNNESASSVSDTTTEEAVAFCLMMLSRDKWKENNKLLYDNKVEIAEYNDDYDDEEDEDEEEEEDEEIYESEEELKSVKKSNKVRGRYKCETCEKVFRSYQALGGHRASHKKIKLNNCENKNKNNNNNNDDEAEQLEVQHVVVVEKKIHECPVCFRVFASGQALGGHKRTHVIGSSTAAATTTATAITTVSVRNSVATVSVRTTSTARVVGDSLIDLNLPAPMDDDEEEEGNVSQFEDSAVSDAEFVKL

SEQ ID NO: 170321 - protein, 49 aa, Glycine max
  Coding DNA Sequence Number=SeqID_78636
MMVVVIEVVVVVDDGDGDDNNHDNDDYNGGHGVNSIDSQVYHRVNELAS

SEQ ID NO: 170322 - protein, 87 aa, Glycine max
  Coding DNA Sequence Number=SeqID_78637
MFPEQLLPELLEEPLTGLPEASAMSPLSPFFSAFHYYNNDVSYKQRGVRETNLVRGEEEDELRGEEAVRREGEKAVRGEGEEASRKE

SEQ ID NO: 170323 - protein, 32 aa, Glycine max
  Coding DNA Sequence Number=SeqID_78638
MVMHTLGAGLLLHELVSSNCLLLLLVLMVISD

SEQ ID NO: 170324 - protein, 78 aa, Glycine max
  Coding DNA Sequence Number=SeqID_78639
MVSLSLIVIVLCGIWSFERVWGVVKLEISAVKCYLSTKNVLPCNLPEEVHSQKFMEEPSSVIEIFNCGRSFFCEFHAK

SEQ ID NO: 170325 - protein, 154 aa, Glycine max
  Coding DNA Sequence Number=SeqID_78640
MPVPPARSCHRDIGITPTRHPVDPEESDMALGMPVPPSRDSARKTPSGPGEVQQGLRVSSSDYEPLSVLQSARRPNKVIRPLLAGLSSRSTAPSGRRRARHHSSGQQTHRHHLWSSPQLIHKKATKSKAKGKLSTRSVTDKSSCVQLKTLKKRY

SEQ ID NO: 170326 - protein, 80 aa, Glycine max
  Coding DNA Sequence Number=SeqID_78641
MPEYPPISNPSEQQGLPSRSPLPIVGSTWTTGLFAPGGLVTKDRSRVALRVHFNVDEDADGTTGGGGGGGGEAGGVAMVL

SEQ ID NO: 170327 - protein, 54 aa, Glycine max
  Coding DNA Sequence Number=SeqID_78642
ALKGLDDTQQSKSKPTARWIVVKYFTDARPLEPKRLKALCIQWSKYYLKVKNEY

SEQ ID NO: 170328 - protein, 73 aa, Glycine max
  Coding DNA Sequence Number=SeqID_78643
  Homolog annotation: Hit_ID=Q84VI1; Match level="QueryCoverage=95%, HitCoverage=10%, E-value=5e-18, Identity=68%"; Hit description =Envelope-like protein
MATAPKEISAPGSPAVPSSPHQEQPKFNIQPIQIIPGQASVPEKLVPRRQQGVKIAENPSLATGSREVDSGIL

SEQ ID NO: 170329 - protein, 75 aa, Glycine max
  Coding DNA Sequence Number=SeqID_78644
MKRLPEEQIFRKTLGTPLPECFRKMYLFRKHSGRGFFRKSFQWFRKHFPEEPSSGIVPEEVLLPELFRKKYFFRK

SEQ ID NO: 170330 - protein, 154 aa, Glycine max
  Coding DNA Sequence Number=SeqID_78645
  Homolog annotation: Hit_ID=Q6UUU1; Match level="QueryCoverage=77%, HitCoverage=100%, E-value=1e-31, Identity=55%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLRGHSAVMAAFVSFHALTLSS

SEQ ID NO: 170331 - protein, 43 aa, Glycine max
  Coding DNA Sequence Number=SeqID_78646
VAVLFGVAVKIYYEGCLVMRIMKLAKYRLKAQVEKGKGPSGEG

SEQ ID NO: 170332 - protein, 213 aa, Glycine max
  Coding DNA Sequence Number=SeqID_78647
  Homolog annotation: Hit_ID=A9CEW8; Match level="QueryCoverage=100%, HitCoverage=100%, E-value=1e-114, Identity=93%"; Hit description =Putative uncharacterized protein
MREALIVWGGWSGHEPQECATIVKDILEEDGFKVYVEHSTEAFADPSVHDLSLVVPIVTMSKIEKEEIKNLTAAVENGVGIAGFHGGAGDSFRECVEYQFMIGGQWVAHPGNIIDYTVNITRPDDPLMEGISDFPYTSEQYYMHVDPSNEVLATKTFTGDHAWWIDGVVMPVVWKRKYGKGRVFYSALGHQAKEFSVPQMKTMFRRGATWAAR

SEQ ID NO: 170333 - protein, 106 aa, Glycine max
  Coding DNA Sequence Number=SeqID_78648
MWAFLTGRQIDWAHLVRYRMLKALRANAPLPYPQLVTLFLRHFQIPLDDEPFVQVKRSFAIGAGAVTSFGYRKDRNGQWLKKDALPPQDERTPSPPPQNGYPSHTA

SEQ ID NO: 170334 - protein, 54 aa, Glycine max
  Coding DNA Sequence Number=SeqID_78649
MDKSLKVGEDEWREKERRSMKFCVSKELWFSPLIQDQVQDSPLSVLRCHEAYKA

SEQ ID NO: 170335 - protein, 46 aa, Glycine max
  Coding DNA Sequence Number=SeqID_78650
MGLRKRGEWRISLRVRTQAIMKHSSKLESGGHMNNARQNIHGAPKK

SEQ ID NO: 170336 - protein, 131 aa, Glycine max
  Coding DNA Sequence Number=SeqID_78651
MASSSVKCSTGVPASDPCEVLNSSTGVDTGDAYGLTSTITGSASGSVLGTNDSRGGPEVAGTGAEGIGAGALDVWGAVEDGPSDPLALALRVPGKLTMGSMDSKVKESEVTPRAKHKAVMRAGNPSLEELD

SEQ ID NO: 170337 - protein, 130 aa, Glycine max
  Coding DNA Sequence Number=SeqID_78652
MDIEEDADIPLILGCPFMLAASCVVDMGRRKLEMGIEDQKISFDLFDEEKQLLDQNVCLQVKKFEEKVLKGLNSFFEAADEKIFSSPLATRTSCPKRIFLPALSELLLVLSVFFALSPKTSLNFNSFELG

SEQ ID NO: 170338 - protein, 35 aa, Glycine max
  Coding DNA Sequence Number=SeqID_78653
KKSLCRLSRPSSFALISDSVFAMAEGASYGLRRPL

SEQ ID NO: 170339 - protein, 162 aa, Glycine max
  Coding DNA Sequence Number=SeqID_78654
MGESEALLMRFPLQFELDAGVFSQALVAPYPRLYLNSCQQNHRIADMGVQKDMGWEWNLKWRRHLFDSQLNMAARFLCDVEGCHIQSVATCPFAGERRRGSRVRFPKEERCAESPPTFICGKRRKNRRKLVKMKILSSGVVFTLEEGISTSHVCLKGQQPTF

SEQ ID NO: 170340 - protein, 196 aa, Glycine max
  Coding DNA Sequence Number=SeqID_78655
  Gene Ontology: Mol. function=nucleotide binding; Biological process =defense response
  Homolog annotation: Hit_ID=Q6L477; Match level="QueryCoverage=57%, HitCoverage=18%, E-value=3e-10, Identity=28%"; Hit description =Putative uncharacterized protein OSJNBa0009L15.8
  Subcellular localization annotation: CTP_CleavageSite=46; ConfidenceScore=5.02e-01
MKGRRHKYGFNNNKREKAEKIIGSPPASLPPSDASASPSTVKWTRKASRLRSLSTRPPGAERPVVHVDPATGKADDPHRKKLRTYLGIVARDKVDVTYENWKEVPTAQKDLIWEDIQAEFDILEASDSRTKRKLLQTVGERWRQFKSDLTRKWALAADQDGVEDTVCEKYGINKEKWAKFCQTRRDPSREDVRKKA

SEQ ID NO: 170341 - protein, 63 aa, Glycine max
  Coding DNA Sequence Number=SeqID_78656
FYGVPVTPGKVIRSPTNQAFIKKYCAPRQAQGETPQQPGDGWQRATNTPPPPLEFISAHPQNG

SEQ ID NO: 170342 - protein, 46 aa, Glycine max
  Coding DNA Sequence Number=SeqID_78657
MEGQISIAISLDPKDDLVIGGYPSHMVQDEEKCTSYSEWIKNTGVR

SEQ ID NO: 170343 - protein, 298 aa, Glycine max
  Coding DNA Sequence Number=SeqID_78658
  Gene Ontology: Mol. function=nucleic acid binding; Cellular component= chloroplast envelope
  Homolog annotation: Hit_ID=Q9SJX7; Match level="QueryCoverage=82%, HitCoverage=57%, E-value=1e-107, Identity=78%"; Hit description =Expressed protein
  Pfam annotation: Domain name=DUF647; Domain location=36-291; Score =160.1; E_value=5.9e-45; Accession=PF04884.5; Description=Protein of unknown function, DUF647
MAAQGKKEGEAPVLWFETSDSVCCQHQFEPDGRLSVVIVDDSRPLYQRMAGSFMNKFFPSGYPYSVNEGYLRYTQFRALQHVTSAALSVLSTQSLLFAAGLRPTPAQATAVSWILKDGMQHVGKLICSNWGARMDSEPKRWRLLGWAADVLYDIGIGLEVLSPLCPHLFLEMAGLGNFAKGMAVVAARATRLPIYSSFAKEGNLSDLFAKGEAFSTLFNVVGIGVGIQLASTICASIQGKLVSMLHAISLPPEKKVCLFSRMGKNRGENALLGEIFHDWTVDDLSKDLNLCFMIIFSA

SEQ ID NO: 170344 - protein, 80 aa, Glycine max
  Coding DNA Sequence Number=SeqID_78659
MAGLISDNGKIKLLQFRLGCRGPETRAQAQFFESWVSFKGIFQDQTRQSQLRDQHAVPPVKVARATVPNCALHPALAWHV

SEQ ID NO: 170345 - protein, 266 aa, Glycine max
  Coding DNA Sequence Number=SeqID_78660
  Homolog annotation: Hit_ID=Q2V3D9; Match level="QueryCoverage=66%, HitCoverage=78%, E-value=2e-15, Identity=35%"; Hit description =Uncharacterized protein At4g28556.1
  Pfam annotation: Domain name=PBD; Domain location=31-89; Score=20.5; E_value=0.0006; Accession=PF00786.19; Description=P21-Rho-binding domain
MSNNNKVKGLLKGLRFISQIFDTDEKDSEIQISNPTDVKHVAHLGSGSSENDPSWMNEFESVPWNSSAPQNLNGDIHSKRSDNSVQRTSHDSMERGSRSGHSQSEEKDSREFPKSSKRQTKSMGNIRESHAKEKSDRPRPPKKSSKPNSHPNDPCNGDTDSLEQQQQGSDLSPKKSRPKMSKDGSNVGSGSSKSRSKPHHHHHHHHSKDSNSNIKEVHARHSSKSRTKHGSFEEDAQTRNKHGSFEEEEGQFQRRSTENILKSYPN

SEQ ID NO: 170346 - protein, 236 aa, Glycine max
  Coding DNA Sequence Number=SeqID_78661
  Gene Ontology: Mol. function=dolichyl-diphosphooligosaccharide -protein glycotransferase activity; Cellular component=oligosaccharyl transferase complex; Biological process=protein amino acid N-linked glycosylation via asparagine
  Homolog annotation: Hit_ID=A7Q1R4; Match level="QueryCoverage=33%, HitCoverage=11%, E-value=4e-20, Identity=65%"; Hit description =Chromosome chr7 scaffold_44, whole genome shotgun sequence
  Pfam annotation: Domain name=Retrotrans_gag; Domain location=32-117; Score=-0.5; E_value=0.06; Accession=PF03732.8; Description =Retrotransposon gag protein
MPIFEGEDPMGWLTKIERYFRLQAVREEDKLEVVMVAMDGEALGWLQWWESWNLNHSWEGFKIAISQRFQASNLGNPFQALLALEQEETMQEFIGQFEKHVGMAKGLEELFLVEFRLMIMEEEEEGDPIDNQQIKRRKETLADERQAVFPQLDLEDKLLRLGVNLKNFPSSAVPAAYAILFQLGIATVLLLYVLFWLKLDLFTTLKTVGFLGAFLLFVGHRILSHLASTSSKLKSA

SEQ ID NO: 170347 - protein, 912 aa, Glycine max
  Coding DNA Sequence Number=SeqID_78662
  Gene Ontology: Mol. function=DNA binding; Cellular component=nucleus; Biological process=regulation of transcription
  Homolog annotation: Hit_ID=A7Q1R8; Match level="QueryCoverage=90%, HitCoverage=86%, E-value=0.0, Identity=47%"; Hit description =Chromosome chr7 scaffold_44, whole genome shotgun sequence
  Pfam annotation: Domain name=JmjC; Domain location=421-537; Score =147.8; E_value=3.1e-41; Accession=PF02373.13; Description=JmjC domain
  Pfam annotation: Domain name=JmjN; Domain location=175-219; Score =93.5; E_value=6.6e-25; Accession=PF02375.8; Description=jmjN domain
  Pfam annotation: Domain name=zf-C5HC2; Domain location=644-696; Score= 87.9; E_value=3.3e-23; Accession=PF02928.7; Description=C5HC2 zinc finger
  Pfam module annotation: Pfam domain module=JmjC::JmjN::zf-C5HC2; Domain location=421-537::175-219::644-696
MEADYGKDCTKSENRENLSVPPGFTSLTSFILKRDGNVKKSDKSTAFQIASEQEPIFMETIPEMNDISAYRQVLMHRPWIIADQSNHHKLEESHIKHLPMVKLGILHFFWCELGNISLLTLVEYTHPNTYMCDPPLNDGRPKGIIHGCPNCSNCVKVTARWHPEDAIREVLEEAPTFHPTEEEFKDTLKYIASIRSRAEPYGMCRIVPPTCWKPPCSLEKKNIWEKSEFVAQIQRIDGHQLQHAQEIMASASGNTKTKRKRDVKVALDSQLGNRNTSTPNNQNVQKCDCESEPGPKFSLKTLKKYADIFKSQYFDYKDKKKIIGSNIKLAIHQQWEPSVENIEGEYGRIVQNPTEEIKVLCVNTLEAGVFSSGFPTVSDPVEAYTYPEYLKSGWNLNNILSLSGSLLCFESSEASRNFAPKIHMGMCFSPLNWKVEEHHLYSLYYVHLGEPKVWYGIPGKFAINFETIWKKYLPDLQAGQPDMHDNMVMQLSCSILKAEGIPVYRCIQYPREFVLVFPGSYHSGFDCGFNCSEAVSFAPLEWLLQGQNVVELYCEQRRKTLLSYDKLLLGAAREAVRVQWETNLCRKSTSDSLTYKDAYKKNGFLIKALNSRIQSESLKRKFLCTSLVSQRMDENFDATCKRECSICLRDLHLSAVGCSCSDNFACLDHAKQLCSCTWSNKTLFYRYEINNLNVLCQALDGKLSAVFKWAKEDLGLTLNSVASKRSKQSSKNIIGSTHPSQDLQMNEPVSQTASDESSKGKQRQLLDILNSSKTKENEVVPNSSKKKNEVVPNSSKKQNAVVSQVVRTFGGTHSSSYDIRSKMKTTVLQSTFADDKKGINSVGAKIDTKTLGHKFTISKEVGDPKVSKVPSVTNARYLPFLQDNVLADVSSDSSSTSMSSDSEDEDVQVANG

SEQ ID NO: 170348 - protein, 161 aa, Glycine max
  Coding DNA Sequence Number=SeqID_78663
MALNRTMDSSLVGEEEEVDLRGSDGHVSEVFVNGDGDEGIKVFVEELGLIMGAGDDVPIVATHEPELGGHQREGLVLGIGVVRVRQGFHKVGEAKVRRWSSRGGWNPNFSPPKRARYGRMPSWGVITSTSLASPKTIIETTHSSSLPAASSPNLSRTITTT

SEQ ID NO: 170349 - protein, 80 aa, Glycine max
  Coding DNA Sequence Number=SeqID_78664
  Subcellular localization annotation: CTP_CleavageSite=22; ConfidenceScore=5.25e-01
MSGRIQRQRPIKVNGNAATVCRAMSFPAFRFSPPGHHFCAFASILSVFGHSIQLVEVRISAKIKDLDLGIQAFGFGCKKT

SEQ ID NO: 170350 - protein, 175 aa, Glycine max
  Coding DNA Sequence Number=SeqID_78665
GGLLAGLKHVLTSGRKVRNKPIRRGPEYSKRLLALFFIMGGMDECMKKCDTDPPSVRDKVMGSRRNSCMMQMQKRAQHGDVHSIIPFDKHITTVGTTSNNMLSKRKTLDEGSLLSSKSETQHDHRFTSTPYVPMDPGLTGAPSMGGKCMESPPTFIRGKPSEKPDMCGLRTLSVK

SEQ ID NO: 170351 - protein, 74 aa, Glycine max
  Coding DNA Sequence Number=SeqID_78666
DRARKTPSGPEEVQQGLRVANSDYGPLPPTNQAFIKRYCAPRQAQGETPQQPGDGRQRATDALPPPLEFTSAHP

SEQ ID NO: 170352 - protein, 72 aa, Glycine max
  Coding DNA Sequence Number=SeqID_78667
MKNLEVQVGQLAKQITDKSSNSFVAITEQNPKEECKAVMTRSKRFVEAEDEDSVVHKKKTADKKGTDDKKNE

SEQ ID NO: 170353 - protein, 78 aa, Glycine max
  Coding DNA Sequence Number=SeqID_78668
MGVVKYMTIDELKRLSIPSEMLKFFNHSSFPHKGHPTRKISMQQGHAYILVARFPDPNYGVKTGFSKEAQKHTMVVLK

SEQ ID NO: 170354 - protein, 108 aa, Glycine max
  Coding DNA Sequence Number=SeqID_78669
  Subcellular localization annotation: CTP_CleavageSite=42; ConfidenceScore=5.18e-01
MQYLGSDPRSSPNKQWLQGFIPNQFNHFVATYPLAGGRRETRGMRVPRKEYARSRHQRLFEENVGKTGKDAIYELLSERFGSCIYARGRVFPFAPTYSSIWDEKIRPT

SEQ ID NO: 170355 - protein, 134 aa, Glycine max
  Coding DNA Sequence Number=SeqID_78670
  Homolog annotation: Hit_ID=A0ST23; Match level="QueryCoverage=18%, HitCoverage=51%, E-value=3e-07, Identity=100%"; Hit description =Putative reverse transcriptase
YNNPSRCTSTCITKDVPSNVFRQRILKREESKEFSDRVLLNSLDQAYRYRRPRGGARYQLLFPLVRVNFELGVIMVIAVSFGKPVVPAALMNRPTRGERRFAYWALAECILAYYVGTDEGVSEVLHVAEKKAAP

SEQ ID NO: 170356 - protein, 23 aa, Glycine max
  Coding DNA Sequence Number=SeqID_78671
MKKIQGLQAPHGATSYEMMFVFA

SEQ ID NO: 170357 - protein, 59 aa, Glycine max
  Coding DNA Sequence Number=SeqID_78672
MTLRQHGLSPWIIFINEVLCFLKINGSGMEKKKYDWRCHFKEKMSQEQAHHHKKPWIRV

SEQ ID NO: 170358 - protein, 206 aa, Glycine max
  Coding DNA Sequence Number=SeqID_78673
  Subcellular localization annotation: CTP_CleavageSite=42; ConfidenceScore=5.04e-01
MTYEDLLPSLIANHFGRGNSRKGSSNPLFPKWDRPNVRTNPLANHGGGAVNAVESDRPHRSKPLRDVATPRRFIFEALQKGGVIPHSGCKEDSCLLHSGEMHDMETCLEVEELLQRMIDQGRLEVNIEGKEEQHICMQSTEGSGDAKPKPLVIYFTKSAASQKPGHPLMAKPVPFPYQNSHAVPWRYTPPGKKEEEVTDVSSLSAK

SEQ ID NO: 170359 - protein, 98 aa, Glycine max
  Coding DNA Sequence Number=SeqID_78674
MASRKRRIIGIRPTSQYDTRRFSSLDAWTRYTDNVLGRNILPERKVELYHTELDDFKAELERCNFYKHLTNLADGSIDLDLVKEFYANLYSSEDRPPK

SEQ ID NO: 170360 - protein, 123 aa, Glycine max
  Coding DNA Sequence Number=SeqID_78675
MVKVGTSYVPINVSFSPKVGPGLPGSTVWCTRIYLRLPIKLIAIPCSSCSATDVLSVNSAHKHTSRTSKCKAGVHADANHHINAAATLPLSIRKPCRCATVDGRAIEAGLCYYGRKGGCVHTA

SEQ ID NO: 170361 - protein, 121 aa, Glycine max
  Coding DNA Sequence Number=SeqID_78676
  Homolog annotation: Hit_ID=A5AFD9; Match level="QueryCoverage=90%, HitCoverage=11%, E-value=4e-09, Identity=35%"; Hit description =Putative uncharacterized protein
MALYPKGEPSPKPLLTYSRRSTTNENQQTEPQGPPRDNSLAADPVEEPEPAHPRRSSRIIKPPDRYIHSMTALLSSIPIPSSYSQAMKNACWQKAIEIELLALEENQTWDIVPCPTSVKPL

SEQ ID NO: 170362 - protein, 632 aa, Glycine max
  Coding DNA Sequence Number=SeqID_78677
  Gene Ontology: Mol. function=beta-lactamase activity; Cellular component=cell wall; Biological process=beta-lactam antibiotic catabolic process
  Homolog annotation: Hit_ID=A1G0F3; Match level="QueryCoverage=45%, HitCoverage=58%, E-value=1e-141, Identity=82%"; Hit description=Beta- lactamase precursor
  Pfam annotation: Domain name=Beta-lactamase; Domain location=67-501; Score=125.6; E_value=1.4e-34; Accession=PF00144.15; Description=Beta- lactamase
  Pfam annotation: Domain name=Peptidase_M15; Domain location=502-632; Score=-18.5; E_value=2.9e-05; Accession=PF01427.8; Description=D-ala- D-ala dipeptidase
  Pfam module annotation: Pfam domain module=Beta-lactamase::Peptidase _M15; Domain location=67-501::502-632
DYEPQDSIGTPNPAVPLRHRLPVTALCAVDRDMGLLKPARQARNCVCAAALAVFPVAVAQTTATASLDADVATVVQHEHLPGLAMAVVDNGQVVYRHAEGTRGDGGRIDQDTLFKIASNSKAMTAALLARLVQQGMLRWEDPVQQHLPGFRMHDAWVGEQMQVRDLLIHNSGLGLGAGDLMLWPEPNAFTRADIIAGLAHLKPVSSFRSRYAYDNLMYVVAGEVAAAAGGKPYDQLMREQRVGNVAQPHARRGDRNNKVVNADGAISPDQPSMAAGGIRCSLRDMTRWMQVLLDPALVPEWLGAEQRRTLWTLHMPMPLGERQRRWDNAHFYGYGYGWRVSDMDGQWKGGRGDADQRRRRGCAHRADAGHAEALHRTRRCTPGDGIPGRTEGGPGRSCGNRASATCDFICAATRGFRSAALAGPLRRSLAGPGLAVPGQGRPALQRRQVASAAGGRAEVAGALAAALGYAWRRSAGVVAARRGPATASAAEPPRVSPATDAASAGLVEIRALSPGIDMDIRYAGANNFTGARVPGYEASSCYLLAPVAKALAEVEQDLRADGFGLRLYDCYRPVRSVQAFMAWVNDPRELSRKAQQYPDLDKSRLLADGYIAERSGHSRGATVDLGLLDCRS

SEQ ID NO: 170363 - protein, 342 aa, Glycine max
  Coding DNA Sequence Number=SeqID_78678
  Homolog annotation: Hit_ID=A5B5G7; Match level="QueryCoverage=62%, HitCoverage=15%, E-value=6e-08, Identity=25%"; Hit description =Putative uncharacterized protein
MEEKGPCLRISGRFDRSRFTSQEAYDRYSDIVIGRKILHERNVMIYHTEFDEFKAELKKRILHKELTNFMDGSIDVVIVKEFYANLYDPKDKSPKQVRVKGHLIKFDEDALNTFLKTIVIIEERDSLPAYSRFCRLRPNPQELAARLSIPGRGFELNEDGLLLKILRKNLTTLTQTWSILSFSNLAPTSHTSDITLDRARLLHGIIQKMDMNLRYIISSQISMIAQHDSSRLGFPALITTLCKAWGLTSDSLSFESLSPTINLAYMKKNCWNLDDPSVTFRGPRKAKGKRSETLPSSDIPPSAAPSTTVLTSSTASASAPLPALIAAPSTGPSSFTSKTLYA

SEQ ID NO: 170364 - protein, 159 aa, Glycine max
  Coding DNA Sequence Number=SeqID_78679
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=3e-25, Identity=55%"; Hit description =Putative uncharacterized protein
  Subcellular localization annotation: CTP_CleavageSite=30; ConfidenceScore=5.55e-01
MTMITPSSKLTLTKGNKSWYRAPPRGRRIKQKSKGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 170365 - protein, 454 aa, Glycine max
  Coding DNA Sequence Number=SeqID_78680
  Gene Ontology: Mol. function=transporter activity; Cellular component= integral to membrane; Biological process=transport
  Homolog annotation: Hit_ID=A8GBJ5; Match level="QueryCoverage=12%, HitCoverage=13%, E-value=1e-16, Identity=81%"; Hit description=Major facilitator superfamily MFS_1
  Subcellular localization annotation: CTP_CleavageSite=71; ConfidenceScore=5.22e-01
MVTTEFVPIGVKTNIAPSLGVSTGTAGLMVTTPGIVAAVAAPGLSLASGRLDRRLPCWDCRQLPDDAAGPRAAGRLRRRLLVVRRQLRPPSGAGSQPGPRHRADPQRHIGRRGVRRAGGGADRRSVRLARRLLRRCGAGGRRTVGAAAFTHVGTAFPAGYAARSGAAAAPADGAHRPDRHRAAVHRPLRRLYLSAPSAATGVRAQPIGDLAAAAGLWRHRPAGHLPRRAPGGTQPARHLYPDRRHAGGYSDRFAAAQRPRRRHADGVGLGVGVRRRAGMRHQLDVRRGAAGAGSRPGAAGVRHPDRTGLRRTAGRRGGGLAGRQQRHAVRRRADPLRHAETCPGHCRGMTLGTYGPSFARYPESGGSPADQAVPAHHPQRVGHPRRRMLLPEYGEMAGGFGADGGLSDRVTEFSAGRAAHRYRQRHRPPAAVAGTARLFGTLPANPDRSQHRRS

SEQ ID NO: 170366 - protein, 234 aa, Glycine max
  Coding DNA Sequence Number=SeqID_78681
  Gene Ontology: Mol. function=protein transporter activity; Cellular component=membrane; Biological process=protein secretion
  Homolog annotation: Hit_ID=A3RNS1; Match level="QueryCoverage=91%, HitCoverage=47%, E-value=3e-52, Identity=53%"; Hit description =Acriflavin resistance periplasmic protein
STLEDPQLRSTPAEKGARPGESTDKNPAKKGGKPLFVSVEQVKPGTIHVYHQALGNVTSFATVAVKSRVNGQLTAIHFREGQLVKAGDLLARIDAKPFEAQLAQIQGQQLKDKALLSNALADLDRYQTLLKQDSIAGQQVDAQVSLVQQYKGAVLSDTGAVENAQLQVAYTRIVAPISGRIGLRQIDGGNNITTADTLAVINQISPIAVTFTLPENMAQEVSRLLDQRTHSGLP

SEQ ID NO: 170367 - protein, 68 aa, Glycine max
  Coding DNA Sequence Number=SeqID_78682
  Subcellular localization annotation: CTP_CleavageSite=36; ConfidenceScore=5.17e-01
MVLVAAIKAALTSIISFMLIMASITVDICSFKAFVLAFTYSCTSSTSPITLARVRNGFMIPIWLAHGT

SEQ ID NO: 170368 - protein, 114 aa, Glycine max
  Coding DNA Sequence Number=SeqID_78683
MEHFLEQAAWPEAQLPLVRPNEAALPEPTPVQVNLEPSNPQSPVVNPPSSPELEAVPPSPPLIVISDASSDEVAAPPDSPATETADPPVSPIGGIVDLFDSSSREVVALTDSPI

SEQ ID NO: 170369 - protein, 196 aa, Glycine max
  Coding DNA Sequence Number=SeqID_78684
  Gene Ontology: Mol. function=endonuclease activity
  Homolog annotation: Hit_ID=Q2HUP4; Match level="QueryCoverage=86%, HitCoverage=57%, E-value=2e-59, Identity=68%"; Hit description =Endonuclease/exonuclease/phosphatase
MDEPSALSRKSEKAFDSQRKTLLNLYDMDQLRNNVNARSLPGSNVLYGSSTVSKEQGPLHHRPNVVKSKQGFPHFRERVWVKKLVHDRRIHFGTWNIGTLTGKSMEIVDVMVRRKINFMCLQETKWTGEKAKELDNSGFKLWYTGKIRSRNGVGIIVDKEWKKDVVDVRRVGDRIIALKLVVGQDTFNVISGYAPQ

SEQ ID NO: 170370 - protein, 189 aa, Glycine max
  Coding DNA Sequence Number=SeqID_78685
MDNHSWCYPACVQCHRKTDIQTGPFTCGCGKDNDQPVLRYRVEVMVTQNNESSKFLLWDRECVELIGETADDVNRVKIKLVDLSCFWQDGDLDLNASPQALYKLLGHVLAFKACSKIDPSNVDCNNTTHAECQSLSVTADHDPVVGFPLTTKKRMSSDEVDDELRSSQISPAQLSSNKLTRHSHKSQFS

SEQ ID NO: 170371 - protein, 141 aa, Glycine max
  Coding DNA Sequence Number=SeqID_78686
  Homolog annotation: Hit_ID=A5BP71; Match level="QueryCoverage=53%, HitCoverage=19%, E-value=1e-09, Identity=42%"; Hit description =Putative uncharacterized protein
  Pfam annotation: Domain name=zf-CCHC; Domain location=114-131; Score =17.9; E_value=0.003; Accession=PF00098.14; Description=Zinc knuckle
MKDKYIVQSLLKNLEKIKNKLVRTSFACMISTPQACGYVSMNYYQYIDVFYTNEHILKAYSAQWWPLGNEATIPPSDDAWTLIPDPTTIRAKGRAKSTRIRNEMEWLEPSEHRQNCSRCGAEGHNRRRCPMQSDRGSNSFN

SEQ ID NO: 170372 - protein, 168 aa, Glycine max
  Coding DNA Sequence Number=SeqID_78687
MYEYLEEERVPDLESILADFMTYQASSKGSCYGMQQQGTQFQRNQSPVGYHWESCWQPDYDNKVEGVINLDDLLMQFKDTIESMQQAFRRTATQISKLVDDMANTAARQEEERVEIETYQESIFQVTSMHHQMPLQRKLSEVSSTPEYSCSAAAGYVRGTEKGDWNSL

SEQ ID NO: 170373 - protein, 89 aa, Glycine max
  Coding DNA Sequence Number=SeqID_78688
MVVILRKENLIVWFCSLHNRPANYIKGIINSALKGLDDTPQPNSKAGARWIVVKYFNDVRPLEAKRLKALRIQWAQFYLKVRMLGNLGC

SEQ ID NO: 170374 - protein, 1030 aa, Glycine max
  Coding DNA Sequence Number=SeqID_78689
  Gene Ontology: Mol. function=DNA binding; Cellular component=nucleus
  Homolog annotation: Hit_ID=A5B9Z2; Match level="QueryCoverage=62%, HitCoverage=30%, E-value=1e-132, Identity=45%"; Hit description =Putative uncharacterized protein
  Pfam annotation: Domain name=HSA; Domain location=871-931; Score =16.9; E_value=0.0023; Accession=PF07529.4; Description=HSA
MLNSRIRRPLCPRFLEKRWCYPWSPLHKSQGASGKEAHTKKIERKHKSHIPKALIGKNLKEADGKKNWMTSTMPPSSANSSGNTKYSMSLKDWTRTPSSPSSVKELSLPDSNTLVNKFVDWKQHQRGTKLPSRLPKLATFDSLKLFPRLKFAATCWFPWPTRDRSGAPFSKTLGERNFALKRPLGALRLCPGFQLRYPFVDSGAFLASIVVVLAFSYVPVETLGSCKLGEFMEMGAAPSIVVVGGSRCTCKDTAALKLVCVLGGLCITLDPLPEGLVPIIVARMRCLVNKVEWRGMEWKGKLGMNGYKSGSALLVNAEVDSMGGVVDGGVGIGLKISPCRAAIEKAQAELREEYDVREERRRELEFLEKGGNPLDFKSGNAASVSVQSTSLTDQPHEQFVSSEAKGSFALTPSPHGDSVDSSARPGAPLASEPNTADNLLLFDGENELPETERRCLHSNRRNNIALSEQSSQIDGNLNAKETEDSAIFRPYARRNRSRSGHGPRGASREVKGLMSETNSQKNLNLTTLSKPKLSSLNGDVGTKNLITNNTLNNELVGIRDHQSTSGNASVPEDKLDITVNRSLKENHGTLPSEDNTVQNPVLMAFGEVNIVELRDPVAVVNHEPPPHVPTTKPENGPYCQPNGFGNVEVDRKSALNEGQNSNATLGKNNFDLESSCTQTSLVRDVNNDSDMCTNTKNVDANGNTMEQTFALKNKLNSADCEVVKGRHKTKNVNGATVSNVNDAGYQNHSGCGNITKAEEDVHINSSCMSNIKGVHHNDSNISKTDKDTVYVDQSNSVKETSCERHEVPVDVSLSEPPQTAPAEKVTSAATDDQPCPTHNMKLADKAREDSILEEAKIIEAKRKRIAELSLRSLSTQNCRKSQWGFLLEEMAWLANDFAQIAAAAQLGHQTAFTCQSRFEKLNKQLGTKILSHRIAKAVMQFWHSAELLLDNDLGINCIVGCVESGKVDANEALRDQRRNSNMIFMGLGLLMGLIIRGGNELSSLSRAFNSAYVRLGSAWLVYYKGQAQAF

SEQ ID NO: 170375 - protein, 1249 aa, Glycine max
  Coding DNA Sequence Number=SeqID_78690
  Gene Ontology: Mol. function=DNA binding; Cellular component=nucleus
  Homolog annotation: Hit_ID=A5B9Z2; Match level="QueryCoverage=92%, HitCoverage=55%, E-value=0.0, Identity=44%"; Hit description =Putative uncharacterized protein
MAASLLLTNWLDASEETSKFLEGQNPAKHAALKVHAYALRFLDANRSQGISSQAEAPTTPEKIFDSSTVDMSWDEHLNEENLFYEVPPTAMETYRKAIESHFLQFEKTGSSIHEEIEMSVYDTAAEFGSQENAYDEEEGETDTYYMPSVYEGNKSSKSAQKKHKNLKAYTPRCGDAGADLPYVHYATGNQPSMLFGKRPASVNVGSIPTKRMRTATRHRVSLPLSAVADTRVWQQKDQSKKRVDSHHFESNGSLCGQPNAKKPKIIRQSLDNPFDNIVPMTNSIPSPAASQMSNMSNPNKFIKIISGRDRARKTKALKISAAQPISGSPWSLFEDQALVVLVHDMGPNWELVSDAINSALQIKIFADNDILQHFQCVFRKPKECKERHKTLMDRTTGDGADSAEDSGSSQSYPSTLPGIPKALYLDALGSARQLFQRLQGPMEEDTLKSHFEKIIKIGQKQHYPKNQVDNLDSKQLAPVHNSHAIALSLTSPNNLNGSILTPLDLCEAEEINPDVPALGYQSSHPGGMTLPNQGFVPSMLPTSGVNSSLPGSSSGMVLGHNLSSSPGPVAASVRGGRYGIPRNSPSSVDEQQRIQYNQMLSGRNIQQSMPVTGTLSGSDHGVRMLPGGNGMGLMGGINKNMAMRPGFQGMASPSMRNSGSMLSSSMVGMSSPVNMHSGVGTVQGNSMLRPHENLHMMRPGHNPEHQRQMMVPELQMQVTQGNSQGIPALCGPSSAFSNQTTPPVQPYPGHAQQPHQLPQQQSHLSSPHLQGPSHATNSQQQAYAVRLAKERQLQQRYLQHQQQLAASNALMPHVQAKSQLPISSSPLQNSSQVQPQNSPQQVPLSPITPSSPLTPLSSQLQQQKLHHAQPGFSRNSTASGLTNQAAKQHPRHPPQRPQQQYQQPGRQHPNQRHNVQSQQQAKLLKGMARGNMMVHQNLSVDTSHLSGLSLPAGSQTGEKGDQILHMMQGQNLYPGSGLNPNQPSKPLGHAFSSNHSQLQQKLHSGSPTTSSKQLHIPSDTSTQGQVSPVSSGQLLSPPQPAVIASNHHQLQPQVQSKKINQTQTNVKRMLPQNHYEHSMSSSKSLSDQSQSDQLPANSASQVSAMTEGCMDSASVVPGVTTAVSSQWKASEPPFDSAMNNQTQESSLGSAPVENSTGNEQPTISQGLGPRSVSLISQAHNSDTQSQSLQQSSQPILSQQPYPAEQQQQQEQEQHSPKDLALQHQPQQHMQHLQSGQSSLFIQSPNSIVE

SEQ ID NO: 170376 - protein, 287 aa, Glycine max
  Coding DNA Sequence Number=SeqID_78691
  Gene Ontology: Mol. function=DNA binding; Cellular component=nucleus; Biological process=regulation of transcription
  Homolog annotation: Hit_ID=A7QAD5; Match level="QueryCoverage=93%, HitCoverage=92%, E-value=3e-51, Identity=46%"; Hit description =Chromosome undetermined scaffold_70, whole genome shotgun sequence
MATPPNDAASTKKPQPIPWTHQETVHLIRAYQEKWYALKRGPLRHNQWEEVAVVVAARCGYDLAHPAKSALQCRHKMEKLRQRHRAEKKQQHSAADALRPGAWQYNALMDDLERGPLPISALAPLYSDEEEDEDDDDAIDDQYDNDGDEGFINIKSKSINCILSERPVRMRSNDRGFLREHVVVVEEEEEEEEEEEVEEEEENENEDDDVLGLSMEMRVFAERFIGMESLKMEMMKETERCRLEMEKKRIQMILESQRRIVDSIGMVLNCGCDCGFIAILDIVGKCG

SEQ ID NO: 170377 - protein, 330 aa, Glycine max
  Coding DNA Sequence Number=SeqID_78692
  Gene Ontology: Mol. function=3-oxoacyl-[acyl-carrier-protein] synthase activity; Cellular component=mitochondrion; Biological process=fatty acid biosynthetic process
  Homolog annotation: Hit_ID=Q8L3X9; Match level="QueryCoverage=34%, HitCoverage=34%, E-value=2e-16, Identity=68%"; Hit description=3 -oxoacyl-[acyl-carrier-protein] synthase, mitochondrial precursor
  Pfam annotation: Domain name=Ketoacyl-synt_C; Domain location=184 -253; Score=26.7; E_value=2.3e-08; Accession=PF02801.13; Description =Beta-ketoacyl synthase, C-terminal do
  Subcellular localization annotation: CTP_CleavageSite=20; ConfidenceScore=5.71e-01
MATSLSIFSSISQHSLHCQSASIISPSFFPLFLSSNPYFLSPRATTPSPSAPNHKMASTPFPPTTTSTSSPSVQAATGSEPLTWPPTMALLSPSASFLSPLSPPKPSEVRVADPTFLGYFIDKGVATTAKVVLKAHPQEKVGVFVRRGKGGSLNVVEYSELEQSLASAVNQEFEHAKIRGAKIYAEVRGYGMSGDAYHITQPPSDGKGAILAMTRALRQGAIGHLLGAAGAVEAIFVVLAIRHGIAPLTPNLTKPNPVFGDGFMPLSALEEMPIRVAMSQSVLNIFRKNDRSHPAQDVAAQISTLLYNHGGCTSSVPSPRLKSYFVSFGT

SEQ ID NO: 170378 - protein, 114 aa, Glycine max
  Coding DNA Sequence Number=SeqID_78693
  Subcellular localization annotation: CTP_CleavageSite=36; ConfidenceScore=5.36e-01
MRVHGYQASRRPDMTTDSPPPGMFPRTQSPVESPTVATYPSVGGRRGAHMCVFQERKMCGVATNVYLRKTLEKPEKEVSLVIKMVLVVKVLASQRSLLRKLLKEAMRKLLEEAS

SEQ ID NO: 170379 - protein, 88 aa, Glycine max
  Coding DNA Sequence Number=SeqID_78694
  Subcellular localization annotation: CTP_CleavageSite=69; ConfidenceScore=5.52e-01
MTMTRSMKSTISTKRSGTNFVKSVETFHGRCSNPTSAPNCASSIKRLIPIKHRPQIPLVGLNSTRTTLRQTYKQLGYRTPILRDNTIN

SEQ ID NO: 170380 - protein, 60 aa, Glycine max
  Coding DNA Sequence Number=SeqID_78695
IVEAKEHHLDEDTLIPHEVAPLELIMAVEWRRKKDDWRRHFKEKMSQEEVHHHKKPWIRA

SEQ ID NO: 170381 - protein, 232 aa, Glycine max
  Coding DNA Sequence Number=SeqID_78696
  Pfam annotation: Domain name=Transposase_23; Domain location=33-103; Score=6.2; E_value=0.00025; Accession=PF03017.5; Description =TNP1ENSPM transposase
GLALPPEPKVGPLAARVSTKESYVDPSGNDPDTGDSDKCKLYINEYPPRLVALGRVYEGSTIVHNIPLLHDQVKVGVEEVSDADAPILVPTKEVKVIGQTLNTFLSWPTHLVKRLSEQGAVGPTKPANRSNHEVDGPLYLLTLTIPQLFLKPLQVMWDATLFGMFNEDFPLYIKHEDPSEIAHGGQCLNISVIQLWIMPDNYLKGIINSALKGLDDTQQSKSKPAARWIVVK

SEQ ID NO: 170382 - protein, 102 aa, Glycine max
  Coding DNA Sequence Number=SeqID_78697
MADLEICKQIYTPQQYHKEIRRKRPQYRPPNKQPSKKKNPTSRYSIRAFNSRKPTLNKERHVGKLRDNKHIQRNKNVMLAINQDITPEIVQTKPIYLQEKQN

SEQ ID NO: 170383 - protein, 17 aa, Glycine max
  Coding DNA Sequence Number=SeqID_78698
MDWRLTLILASSAAERR

SEQ ID NO: 170384 - protein, 69 aa, Glycine max
  Coding DNA Sequence Number=SeqID_78699
  Homolog annotation: Hit_ID=A7QFF8; Match level="QueryCoverage=40%, HitCoverage=31%, E-value=6e-08, Identity=96%"; Hit description =Chromosome chr8 scaffold_88, whole genome shotgun sequence
MGAGHARSRYLNRKEGDAEGRASDWSEVEREGWGSLAFGIAGPGGRPARRAISSVVERAPDNCVVVPGL

SEQ ID NO: 170385 - protein, 157 aa, Glycine max
  Coding DNA Sequence Number=SeqID_78700
  Homolog annotation: Hit_ID=UPI00016621D1; Match level="QueryCoverage =71%, HitCoverage=38%, E-value=6e-10, Identity=36%"; Hit description =UPI00016621D1 related cluster
TLTFGGLYVPPFRGLHALTFIGLHALTFSGLDFLAFRGLQVLAFRRSCTFTFRGLHILAIRRLHVLAFRGLHVLTFRGLHVLTFRGLHALTFRGLHPLIFRGLHVLTFRGLHVLCPATVMPISPCGSISWSVSSRHDSTQRLASSSAPFVNHGQRAR

SEQ ID NO: 170386 - protein, 178 aa, Glycine max
  Coding DNA Sequence Number=SeqID_78701
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=8e-19, Identity=31%"; Hit description= UPI00006A17C9 related cluster
  Subcellular localization annotation: CTP_CleavageSite=92; ConfidenceScore=5.73e-01
MARTCSPLKARACSPLKMRTCSPLKVTTFSPLKVGTCSPQKARTCSPLMARTCSPLKARACSLLKMRTCSPLKVRTCSPLKEGTCSPLKARTCSLLKARTCSPLKVRACSPLMARTCSPLVRPFEGEGVQLSDGEEVYSSEGEGIPLMVRTCSPLKARTSSPLMARMCSPLKEGHAAL

SEQ ID NO: 170387 - protein, 146 aa, Glycine max
  Coding DNA Sequence Number=SeqID_78702
MAKFDPDIVLEFYANAWPTEEGVRDMRSWVRGQWIPFDADALSQFLGYPLVLEEGQECEYGQRRNRSDGFDEEAIAQLLCIPGQDFARTAAGRRVRIMRTNMTTPPFVTMIRESGGMRSHMTVGSPNSHVPSFIICMLSYFYDLRD

SEQ ID NO: 170388 - protein, 161 aa, Glycine max
  Coding DNA Sequence Number=SeqID_78703
MDIRMFSLLQLDVQSTLDVFVLLEPVSPSRDQLEESITEKVTRQLMASFSQMQSQFQSQMQSHGIALPSEPPLGPSGPRVSTKESCVDPLGNDPETGDSDRCSLYIEANPARLVALGRVYEGSTVVHNTLLLPSQVKVGVEEVKDLDAPVPVPTDEVSLVG

SEQ ID NO: 170389 - protein, 203 aa, Glycine max
  Coding DNA Sequence Number=SeqID_78704
  Homolog annotation: Hit_ID=UPI00006A2D9E; Match level="QueryCoverage =42%, HitCoverage=45%, E-value=8e-07, Identity=20%"; Hit description =UPI00006A2D9E related cluster
MTGPLNESISCFLKRVDPWVLVPSPSQDYTSSPSEGCTPSPSEGYTPSPSEDYTSSPSEDYTSSPSEDNTSSPSEDYTSSPSENYTSSPSEGCMPSPSEGYASSPSEGYMHALKGLRVLTFRGLHALTFRGLHALTIRGIHVLAIRGLHVLAFRGLHALTFRGLHVLTFRGLHVLAFRGPHTLSFSGLHAFAFRGLDALTFKG

SEQ ID NO: 170390 - protein, 48 aa, Glycine max
  Coding DNA Sequence Number=SeqID_78705
MPPPPPPHLWDTGLPCSDVLRWPSAGKGRRLVGRDPILHLHPCLSTCK

SEQ ID NO: 170391 - protein, 79 aa, Glycine max
  Coding DNA Sequence Number=SeqID_78706
MVNYGSAKVSQNALLQASETRLTGALSKGGKMRGVATNEGISTSHADKSRTLAPTYPPLKRKSDLRSSFLRVNQAILFT

SEQ ID NO: 170392 - protein, 128 aa, Glycine max
  Coding DNA Sequence Number=SeqID_78707
MASVLKGVDDRVGTTTSTPCAPGAVAAAHPAEIHAVRPAASAAATGAELAVPPGVGGWRSGISRIALAEDRSSRSGATLVYDGRKRQTGGQPARRSGRQLQRRRQRSDPDRGAQARSGYAVLSASAAD

SEQ ID NO: 170393 - protein, 335 aa, Glycine max
  Coding DNA Sequence Number=SeqID_78708
  Gene Ontology: Mol. function=motor activity; Cellular component=cell projection
  Homolog annotation: Hit_ID=P15305; Match level="QueryCoverage=92%, HitCoverage=95%, E-value=3e-22, Identity=22%"; Hit description =Dynein heavy chain
MRGTVHKPRANLGEDQKSSPSEGLHALAFRGLHTLNFRWLHAFAFKGQHVLTFRGLHVFAFRGLHALAFRGLHVLAIGGLHALTFRVLHILAFRGLHIPAFRGLHVLPFRGLFVRTFRGLHVLAFRGLQYLAFRGLHAVAFRGLHVLTFRWLHALAFRGLHVLSFRGLHVLAFTRLHVHAFRGLHALTFRGLHVLTLRGLHALVFRGLHAVTFRVLHAVTFRGLHVFAFRGLHVLAFKGLHALPIRGLHALTFRELHVLAFRGLHLLAFRGLHILTFRGPHVLTIRGLHVLAFRGLHVLAFRGLHVLTIRGLHVLAFRGLHVLTFRGLHALAFRR

SEQ ID NO: 170394 - protein, 106 aa, Glycine max
  Coding DNA Sequence Number=SeqID_78709
MDVWGANTFPIASFPVFRRFPQITVGGDSACIPFVEHASRESRVALPPKGRLRHEEFFGLGGRDPESVLSAFNWNVLQPMLQVYRVGFKDSISCLPLPTSPRSLLV

SEQ ID NO: 170395 - protein, 100 aa, Glycine max
  Coding DNA Sequence Number=SeqID_78710
MEAMKEKMATMMEANISMKEIMEAKIWEVGMAPMMCKFKTSMPSRHMACLPTVHHPMWRTLPVRMSITPLLYPLRANNPKLIMHMSLKPWGRHMKCPTTI

SEQ ID NO: 170396 - protein, 73 aa, Glycine max
  Coding DNA Sequence Number=SeqID_78711
MVRLGDRLRQVRWRLWILALGIPCIESLPSSESRQRVPQMERWCKYRNVLNYTITLLVFILRKVFMSSVKGKM

SEQ ID NO: 170397 - protein, 49 aa, Glycine max
  Coding DNA Sequence Number=SeqID_78712
MITKDDDKGDDKKLKESRIKFQESRFKRSRFKTQDSRIKRRLNQDKYEK

SEQ ID NO: 170398 - protein, 195 aa, Glycine max
  Coding DNA Sequence Number=SeqID_78713
  Homolog annotation: Hit_ID=A5BH93; Match level="QueryCoverage=50%, HitCoverage=10%, E-value=1e-12, Identity=40%"; Hit description =Putative uncharacterized protein
DAHAKVEYVKKLHKQVKAQIAKKTESYDKQAKKSKKKVVLEPGDRPFQVLERINDNAYKIDIPEGGNDENPKAAQIQGPMTKGRIKQLEDTIQQMVAAILDKCSTKILVYSLFQIGITCFYMGVVLPESASGRQEAPFTLKKRNQEKLLAYKGVGMSPPPLGFSQSLKNSLISLKDENLAPCSAICSLKFTLFRL

SEQ ID NO: 170399 - protein, 188 aa, Glycine max
  Coding DNA Sequence Number=SeqID_78714
  Subcellular localization annotation: CTP_CleavageSite=46; ConfidenceScore=5.83e-01
MARGPSKASTTTPSFASSPAPVPLTSLPPPSVPAPVGTSTQSSDLMVSMLQSLHHGLCLVMQSIHDLAQHRPIISMEDFMEQVAWPGVQPSPLGRGEASATQEPQPQHQPDIAHEAMPEMTPRTSPVIAPVMEVSEDEKGIEDTDYAADLEVAQSTWDPWPTAAQEILQPAQDTPYSPQGEQTPARDD

SEQ ID NO: 170400 - protein, 266 aa, Glycine max
  Coding DNA Sequence Number=SeqID_78715
  Gene Ontology: Mol. function=metalloendopeptidase activity; Biological process=proteolysis
  Homolog annotation: Hit_ID=Q40983; Match level="QueryCoverage=81%, HitCoverage=20%, E-value=3e-92, Identity=68%"; Hit description =Metalloendopeptidase
  Pfam annotation: Domain name=Peptidase_M16_C; Domain location=27-223; Score=3.8; E_value=0.0069; Accession=PF05193.12; Description =Peptidase M16 inactive domain
MMNTIEYRVDCQLSIRFPIGLEEQIKKWDADKIRKFHERWYFPANATLYIVGDIDNISKTVYHIENLILVTHAIFGQTGADNKKGSIATPCAFGEMASFLTPKLSVGLGGNSIERSANATDQSKVFNKERQVVRPPVKHNWSLPGSGVDLKPPQIFQHELLQKISINMFCKSSNPPFTSVELDHNDSGREGCTVTILTITTEPKNWQNAIRVVVQEMRIKILLNTMTVIRNNRCRIRPLWAAFYIGQSTIVVGWWVFNDSDFNNRS

SEQ ID NO: 170401 - protein, 584 aa, Glycine max
  Coding DNA Sequence Number=SeqID_78716
  Gene Ontology: Mol. function=oxidoreductase activity; Cellular component=cellulose and pectin-containing cell wall; Biological process=electron transport
  Homolog annotation: Hit_ID=A7R3R4; Match level="QueryCoverage=88%, HitCoverage=96%, E-value=0.0, Identity=75%"; Hit description =Chromosome undetermined scaffold_560, whole genome shotgun sequence
  Pfam annotation: Domain name=Cu-oxidase; Domain location=204-340; Score=200.8; E_value=3.3e-57; Accession=PF00394.13; Description =Multicopper oxidase
  Pfam annotation: Domain name=Cu-oxidase_2; Domain location=420-561; Score=168.6; E_value=1.7e-47; Accession=PF07731.5; Description =Multicopper oxidase
  Pfam annotation: Domain name=Cu-oxidase_3; Domain location=78-194; Score=184.6; E_value=2.5e-52; Accession=PF07732.6; Description =Multicopper oxidase
  Pfam module annotation: Pfam domain module=Cu-oxidase::Cu-oxidase _2::Cu-oxidase_3; Domain location=204-340::420-561::78-194
MRFQQCSLQDLVSVTAEERTTQNWYISLNLKVKVMLQVSVPNAMGSTSLLHLLLGVVLALLSVSLVEGEDAYKYYTWTVTYGILSPLGSPQQVVLIDGQFPGPQLDLVTNENVVLNLVNKLDEPFLLTWNGIKQRKNSWQDGVLGTNCPIPPNSNYTYKFQVKDQIGTYTYFPSTSLHKAAGGFGGLNVYHRSVIPVPYPYPDGDFTLLIGDWYKTNHKVLRESLDSGKSLAFPDGLLINGQAHTTINGDQGKTYMFRISNVGMSTSINFRIQGHPLKLVEIEGSHIVQNTYDTLDVHVGQSAAVLVTLNQPPKDYYIVASTRFSRKVLTATAVLHYSNSNSPASGPLPSPPIYQYHWSVKQARTYRWNLTANAARPNPQGSYHYGKITPTKTIVLSNSAPLINGKLRYAVNKVSYVNSDTPLKLADYFNIPGIYSVDSIQTLPSESTPASIATSVVPTSLHDFIEVVFQNNENAMQSWHLDGYDFWVVGYGFGQWTPAKRRTYNLVDALTRHTTQVYPNAWTTILVSLDNQGMWNLRSAIWERQYLGQQLYLRVWTSERSLANEYDIPNNALLCGKAVGHNNP

SEQ ID NO: 170402 - protein, 181 aa, Glycine max
  Coding DNA Sequence Number=SeqID_78717
  Gene Ontology: Mol. function=nucleoside-triphosphatase activity; Cellular component=integral to membrane; Biological process=transport
  Homolog annotation: Hit_ID=Q7FMW4; Match level="QueryCoverage=40%, HitCoverage=4%, E-value=2e-09, Identity=45%"; Hit description =Pleiotropic drug resistance protein 15
MALPSLGIYQTLLLLWLSLHPPNSHRRWNGSIRKELEGIEEGLLQIVHVRVKPSGTVPPRLPGDLRAITPDLCGYGDTAALPDAFLYSAFHIIVDLVGQRSMLTLHFTGLQLYFIYTFFRMIQELIKELSTPTPAMYSTVMFLGTKDTLGVQPVVDIERTVLYHEKAIGMYSTLPYALDQE

SEQ ID NO: 170403 - protein, 107 aa, Glycine max
  Coding DNA Sequence Number=SeqID_78718
  Homolog annotation: Hit_ID=A5AHJ1; Match level="QueryCoverage=94%, HitCoverage=51%, E-value=4e-10, Identity=33%"; Hit description =Putative uncharacterized protein
MDEYFRVSNCKSAKDMWDTLQVTHEGKIFPNEDLINKVLRCLSREWQPNEHEMELMRLNQHGENDKKKKGIALKASSSIQEESDKEDSVEIDEDDDLSLFVKDSTNS

SEQ ID NO: 170404 - protein, 287 aa, Glycine max
  Coding DNA Sequence Number=SeqID_78719
MSEIKEVQEQMKADMDSMKEQMTTMIEAMMSMRKMVEVNTATVVAASTATEMDPTHPFGINQESRPVPDMSKHPFPPYGLCPNYMPPNVVHMPDENIDHFAPIPLESQQPQFGHAHVSQPMGETPKAFGGIPLPNTLGVPQYCPQPQPLHFTVGRVPPVMVEREKFDHMEERLRVIEGGGNYAFVDMAELCLVPNVVIYPKFKVPKKLKNTSRFKRKVEFKNQDSRIKLQESRSRFKIQESREDLIKISMKRIFQKLSSTWIFLKTCLPKSFYSLVIDYQIAVINYQ

SEQ ID NO: 170405 - protein, 104 aa, Glycine max
  Coding DNA Sequence Number=SeqID_78720
MDEEGLKFEEKLVKVDTNPFQVHTNYAKPIQILMVGAFIDEAKSLDDFEKKGENATYLPSSRVPTNKWIQQGILGTRSKWQAFEVNNKVPQKEATSEGSKKGYY

SEQ ID NO: 170406 - protein, 145 aa, Glycine max
  Coding DNA Sequence Number=SeqID_78721
  Gene Ontology: Cellular component=protein complex
  Homolog annotation: Hit_ID=A7QZ28; Match level="QueryCoverage=89%, HitCoverage=44%, E-value=1e-35, Identity=53%"; Hit description =Chromosome chr17 scaffold_263, whole genome shotgun sequence
MAHKEKALEHLKVTKTKIVVVGQKMDLVFYTLQLGFFDMDFDLISKSIDKAKNWFSNCSHHGGSLYEEGVLTIIISLDRVSLKQKVVDSPKILTMIGKIPYLSEFLNSLYDCQYKSFFLSICTSASRDEESRYKKECYGEKKYVF

SEQ ID NO: 170407 - protein, 92 aa, Glycine max
  Coding DNA Sequence Number=SeqID_78722
MKYRITQCFDQEYKRIPRKGAKGLASGSPGPWNYLLAKQLARLGIECDLCTLMMQSYPARALDRRPQVEWAKDAREGPRVLMSLRVDFGPMG

SEQ ID NO: 170408 - protein, 111 aa, Glycine max
  Coding DNA Sequence Number=SeqID_78723
MGETHEAPRDHSLADFEPHLRYVTEGQAFCSVPLPNTLGGPQYRPQPQPLHFAVGRVPPIMVEREKFDHMEERLRVIEGGENYAFVDMAELCLLLDMVIPPKFKVSNFDKY

SEQ ID NO: 170409 - protein, 103 aa, Glycine max
  Coding DNA Sequence Number=SeqID_78724
MGAYAKDGKLLLHFFQKSVARAAITWYTNLEPSQVHSRKDLMMVGYMPSSFADLVFAGKRIEVGLRRGKFDYASTVSSSNRRPGMSGGNNNEEETHVVTIVPT

SEQ ID NO: 170410 - protein, 73 aa, Glycine max
  Coding DNA Sequence Number=SeqID_78725
MAKEMIYGHNFEAPWLYFSSSPFPSAFFLCSLQFQPLNPSPYIAIYRNAIWCKESSRKRAACLGLKSSARPSE

SEQ ID NO: 170411 - protein, 228 aa, Glycine max
  Coding DNA Sequence Number=SeqID_78726
MVNQDSFKDVLMITMMITKDDDKDRIKKNSKLKRKVKSQESRFKVQDLKNQDQDSRLKIQESREGCGEGEGIGVEHCGGRWRHTRYAEGGASIRDGTSFVVQVEGTSTWVVILRTREGTSLVDQFKWRMEKDEWMYESIMFEEVDMNYQNEEACGANDPHVDCSDAFNTSQVFDSREDVLRWARSVAHEKGLVAVIIRKNLSEETLGLGNVGVPSSFVASQCLEDKAG

SEQ ID NO: 170412 - protein, 67 aa, Glycine max
  Coding DNA Sequence Number=SeqID_78727
  Subcellular localization annotation: CTP_CleavageSite=50; ConfidenceScore=5.18e-01
MRGFGTLAARPGKTARKLGGSSTRPQQQMPSLYDRTTKLEETLAQFMQVSMSNQKSTESTIKNLEVQ

SEQ ID NO: 170413 - protein, 809 aa, Glycine max
  Coding DNA Sequence Number=SeqID_78728
  Gene Ontology: Mol. function=nucleotide binding; Cellular component =intracellular; Biological process=defense response
  Homolog annotation: Hit_ID=A7R7K5; Match level="QueryCoverage=99%, HitCoverage=98%, E-value=0.0, Identity=45%"; Hit description =Chromosome undetermined scaffold_1841, whole genome shotgun sequence
  Pfam annotation: Domain name=LRR_1; Domain location=656-677; Score =5.6; E_value=29; Accession=PF00560.24; Description=Leucine Rich Repeat
  Pfam annotation: Domain name=LRR_1; Domain location=679-701; Score =13.9; E_value=0.61; Accession=PF00560.24; Description=Leucine Rich Repeat
  Pfam annotation: Domain name=LRR_1; Domain location=703-725; Score =13.4; E_value=0.84; Accession=PF00560.24; Description=Leucine Rich Repeat
  Pfam annotation: Domain name=LRR_1; Domain location=727-749; Score =10.8; E_value=3.1; Accession=PF00560.24; Description=Leucine Rich Repeat
  Pfam annotation: Domain name=LRR_1; Domain location=751-773; Score =11.1; E_value=2.7; Accession=PF00560.24; Description=Leucine Rich Repeat
  Pfam annotation: Domain name=NACHT; Domain location=183-330; Score= -16.1; E_value=0.0011; Accession=PF05729.3; Description=NACHT domain
  Pfam annotation: Domain name=NB-ARC; Domain location=143-438; Score =23.9; E_value=8.6e-12; Accession=PF00931.13; Description=NB-ARC domain
  Pfam annotation: Domain name=RPW8; Domain location=3-154; Score= -25.1; E_value=0.0073; Accession=PF05659.2; Description=Arabidopsis broad-spectrum mildew resistance protein RPW8
  Pfam module annotation: Pfam domain module=LRR_1::LRR_1::LRR_1::LRR _1::LRR_1::NACHT::NB-ARC::RPW8; Domain location=656-677::679-701::703- 725::727-749::751-773::183-330::143-438::3-154
MAMIMDAVLGKLLDELLKEVVNVKDRAVKFRATLITLESTLNKVGRLAKQIDGLNNQLNKPAEEMKELKDKLAKGKKLVMECSEIQWWNCCYKANYQEELEALYESIRLYFNLDMQGLILTNELQNQVILTEIHATVMESGPRRTELKGVCSPPAPPAFTVGLDVHLREMKVKLLNNHHHAGSVLTVTGTPGSGKSTLVKKFCCDEEVKGIFKENIFFITFAQKPKLNTIVQRLFQHNACQVPEFQSDDDAVYQLENLLKQIGKNPILLVLDDVPSESVSLVDKFVFQIPKYKILVTSRITIRGFDQPYVLKSLNEVDAINLFRHSASLNQSSSDIPENIVKKIARGCSGSPLALIVTGKSLSREPPWAWNNRAKKLSKGQPILAFSADVLTCLQKSFDDLDPKVAECFRDLSLFPEAQRIPAAALVDIWAELRDEDDDSAMENIYELVKRNMADIVVTRYGKCFLKDDTNISSGTIDYNYHYVTQHGLLRDLAILQTNKELMKKRNRLIIDVSGNNLPDWWTTQNEYHIAAHSLSISTDDTFTSEWCNLQASEVEVLVLNLREKKRSLPMFMEKMNKLKVLIVTNYEFYRADLENFELLDNLSSLKRIRLEKVSIPFLSNTGVQLKNLHKFSFFMCNVNEAFKNSTIQVSKVFPNLEEMNIDYCDMVELPIGLSDIVSLKKLSITNCHKLSALPEGIGKLVNLESLRLTSCTKLEELPESITSLSKLNFLDISDCVSLSKLPENMGELRSLENLNCRGCTRLTDLPYSITELESLSAVVCDEETAALWEPFKTMLRDLKLKDENREGK

SEQ ID NO: 170414 - protein, 29 aa, Glycine max
  Coding DNA Sequence Number=SeqID_78729
MATYRWQKHTLDESPLLALLTTRLKSARI

SEQ ID NO: 170415 - protein, 232 aa, Glycine max
  Coding DNA Sequence Number=SeqID_78730
MATIICWRISSDCLVLPLVIGPCIWATLGFSSTSVEESPYCGTYHLMLSQVGVWSSLRRIRLIFQLRSIMIILFFDTGQVFLIFLVAHYKVVIHIKNSSKVPGGVFVMDTKKGDPSFLPSLTSISTTPGCKFSTALTSLLNREMHALGNSSGPWYRQQLLRDRGTAIGCCGIGGDRRERGCPALGAGGIGEREGEGSPALGAGGIGGERREGWDAATGCCGTGLMRQHEALH

SEQ ID NO: 170416 - protein, 140 aa, Glycine max
  Coding DNA Sequence Number=SeqID_78731
GTIVDDWKFDYSSHDAWCMVCNDQMHKALRANAPLPYPHLVTLFLHHFKIPLEDEPFVQVKRSFVIGAGAVILFGYHKDDDGQVDSSSLLNDVPSELHSLRAFVGDRFDAMDTPLDAMDAHFDGMDTRITRLEDDMSFIR

SEQ ID NO: 170417 - protein, 104 aa, Glycine max
  Coding DNA Sequence Number=SeqID_78732
MDGQWLKKDAHLHKTNVLPLLRLNEMTPQPSCMKFFRSYEASTPILLNALIPWMIVSMPLMLALKEWIPASLSLRRMGRETGIRSGAKKSRDHKLQNIGGVWDK

SEQ ID NO: 170418 - protein, 97 aa, Glycine max
  Coding DNA Sequence Number=SeqID_78733
YISCGPVLVEGTSTRWFKENKGGHIPCGSLPVKGFLQGGADIEEEKPTYLRSNPLQGGGDDAILPRKGPVTRAMSKRLHEDWARAVEEGLRVLMNLR

SEQ ID NO: 170419 - protein, 183 aa, Glycine max
  Coding DNA Sequence Number=SeqID_78734
MQSQLQSQIHSQGLALPLEPEGSTTVHNIPLLHGQVKVGVEEVKDVEALVPVPTTEVILVVQALNTFLAWLTHLVKRLSEQPLQVMWDATVFGMFNEHFSLYIKHEDPSEIARSGQCLSISVIKLWILHLTETSMRARNSDVYGFLKPQSIQRSGQSQFESESYMKSWMQSSQRDVYLGAYLN

SEQ ID NO: 170420 - protein, 80 aa, Glycine max
  Coding DNA Sequence Number=SeqID_78735
ENKRLQCEGFSSQLRHNIEIPNGENAHNWVANVVFKFHNDPTVNEPEIVVFLRQVWWATGKRKGFERRIGKTKMRPKRGI

SEQ ID NO: 170421 - protein, 102 aa, Glycine max
  Coding DNA Sequence Number=SeqID_78736
MGEELATQLAQASKVASSRSNSLLEEESGRPNFRRSYENSRIAKNTSFRFPSHYGIFTDRVSLLPFDFRHVSGLHILCNKGCQVSQSGQSKVVYQIIIPGRN

SEQ ID NO: 170422 - protein, 127 aa, Glycine max
  Coding DNA Sequence Number=SeqID_78737
  Homolog annotation: Hit_ID=Q6UUU1; Match level="QueryCoverage=62%, HitCoverage=54%, E-value=2e-32, Identity=85%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGRVCLISTPDTQFPGRQFAPSWTVCTNPPFSPTAAPLSGKLSS

SEQ ID NO: 170423 - protein, 43 aa, Glycine max
  Coding DNA Sequence Number=SeqID_78738
MWKFFIVLRRSSPFFIRSSFVLRSSTGETKAKINSPSQARPQK

SEQ ID NO: 170424 - protein, 41 aa, Glycine max
  Coding DNA Sequence Number=SeqID_78739
MANTMMKINKKAEEIFNIVYVIDQSYGEVSRSFAIRWKNEE

SEQ ID NO: 170425 - protein, 180 aa, Glycine max
  Coding DNA Sequence Number=SeqID_78740
EGIYPQGEGQPLMVKEECQETLVCIATPLRLEVIPRVKELLDEGLVRKRLNPCALLVPKIGVPMDPKRIKVIPDWPTPPSVEVKSLEYKEPFQRGGDDAILPPRVLDRRLQEDWDGATKEGPKVLMNLQVDFFEPMGQGCDAIQPRKVLDRRLQVDWARDPREGPRVLMNLRVDFEPMGE

SEQ ID NO: 170426 - protein, 145 aa, Glycine max
  Coding DNA Sequence Number=SeqID_78741
  Homolog annotation: Hit_ID=A5C7Z4; Match level="QueryCoverage=78%, HitCoverage=40%, E-value=3e-08, Identity=29%"; Hit description =Putative uncharacterized protein
MSQHISVTVVDSSSQRDVYLGAYLNGFHCSGHWQMMVILPKEHLVVWFCSLHNRPDNYLKGIINSAIKGLDDAPQPKSKAPARSIVIKCNRQKGTTECGYYVMHWMSTIILGTFRNNWEAYFNDPRPLEPERLKALRIQWAKFYL

SEQ ID NO: 170427 - protein, 41 aa, Glycine max
  Coding DNA Sequence Number=SeqID_78742
RAFAKRNTHGLRARKTLKEDELYRFTKRTASVNPLSEKGMR

SEQ ID NO: 170428 - protein, 207 aa, Glycine max
  Coding DNA Sequence Number=SeqID_78743
MDIIPDKYPLSMPNIKFGSKLYVNADITEIHEFRQSLCVPFYSGGMINDKDGSQSQSSQSNMVEKFLQNAQVVSIGEINNLRQDCYCLTVGTIDEIIIDAPWSYDSCPNCTTTFDPSKGGSACRSCHTSVVDTIPRMEHNRDKGNFLLWDATCIKLFGKTAGECRDELIAARDDIKVFPTRVDEIQLKTWASRFKFRSQCANHLCWM

SEQ ID NO: 170429 - protein, 66 aa, Glycine max
  Coding DNA Sequence Number=SeqID_78744
MYMVNDIFTLSRHKENMVQPKPSAGLKGKPHQHALTHHAFLYFNEQKLGPPRPKSCFGIYPNCGIL

SEQ ID NO: 170430 - protein, 129 aa, Glycine max
  Coding DNA Sequence Number=SeqID_78745
  Subcellular localization annotation: CTP_CleavageSite=52; ConfidenceScore=5.53e-01
MATPLISPPPPTGVALHSSSTLKRTRKATRLRSLSTKPAGAERPLVHVDPTTAKANGPHKKKLRTYLGIVARDKAEFDIPEASDPIRTVSMTQYAKSIALARRYGPNFVRAAETLRGRYLIFDFYCFQL

SEQ ID NO: 170431 - protein, 187 aa, Glycine max
  Coding DNA Sequence Number=SeqID_78746
MSMTSSTASSRMKYPIIRPPSIMQFKAAFHNDQTPNYPESVQLRYNGATYQIQLQQHRGRFFLADGLTDFRADLKIYESIIINFFVCDDISIFDVHFTPPLDQQTCAKPLLHSRQHISTEEITQCILGAPHPLEISFHAAKHLNECGNHMTILRKHGPPLQWKVVTLDVSIKDKSIVRPWYKFLKGK

SEQ ID NO: 170432 - protein, 44 aa, Glycine max
  Coding DNA Sequence Number=SeqID_78747
MAGDAILPRKGPVTRVMSKRLQEDWARAVEEGPRVLMNLKGSIM

SEQ ID NO: 170433 - protein, 161 aa, Glycine max
  Coding DNA Sequence Number=SeqID_78748
MTDDSLSERQRAERVLAPNLGESHLKASLPQIWGSYWVKRNGMEAKCKRGACNRVGNKKKKVDLWINALLESKLLHPIKTMNYLQPSLITSLRAEKHTQSNEAECKKRASNRVGNKKKKVDLWMNALLESKLLHPRKTMNYLQPCLITSLRKVLLIQFVCL

SEQ ID NO: 170434 - protein, 114 aa, Glycine max
  Coding DNA Sequence Number=SeqID_78749
MLIREVIPNRKGICRSLNPAQMLNHHVFCTTLVYDLNIKLLKKKHPPDQSRFSIRLLQQAVGMKRYVWTMNSQILIKHHPQIPLVGLNSTRTTLRQTYKKLGYRTSILRDNTIN

SEQ ID NO: 170435 - protein, 74 aa, Glycine max
  Coding DNA Sequence Number=SeqID_78750
MEESIGHILDLTPIGEKKERKDQEANINLSYFHGKDNVEACLDWEMKVDQLFACHHTTSKGMPSIGGLPLLGKE

SEQ ID NO: 170436 - protein, 324 aa, Glycine max
  Coding DNA Sequence Number=SeqID_78751
  Subcellular localization annotation: CTP_CleavageSite=46; ConfidenceScore=5.03e-01
MARGRYEARMLALKLDKTFIGNQKLMLGNEVRPNLSYANVTQSYFRGNTRQKRNGSRVFDVQSFHMSYKANLSTESKLGRAYVSRVVRVGDSYITKKKLHLEGIFGIGVTLIGSSLVLLETEDLEEVGEYINVGADWVTEWFEEIMSWKLTIIDNERLDESIDGSIRTTKRRVRRRKIEVTGWMLFVVGGDQAHRKEKIGPNNGFLENQPRSNSYTKEGSGTSRVGVAVGPKKEAQTIDFQAQGMFEGSPRKMSFKNSGRVVLSSLEVEKGEGRRLSIGAPEKGGINVVGSNADGSEPMEIYVEQIRSMEERDIIDKANKGKQM

SEQ ID NO: 170437 - protein, 314 aa, Glycine max
  Coding DNA Sequence Number=SeqID_78752
  Homolog annotation: Hit_ID=A7P1M2; Match level="QueryCoverage=98%, HitCoverage=37%, E-value=4e-74, Identity=44%"; Hit description =Chromosome chr19 scaffold_4, whole genome shotgun sequence
MNVSAVDCEVIVMFQFPPLDAKNNGGYIKGSIESMREKSNPLYFKQLDVISAAFYTAEASQILKKIDMEVIVILVCTTLACVFMALFAKNHDKKSILLGNEWLEVNEIAVRIIVMAAFLLQLHLLQLTWSTRKADTKQKDLWIAEKKVLHVIFTLYAVGILIALLVHQNNTLHGDVVYSSSLSQQHSFWEHLKSCSGLVLDDFLLPQILLNIFMNSKGNALSCSFYFGTSLVRLIPHAYDLFEALAYVDGSCLYADEIADYYSTAWDIIIPLVSLMFASIIHFQQRFGGCSILSWRIKTKGVEEYEKVPMVTEA

SEQ ID NO: 170438 - protein, 410 aa, Glycine max
  Coding DNA Sequence Number=SeqID_78753
  Gene Ontology: Mol. function=hydrolase activity, hydrolyzing O -glycosyl compounds; Cellular component=anchored to membrane; Biological process=cell wall organization and biogenesis
  Homolog annotation: Hit_ID=A7QJ39; Match level="QueryCoverage=14%, HitCoverage=23%, E-value=4e-14, Identity=60%"; Hit description =Chromosome chr2 scaffold_105, whole genome shotgun sequence
MEFTDKEEVVIEEKVERWEEEDTEGMPYGQWLKALPSRPNVVVEVKQQVIYGKVKHTSLFDDKEKEKEKPMSNHKKDKKEIVEVMGEKSEMQGVDVLEDARKAGGIILMQSEGIEVELQSWRLSQILNPRENSGGNVVDLDLISQFQEVLMDIEIEGYEFTWTNKRKGADLIEEKLNKAFVNNMQRDQYPIILNMLVSQQQRGVRIRRHRQGDRIGNFTNNIRRLQKRLGEVQKMTQNDVVMEMEANIERDMDECLKMDEVNKYTRSSAPTLSSSLLIFERGFAEVAADIGRSGTVTTPVMPPPPKENARTTFSGPKLDQVRRLRHLVDVYDGQGMVDPKQIDVVYSALDSLGYRKLLVHISGTGWPSKGDLDEAGANLKNAKNYNGNLIKMAMSYSVLCFLCDCRQIHL

SEQ ID NO: 170439 - protein, 137 aa, Glycine max
  Coding DNA Sequence Number=SeqID_78754
  Subcellular localization annotation: CTP_CleavageSite=83; ConfidenceScore=5.06e-01
MARFHWWNLLKILLHQFHHLILIHTTLRSVSLFTPLSPHTTHSDLSTQISQLRSLSASINFTMVTLFDSLAVVRLPTAAFSPAATSRTSVLLPHCAGLRLRPAAATRLVASPARRIASRAARVVCEAQDTAVEDTER

SEQ ID NO: 170440 - protein, 69 aa, Glycine max
  Coding DNA Sequence Number=SeqID_78755
MYYSTKNIVHDATLKENRVNDLGDEKEGGISVGGSPDVPWRQWPAAVVVKEGPFCFFEDSTIGACFSKF

SEQ ID NO: 170441 - protein, 111 aa, Glycine max
  Coding DNA Sequence Number=SeqID_78756
MVEMCRFPVRFYVRIMDIDAVLLIVVVNPCRMAPEDVVEAMATVMAQQEDTMAQQYQANMAQQGVAPTLIHPKFQRFVEFKKNDPPQFKDTTDLWIRELEKIFRAMDFPDD

SEQ ID NO: 170442 - protein, 148 aa, Glycine max
  Coding DNA Sequence Number=SeqID_78757
MGGAMTMMDIDEDMTKSKGKDPLEGLGGPMTRARARKAKEALQQVLSILFEYKPKFQGEKSKGPIGNLGISLLGDQMVADLLAVGVIQEHPGCIKGLSQPLCVALAGKSDSFLPFIFNLVLSNHNSRKSTSAQNYLVAITPILRTQIK

SEQ ID NO: 170443 - protein, 49 aa, Glycine max
  Coding DNA Sequence Number=SeqID_78758
MDKSLKEEMMRGRRRREGARNFVPQMRCPKIQGLKNPTFLGYPTYIMKP

SEQ ID NO: 170444 - protein, 74 aa, Glycine max
  Coding DNA Sequence Number=SeqID_78759
  Homolog annotation: Hit_ID=Q4A3R7; Match level="QueryCoverage=74%, HitCoverage=19%, E-value=9e-07, Identity=50%"; Hit description =Capsule O-acetyl transferase
MCGSNAFEVILMMPKNQELSKISSKDSRIKFQDSRIKFQDSRIKFQESRFKNNQDQDSRLKIQQSRRRLSQDKY

SEQ ID NO: 170445 - protein, 274 aa, Glycine max
  Coding DNA Sequence Number=SeqID_78760
  Homolog annotation: Hit_ID=A5B5G7; Match level="QueryCoverage=60%, HitCoverage=12%, E-value=6e-08, Identity=26%"; Hit description =Putative uncharacterized protein
AKLKRRNWHKELTNFMDRSTDVAIIKEFYANLYDPKDNSPKQVRVRGHLIKFDADALNTFLKTPMIIEEGEELSSYSRFCHLRPDPSELPAQLCIPGRGFELNADGLPLKILRKNLTTLAQTWSILSFSNLALTSHTSNITLDRARLIYGIIQKMDMNLGYIISSQISMIAQHDSSSLAINLAYVKKNCWNLDDPSVSFRGPHKARGKRSETLPSFEIPPLAAPSTTVPTSSAPSASAPLPAPIIAPSIGSSSFTLEILFAMLQSLHRGHIIIM

SEQ ID NO: 170446 - protein, 72 aa, Glycine max
  Coding DNA Sequence Number=SeqID_78761
GLVGACTLSATLARLTCISEFRLSARLLAQRMDSSGALSGIIPCSANMHNSFFFQILPRAQRKELCAHRMAR

SEQ ID NO: 170447 - protein, 191 aa, Glycine max
  Coding DNA Sequence Number=SeqID_78762
MAKVDPEIVLEFYDNAWPTEGGIRDMRSWVMGQWTPFDPDALAQFVGDLLQLEEGMPPTRHPLDPDKSNRALGKVIRPPITRAFIEKYCTPRQVRGDAPQATDAPPPPHQADPAGSFGMERYLQHLVRQQAANHKGQVQIHESLYQLSLSQQSQGFAPFACPTSDQSRAEVAWPRDWPKAQAGKAPAWMRR

SEQ ID NO: 170448 - protein, 264 aa, Glycine max
  Coding DNA Sequence Number=SeqID_78763
  Gene Ontology: Mol. function=anthranilate synthase activity; Cellular component=ribonucleoprotein complex; Biological process=aromatic amino acid family biosynthetic process
  Homolog annotation: Hit_ID=A6T7W9; Match level="QueryCoverage=75%, HitCoverage=84%, E-value=1e-42, Identity=74%"; Hit description =Anthranilate synthase component I
  Pfam annotation: Domain name=Chorismate_bind; Domain location=47-226; Score=-80.1; E_value=4.4e-11; Accession=PF00425.9; Description =chorismate binding enzyme
MIMQTSKPALELLTSDAIYRENPTALFHQLCGARPATLLLESADIDSKDDLKSLLLVDSALRITALGNTVTVQALSANGAALLELLDNALPSGIENLRQPNSRVLTFPPVSALLDEDARLIWSAPAGRARSDVLGGLFAYDPGSRYVADLTKVDRYSFVMHLVSRVVGELRRDLDVLHAYRACMNMGTLSGAPKVRAMQLIAAAEASVAVATAARSATLPPMATSIPASWMPQNQRHFAAGEIFQVRAVAPYRAHFPAVAAPRL

SEQ ID NO: 170449 - protein, 67 aa, Glycine max
  Coding DNA Sequence Number=SeqID_78764
MASGNRLPRVTSSEEDPEELPPEPAVDALDFLEGDEDPLLEVDSPEDVMSASEADSTEDSGPREMAI

SEQ ID NO: 170450 - protein, 275 aa, Glycine max
  Coding DNA Sequence Number=SeqID_78765
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLVADIYYNVSSHFGCKQLIRSSWYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 170451 - protein, 117 aa, Glycine max
  Coding DNA Sequence Number=SeqID_78766
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=25%, HitCoverage=29%, E-value=6e-11, Identity=100%"; Hit description=LacZ protein
MHAPPGRERRVLSFSDTTHSLRVLCGAYRSQIRLLHDALAINVTMNGAHPPFASWRNSEEARTDRPSQQLRSLNGEWDAPCSGALSAAGVVVTRSVTATLASADVRRCFCRYAPPRQ

SEQ ID NO: 170452 - protein, 130 aa, Glycine max
  Coding DNA Sequence Number=SeqID_78767
MKHSSKLEGGGHMNSARQTNSWGSEKGVRMEDCLEGPHLRQSLKHSSKLEGGGHMNSVGNNDSWGSEKGGEWRISLRVEDDMNETLGNTFMGLRKRVENGGIALKGPITTAIMKHSSKLEGGGHMNSARQ

SEQ ID NO: 170453 - protein, 961 aa, Glycine max
  Coding DNA Sequence Number=SeqID_78768
  Gene Ontology: Mol. function=kinase activity; Cellular component =intracellular; Biological process=D-ribose metabolic process
  Homolog annotation: Hit_ID=A8GKW3; Match level="QueryCoverage=64%, HitCoverage=96%, E-value=0.0, Identity=77%"; Hit description=PfkB domain protein
  Pfam annotation: Domain name=HTH_6; Domain location=716-827; Score =12.0; E_value=8.7e-05; Accession=PF01418.8; Description=Helix-turn -helix domain, rpiR family
  Pfam annotation: Domain name=PfkB; Domain location=70-388; Score =146.9; E_value=5.6e-41; Accession=PF00294.15; Description=pfkB family carbohydrate kinase
  Pfam annotation: Domain name=SIS; Domain location=845-960; Score =76.1; E_value=1.2e-19; Accession=PF01380.13; Description=SIS domain
  Pfam module annotation: Pfam domain module=HTH_6::PfkB::SIS; Domain location=716-827::70-388::845-960
  Subcellular localization annotation: CTP_CleavageSite=55; ConfidenceScore=5.27e-01
MKIKFGAETYSASSHPSSFPASWLTSQSTRETGKPHPETPEALRLIVGGSARRVCLSQKETISMSTQQKRLDVICIGRIAVDLYGQQIGSRLEDMTSFNKYLGGSSGNVAYGTAIQGLKSAMLARVGDEHNGRFLREELQRVGCNTDGLITDKQRLTGLVILGIKDEETFPLIFYRDNCADMGLVPEDIREEFITSSRAVAITGTHLSHPDTRAAVLKALDIARRNGLRTALDIDYRPVLWGLTSLGDGETRFIESGQVTQQLQEVVHYFDLIVGTEEEFHIAGGSTDTLTALKNVRKASSATLVCKRGPLGCVVFEGEIPDSWEQTRLHSGVRVEVLNVLGAGDAFMSGLLRGWLNDESWEQACRYANACGALVVSRHGCAPAMPTKEELDDFLSRDNAVKRPDLDARLNHLHRVTTRKQQWPELNVFAFDHRKQLADMAREAGVSEERIPQLKLLLLQAAQEAANEAGLNEKSGILADTTYGQKALNAITGKHWWIGRPIELPSSRPLRLEHGNIGSQLVDWPAEHVVKCLVFYHPHDSAELRKEQDELVLDVWRSCNKSGHELLLEVILPESNPDRNESYYYDMLSHFYSLGVQPDWWKLPPLTAESWQAIGELIEQQDPHCRGILLLGLDAPEEKLKAGFAAAAQATWVKGFAVGRTIFGQPSRQWLNGELDDKALIETKRPDGPLFSVLRADALTPALSHREREPFRQDDIRRRYETLSKRLKQVARYILDNSNSIAFDTVASIAQQADVPPSTLIRFANAFGFSGFNEMKQVFRQHLMEETVNYTERARLFRQTATDDSASSPESPVEILNVFTMVNSQALQQLAMQVNPDQLNKAVKMLNEAENIYIIGLRRSFSVASYLVYALRHLERRAFLIDGLGGMFTEQLSMVNPKDVVIAISYSPYAREAVELVELGAKRGAHQIAITDSQVSPLAAFSDVCGLALPGANPGGVAGAE

SEQ ID NO: 170454 - protein, 143 aa, Glycine max
  Coding DNA Sequence Number=SeqID_78769
MAAQLIHDRVEMECLEGAWETLEGNTRCRFRGTIRFTATSLVHPDEPVRTLQRTVEWILPTPTPYRLVEPVQVIEVTSSEEDPEEDPEELPPEPAVDALDFLEGDEDPLPEVDSPEEVMSASEADSTEDSGPREMATSGGSSS

SEQ ID NO: 170455 - protein, 111 aa, Glycine max
  Coding DNA Sequence Number=SeqID_78770
DAGSRQARQGASAGVGGCRGWLNYAASEQIVLRVHHMRAIGAGLFAITPAGERGMCCKAIKLGNARVFPVTTFFPFTSYPNFVNINQCTLRVQLIASEPNLRSCLMDEGLT

SEQ ID NO: 170456 - protein, 78 aa, Glycine max
  Coding DNA Sequence Number=SeqID_78771
MDVEFTKRCVPRSLLEWGFNDNQGSKSKAIVRWIVVKQHGSTMCGYYVIQLMSMIVLGGFKDNWETIIVYFKTNFNLL

SEQ ID NO: 170457 - protein, 163 aa, Glycine max
  Coding DNA Sequence Number=SeqID_78772
  Homolog annotation: Hit_ID=A5BKB8; Match level="QueryCoverage=64%, HitCoverage=23%, E-value=9e-34, Identity=73%"; Hit description =Putative uncharacterized protein
MGGGAWPFLVGGAICLVNSVNERDLSLLNSYVEVTSTASFLEGLWPLRPRKFEAIQIIAIVGLQRGIPSKRESSARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 170458 - protein, 136 aa, Glycine max
  Coding DNA Sequence Number=SeqID_78773
MDNEEGVQEQMKADMSALKDQMASITEAMLKNQKSIEDNATAAASNTAREAEPAFYFPSRNQPPPPPHELPQPNIILHAPSQSAPVKELLPISKDNGKIDLLEERLRAVEGLGNYPFSDLVDLCLVPDIIIPPKFK

SEQ ID NO: 170459 - protein, 182 aa, Glycine max
  Coding DNA Sequence Number=SeqID_78774
MKNSEESPRNRLRKRLGSIMKAPRLGFFPRKQFFSVILRDSSIPERLNPFTLPSLPLFIGEKQEVVAAQLARASWVPCTRSHRPFVEDSRRPKLCNNACFDFWNVVKLYGLRNNACFEGSEGNKQGSKVDRKYPRTKLGRHVDAVLPRKGPVTRAISKRLQEDWPRAVEEGPRILMNLRVDF

SEQ ID NO: 170460 - protein, 59 aa, Glycine max
  Coding DNA Sequence Number=SeqID_78775
YGHPNLRRHSISTFELNDILLAQWDIPVKTFACQDFPESSLVVSGFLNSFLALCRDPDE

SEQ ID NO: 170461 - protein, 56 aa, Glycine max
  Coding DNA Sequence Number=SeqID_78776
MSGVATKVYSRKTLEKPKRRRSADFENEGSGVVYAQGRVLPLLLRILRCDEKFRPT

SEQ ID NO: 170462 - protein, 170 aa, Glycine max
  Coding DNA Sequence Number=SeqID_78777
  Homolog annotation: Hit_ID=A5C0V9; Match level="QueryCoverage=74%, HitCoverage=26%, E-value=4e-07, Identity=26%"; Hit description =Putative uncharacterized protein
ATVSPAKPPDRPDHEVDDPLYLMTLTIPQLFLKPLQVMWDATVFNEDFPLYIKHEDLHEIGTRWHLTETSMRAGNFDVYGFLEPQSIQRSGQSQFESKSYMKSWMQSSKCDVYLGAYLNWPDNYLKGIINSALKGLDDTPQPKSKAGARWIVVKCNRQKGSIECGYYVMH

SEQ ID NO: 170463 - protein, 96 aa, Glycine max
  Coding DNA Sequence Number=SeqID_78778
MEKSGGKQNNFGTMKEREWKIFRSDKFSARLPFSTGDIPPHMNKVEKTETPSFLSKNTSLEKILLLSPMFPRHVHLKAKSWHPALHSRLQGRLPLA

SEQ ID NO: 170464 - protein, 80 aa, Glycine max
  Coding DNA Sequence Number=SeqID_78779
MICFYNLTIGILEIITFGLPLSKKGALSAIPTERNCAERPKATLSPFPTERKCTEHPEGPLSESCRDLRWTNKRERERDL

SEQ ID NO: 170465 - protein, 80 aa, Glycine max
  Coding DNA Sequence Number=SeqID_78780
MQPLLFSVGGPPSTVEGREKLDLIEERFRAVKGFSDYPFADMTELCLVPDVVIPPKFKIFVDPKDQEKTAFTCPFDVFTY

SEQ ID NO: 170466 - protein, 96 aa, Glycine max
  Coding DNA Sequence Number=SeqID_78781
STESNDGSQYPPVVLGGGKYGFRVWETFSGEEASENRVFHTKDGSLSAPFGRLAHFLSVGIGLSTTLVMQSYPQGYWIGDSKKLGLELLKKALGFS

SEQ ID NO: 170467 - protein, 136 aa, Glycine max
  Coding DNA Sequence Number=SeqID_78782
  Subcellular localization annotation: CTP_CleavageSite=34; ConfidenceScore=5.24e-01
MLSSSRPPGCAHNSLPPIGDQPGSPKVFPTRKISMQQGQAVILIARFPDPNYGVKMLPPGSSSRHLEIFFRLRSSVPRNPLPYQNEGDLIWISKNKANNNALKHPHHYMKGLRAFWVVQRDIIWKFRPRQCDRGSM

SEQ ID NO: 170468 - protein, 143 aa, Glycine max
  Coding DNA Sequence Number=SeqID_78783
MRILKILIVAANNLCCFHPPELIGTILVGVMGKRNLNLGSQYMTFGKWISGMKFNLSLDARNKPIREGQEKDLVVHSYQCLIAADSPWPTMRMFSTLCSDASVLRYLRVRNYNTKKAAKMLKGSIKFLVRCSLELDPVTKATS

SEQ ID NO: 170469 - protein, 130 aa, Glycine max
  Coding DNA Sequence Number=SeqID_78784
MWNLKVSFDLTGQWYFHGGESRYHYYGGIIVCNIPSLGTPLVTTKLTFLAEVFNIREVEYTYPQRSCDTIQEFIVGYAQEVKVGQNQEELLVDGTGDGREANVRQNQEKLLADGTGDGGLIFTEGHFDPS

SEQ ID NO: 170470 - protein, 250 aa, Glycine max
  Coding DNA Sequence Number=SeqID_78785
MQSQGLALSPKPEVGPSATRVSTKESCVDPSGNDPNTGDLEKCGLYVEENPPRLVALGRLYEGSTTVRNIVLCNDQVKIGVEEVRDTDAPILVPTQEVQLVGQAFNTFVAWPTHLGAVGLGKPIDRLYHDIDDPLYLMTLIIPQLYLKSLKVMWNATLFGVFNNNFPLYIKHEDLSEIAHGGQCLSISIIQLWILHMTKTSMRAGNADVYGFLEPQSIQRSVQSQFQSESYIKNWMQNSKRDVYLGVYLN

SEQ ID NO: 170471 - protein, 54 aa, Glycine max
  Coding DNA Sequence Number=SeqID_78786
MNQCLDNTDFEGFGASIEDIIHDVSLSELCSSNKSNYEDKVTRQLKSEEEVLSH

SEQ ID NO: 170472 - protein, 64 aa, Glycine max
  Coding DNA Sequence Number=SeqID_78787
MDDCERINERSWDMFYRGPMVASNVLTKIRNLDTSGWTWLNGISNFTAHVSEIERKGHRLVVVC

SEQ ID NO: 170473 - protein, 172 aa, Glycine max
  Coding DNA Sequence Number=SeqID_78788
MDLMTTFGQVLQPTLRWEGEGQIDRPKRSPPREKMSKAATNVYSRKTLEKPKRGLRILKIRVQELFMNREARPGELGISAETMSSPRRAGFFTMKLFGGLGEAEASLVALSAIEESSKASILRLRAKREISTLSVVVVFSQAQRRLVLSLNPLTRTKREGGTKRNVANSEPI

SEQ ID NO: 170474 - protein, 59 aa, Glycine max
  Coding DNA Sequence Number=SeqID_78789
MTVKKRLSHEVLKVTVELSSFSGLRVHHPLKAASACLGRQMNLAEHQYQGRTLSAILVR

SEQ ID NO: 170475 - protein, 120 aa, Glycine max
  Coding DNA Sequence Number=SeqID_78790
MEAMKEQMTTMMEAMMSMRKMMEVNTAIVVAASTAIEVDLTHPSSLNQVNHQPRTWSKASIPSHHMACLPTIHHPMLHTLPMRTSITPLPYSLKANNPNLDRHRSLNPWGRHMKYPETTL

SEQ ID NO: 170476 - protein, 56 aa, Glycine max
  Coding DNA Sequence Number=SeqID_78791
MEKMNMYKTTKGDPLRAKGHFGAVAARPGELRLSAEAMSSPKRAGARLDLVLVSSP

SEQ ID NO: 170477 - protein, 560 aa, Glycine max
  Coding DNA Sequence Number=SeqID_78792
MSGKIGWVSLNNVSKKLFEFDSNIFHRFKDHFFKVLAIDVVADGMPLMFNRDKEPCFSNFGVVAGLAGRANHFVSSVSIMGDFAWKPLMKQVGPASGIMPLCIAAPSVGGGGQPAEVEGPYEPSRPKISGREAAPAIAEVVVQAAQAGFAMVLPSIVVDPLLSVDVAAIGASTIPPPSLTLLWHHLLRPRTLMSPSIICTPPVMLTHCRNATGCARLFLQRSLAILEKNGLRHQDRVQKVASLEVEENHQLSSKVGGALAKLLRTRLDGDDLFKHCKGLQAKKLNLGGKVESMESKLWAAKDREASKELEEELLLCKKKSGLFAEDLDLGLFDPFKDVKEGVLLDEEEIDAEEEAANEGQGAAEQGDDAYDHVCLVKSRVTWSHLSFSPNGCEELCLTFLWLKVLPNQCGDRSLDLLSSSSDGCEEVVLGFVEPWTRDVFVLGFFKPVELCRGLPRTGLGFCRPVKISKRVAWLARASYKVAGTRDVVHRALAYMSLVIGGMHWRCGDMLLDICHSLWVTQTRVMMDAHMHMSWVARTQGLVGCSSAHVVGDTYWRLSSM

SEQ ID NO: 170478 - protein, 501 aa, Glycine max
  Coding DNA Sequence Number=SeqID_78793
  Homolog annotation: Hit_ID=Q4CSD8; Match level="QueryCoverage=44%, HitCoverage=56%, E-value=4e-12, Identity=28%"; Hit description=Per -hexamer repeat protein 5, putative
MKLAEDNKNLEDQVLALTIEAKGLGMRAINAEALVRSWDAKIARIWLALAATDKEKEEVISDKKMIQQKDFNDLMMIDDISEDTTLTPERQMTLTEALHVEGVRERNVNKSSSSTLVEEGTREGTISEPSSSTLVEEDSQEGTVSESLSSTLAEEGTWEGIVSESSSSNLAEEGTREGNVIELSSSTLVKGGTREGLVSKSPSSTLAEGGTRDGTVSESSNSTLVEEGNRKGIVSESSVRTSPIEGGGRAPAKDTLSLKLRCCTKYVGIWPRGYSASYGTFSWKDATWKKPISLENFEGKGIVLHKKTPTPEEAEKQMAMDALIAKELVEEEVKGATQSKGNKKGKGKKNKKNALHIEEQVALEEAIRNNLKDSTVVSNSQTRTPLNIRPNRLRFKPLRLFTRGFHPHPNDIIFAKRIMVCPRMPTLDPKKRKKPKPCAPTLPIWQAIKSQRFSFLIAKKLKQLFVERRKFFEDDAGRMWEQHLCDQRQETGSLNLSKEER

SEQ ID NO: 170479 - protein, 183 aa, Glycine max
  Coding DNA Sequence Number=SeqID_78794
MYVAYLCLCRNSGFASIILFVATPPFTASLAATVAVGVKGKNGVSLKDSTLFGLFLIEPIKANFNFLTLRCKKEYMVKCVSWIAGAVTVIYNYKYIRSGNVMFFKQLKRLRWLKRLDLVGFLLSLDFLARTLTQLHTSLLLELLLFSECILDCQGINLTTFMSCTWRSMRNAAKILSNLTKGT

SEQ ID NO: 170480 - protein, 229 aa, Glycine max
  Coding DNA Sequence Number=SeqID_78795
MVLGSEDGVTSNEDFLLDDRELESDYYLSSKDNDEDDEVKIIIMPMLATEEVGDEDGYGRGLVYFWSDLADGPSLSPAINLAYIRKNCWNLDNPTITFPGTRKTRARGPSNASTSAPASTSTPAPAPAPSQITAPSNTSPSPVGGGETPTTHEPEPDATSEETPKVTPAATPLEATEEGDGAADTYYAVDMAAVQGTWDPWSTPAQDTSSPVQDTPSAPQDDPAPTQED

SEQ ID NO: 170481 - protein, 456 aa, Glycine max
  Coding DNA Sequence Number=SeqID_78796
  Homolog annotation: Hit_ID=A7PP25; Match level="QueryCoverage=97%, HitCoverage=98%, E-value=1e-43, Identity=29%"; Hit description =Chromosome chr8 scaffold_23, whole genome shotgun sequence
  Pfam annotation: Domain name=DUF247; Domain location=23-445; Score =191.0; E_value=3e-54; Accession=PF03140.6; Description=Plant protein of unknown function
MTQQPDFSWMVPIEVMLGALYHGQVQACSISSVTDELRSPNEAAFKPKEVSIGPLHRGTTRHVQLMEETKWHYMREFLDRRGTQEQNRRSERRLRECGTDILKLDKIIMACYGGNIRSEPQELAKIMIVDGCFLLELLIRLGDFICNNSSSYANDPILKNEEKMVSVLNDITLLENQIPFIVLKKLYRKVFPDGSDINNDNRVADIVCKAFGYTEVKAPVHILHLMHLSTVEQTQQEGKRVEQELLRCATRLQAAGVEIKAANTIARHKLVDWFNFEISFSDSVLRIPPLYVKDTTEVRWRNLIAWEQSRIWIRCKYTSYALFFQGLVCCKHDIELLEKNGVIVNKAGKSTDELLDLFRTIAKGAEYMDSSYSEIGARLNMYNRGKITTAFQGLPVVTWHKCRHVLQIIVYYWGNWYRILIRDHIPTVWKFIGVLAAAALLVLTIMQTYYSSRNKD

SEQ ID NO: 170482 - protein, 170 aa, Glycine max
  Coding DNA Sequence Number=SeqID_78797
MSIRFVLSNLIAKAVWTTRSMSGANKKMIEALVARKKEECLKNPELGRIFKLYKSEKRFEHVILKLCASRCKKCLKMQEMISKKKEMLQYPTKLKLFEPRCYDGAREAIVGFMKRPCLFVVSDDLKVRQLTTTSSIQYMQELGNVKFIDLKEHMVEIRKSHEVIILAIHS

SEQ ID NO: 170483 - protein, 183 aa, Glycine max
  Coding DNA Sequence Number=SeqID_78798
GSNNKLKLRRAERDESRVESMALKDKLKACHRSKRSLTEQSSGTEENMLTIIDQYKEKVNLAASLRQRLEDEHAKVLTLQMEREARERVIESLRWEAVKWMDRFALTLNGSQELPRLLARTKAMTEVYLTPDELSYPNFVRGLSFDDIQPLIGRFEIFGTLCCTICEVPRRAENQKEAGLRDP

SEQ ID NO: 170484 - protein, 116 aa, Glycine max
  Coding DNA Sequence Number=SeqID_78799
IPEHKAYWALKLLNFDNNACGEKRKLQLLELEEMRLNAYVLRLFPGGVPIAKVKWAAGSHALSAHPRAKRPTSMRSFNGDFPPWRCSGRQRRRGERRRHPLGNKPWKNELHHQDEP

SEQ ID NO: 170485 - protein, 46 aa, Glycine max
  Coding DNA Sequence Number=SeqID_78800
MRRKEERRRKKEHKYEDPMPIAHLYVSMEPLLSMNVQFADKCVPAR

SEQ ID NO: 170486 - protein, 36 aa, Glycine max
  Coding DNA Sequence Number=SeqID_78801
MGAKHLHEDQRMVARHRAKVSLHMMSHMLEMERLSL

SEQ ID NO: 170487 - protein, 249 aa, Glycine max
  Coding DNA Sequence Number=SeqID_78802
  Gene Ontology: Mol. function=magnesium ion binding; Cellular component=cytoplasm; Biological process=Mo-molybdopterin cofactor biosynthetic process
  Homolog annotation: Hit_ID=A8AL83; Match level="QueryCoverage=76%, HitCoverage=97%, E-value=2e-54, Identity=55%"; Hit description =Putative uncharacterized protein
  Pfam annotation: Domain name=IspD; Domain location=7-187; Score= -109.8; E_value=0.089; Accession=PF01128.10; Description =Uncharacterized protein family UPF0007
MTAFTGVILAGGQGSRMGGQDKGLLPLQGKPLYQHVLQRLQPQVNIVLISANRNIDRYQASGCQVIRDSLPDYPGPLAGMLSGLRHSQTEWVAFCACDTPWLPQDFVARLWQQRGAAAAVWVTSGQRDHPALALVHRALADDLEAWLLRGERRLMQFMREHGGHGVLFDDDEAAFRNINTPDDLVNEESDSATESAGHSPRADQAYPSSDGHRYAGKRQLSAAQSGSRSGDRRQRTTLGVNVRNAAAAA

SEQ ID NO: 170488 - protein, 92 aa, Glycine max
  Coding DNA Sequence Number=SeqID_78803
MEFCALGIVPYVTTYPFAGERGEAHECVFHRRKMRGVATNVLLKGKTLEKTKGKLVIKNIPDSGVIFTFEEGRQKRGSCSYVPSIEEEIRPT

SEQ ID NO: 170489 - protein, 171 aa, Glycine max
  Coding DNA Sequence Number=SeqID_78804
MENEEEENGNVRERESCLKTQYVDASDCIILDDHEGEEHCCGKGTNARSVSFLLRSQEKIGDSAKVVIKQDMKGGEHKYGFNNNKRSWLLHLPLPPPPPPPPSDASASPSTVKRTRKASCLRSLSTRPPGAERPVVHVDPATGKADGPHRKKLRTYLGIVACDKVDVTYEN

SEQ ID NO: 170490 - protein, 134 aa, Glycine max
  Coding DNA Sequence Number=SeqID_78805
MSKCPRCGGSRYKVKDDEDDSSDENSKKGPPAKMTLKTLPDMQMGETLMEWSVIRLTARSGRRFMDEEVLVFDEFNKETTAIERPEHPGRVRAAGAGVTIKQYFGSAPRTSPSSSSMPPDDLQQLTQQIKDQLE

SEQ ID NO: 170491 - protein, 216 aa, Glycine max
  Coding DNA Sequence Number=SeqID_78806
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=50%, E-value=1e-23, Identity=100%"; Hit description=LacZ protein
MKHFTDTLISANIGTKAGTGPPLEVDGIDKLDERHRGRVHPDRRPGPAAADRDQLRHLHPDRHRHPAGPGSAAAGAADLAAGRAGTLRSHARSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 170492 - protein, 153 aa, Glycine max
  Coding DNA Sequence Number=SeqID_78807
  Homolog annotation: Hit_ID=A5C922; Match level="QueryCoverage=60%, HitCoverage=35%, E-value=1e-08, Identity=33%"; Hit description =Putative uncharacterized protein
MAQPPPRERTLREMVAPDFTYESLCIQYPDEDVPYVLKTGLIHLLPKFHGLAGEDPLFLIPRSITSWDDLKRVFSEKNFPASRTTAIRKDISGIRQLSGESLNMERSMIDAASGGALGDMTPAEARNLIEKMASNSQQFSARNDAIVIRGVHE

SEQ ID NO: 170493 - protein, 177 aa, Glycine max
  Coding DNA Sequence Number=SeqID_78808
  Homolog annotation: Hit_ID=UPI00006A2939; Match level="QueryCoverage =79%, HitCoverage=75%, E-value=2e-11, Identity=31%"; Hit description =UPI00006A2939 related cluster
GLHVLTFRRLHALAIRGLRVLTFRGLHALAIRGLHVLTFRGLHALAIRGLHVLTFVGLHALTFRGLHRTNVLANVGLHALTFRGLHVLANRGLHALTFRGLHILAFRGLHVLTLRGLHVLALRGLHVLTIRGLHALTSRGLHVLALRGLPALALGTSYPHLQRTTCPHLRRATCPHL

SEQ ID NO: 170494 - protein, 177 aa, Glycine max
  Coding DNA Sequence Number=SeqID_78809
  Homolog annotation: Hit_ID=Q2HSV3; Match level="QueryCoverage=66%, HitCoverage=20%, E-value=2e-08, Identity=29%"; Hit description=IMP dehydrogenase/GMP reductase, putative
MKAHMKGIQGAPYRAHLDALTIKDVSWLPYSEHRAVRGFELISCYRGQLRWGHVVFGYIETIPPPSVTASLSYDEIDERWMHFRDHLAPAGEICVVPGQVSADYMEWFFKISHLFVTPTHEGDEPKQPATPDVDAYVEPHVPWRFQLQLISPYIQWFLVKVAKRSHKGWSVCSTLGW

SEQ ID NO: 170495 - protein, 16 aa, Glycine max
  Coding DNA Sequence Number=SeqID_78810
IPSSEEVYPMKKVTLN

SEQ ID NO: 170496 - protein, 85 aa, Glycine max
  Coding DNA Sequence Number=SeqID_78811
AASERGSLVSHQRELCQHGLDVQGMGHHDTQRNPARATKLGAAVSSRVRIGELDPDFDFKQLINQAEEGEDEDWGLPPELKRMVE

SEQ ID NO: 170497 - protein, 160 aa, Glycine max
  Coding DNA Sequence Number=SeqID_78812
MVIDQSLFYDLTQLSSEGVPFEGSLNDDWKFDFSVHDAHRFVCTNQADMTRRLLAGSLAFESRILHYLIVRILLPRSSNLAQGAQPIDEEGHLPVGEDFSLLQRILDRFDGLQTFVGERFDALELQVDMRFDEMDSRITKVKGDVSYIRTCFDLPPPPPS

SEQ ID NO: 170498 - protein, 79 aa, Glycine max
  Coding DNA Sequence Number=SeqID_78813
MATDQHLVMVNKKRRPIICRTKLDLNKTSKEASKAIEVAQVSISNQKNTDASIKNLEVRVGKLAKYLFEHGSGSFSATT

SEQ ID NO: 170499 - protein, 101 aa, Glycine max
  Coding DNA Sequence Number=SeqID_78814
MWTTGLSAPGGLVAKDHSHVALRVRFTVDEDADGSAGGGRGGEPGGVAMVLMSVATCPFAGVRGDAHGCAFQRRKDAQSRHQRLFVENVGKTEGNRSKRKF

SEQ ID NO: 170500 - protein, 226 aa, Glycine max
  Coding DNA Sequence Number=SeqID_78815
  Pfam annotation: Domain name=G-patch; Domain location=1-42; Score =22.5; E_value=0.00036; Accession=PF01585.14; Description=G-patch domain
MVARVMLRHGYEPGMGLGKDSHENADVVDVRRNPHKYGLGYEPGKPGRRNAPSRLRADRAWPGHVSQCFTSAGIMFEEEVAAIGEEAPQDPPSFLRPCNPNFQLGNWHVTSQSEVYTADSICENRSFEDPNSEGLIIDFDREVSQTINKEEEEDVLSPELERLIAQEERVSQHALLRASDARLAGALSKGGKMRGVATNVYLWKTSEKPKGIGQNENSKFGSCIYV

SEQ ID NO: 170501 - protein, 278 aa, Glycine max
  Coding DNA Sequence Number=SeqID_78816
  Gene Ontology: Cellular component=integral to membrane
  Homolog annotation: Hit_ID=A1JM37; Match level="QueryCoverage=98%, HitCoverage=89%, E-value=1e-110, Identity=43%"; Hit description =Putative uncharacterized protein
  Pfam annotation: Domain name=MCE; Domain location=125-207; Score =20.2; E_value=0.0013; Accession=PF02470.11; Description=mce related protein
  Pfam annotation: Domain name=MCE; Domain location=3-98; Score=26.2; E_ value=0.00012; Accession=PF02470.11; Description=mce related protein
  Pfam module annotation: Pfam domain module=MCE::MCE; Domain location =125-207::3-98
KPDVLTVQLSAPETYGIDAGQPVMLYGVKIGQVISRRLDENGISFVAAINPEHRQLVHADSKFIVNSRLDVKFGLDGMQVLGASAREWVDGGIRLVPGAKGQPSSRYPLYADSERAAEGITGDQPPTTLKLTANSLPDVQAGSVVLYRKFQVGEVVDVVPRADAFEISVHIQPQYRKLLTSESVFWAEGGAKVQLNGSGLTVQASPLNRALKGAISFDNLTGAQAAKGVKRVLYPSETAARAVGSQITLHTFDASKLSAGMPIRYLGINVGQVESHWR

SEQ ID NO: 170502 - protein, 54 aa, Glycine max
  Coding DNA Sequence Number=SeqID_78817
MASRKCKSIGSRPTTQYDTRRFYSFDALNRYMDNILGRNIVPERKVEIVGSSGL

SEQ ID NO: 170503 - protein, 82 aa, Glycine max
  Coding DNA Sequence Number=SeqID_78818
MSNHKSTESAMKNLEIQVGQLAKQLAEKSSSSFGENIEKNPKEECKAVITRSSKLVAAEDEDVVALKEKVALKDTTAKKKNE

SEQ ID NO: 170504 - protein, 230 aa, Glycine max
  Coding DNA Sequence Number=SeqID_78819
MKREKHASYSSHNSCKSLSEELCEYYEGRHRSHLRPHSHRREKERKPQVANINLSYFHGKDNVEANLDWEIRVEQQLKNKGYITSQCPTTKTMIMRSQDIYSSQDEATTSPSSSESDEAKGEESSEEFYPQEEGQPLMVKEECKEVSASSKRLVKKESHFEIKKNIKETSPLRQPLHLLLCKKTLVSTATPLGLEVIPQVKELLDEGLVRKSLNPCALLVPKIVMHPTSS

SEQ ID NO: 170505 - protein, 127 aa, Glycine max
  Coding DNA Sequence Number=SeqID_78820
MTRGNPSDLQPFDPEIDRTFHRLVRHHFIPFDHSEHSITGESVHSVIGDFEHPDLEHYNFEHSDSEHYDFAHSENMAQPPPRERTLREMDAPDFTYESLCIQYPDEDVPYVLKTGLIHLLPKFHGLA

SEQ ID NO: 170506 - protein, 469 aa, Glycine max
  Coding DNA Sequence Number=SeqID_78821
  Homolog annotation: Hit_ID=Q2HW90; Match level="QueryCoverage=45%, HitCoverage=43%, E-value=2e-25, Identity=33%"; Hit description =Putative uncharacterized protein
KNLELASLRELGQRMDQVRRQAFSKAYGKIWDLAMIEVSIEAITSLAQYYDQSLRCFTFGNFQMVPTIEEFEGILGCPLGGRKPYLFSGFYHSMEIVAKVVKISAQELDQMKQNRNGVVGIPRKRLGEKEEALADQGEWTSFIDLLALLVFGTILFPNIDGLVDLAAIDAFSAYHHSKENPVIVVLANAYDTFDMRCKKSGARIVCCTPALYVWSSHVHLKGKSKLGGTLGRIPKRPLDGNKGLVSIKAMQKILQRIRKAWDTMERKDKELRGSNNGVIGGYHKWLKARTQGITWLPKVKGPSGKEAEVPEESEEVQALKAELEKMRVVKEKLKTTVTRVRKECDKLRDVNMTDVAGNKEGPKEEWSRNKFRGALWGGSNEIKLRRAERDESRVENMVLEDKLKTCQREARERVIESLHGEAMKWMDRFALTLNGSQELPRLLARAKAMMDVYLAPDEVHELFDYCQHL

SEQ ID NO: 170507 - protein, 77 aa, Glycine max
  Coding DNA Sequence Number=SeqID_78822
MARSVFAPCPYFRDLHGRKLKGLLVIIPKVVISLLMVSRGIIPFEEHIATVGTTSNNVLSKRKTLDEGSLLSSKSET

SEQ ID NO: 170508 - protein, 55 aa, Glycine max
  Coding DNA Sequence Number=SeqID_78823
MPFNVVVPREASSTLSLIPLVAQSPPVIDDDMEDAMELELEPEEDPEEDLEEDTR

SEQ ID NO: 170509 - protein, 41 aa, Glycine max
  Coding DNA Sequence Number=SeqID_78824
MAKVDIGKNGKNYLLPKLKKLAILGNREQNSKLKIQIGSLK

SEQ ID NO: 170510 - protein, 74 aa, Glycine max
  Coding DNA Sequence Number=SeqID_78825
MLVEAMQEMHFVGEAFVVEWAIFVGWVLDWEEFRCWLNNGTDTRNMGKWGCEGFVGILAMWELKLQHGRLCPSS

SEQ ID NO: 170511 - protein, 126 aa, Glycine max
  Coding DNA Sequence Number=SeqID_78826
SEEKLEESQEIVKDALIAVGRHDCHHQKGGDCGSNDFQDYFDDAEESKVKQVPKNQESKKLQESSFKESRFKNNQVSRFKIQDSRTIKFEESRFKYNQDQDSRLKIQESREDSIKISTEKVFQNIE

SEQ ID NO: 170512 - protein, 55 aa, Glycine max
  Coding DNA Sequence Number=SeqID_78827
MAPNSLGFLLRILDGGKIQVTIKKPMTRKFKDHIIENVIYAMSYFGVIGNRVVSE

SEQ ID NO: 170513 - protein, 113 aa, Glycine max
  Coding DNA Sequence Number=SeqID_78828
MGPVYLGQRLGLVNLGHRQGPGHLGQSQGHCMWDKDRLVEAIVERDGNQKTHNSTYVLEIFRTNRDQIWEDWRDVAGRRGHRHAPTEEDESRDGVTSRKCRRNGDSGDLQRKM

SEQ ID NO: 170514 - protein, 78 aa, Glycine max
  Coding DNA Sequence Number=SeqID_78829
MTFSGENCWFLKILAFLWYQMEKDRASHRNSHALLKMILWIYGIGTHSINPSHCLPPKTPSLFTVEHKMINRFFFMIT

SEQ ID NO: 170515 - protein, 284 aa, Glycine max
  Coding DNA Sequence Number=SeqID_78830
MSTSGPVLSISRTSSIGLLKKDCNFFLIFVLEAIAVPGVRSALLLLSLNVFSHFQSVTNVFPACFIVYFSTCIVHPKLKVLIILKVSPIVLLSEFEIPRFGLRKFIMAQHQFQPSGAPSTPIPPSLSSPRSSTLFSSDDQRQRQGVLFEGTLVYDCKFNYSSHDARRIFCNDQADMIARLLAGSLTFDCHIMYYTIARILLPCSSNLAQASEEDLILMWVFLTGRQIEWTHLVRYRKHKALPANAPLSYPHDNFFWAPPIPDERTPSPPPQRDVSSTLMNEVPF

SEQ ID NO: 170516 - protein, 116 aa, Glycine max
  Coding DNA Sequence Number=SeqID_78831
  Homolog annotation: Hit_ID=A5BFT3; Match level="QueryCoverage=43%, HitCoverage=3%, E-value=8e-10, Identity=54%"; Hit description =Putative uncharacterized protein
MELDLFFAREKILNKKLDVAHVPAMDQIADVLTKALSPSSFLSFRPKLKVVERLLPTPLELAGEYKKIKVHLEVLLHTFYPGPGVEQGIIHDLFRRELLVLEDLGISMVPNGEGQG

SEQ ID NO: 170517 - protein, 80 aa, Glycine max
  Coding DNA Sequence Number=SeqID_78832
  Gene Ontology: Mol. function=aspartic-type endopeptidase activity; Biological process=DNA integration
  Homolog annotation: Hit_ID=A5ADA3; Match level="QueryCoverage=90%, HitCoverage=6%, E-value=5e-28, Identity=75%"; Hit description =Putative uncharacterized protein
MFCEEAGIEHQLTTPYTPQQNGIKRDKLDKKAEHGIFVGYSSVSKAYRVFQPHTRKILISRDVYFMENEKWSWIVLKRRR

SEQ ID NO: 170518 - protein, 122 aa, Glycine max
  Coding DNA Sequence Number=SeqID_78833
MKLNQKVKAEIKRVGKKETNTQEFLYWFDNNPCLHPVPKRPAVLEISFQPCKNPFTSKDPQGMYPSLFSLNNLVDVPSTRTDPQEMYPLLFSVKLKEESKEFSDCVVLNSLTRENGDTKEFR

SEQ ID NO: 170519 - protein, 75 aa, Glycine max
  Coding DNA Sequence Number=SeqID_78834
LSLEYFPLDLMMKYVQFQLTIWAQRASIAKYSFGVLNATEESGRASISRLQLSIMVVFSQAQHRTGAKLKSTNSR

SEQ ID NO: 170520 - protein, 97 aa, Glycine max
  Coding DNA Sequence Number=SeqID_78835
  Subcellular localization annotation: CTP_CleavageSite=60; ConfidenceScore=5.13e-01
MASYGGEFVLDSSSPWSGISNHLSSFSIPLPMIFKKQMTPLMKKIQGLQTPHGAASCGIRASSSRALDRRLQEDWAREAREGPRVLMSLRIDFGLMG

SEQ ID NO: 170521 - protein, 221 aa, Glycine max
  Coding DNA Sequence Number=SeqID_78836
MGHIQQQEGTSVVGVLQLKRNQGVTYNLIMYKMMRLTKLSKCHRSTKSLKFKIFHQVMSTLPDPHHMTPVGKGQLWKKNVVRLLPPQDNFPSYTSSPSFVYMPVRSPDVAPTPSPPPTEVRPFSSHVDACGPSPIDARGSSPVLTSTPSPSPALANMPTDEDATNLAMENPSPAPLMIVLWFHPSKVAAKVVTLSIRQQFCQSLSTWGATSKVIRNFFPMF

SEQ ID NO: 170522 - protein, 67 aa, Glycine max
  Coding DNA Sequence Number=SeqID_78837
MKRCMMRSRKPDMGLSTIMHHQKGKTLDEASLLSSESRTQHDHRFTSTPYVPMNPGIGPNISKYAQK

SEQ ID NO: 170523 - protein, 33 aa, Glycine max
  Coding DNA Sequence Number=SeqID_78838
MAIYRKRPFGAGKARPELTKNHQNPVRPLGLAL

SEQ ID NO: 170524 - protein, 278 aa, Glycine max
  Coding DNA Sequence Number=SeqID_78839
  Gene Ontology: Mol. function=dihydrodipicolinate reductase activity; Cellular component=chloroplast stroma; Biological process=lysine biosynthetic process via diaminopimelate
  Homolog annotation: Hit_ID=A5BWJ3; Match level="QueryCoverage=33%, HitCoverage=31%, E-value=3e-32, Identity=77%"; Hit description =Putative uncharacterized protein
  Pfam annotation: Domain name=DapB_C; Domain location=139-260; Score =19.8; E_value=2e-07; Accession=PF05173.5; Description=Dihydrodipicoli nate reductase, C-terminus
MIEILAKARNLLLECDFNSSNLLFLSERFLVFKEAKQLMELVHQTLQVVDAAAYSLRMIYQSMLAPYENENLTGLGAGIVIHSCKTIGEQNILCHASILEKLTSLLDDKFKILSKGRGIRWSYHVKSERKFDFQLSFTGVDVIKVASSRRSFDKTLNKMDLPSADANQIANNLSNLGQIYNGEDPSTDGLKERGQVLGDGIRVHSMVLPELPSSTTIHFYSPGEVYSIKHDIIDVKCLMPGLLLAIRKVVHLKFVGKHYVEGLKRSNKRKTHRPQTAF

SEQ ID NO: 170525 - protein, 68 aa, Glycine max
  Coding DNA Sequence Number=SeqID_78840
MDLHDPFQQKGREAIKLSNVGFNSTTLVKGGMNGPYDKHSHQESSLVVYCLLHLYHLSQPTLRREGDA

SEQ ID NO: 170526 - protein, 260 aa, Glycine max
  Coding DNA Sequence Number=SeqID_78841
MGASDKNSEGVYLRAFLFSLTGSDEPLCETWERFKSLLRRCPNYGTMMSKSPEEPIVIIDSIVASDYQSHHDRASVQRKGIMMLDNQNAILAHHKLLTKQIEALTKQIGQLPQQFQQGGGGPLFAESRQQDNNAYSGPTNPSFASISNNSYAHPLNRGPPPPQQQQAQTDKISGWTTCKTTHEHGGGSFSINTQGDAGAHGCVFHGRKMHRVATNVYSRKTSEKPERATRDSWERVPRKEYARSRHQHLFEENVGKSEKT

SEQ ID NO: 170527 - protein, 119 aa, Glycine max
  Coding DNA Sequence Number=SeqID_78842
MKRLTIATEVDTTVTMLNNDSDDRHNGDSGNVHADKLLFEPKIAKTERKKKKQATIKPPGESSSTDCRSIEKPPLVIDNRDAEALPKRFRNVFREEFLEGFRPFFDVLHSFFIVIRSST

SEQ ID NO: 170528 - protein, 364 aa, Glycine max
  Coding DNA Sequence Number=SeqID_78843
  Gene Ontology: Mol. function=transcription factor activity; Cellular component=intracellular; Biological process=regulation of transcription, DNA-dependent
  Homolog annotation: Hit_ID=A1G1C2; Match level="QueryCoverage=25%, HitCoverage=36%, E-value=2e-46, Identity=100%"; Hit description =Putative uncharacterized protein
IIGPLVVAEVGVGGAGGQQQAVVVQRAAIGHADLPGLLVDGHHFAEADFHIALVAEDVAQRCGDIRGGQAGGGHLVQQRLEEVMVAAVDQGDAYALAGQGAGGPETGKTAADNNQVGNALATHRLTPVGALGEAPGIFARRPPVTSAPGWIGDTRVQATAREEPMSEPEKRIALLIDADNAPASKIDEVLAEVARYGVANVRRAYGNWKSPRLKGWEAVLHEYAIRPIQQFAYSKGKNASDMAMVIDAMDLLYARNLDENAGTVRQRVLEVHLSGSAGPDPRQRAGYRTGLQRTGLERAGSQRRCAAAQERCGNAQRHPAGEDAAPRGVLGRGRGWLVASGAGWQPDRQPGFVRSAQLRLRQAQ

SEQ ID NO: 170529 - protein, 185 aa, Glycine max
  Coding DNA Sequence Number=SeqID_78844
  Homolog annotation: Hit_ID=A5BQX5; Match level="QueryCoverage=62%, HitCoverage=35%, E-value=1e-08, Identity=33%"; Hit description =Putative uncharacterized protein
MTRGNPSDLQPFDPEIDRTFHRLVRHHFIPFDHPEHSITGESVHSVIGDFEHPDFEHYNFEHSNFEHSENMAQPPPRERTLREMDAPDFTHESLCIQYPDEDVAYVLKTGLIHLLPKFHGLAGEDPHKHLKEFHIVYSTMKPPDVQEDHIFLKAFPHSLEGVARTGCITLLQGPSRAGMTLREYS

SEQ ID NO: 170530 - protein, 83 aa, Glycine max
  Coding DNA Sequence Number=SeqID_78845
  Subcellular localization annotation: CTP_CleavageSite=26; ConfidenceScore=5.32e-01
MSTLSRVTIPNCVLNFFLWGPSAFPVARSTWTTGLSAPAGLVANDLSRVVFLVHFKVDDNYDVASVGGGGEGGGGELDRVAIG

SEQ ID NO: 170531 - protein, 181 aa, Glycine max
  Coding DNA Sequence Number=SeqID_78846
  Gene Ontology: Mol. function=helicase activity; Biological process =viral genome replication
  Homolog annotation: Hit_ID=Q2A9I1; Match level="QueryCoverage=93%, HitCoverage=13%, E-value=1e-38, Identity=42%"; Hit description =Putative uncharacterized protein
MVSNSNEITQNDELKEYLDCRYISPCEAAWRIFAFPIHGRKPAVERLYFHLPDQHNVLYEDHDDIDDKQITTTQEKKGYTIGRLIWVPPTTGELFYLRMMLGSCKGPTSFEDIRTVANIQYATYRETCFAMGFLQDDREYVEAIKEAKDRGTANYLRKLFVLILLTGAMSKPEEVWNQCWH

SEQ ID NO: 170532 - protein, 83 aa, Glycine max
  Coding DNA Sequence Number=SeqID_78847
MSISSSTASTRIRYPIVRPPAIIQFRAAFHNDQRYPHFTMNNGHPITHTKFGSNTMEQPTQYESSNIEADIFLQMGSQTSGQI

SEQ ID NO: 170533 - protein, 90 aa, Glycine max
  Coding DNA Sequence Number=SeqID_78848
MHRSPTGTLVPLDLEIEATLRRNRAERRRKLLQDRTVVSILEEETHFSNSSSPYSPSSRESANQHSEAVTMADEHNQRTTLEDYSSGSVP

SEQ ID NO: 170534 - protein, 87 aa, Glycine max
  Coding DNA Sequence Number=SeqID_78849
  Subcellular localization annotation: CTP_CleavageSite=71; ConfidenceScore=5.30e-01
MASRISWKSSYTPDPSHGFPPQPLSHFAVEEKMSSLLMLTATKRARNILNRNASSGQISPSGESIQKQPPRDSYLADMKAIPKPDPL

SEQ ID NO: 170535 - protein, 198 aa, Glycine max
  Coding DNA Sequence Number=SeqID_78850
  Gene Ontology: Mol. function=transcription factor activity; Biological process=negative regulation of transcription, DNA -dependent
  Homolog annotation: Hit_ID=A1FYU9; Match level="QueryCoverage=97%, HitCoverage=98%, E-value=4e-60, Identity=59%"; Hit description =Transcriptional regulator, TetR family
  Pfam annotation: Domain name=TetR_N; Domain location=14-60; Score =51.2; E_value=3.5e-12; Accession=PF00440.14; Description=Bacterial regulatory proteins, tetR f
MYRRDIPEQRKEQLINAAFETINVVGLAGVTLSQVAKEAGLSTGIVSHYFGDKEGLLSATMRKILRDLRDAVAECRAQAASDSQSQLFAIIQGNFHPSQTNAVSMRAWLDFWAASMHQPVLRRLQRANDRRLYSNICSQFRRELPLPQARDAARGLAAMIDGLWLRGSLAGDETDLKQDCRIACDYVIQRLKAAPSAA

SEQ ID NO: 170536 - protein, 136 aa, Glycine max
  Coding DNA Sequence Number=SeqID_78851
  Subcellular localization annotation: CTP_CleavageSite=54; ConfidenceScore=5.10e-01
MRSDWLVQFSILNHFRSPMNCVFVHVSSTHEFGAIRSDCLVQFSIFFRSPMNCVFVHVSSTFEFGAMRSDCLVQFSILNHFRSPMNCVFVHVSSTHEFGAMRSDCLVQFSILNPFSEPHELRFRSCVLHPRVWSHA

SEQ ID NO: 170537 - protein, 104 aa, Glycine max
  Coding DNA Sequence Number=SeqID_78852
MSLPIAVHVSSTFKFGAMLHDCLSVDPLVQSSILQFFSEPHECHCLALFMCPHVRVWSPCECDCLALFANSPFSTSIRSPMNVIAKRCSFMLHPKSLELCFMIA

SEQ ID NO: 170538 - protein, 473 aa, Glycine max
  Coding DNA Sequence Number=SeqID_78853
  Gene Ontology: Mol. function=motor activity; Cellular component=cell projection
  Homolog annotation: Hit_ID=UPI00016621D1; Match level="QueryCoverage =99%, HitCoverage=40%, E-value=3e-20, Identity=31%"; Hit description =UPI00016621D1 related cluster
MGLHILAFVGIPVLAFRGPHVLPFIGLHALTFSGLCVLTFRGLHPLTFRGLHPLAFVRLHALTFRGLHIFGFIWLHALCFLGLHALAFRGLHVLPFRGLHVLGFGGLHVLTFRGQHVLGFRELHVLTIRGLHDLIFRGLHVLVLRGPHAFAFVGLHTITLRGLHALSFRGLLVLQLRRLHLLTFRGLQRTTRPPLQRTTRLHLQRITRPHLQRATRPCLKRTTRPHHKGPQALAFVGQHTLTFRGLHVLAFIRLHALAFRGLRVLAFRGLRVLTFRGLHVLTFRGLHVLSLRGLHVLTFRGLHVLTFKGLHALAFKELHVLVFRGLLALAFRGLHVLTLRGLHAFTFRGLQVLAVRGLHALTFRGLYALAFVGLHALTYRGLHVLAFIGLHSLTFRGLHVLTFRVLHALAFRGEPVLAFVGLHALTLRGLHILAIRGLHALAIRGLHVLAFVGLHALNFRGLHVLTFRGLHAL

SEQ ID NO: 170539 - protein, 229 aa, Glycine max
  Coding DNA Sequence Number=SeqID_78854
  Gene Ontology: Cellular component=mitochondrion
  Homolog annotation: Hit_ID=A6H595; Match level="QueryCoverage=30%, HitCoverage=80%, E-value=8e-28, Identity=85%"; Hit description =Putative 23S ribosomal RNA
MDVDKILPSSSTLGWHSLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPMSRRLIGSGLVRETTGAVAKASLHRAIVTAYGPEPGSEPTDVEESADELWLGVKCHSNPELAGSPRNALRRSS

SEQ ID NO: 170540 - protein, 161 aa, Glycine max
  Coding DNA Sequence Number=SeqID_78855
MWAFHTGRQIDWAHLVRYRMHKALRLNAHLPNPHLVTLFLQHFNFPLDSELYVPIKRSFLIGAAVVASFGYRKERDGSWVKKGAQPNDDGGHLSVEGDSSLLQSILDRFDGLQTYVGERFDSLERQVDTRFEEMNSRIAKVEEDVTTIRDYLDLPPPPPSV

SEQ ID NO: 170541 - protein, 171 aa, Glycine max
  Coding DNA Sequence Number=SeqID_78856
VESSQATVRSQDKSMAEINQGTDPNGARVTTDRSLPLPSAKQVENVAAGQPSSSGQTLTHKEGGDMVNVPLKNKNGRLAVLASSSHFWLPFAFIFGVIVHSNKKWPQGNLPQKDPGRIKRPKEPVPLPSMTVTALGALNTSSALRPSRDGHFSGSDASSSGTMSILISRRR

SEQ ID NO: 170542 - protein, 129 aa, Glycine max
  Coding DNA Sequence Number=SeqID_78857
MWDATVFGVFNQDFPLYIKHEDLSEIAHCSQCLSISVIQLWILAHWQMVVILPKENLVVWFCSLHNRLDNYLKGILNSALKGLDGTPQPKSKAGARWIYFNDVRPLEAERLKALRIQCAHYYLKVRNQT

SEQ ID NO: 170543 - protein, 161 aa, Glycine max
  Coding DNA Sequence Number=SeqID_78858
  Homolog annotation: Hit_ID=Q2HSI4; Match level="QueryCoverage=68%, HitCoverage=55%, E-value=7e-08, Identity=34%"; Hit description =Putative uncharacterized protein
IMVRTRGLGRALGQVTGRGLGRGDRDDSDDAPQRRRPTASAQRQRVAVTVDHVDELVIPAPDVQDDPMEAPAVGFPGGPSDPSVLTAYADHVACSVWTGEERPELKLSSHGRKVHSLGRHVPAIEGLIAGTGLSPLIACSVDTGDRGLLSAFVERWHRETT

SEQ ID NO: 170544 - protein, 315 aa, Glycine max
  Coding DNA Sequence Number=SeqID_78859
  Homolog annotation: Hit_ID=Q2HW90; Match level="QueryCoverage=90%, HitCoverage=61%, E-value=5e-32, Identity=31%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEELLGCPLGGRKPYLSSGCLPSLSRIATVVKDSARGLDRIKQTRNGIAGLPQKYLEDKARDLAAIDAFLAYHHSKESPVVAVLADLFDTFDRRCEKSSARIICCLPALCVWLVSHLFQQDTRHPCPLLSHRSCTEKRRIDWDQLLAGIGGRTISWFPRWKEGKEGVLFSCGRYPNIPLVGTRGCINYNPALAIRQLGYPMRGAPTEESMSPFLVRDLGAQKFQDYTKNP

SEQ ID NO: 170545 - protein, 354 aa, Glycine max
  Coding DNA Sequence Number=SeqID_78860
  Gene Ontology: Mol. function=transporter activity; Cellular component= membrane; Biological process=oligopeptide transport
  Homolog annotation: Hit_ID=A1FTU9; Match level="QueryCoverage=85%, HitCoverage=60%, E-value=1e-155, Identity=90%"; Hit description =Amino acid/peptide transporter
  Pfam annotation: Domain name=PTR2; Domain location=14-300; Score= -30.6; E_value=8.9e-05; Accession=PF00854.12; Description=POT family
MAGSVRPEGRAPRSGSHLLHGHNIGAMTPGADRVPGRKSRYRCHAVLQGRVIASGVGMLISLVWFYIGRAGLKGIGAPPAGAEGFGRIIMVLAGAVVAIPVAYFLLATGATALAWILGAMFTALAILLLVEGIREGKVQRDRVIAMLIIFAFNVMFWMFFEQAGSSFTFLAENIVNRQFGEWTFPTAWFQSVNSVAIITLAPIIAWIWVAMGRANPSIPRKFGLGLLFNGAAFALLMYALSQMVVDGKIPFWTLFMVYVIQSVGELCLSPIGLSMVTKLAPVRLVGFGMGGWFLSTGIGNNLSGIFAGVVSGEGGMTVESALKGYTFGFWALIGSGVVLFLIAPLINKLMHGVK

SEQ ID NO: 170546 - protein, 104 aa, Glycine max
  Coding DNA Sequence Number=SeqID_78861
LGGIDGDPVLRGTRIRATWEYVSSVEGGQLRIVDSCVICGCGEMIYTIARSPPSTTYDGGTWRYVTGVRRPWGRQASSWQSTNKRIKTTKQGGLCGGWPAMDLE

SEQ ID NO: 170547 - protein, 147 aa, Glycine max
  Coding DNA Sequence Number=SeqID_78862
MALDLKNGILGDDKSLLYELILALGDKSFTLFDFGNLPVEDRRTTKNGGKSLQNHPRKHLGSVTEVSRLGFSSQKQFFSLILSDSQIPGGLNIFVQLSPPIYRKKREKLATQLAQVSWVASSRRHRLLVGLPGRPKWARLLFVPPVY

SEQ ID NO: 170548 - protein, 217 aa, Glycine max
  Coding DNA Sequence Number=SeqID_78863
MLVTLADRESTSVATLSLDAEGYTSTERPYYFDMQYGVGLGAVRGYMGVEPVPFLVKDITRALGLPAIHEPLKQFFHHGTGFYVMRLPERLEVTTSPNLFARDGPSFSMASQYCVRELHYGTHTWHPGHTTWGRVAGEPSQVVPGAVLLTGRGVAGAERWANALSAAGALDILGCFHPCWGGGDRVGISFLLPRAHYWGSSVVVGGHIGSIFELAFS

SEQ ID NO: 170549 - protein, 126 aa, Glycine max
  Coding DNA Sequence Number=SeqID_78864
MVSFATISEIRVSKATSQEEDLLHRGTKKIKEGAKVYMKGSSMSFADKLLQPMGRGDMSIETAMNLHKDVMNEVPKEKEVLELTRRMVRSSLCLMLVVNVWGETGELPYYWRKGSTLMGKKWYYSD

SEQ ID NO: 170550 - protein, 361 aa, Glycine max
  Coding DNA Sequence Number=SeqID_78865
  Gene Ontology: Mol. function=transferase activity, transferring glycosyl groups; Biological process=metabolic process
  Homolog annotation: Hit_ID=A7QMB6; Match level="QueryCoverage=47%, HitCoverage=33%, E-value=1e-23, Identity=38%"; Hit description =Chromosome chr5 scaffold_124, whole genome shotgun sequence
MAVGTILCLRSQWRPLSLSHTDWLLRLNVRGAYDPSSGTAACGGILRDYRDRFVLGFSIARKYDIWGIYHGMKIARRYEIWDLYRDILWQHSIRKSPKIARQHDFGKIVVGSGSEEAIGFVLDGCPTSTSVQHCFPLCHELKALTSATNHLYFFLTPHDAAADSFAEFGLSMKQQAALSIEQNMEHSDTPHILAIPFPAEGHIKPMFNLAKLLSHRSHRITFVNTHHNHNRLLQFTDLPSFHTQFPDFHFASITDGIPSDNPRKGALINYLPMLITPSARSLVAKEFRELFSRLLEKNGDQWQQPSCIIVDGLMSTIVMGVALEFRIPVIAFRTYSATCTWVTIFMSKLAKEGAQLLRSNQ

SEQ ID NO: 170551 - protein, 579 aa, Glycine max
  Coding DNA Sequence Number=SeqID_78866
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=98%, HitCoverage=69%, E-value=3e-93, Identity=35%"; Hit description =Functional candidate resistance protein KR1
  Pfam annotation: Domain name=LRR_1; Domain location=227-248; Score =10.1; E_value=4.1; Accession=PF00560.24; Description=Leucine Rich Repeat
  Pfam annotation: Domain name=LRR_1; Domain location=270-292; Score =11.5; E_value=2.3; Accession=PF00560.24; Description=Leucine Rich Repeat
  Pfam annotation: Domain name=LRR_1; Domain location=294-315; Score =10.7; E_value=3.2; Accession=PF00560.24; Description=Leucine Rich Repeat
  Pfam annotation: Domain name=LRR_1; Domain location=317-338; Score =6.5; E_value=19; Accession=PF00560.24; Description=Leucine Rich Repeat
  Pfam annotation: Domain name=LRR_1; Domain location=366-387; Score =10.3; E_value=3.8; Accession=PF00560.24; Description=Leucine Rich Repeat
  Pfam annotation: Domain name=LRR_1; Domain location=389-410; Score =4.6; E_value=43; Accession=PF00560.24; Description=Leucine Rich Repeat
  Pfam module annotation: Pfam domain module=LRR_1::LRR_1::LRR_1::LRR _1::LRR_1::LRR_1; Domain location=227-248::270-292::294-315::317 -338::366-387::389-410
MNINLTSKQQGISIIQSWLMGKKVLLILDDVDIHKQLQAIAGRPDWFGPNSKIIITTGNKQLLASHEVNKTYEVKELNVNDALQLLTWQAFKKEKACPTYVKVMKRAVTYASGLPLALEVIEEEKNIFLDIACYFKGWKVTEVEHILCGHYDDCMKHHIGVLVEKSLIEFSWDGVVNMHDLIQDMGRRIDEQESSKEPGKNLPYASYLKVALRHLGSMAQGRQKFRNLKVLNFDDCEFLTEIGDVSDLPNLEKLSFDRKLTTFPPLNLTSLEILELSQCSSLENFPEILGEMKNLLYLELVNLGLKELPVSFQNLVGLKTLSLRDCGILLLPSNIVMMPKLDFLDASSCKGLQWVKSKEGEEKLDHVVTLNLRNNNFTFLPECIKELQFLRILEVGGCLHLQEIRGVPPFLTYFTARECISLSSSSSRMLSNQELHEAGQTKFWFPGATIPEWFNNQSRGPSSSFWFRNEFPVNVLCLLLARVERIDVDDIFMPAVFINGKLHKNPSRGTKVGKVKLDYTYLFDLKSALELNDIYEVALEKERNQVEITYAGLIETSLVKATGTHVLRQDDIRYDDPYY

SEQ ID NO: 170552 - protein, 232 aa, Glycine max
  Coding DNA Sequence Number=SeqID_78867
MTPPIGVINVFLVPDDFKVDSSTGDDDHGMWEVINNLNGRGPKQKMRNGRGRFAIDCLISTEILFEYSIKDFRLPVNFRMISSAHAKLGALEFEKFTPKFANEKWGHNKKLSYRHSVMFANQLKESLSNLKSVEKENLPHSNWNCALMHKIPDIVRNKPRFGNTHVSRDRSLMEFLQQSGPEMWCMINPYAALEDDKPLMNSVIPIIGGLGIDILKWNSSLEHKLHCSSSKK

SEQ ID NO: 170553 - protein, 173 aa, Glycine max
  Coding DNA Sequence Number=SeqID_78868
MVSFLNIFSGVLFLHVLSMQVASGSDDLGQKWTRGMQRASWSGDFVHDRHVARARGHARLIGDFRLPHWKRQIDWRFEPAMSCLVGAVQQLRSSAVQNLQVCSRNRKRHKLAKRFTYHAHKVEGKQGVVVCPRTGTHEITYSLLARPSAKCQMRIHAKYQICRILRIRSFELK

SEQ ID NO: 170554 - protein, 175 aa, Glycine max
  Coding DNA Sequence Number=SeqID_78869
  Gene Ontology: Mol. function=transferase activity, transferring glycosyl groups; Biological process=metabolic process
  Homolog annotation: Hit_ID=A5C1L1; Match level="QueryCoverage=95%, HitCoverage=36%, E-value=2e-25, Identity=36%"; Hit description =Putative uncharacterized protein
MEHSNAPHILVLPFPAEGHIKPMFNLAKLLSLKGHKITFVNTHHNHNRLIQFTDLPSFHTQFPGFHFASITDGVADNLPQNEFEHMISPTSRSEVAGEFRGLLSRLVVEKPRQWDPPPSCVIIADGLMSTVSMDVAKEFGVPLIAFRTYSATATWVSIHVSKIVQEGVMDLQNPG

SEQ ID NO: 170555 - protein, 107 aa, Glycine max
  Coding DNA Sequence Number=SeqID_78870
MGLKIERLKNIFINLEMVVVVEALLLSYQKVKNKNNNLDKSKVEIKSAQRKSKEHREEESKHKFYTSSTTTRAYIQSSSNLLRFPFLVKILYNQRATKDVPSLVLFE

SEQ ID NO: 170556 - protein, 43 aa, Glycine max
  Coding DNA Sequence Number=SeqID_78871
MVVLKHLIVSACFRKEGEFKEEEEEDDDKVNEVVMTIVVVQNI

SEQ ID NO: 170557 - protein, 101 aa, Glycine max
  Coding DNA Sequence Number=SeqID_78872
  Gene Ontology: Mol. function=methyltransferase activity; Cellular component=cytoplasm; Biological process=fatty acid biosynthetic process
  Homolog annotation: Hit_ID=Q2HRW2; Match level="QueryCoverage=99%, HitCoverage=29%, E-value=1e-28, Identity=63%"; Hit description=Beta -ketoacyl synthase; SAM dependent carboxyl methyltransferase
MEEVREVIEAEGSFTLQTLKTFKLGWDANLQDEVNGSLLDSKIRGEFIAKSIRVVFEPILTVEFGNEIMDELFSRFATKISQLIEFEALEYTNLVMSMGKA

SEQ ID NO: 170558 - protein, 258 aa, Glycine max
  Coding DNA Sequence Number=SeqID_78873
  Gene Ontology: Mol. function=signal transducer activity; Biological process=response to light stimulus
  Homolog annotation: Hit_ID=Q9FIK1; Match level="QueryCoverage=23%, HitCoverage=10%, E-value=1e-08, Identity=50%"; Hit description =Photoreceptor-interacting protein-like
MGQIRMTNPFKRTGRASSPRLLHRDTEGVDASCEMRKKIVDPSFVSDESHTGLVEDTPSNSPNHVILISAPLPLPTVRPPRLRGRYSRINGDNERVEQWLEVVSWELRAFVYHNFLSSLLPKCGLLHRPWLDSSGSENVPLELHDMSGGVDAFELCAKFYYEVMQSYPARALDRRLQVDWARDPREGPMVLMSLRLSSSFFRNLFKEASQGASSPSFLSKAHLGGEAPFSMAYSLMDGASSHLFSFVFRCISMVENHH

SEQ ID NO: 170559 - protein, 196 aa, Glycine max
  Coding DNA Sequence Number=SeqID_78874
MLVQMKGTFYLKLVKVFYTCARADMEGNLFSTINGVEMVINALVWKVVVGLDMARIRKFEESVDGYNKMQTYRGMLLDPARNLRNFLGVGSLTTENRMLMYLITYILTLRSINHAQVTNDDLKIMYGLKSACRFIDYFNIDVSNKIVDFTKAFNEVTERHLKKLRMRFFEHKWIMAREPPAAANMDQMEEEAKDEF

SEQ ID NO: 170560 - protein, 185 aa, Glycine max
  Coding DNA Sequence Number=SeqID_78875
MALRGAKQSGILGGGVESLKIASATVAFAEAVKSNHQLSSKGDKNELAEKVEKDKLAKVVVDLEARLKESKSRLEESELWVGETGQKHENRSVFSKVRTFQKENNQKHKSKGELIKHEGVVSKMFMIPRLCISAILDEKMCFCEENPSRDATVTLPRHFREQIHEDFPPFFTVLRPFFVHSSVFN

SEQ ID NO: 170561 - protein, 104 aa, Glycine max
  Coding DNA Sequence Number=SeqID_78876
MAYGRSYLHIRCFQVNFSTSLAVISHSGLASIFLVKYLMAISRYLTAPRAFYSGSIKGIGPECQLLLVGTHHLGCKGASPSMETTDPFVKLSRDIICLLAVQAS

SEQ ID NO: 170562 - protein, 16 aa, Glycine max
  Coding DNA Sequence Number=SeqID_78877
MAPTPRTHVEILGPIP

SEQ ID NO: 170563 - protein, 52 aa, Glycine max
  Coding DNA Sequence Number=SeqID_78878
MREVYGRLEALENQANQNVRRNIDGNRGNNGGNDGSRHNRVEGVKLNVPPFK

SEQ ID NO: 170564 - protein, 130 aa, Glycine max
  Coding DNA Sequence Number=SeqID_78879
  Subcellular localization annotation: CTP_CleavageSite=23; ConfidenceScore=5.31e-01
MTTDSPPLPMFPWTRFPVESPVVATYPSTGRQRETHGCVFQGRKMRRVTTNVYLRKMLEKPKGGLRILRIKGSGVVYVWGRFQHKQLVEFYFYNCWNLPFFGGGAKRPLGWAKGASSIKGKRVESPPMFI

SEQ ID NO: 170565 - protein, 65 aa, Glycine max
  Coding DNA Sequence Number=SeqID_78880
MLVNAYDTLTEDARRVEQGLSVAHPLCMYGWLLTFFAMKVDMHVPYKVTACVPRKGKQIGSSSWL

SEQ ID NO: 170566 - protein, 106 aa, Glycine max
  Coding DNA Sequence Number=SeqID_78881
MDYGEIVMALIKLESSNPKVALGSLVFYFHFRFHLFPFPHISAQSITVSNNLLLFAASLLPHVYPSNLPNNWYQSRWFKLVTGSDEYAGGHDYTRGGDYHVEETHT

SEQ ID NO: 170567 - protein, 41 aa, Glycine max
  Coding DNA Sequence Number=SeqID_78882
MEMQRKIKEKSLVSYPNFVRGPLLDDVRPFFGPREVLGTHH

SEQ ID NO: 170568 - protein, 140 aa, Glycine max
  Coding DNA Sequence Number=SeqID_78883
  Homolog annotation: Hit_ID=UPI00016621D1; Match level="QueryCoverage =82%, HitCoverage=40%, E-value=7e-11, Identity=39%"; Hit description =UPI00016621D1 related cluster
MAPLSSLQNGQGGPWVLVPIFFRGLHVLAFRGLHVLTFRGLRALAFRGLHALAIRGLHDLTFRGLHVLTFRGLHVLAFAFLGLHALTFRELHVLTFRELHVLTFRGLHVLTFRGLHTLIFIGLHALTFRGLHVLTFRGLH

SEQ ID NO: 170569 - protein, 70 aa, Glycine max
  Coding DNA Sequence Number=SeqID_78884
MGCQLSQPTLRWEGDVRAHGCAFQERKMHGVATNVYSRKMSEKPERCGLRTLIVKGSGVVFMHGEGEEMT

SEQ ID NO: 170570 - protein, 109 aa, Glycine max
  Coding DNA Sequence Number=SeqID_78885
  Subcellular localization annotation: CTP_CleavageSite=62; ConfidenceScore=5.10e-01
MTNRLRILLILPFPLSKTFQRTNHLRYLLFPLTKIQRTNRLRILCPNTLEGTSFVNKKGYISCGSVQVEGISTWFFKENKGGYIPFAWGLDVGTVERNLKNRRLLGYWM

SEQ ID NO: 170571 - protein, 196 aa, Glycine max
  Coding DNA Sequence Number=SeqID_78886
  Homolog annotation: Hit_ID=A6VH24; Match level="QueryCoverage=42%, HitCoverage=22%, E-value=6e-09, Identity=49%"; Hit description=SCP -like extracellular precursor
GLHVLTFRGLHALAFRGLHALAFRGLHIHAIRGLRSLTFRGLHALSFRGLHALAFRGLHVLTFRGLHVLAFRGPHVVAFRGLHVLTFRGLHTSPSENYTSSTSEGYTSSPLEGYTPSPSEDYTSSPSEDYTFRLSEDYTSSTSEDYTCTTSEGYTSSPSEGCMPSPSKDCTSSPLKDYTSSPSENYTFPLLEDYTS

SEQ ID NO: 170572 - protein, 145 aa, Glycine max
  Coding DNA Sequence Number=SeqID_78887
  Homolog annotation: Hit_ID=A5BSR3; Match level="QueryCoverage=44%, HitCoverage=20%, E-value=4e-08, Identity=46%"; Hit description =Putative uncharacterized protein
MARTKKIGQMMSKAAKEIAEKIDSLEEQASQGSFIPHGCQDVLTAAIGRPEHPGRVHATRASVTIKQYFGPAQRTSHTSSSIAPEELEQLTQQIRDQLEDQMQSQFQSQMQSHGLAQPPELEVGPSAAHVSTKGSCVDPSTTDPD

SEQ ID NO: 170573 - protein, 42 aa, Glycine max
  Coding DNA Sequence Number=SeqID_78888
MTYVLTPRVFQERPELKLSSHGRKIQKLGRPAPEIEGIVAVT

SEQ ID NO: 170574 - protein, 60 aa, Glycine max
  Coding DNA Sequence Number=SeqID_78889
MKRCPFEALGSIAPITSIPYMENGQGAAKMFKGTGGALTLSTNVWHLWHFLTWIPQSFSM

SEQ ID NO: 170575 - protein, 124 aa, Glycine max
  Coding DNA Sequence Number=SeqID_78890
MAAQLIHDRVEMECLEGVWETLEGNVRCRFRGMIRFTATSLHTVEWILPTPTPYRLVEPVQVIEVTSSEEDPEEDPEELPPEPVVDALDFLEGDEDPLPEVDSPEDVMSASEADSTEESGPGEG

SEQ ID NO: 170576 - protein, 77 aa, Glycine max
  Coding DNA Sequence Number=SeqID_78891
MPADVGQEKMTDRGLKKKHDRMTPIEHFQIDIVQRKLFLFGIAYKICNVVRLGFFVRAQPKLYFGRHRHFVVMPGKH

SEQ ID NO: 170577 - protein, 92 aa, Glycine max
  Coding DNA Sequence Number=SeqID_78892
MFGTLCCTICEVPRRAENQKEAGLRDPFFLQKAVASGGSNLARLGELGGKLLHYFAINRGRSEGRRGSAFLALLILSKLLRKIISVKKIQAE

SEQ ID NO: 170578 - protein, 160 aa, Glycine max
  Coding DNA Sequence Number=SeqID_78893
MFVDPDNTNAATLGEVVETLHYMVSPQGRNTWTVDDLVPYVEKLAIISEEQERITEPVSHGPASDREFPAQEFHILRSSVETQSIGRRREPVEAEEYSQQMMERGHGMYYTPATFSQYPSQMYQYPFEGHHTDTSASEHSFGGVAETQPHFSWPTITPSQ

SEQ ID NO: 170579 - protein, 50 aa, Glycine max
  Coding DNA Sequence Number=SeqID_78894
MNEESFWVMVSTTPTWVSLGASEKVLTGARPMIRSITTQHPAKDVKEALL

SEQ ID NO: 170580 - protein, 331 aa, Glycine max
  Coding DNA Sequence Number=SeqID_78895
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=86%, HitCoverage=100%, E-value=1e-147, Identity=92%"; Hit description =Beta-lactamase TEM precursor
  Pfam annotation: Domain name=Beta-lactamase; Domain location=31-280; Score=184.9; E_value=2e-52; Accession=PF00144.15; Description=Beta -lactamase
  Pfam annotation: Domain name=Peptidase_S11; Domain location=29-263; Score=-122.5; E_value=0.033; Accession=PF00768.11; Description=D -alanyl-D-alanine carboxypeptidase
  Pfam module annotation: Pfam domain module=Beta-lactamase::Peptidase _S11; Domain location=31-280::29-263
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGMQAWHWPSFYNVVTGKTLALPNLIALQHIPLSPAGVIAKRPAPIALPNSCAA

SEQ ID NO: 170581 - protein, 302 aa, Glycine max
  Coding DNA Sequence Number=SeqID_78896
  Homolog annotation: Hit_ID=Q6WAY6; Match level="QueryCoverage=80%, HitCoverage=49%, E-value=8e-30, Identity=32%"; Hit description =Putative uncharacterized protein
GKLFRKAYSKIWDLAMVEVSTEAIASLAQYYDQPLRCFTFGDFQLLPMVEEFEEILGCPLGGRKPYLFSGFYPSLARISKIVQISVQELDHRKQFENGVVGIPRRYLEGKARILAGKGEWALFIDILALLIFGGVLFPNVDGLVDLAAIDAFLAYHNHRESPVVAMLADLYDTSTEDVRRAVRGLFVVLQLFMYGRTGVLISCGGFSNVPLMGTRGCNSYNPVIAIRQLGYPMRGAPLEEEIAPFISRGFDKTNVETLQKWLKAHVQGLDWLPSLRIAKREEVEAPEEETEVQDLRAELEQA

SEQ ID NO: 170582 - protein, 332 aa, Glycine max
  Coding DNA Sequence Number=SeqID_78897
  Gene Ontology: Mol. function=tRNA-pseudouridine synthase activity; Cellular component=cytoplasm; Biological process=tRNA pseudouridine synthesis
  Homolog annotation: Hit_ID=Q0T2G7; Match level="QueryCoverage=52%, HitCoverage=64%, E-value=3e-86, Identity=86%"; Hit description=tRNA pseudouridine synthase A
  Pfam annotation: Domain name=DXP_reductoisom; Domain location=7-109; Score=-57.7; E_value=0.018; Accession=PF02670.7; Description=1-deoxy- D-xylulose 5-phosphate reductoisomerase
  Pfam annotation: Domain name=PseudoU_synth_1; Domain location=107 -200; Score=96.7; E_value=7.1e-26; Accession=PF01416.11; Description =tRNA pseudouridine synthase
  Pfam annotation: Domain name=Semialdhyde_dh; Domain location=6-108; Score=79.5; E_value=1.1e-20; Accession=PF01118.15; Description =Semialdehyde dehydrogenase, NAD binding domain
  Pfam module annotation: Pfam domain module=DXP_reductoisom::PseudoU _synth_1::Semialdhyde_dh; Domain location=7-109::107-200::6-108
MSDGWNIALLGATGAVGNAVLELLAERQFPVGELYLLASENSAGESVRFDGRSLRVQDAAEFDWSQAQLAFFTAGREASARYAEEAASQGCLVIDSSDLFALEAGRAAGCRYGWQRQNEVRSVQEKLEKALAKVANHPVNVFCAGRTDAGVHGTGQVVHFETTSSRADSAWTLGVNANLPDDIAVRWVKAVPESFHARFSATARRYRYVIYNQRLRPAILGNGITHFYHPLDAEKMHRAAQALLGENDFTSFRAVQCQSRTPWRNVMHLNVTRLGPYVIVDIKATPSCITWCAISSAVCWRLAAAISRKRGWPRCWRQKIARWRRQRRKPKG

SEQ ID NO: 170583 - protein, 359 aa, Glycine max
  Coding DNA Sequence Number=SeqID_78898
  Gene Ontology: Mol. function=protein transporter activity; Cellular component=type II protein secretion system complex; Biological process=protein secretion by the type II secretion system
  Homolog annotation: Hit_ID=A8AIN9; Match level="QueryCoverage=67%, HitCoverage=98%, E-value=3e-79, Identity=61%"; Hit description =Putative uncharacterized protein
MRNAFLSRLMTPCVMLVMLIFCSQQGYVVYKDYKKVTNKLANADKPALKKPDAEKSFGLFTAAVRQSDAPAAAKAPLSAEIEGIIRSDESWLSFAVIKTPAGQQSYREGEPLVGFDDAYYEGAKQTLALNKPAYFKGGVDSAPVTKSKKDAGADSLHLDDYLVLKPLIDKGQLEGFTINPRNATPFYHNAGLEKGDVVLKVNDVDMTQEAQAKNIIANWSKMKEADVVVRRHAHLENIRINKFPWACVALTALSLYSGSLLAANFSASFKNTDIREFIDTVSRNLNKTILVDPSVQGTVSVRTYNVLSEEEYYQFFLSVLDLYGLSVIPMDNGMVKVVRSSVARTAGVPVPTSKIRARR

SEQ ID NO: 170584 - protein, 46 aa, Glycine max
  Coding DNA Sequence Number=SeqID_78899
MELLGLGSSSSMDSFASWKMNGSGMEKEEREPTNPRSSQRFSTKCF

SEQ ID NO: 170585 - protein, 38 aa, Glycine max
  Coding DNA Sequence Number=SeqID_78900
METVSMILKLCNSSLASGNRLPRDVIDYQRRKPLRQTF

SEQ ID NO: 170586 - protein, 82 aa, Glycine max
  Coding DNA Sequence Number=SeqID_78901
MTLDQVRVLFLGDGSNHMIVLGGKHKNKLLVVGGVWCLTRCLWLCGCGCLTRCLWLVEEGVAEWWLVVASGSRRGRVVLSGG

SEQ ID NO: 170587 - protein, 168 aa, Glycine max
  Coding DNA Sequence Number=SeqID_78902
MLSGDNLTKGIFWLVRGTHRPHLAFLTTTELYPWLVRAPCPVPTSNVSSQLSFICCDQMTSLVLHLPFYINAIKTKWEHDDVSMWITSLSSYVVVPMSSYNRFVMPVPEVVIPSKSYSSSASIKMSSTRSNLSSKDIDATFPFLMSPYSVLLESWVPLIEAVLESNKH

SEQ ID NO: 170588 - protein, 181 aa, Glycine max
  Coding DNA Sequence Number=SeqID_78903
  Homolog annotation: Hit_ID=UPI0000DC05E4; Match level="QueryCoverage =95%, HitCoverage=36%, E-value=2e-08, Identity=22%"; Hit description =Seminal vesicle secretory protein 2 precursor (Seminal vesicle secretory protein II) (SVS II).
MLSPMKNKGEDVKSYGNIKARTLSPMKGKGEDIESYGNIKARIQRTLSPTKNKGEDVKSYGNIKARTLSPMKGEDVEFYGNIKTEGVDPMKKRQRTLIPMKNKGENIESYGNIKARKLSPMIDRGEDRTLSPIKNKGEDVESYGNIKVRTLSPMKDKGEDIESYGNIKARTLSPMKHANRY

SEQ ID NO: 170589 - protein, 58 aa, Glycine max
  Coding DNA Sequence Number=SeqID_78904
MTPLMKKIQGLQALHGATSRGAHMKGPITRAMSKRLQEDWARAAEEGPRVLMNLRVDF

SEQ ID NO: 170590 - protein, 96 aa, Glycine max
  Coding DNA Sequence Number=SeqID_78905
MEHRSSVGIGEHVELHPPVREAIVVIHHAVEVLDGVKGPENECKEKRKYGWCASKEKNIDAAWRVTGKPGHGSIHHHIRPQHSVNDARHGLGPSRR

SEQ ID NO: 170591 - protein, 182 aa, Glycine max
  Coding DNA Sequence Number=SeqID_78906
MEVLVEEDGSKIDYSIVLQHSSAGMVRMVQRNLREMKSGDNLTKDNSVKKDFHLWVSIFECERIPPRVLHRILIVGSLSSGTPPNLSHKNDDLGLIHRWIVMKFENHVRNPITSILTVGNFDIMSELREIPLALEKNKSHDDSTSGGFNPFSVSLTFGNSIGVRGKKLEESQGTARDAAIAD

SEQ ID NO: 170592 - protein, 210 aa, Glycine max
  Coding DNA Sequence Number=SeqID_78907
  Homolog annotation: Hit_ID=A2Q4S5; Match level="QueryCoverage=88%, HitCoverage=30%, E-value=2e-20, Identity=34%"; Hit description=IMP dehydrogenase/GMP reductase, putative
  Pfam annotation: Domain name=DUF1723; Domain location=109-158; Score =48.9; E_value=1.7e-11; Accession=PF08330.1; Description=Protein of unknown function (DUF1723)
MVRTRGFDQALGRAIGKVLGRRDESDVDAPSGEGLLHQPGFPGGPHDTSVLSDFENHIALRVWNGEERSELKLSSHGRKMAKFGRLAPEIEGLVVASGLSPLIACSLDTSDQGLMFAFVECWHKETSSFHLPVGEVTITLDDVASLLHFPIVRAFHSFELLHVDDIVEMLVELLVVSAAEARAETIQCHGSYVRLLWLRDVYELKIGACD

SEQ ID NO: 170593 - protein, 89 aa, Glycine max
  Coding DNA Sequence Number=SeqID_78908
MGNNHRAKTMAEALIGDVTWTEGQTTAFDDTIVENAEVKDKRVEHRRMSHKVNTIEEIDDSKETWKMVGDKIVVSVKNIDNKKWPSQLK

SEQ ID NO: 170594 - protein, 120 aa, Glycine max
  Coding DNA Sequence Number=SeqID_78909
MDRAHKAPSGPGEVQQGPGVSSSGYGPLLVLQGARPPQQGIVPARHPVDPEKSNRVLGSTECLPPPARSSGPLLTELSSRSIAPLGRRRAIHHNSLGMAGSGQQMHRRHLQSTSAHPQKG

SEQ ID NO: 170595 - protein, 187 aa, Glycine max
  Coding DNA Sequence Number=SeqID_78910
  Homolog annotation: Hit_ID=Q1RSH0; Match level="QueryCoverage=58%, HitCoverage=58%, E-value=9e-12, Identity=37%"; Hit description=H+ -transporting two-sector ATPase, alpha/beta subunit, central region, related
MRVCKDSGWEWEFSWRRPLFDNEVGMAISFLNDVDSMQIYPQREDAWVWEADSSGHYSAKSAYDTMREFLHEGTVDKAHEELWKIKAPSKVLVFAWRLLRDRLPTRANLHRRQVEVNDSRWKSWWLALTWTIWQQRNAILFSNATFNANKIMDDAAFLLWTWLRNLEKDFGTSFNHWSSNLSLGFTC

SEQ ID NO: 170596 - protein, 122 aa, Glycine max
  Coding DNA Sequence Number=SeqID_78911
MVAFVSKAQFAVEELKLSLEADKVEDIKAKLDNLYMVLVLHGMHPDFDHIRDQLTILKLLPWYLIDGDKVVGETEEDKLEEDVTINVLTADYQEYLQLKAAKESQTSSAIGGHNSTACISQS

SEQ ID NO: 170597 - protein, 98 aa, Glycine max
  Coding DNA Sequence Number=SeqID_78912
MQCIKKYMLKAPKQTKHSRILMRREFIRALERMIKAPGELYWDYFIIQSLNKHKSVIQSLWLFKENFLPIWNSPKTCLRPLYTVYNVTDAILPPKGIG

SEQ ID NO: 170598 - protein, 69 aa, Glycine max
  Coding DNA Sequence Number=SeqID_78913
MNEFKMFKMFKMFKIESRTLQGSRGNLILRIKIQGSSFQESRSRFKTQDSRIKRRLNQDKYEKDFSKNE

SEQ ID NO: 170599 - protein, 83 aa, Glycine max
  Coding DNA Sequence Number=SeqID_78914
  Gene Ontology: Mol. function=nucleotide binding; Biological process =defense response
  Homolog annotation: Hit_ID=Q6R270; Match level="QueryCoverage=100%, HitCoverage=7%, E-value=1e-15, Identity=50%"; Hit description =Disease resistance protein
METEMIVGALVYTFVQTTIDSLASRFVDYFGGRKHNKKLMMADDAEQKQFRDPRVRDWLLKAKDVVVFETKDLLDEIDYELSK

SEQ ID NO: 170600 - protein, 229 aa, Glycine max
  Coding DNA Sequence Number=SeqID_78915
MEREKGIAQRQYIWRLQSLLRLSDIWELYRSSRKKNWRNLRKSLEMSLSLSEDISSVCDKLSMHVIEMLYALSCKLWIKGEALMDSSECRPWRSPGLSAPLSLCRSHMVGAFSQNTMTLIGLPMILPNGVTVSPDERPRYRNRKGDVSTNVLAACGSNLRVTGHGAETAMDVNEAMSRKTNEVEFMGLGATATIDLEEPNSNTKGKRQGSTSSVTHTFSQEKDGRKKKE

SEQ ID NO: 170601 - protein, 124 aa, Glycine max
  Coding DNA Sequence Number=SeqID_78916
  Gene Ontology: Mol. function=identical protein binding
  Homolog annotation: Hit_ID=A7PDH0; Match level="QueryCoverage=90%, HitCoverage=92%, E-value=4e-43, Identity=77%"; Hit description =Chromosome chr17 scaffold_12, whole genome shotgun sequence
  Pfam annotation: Domain name=MazG; Domain location=35-114; Score =12.2; E_value=0.00015; Accession=PF03819.8; Description=MazG nucleotide pyrophosphohydrolase domain
MEYSNGFPSKRDVSLQELSKRLDEFAKVKGWDQYHSPRNLLLALVGELSEILQWKGEVAKGLPNWSSDDKEHLEEELSDVLLYLVHLADVCGLDLGQAALTKIVKNAHKYPVTSTNYTNNSTYN

SEQ ID NO: 170602 - protein, 308 aa, Glycine max
  Coding DNA Sequence Number=SeqID_78917
  Gene Ontology: Mol. function=transferase activity; Cellular component= chromatin; Biological process=DNA integration
  Homolog annotation: Hit_ID=Q2HRZ3; Match level="QueryCoverage=20%, HitCoverage=9%, E-value=3e-15, Identity=69%"; Hit description=FAR1; Polynucleotidyl transferase, Ribonuclease H fold
MTTSSILALLYFTQEFIIESDASENGLGALLTQKGQLVAYFSKALTEHNLAKSAYEKELMAVENYRVEENLPINLEDDNSYQPEVVLAAHTITKAELRSKAKLLFIAFASIPTQDSPPSSPLPKPTSSKNSLDTNVDHHGKFGSEFNHTFNLLCELWFVKFVMSFEISLDNCSISDYLLHVQTLVNELTSIAETVSNSEHLDLILDGLPDEYESSRKRALSSINLTQGLGSVSLNSGSSSLDNSVNPNFAQSINPNLKFKFADAQCQLCYKFRHDAFYCYHRQEENYVHTFPPLALLSVTQSTSTSSA

SEQ ID NO: 170603 - protein, 169 aa, Glycine max
  Coding DNA Sequence Number=SeqID_78918
  Gene Ontology: Mol. function=transcription factor activity; Cellular component=nucleus; Biological process=regulation of transcription, DNA-dependent
  Homolog annotation: Hit_ID=A9Y0K9; Match level="QueryCoverage=48%, HitCoverage=34%, E-value=1e-21, Identity=62%"; Hit description=ERN3
  Pfam annotation: Domain name=AP2; Domain location=23-74; Score=61.1; E_value=3.8e-15; Accession=PF00847.11; Description=AP2 domain
MEYQNQRAKEGRFCEKLKIKNKPMFVGVRQRASGKWAAEIKDTSKKIRLWLGTYQTAEEAARAYDEDACLLRGSNTRTNFYTQGNLTSMKIERMELTEEEETLAGRRRKKKRLVGEHQQHHREGEEEPAAARTEEGRRTMLAEEGNEEGSRMTGAGCTSKKHLATPELF

SEQ ID NO: 170604 - protein, 493 aa, Glycine max
  Coding DNA Sequence Number=SeqID_78919
  Gene Ontology: Mol. function=phosphoribosylaminoimidazolecarboxamide formyltransferase activity; Cellular component=integral to membrane; Biological process=purine nucleotide biosynthetic process
  Homolog annotation: Hit_ID=Q84XA4; Match level="QueryCoverage=98%, HitCoverage=76%, E-value=0.0, Identity=89%"; Hit description =Aminoimidazolecarboximide ribonucleotide transformylase/inosine monophosphate cyclohydrolase
  Pfam annotation: Domain name=AICARFT_IMPCHas; Domain location=77-426; Score=649.1; E_value=3.7e-192; Accession=PF01808.9; Description =AICARFTIMPCHase bienzyme
  Pfam annotation: Domain name=MGS; Domain location=1-72; Score=30.6; E_ value=5.5e-06; Accession=PF02142.13; Description=MGS-like domain
  Pfam module annotation: Pfam domain module=AICARFT_IMPCHas::MGS; Domain location=77-426::1-72
MFWPFSQLDGRVKTLHPNIHGGILARRDQKHHIDALSAHGIVNLYPFYDKVTSAGGVEFEDGIENIDIGGPAMIRAAAKNHKDVLVVVDTEDYPALLEFLKRNQDDQKFRLKLAWKAFQHVASYDSAVSEWLWKQSVGDLLVSILVTDKFPPSLTVPLSLKSSLRYGENPHQKAAFYIDKSISEVNAGGIATAIQHHGKEMSYNNYLDADAAWNCVCEFRNPTCVVVKHTNPCGVASRDDILEAYRLAVKADPVSAFGGIVAFNVEIDEALAKEIREFRSPTDGETRMFYEIVVAPSYTEKGLEILCGKSKTLRILEAKKNEAGKLSLRQVGGGWLAQDSDDLTPHDIKFNVVSEKAPQDDELRDAEFAWLCVKHVKSNAIVIAKVVISHIMKLFYASMKKNNCMLGMGSGQPNRVESLRIAMRKAGDDVKGAALVSDAFFPFAWKDAVEEACESGIGVIAEPGGSIRDQDAIDCCNKYGVSLLFTNVRHFRH

SEQ ID NO: 170605 - protein, 151 aa, Glycine max
  Coding DNA Sequence Number=SeqID_78920
MFATTFNTPPSAYNLPPLTSCYLPSLPTQIRDMSHEDEEDDDHDNNNNDDDDNDGGGDDDDNGGDHGKGHKEGMKDNFVPLHFFEKGEGDNNHIRKVMLGASNIIAGAPSILSESMKMSFTQVDTDHVDPLIRMSHTDHVDQYELYGSRSC

SEQ ID NO: 170606 - protein, 104 aa, Glycine max
  Coding DNA Sequence Number=SeqID_78921
MITKDDDKGDDKKLKGQSKNEFKMFKIESRTLQDSRRKLNSRIKNQEKAIQESRKSLIKISMKRFFQKLSSTWIFHKTCLPKSFLLSGNRLPDYCNRLPVAKWI

SEQ ID NO: 170607 - protein, 128 aa, Glycine max
  Coding DNA Sequence Number=SeqID_78922
MQAVSLKKTLMRAQAQVLNTTPSFLTCDKCGIVHGPRECTIDGKLVVAKDEINFIKGVNNYYNQYPDNFNQGQGFRQSRGMFRSQQPMTKLKKEKVTPPQEKKALMEESQETDKKGENKVLTPPYVCC

SEQ ID NO: 170608 - protein, 180 aa, Glycine max
  Coding DNA Sequence Number=SeqID_78923
MVDHDPPKLTTIVVNFVEAMPSKVILMMPKNQELSKLQRFKNQVSRIKIQDSRIKFLESRFKDDQDQDSRLKIQESREDSIKIRYILCGTSKGYIYLGCCTENTRGYIYCGSVQVEGTSTWLFKENKGGYIPCGSLSCLGSSSSMDSFASWKINGSGMEKEEREETPLQGEDESRRSSPP

SEQ ID NO: 170609 - protein, 76 aa, Glycine max
  Coding DNA Sequence Number=SeqID_78924
MASEKAVDDQCHQIYGIIVRYPTSAPDRASSIKCLVLLKYHPQIPHVGLNLTRTALRHTYQQLGYRTPIPGDDTIN

SEQ ID NO: 170610 - protein, 289 aa, Glycine max
  Coding DNA Sequence Number=SeqID_78925
  Gene Ontology: Mol. function=nucleotide binding; Cellular component =myosin complex; Biological process=signal transduction
  Homolog annotation: Hit_ID=B0CN61; Match level="QueryCoverage=29%, HitCoverage=5%, E-value=7e-33, Identity=81%"; Hit description=Myosin XI-K
  Pfam annotation: Domain name=Cation_ATPase_N; Domain location=104 -167; Score=-0.3; E_value=0.0041; Accession=PF00690.17; Description =Cation transporterATPase, N-terminus
MAPKKLSTKRSRRDATGEGSSAALKFDSHLFWSVEHQQRFEAIRGWSFHRERRFDPEIVLEFYANAWPTEEGVRDMRSWANSVSSVRGGTWPTISMRKPLPSCGAYRENIPIEEIFDNLKCKKEGLSSEQVQQRLDLFGYNKLEEKMVASSDHLILFEALMLVKSLNVVEDNVFVVLSQRLGPDYKLGSPSSFRYLNQSKCYALDGVDDAKEYLATRRAMDVVGINKKEQAIFRVIVAILHLGNVEFSKGEEIDSSVIKDEKSRFHLNLGRCTNQACDGNDRGGYYKNP

SEQ ID NO: 170611 - protein, 432 aa, Glycine max
  Coding DNA Sequence Number=SeqID_78926
  Homolog annotation: Hit_ID=Q6WAY6; Match level="QueryCoverage=86%, HitCoverage=59%, E-value=5e-30, Identity=29%"; Hit description =Putative uncharacterized protein
MGSSQVPSLKKRFYQVKVKSLGVTSLKELGQLMGQLQRQASRKAYGILDHRKQVENGVVGIPRKCLEAKARVLAGKGKWTPFMDILALLIFGGVLFPNVDGLVDQAAIDAFLTFHDCKESPVVAILADLYDTFDRRCEKSSTRIVCCTLALYVWLVSHLFRQDVRHACPLEGHRSCIEKKEASWDRLLASKEEASVNWFPRWKEGRTRVLISCGGFPNVPLMGTRGCINYNPILAIRQLGYPMRGAPLEEDLTPIIARGFSSTNMEALQKVCKAWEMVQKKDKELRGSNNGPIGGYYRWLKAYMEGLHWLPNLRTTKGVEVEAPEEDEEVQALRTELEKAQIVKEKFKSAALRIRKENAELRDVNIATTKALEQETKRAHREEHGRNKFRGALWGSNSELKLRREEMDQSRVDSLILKDELRICLRSKRSLS

SEQ ID NO: 170612 - protein, 247 aa, Glycine max
  Coding DNA Sequence Number=SeqID_78927
  Gene Ontology: Cellular component=chloroplast thylakoid membrane
  Homolog annotation: Hit_ID=Q9FL44; Match level="QueryCoverage=64%, HitCoverage=68%, E-value=2e-40, Identity=55%"; Hit description =Arabidopsis thaliana genomic DNA, chromosome 5, P1 clone:MOJ9
  Subcellular localization annotation: CTP_CleavageSite=39; ConfidenceScore=5.32e-01
MACALQATLAANAYVFSSRRFSLKLQKNSKRRFSLFTVRVDSDESDCNEEECAPDKEITGEKLGGRIWLVLISYGLLVNLKVGKVSVEWLAGEKTKVVGTFPPRRKPGWTGYVEKDTAGQTNIYSVEPAVYVAESAISSGTAGSSSDGVENTAAIVTGLALISIAAASSILLQVGKNAPPQIQTAEYSGPSLSYYINQFKPLEITEVSVPSEAELSSSVQLESSPPEVSQVQVEAQAPETSSVNIVS

SEQ ID NO: 170613 - protein, 207 aa, Glycine max
  Coding DNA Sequence Number=SeqID_78928
  Gene Ontology: Mol. function=DNA binding; Cellular component=nucleus; Biological process=embryonic development ending in seed dormancy
  Homolog annotation: Hit_ID=A2Q4K0; Match level="QueryCoverage=33%, HitCoverage=76%, E-value=4e-24, Identity=78%"; Hit description =Homeodomain-related
  Pfam annotation: Domain name=Myb_DNA-binding; Domain location=9-59; Score=28.8; E_value=2e-05; Accession=PF00249.22; Description=Myb -like DNA-binding domain
MASSSMSSTGSWSTKDNKAFERALAVYDKDTPDRWYNVAKAVGGGKTPEEVKRHYELLLRDVRYIESGKVPFPYKQSGGSEEEKSPLVFFASLASLSPAHALLLPPTVLLLQFSSSSHAASSFFFFFFAAIAAIVAVFRRKVWVFAFVVWVFAFLLLLRGKFVVRVLVFAGDGGNRCREIAGLFTDHLIHKHFPNQVDPEDAYGSSD

SEQ ID NO: 170614 - protein, 186 aa, Glycine max
  Coding DNA Sequence Number=SeqID_78929
  Homolog annotation: Hit_ID=A5C0G0; Match level="QueryCoverage=39%, HitCoverage=11%, E-value=2e-10, Identity=47%"; Hit description =Putative uncharacterized protein
  Pfam annotation: Domain name=Chromo; Domain location=1-48; Score=8.4; E_value=0.054; Accession=PF00385.15; Description='chromo' (CHRromatin Organisation MOdi
MASKFIPSESGPKRMVLVQWKGLPPEETSWEDWSAFKTTHHIEDKVLLDGDGSVMDSNDGGLQEAVWVQEGNARPTRNKRSPAYWKDYGLGPRNPRGINNLLALGRIQLGDVPNQVKVLSWNCRDLVNLRVVPVLKDILGVHKPGTLFLSKTLVHSNRVEEIRVALGFQKVFVVDKDGRSGGLALF

SEQ ID NO: 170615 - protein, 121 aa, Glycine max
  Coding DNA Sequence Number=SeqID_78930
MMQDVTAPPEAFFQTIFGEVGKVYAVKWKDVLDSVWHLVDKDENYHNIVYNQDLDQPAIVAGWTTLRDFYQLTEDHLVSLHHYGFVTFKVYLTEQKVSCSSLKVAGCPSKNVGCPKQLRQV

SEQ ID NO: 170616 - protein, 711 aa, Glycine max
  Coding DNA Sequence Number=SeqID_78931
  Gene Ontology: Mol. function=hydrolase activity; Cellular component =mitochondrion; Biological process=cell division
  Homolog annotation: Hit_ID=A7QM20; Match level="QueryCoverage=96%, HitCoverage=80%, E-value=0.0, Identity=71%"; Hit description =Chromosome undetermined scaffold_123, whole genome shotgun sequence
  Pfam annotation: Domain name=Dynamin_M; Domain location=235-546; Score=375.8; E_value=6.9e-110; Accession=PF01031.11; Description =Dynamin central region
  Pfam annotation: Domain name=Dynamin_N; Domain location=49-226; Score= 312.2; E_value=9.7e-91; Accession=PF00350.14; Description=Dynamin family
  Pfam annotation: Domain name=MMR_HSR1; Domain location=47-227; Score =1.5; E_value=0.00078; Accession=PF01926.14; Description=GTPase of unknown function
  Pfam module annotation: Pfam domain module=Dynamin_M::Dynamin_N::MMR _HSR1; Domain location=235-546::49-226::47-227
  Subcellular localization annotation: CTP_CleavageSite=52; ConfidenceScore=5.22e-01
MAEDIPSSSPPIAASDTAPLGSSVISLVNRLQDIFARVGSQSTIDLPQVAVVGSQSSGKSSVLEALVGRDFLPRGNEICTRRPLVLQLVQTKAPEDDEYGEFLHFPGRKFHDFSEIRREIQIETDREAGGNKGVSDKQIRLKIFSPNVLDITLVDLPGITKVPVGDQPSDIEARIRTMIMSYIKTPTCLILAVTPANSDLANSDALQMAGIADPDGNRTIGVITKLDIMDRGTDARNLLLGKVIPLRLGYVGVVNRCQEDIQMNRSIKDALAAEEKFFCSRSVYNSLADSCGIPQLAKRLNQILAQHIMAVLPGLRARISTSLVAVAKEYASYGEITESKACVNTGICILDISPIPILAGQAALLLNILSKYCEAFSSMVEGNNEEISTSELFGGARIHYIFQSIFVRSLEEVDPCEDLTDDDIRTAIQNATGPKSAVFAPSVPFKVLVRRQISCLLDPSLQCARFIYDELIKISHRCMVIDLQRFPFLWKRMDEALGNFLREGLEALENMIAHLIAMELNYINTSHHNFIGGSKALEIASQQTKSSMVSIPVSRQKEVLESDKGSVSERSVKSRAILARQANGVVTEPGVHAASDAEKVVSSGNTGGSSWGISSIFGGGDSHTIVKENVASKPHTEPVHSVEQSFSMIHLREPPPVLRSSESYSETEAIDITVTKLLLRSYYDIVRKNVEDLVPKAIMYFLGLIGFLSRD

SEQ ID NO: 170617 - protein, 106 aa, Glycine max
  Coding DNA Sequence Number=SeqID_78932
MVRVVIYRQMLVLTSVEHLIKIFLEVSYSYLTFMLSITHFTHYSLPKPMFLPHFLMQSYSPRALDRRLQEDWAKDATEGPRVLMSLRVGYPRSIGFFSPCILGHLD

SEQ ID NO: 170618 - protein, 394 aa, Glycine max
  Coding DNA Sequence Number=SeqID_78933
  Gene Ontology: Mol. function=transcription repressor activity; Cellular component=nucleus; Biological process=mRNA processing
  Homolog annotation: Hit_ID=A7QYP7; Match level="QueryCoverage=43%, HitCoverage=21%, E-value=7e-41, Identity=58%"; Hit description =Chromosome undetermined scaffold_252, whole genome shotgun sequence
  Pfam annotation: Domain name=NmrA; Domain location=165-394; Score= -101.7; E_value=0.021; Accession=PF05368.4; Description=NmrA-like family
MAKKILGGDRKGTRLGSSQIPKSESMLFSPALDDAKHCFSRPEMYKENLASTLEAYNHHEFLCYKSHLAWPPRLEAFDADPLPLCVATVWRARKNDIAVKMKITMCEALVVDSLSSTPTRVETLDVIDLRKQQRKEPKKPLYQVLEEKKEKIAPGTLLGTTHTYVVNTGTQDKSGAKRVKLKRVSSIFREKGEKGFLCDDIDWWDNMFHVFQIDLLRGQKSHKVDVTLLPQELDAMENVLPANDVNITTLICYLSWNCSKYEEAREEKKLRNQCEDSSDMVAEARREKISERMKILQDLVPGFNKRFLPSNFRVEEDRVNPLPPFQAVLDKKRKIRRKIEAVGIPYTFVSANCFGAYFVNYLLRSYEKKNNITVYGNSDTKGTYSHEPHHYGVE

SEQ ID NO: 170619 - protein, 42 aa, Glycine max
  Coding DNA Sequence Number=SeqID_78934
MGKGVVTVASSGRTAKASSGTSGRRCSEKFPEKGFFRNCLLL

SEQ ID NO: 170620 - protein, 84 aa, Glycine max
  Coding DNA Sequence Number=SeqID_78935
MRSRHYRITTVSDFYIVLCAVFLIRHPHFPRKNIGGDSHVFSFFGRHTFYLILPSRRRVGCDSWQLHWGLVRELGHSISVQYLS

SEQ ID NO: 170621 - protein, 54 aa, Glycine max
  Coding DNA Sequence Number=SeqID_78936
MSHPIRALGLDVLQHKNAPTIWDWHGLKGALKPGVFSPKAYTPKSPLGPLPPDS

SEQ ID NO: 170622 - protein, 176 aa, Glycine max
  Coding DNA Sequence Number=SeqID_78937
MRLVSGALRTESFDKNVKVVYGPGWESTVPGSQMLVWICCPIIPLKVEWLPPQGLKSSIVLPVRWGCDSPWMRSGKVLALSTLPHGVTPSPQRNLELLAVSHLRPDRVLSMDECERIGERPWGMFYRGPTMGAKCSYQNPESWHVMVDVAEWGPKLHTSAWRSAFDRRGDLQNKGL

SEQ ID NO: 170623 - protein, 134 aa, Glycine max
  Coding DNA Sequence Number=SeqID_78938
MFEGILGCPLGGRKPYLFSGFYPSMARTSKVVKISAQELDRVKQYKNGVVGIPRKRLEEKAEALVDQGKWTSFIDILALLVFGTILFPNVNGLVDLDAINAFLAYHHRKESLIIVVLVDAYDTFNLRCKKRNVN

SEQ ID NO: 170624 - protein, 489 aa, Glycine max
  Coding DNA Sequence Number=SeqID_78939
MRERKEREERDEREECVERDTGWVRVTSRAKRGVRNRVSLRKEPHVRYAETRGRAQQKAAIVNWRDHTDISSFYFTRFTDDITENELWQHFKRWGDQMARQLDNIVIGGQKLFDNIPKYNQERRTHEDMGRQAKNERGDMPTRFQRTMQQCQRTALPYADVVRKKNTTQPRRQDQKQPDAWVGRLTNPARFEMLEEELRWELGLDLAPRYLGDDQVLLTGMNEDEAERLMNGGLHGTISHFYSLEKWKPNLRTGNRMVWVHCWGIPLQVWDKNRIRQIVGTMGDMVDVDEDVETKRQVDRARVLIRTPWPPTIKHCGSMSCEHHSRGSSYSDSSEERESADSLAGDEFLQATTFAGTNRELTRDSPLNQRSNSPHSSIVPNTGVGDTTMTGMPTRWKQTEDPMDKEEGPRVMTGKNDEETVNANIETHAAKFPTVESYFNGQEIRACVFHQNRQREKGETSGVQCQPPSPPRDYAAKNTSTKGKQAFGK

SEQ ID NO: 170625 - protein, 292 aa, Glycine max
  Coding DNA Sequence Number=SeqID_78940
  Gene Ontology: Mol. function=metal ion binding
  Homolog annotation: Hit_ID=A6XER5; Match level="QueryCoverage=81%, HitCoverage=87%, E-value=7e-76, Identity=58%"; Hit description=ERAD RING E3
  Pfam annotation: Domain name=zf-C3HC4; Domain location=1-35; Score =15.3; E_value=0.0016; Accession=PF00097.16; Description=Zinc finger, C3HC4 type (RING finger)
MAKAKRLNCNHLFHLACLRSWLDQGLTEMYTCPTCRKPLFAGVPENQTNSDVGTISSDEQLARQISAGLDRPNSARHTMPAGLYPNQTLNTPEGVPWRGAGLDSGWWHSWPNQGVDGAGPSTAIRTVGLGRVQMMMRHLASVGETYAQTAFEDTAWNLWPINPSQASASGSTISPPGGRLPERTGSLHLRNASQSANDDVANILAMAETVREVLPHIPDDMIFQAREERHFLSSTKTSIPTKLVGSRCNGRTDEMPPLQHPCKKDNANPESVLVSYADSSLLVVCPLEALNM

SEQ ID NO: 170626 - protein, 77 aa, Glycine max
  Coding DNA Sequence Number=SeqID_78941
MVELRRQCAKTDNNQNFNLEIKSSVYIEEAKEHHLDEDALIAHDVAPCGAYRPWIFFINGVLYFLKINGRGMEKEER

SEQ ID NO: 170627 - protein, 171 aa, Glycine max
  Coding DNA Sequence Number=SeqID_78942
MESSNVKNKSSGKRKMSSEDTRSYFTWNLEMVRVLADVLRDKRNLGNKGDGNWKAVAYSTTPQILSKHFGVHLMADNVKNRFKLWRTWYGIVSDILSQSGFDWDSTNAKDRAIGIRAENALDADDIMSKETNEEEAIHSKRCEGIRVLKQMQLENLELFWKFDLFCDYILI

SEQ ID NO: 170628 - protein, 116 aa, Glycine max
  Coding DNA Sequence Number=SeqID_78943
MIMRIQDIYSSQDEATTSPSSSESEEAKGEESSEEIYPQEEGKPLMVKEDCKEVSVSSKSDQGLPMDPKRIKVIPEWPTSPSVAKRIHEFQEPLDLRSNPFQGGGNDAILPRKGIG

SEQ ID NO: 170629 - protein, 481 aa, Glycine max
  Coding DNA Sequence Number=SeqID_78944
  Pfam annotation: Domain name=IncA; Domain location=184-419; Score= -15.6; E_value=0.06; Accession=PF04156.5; Description=IncA protein
MSKKLFEFDSNIFRRFKDHFFKVLATDFMANGMPLMLNRDGEPHFLFYWQFDRTKFKSYDEDMLTLVERVNKAILEKFRVSLDARTILSLPSASNPLTALDGIMGDFTWRPLVKQVGPTSGTVPSSSTTLSVGEKGQPADEVGLIAVAAEVTPALLPLFWAGAYCESPMTMQDVPPTPPDVEAPAATVVTPANPTEVTNATIEAIVPATQADLVVMLSSTVVALLLSADVATIGAPVVMPPSLSALVILPSAVLAAMEFPSLSSCPCVSLDHLYTSSDVDSLWGATYKPEQKTSTSFVSTFEKNLIRPAGVQNATDSTKAFLQRSLAIVEENKLWNQEVVQKVVSLEVEVEKMDLGGRVESMAAEKDELAKRVAELEVCLRESESRFGKSKMRDAKEREANKELEEELILYKEEAVEQHEKDFQNVVRQAVFFAKDLDLGFFDPFKDVKNGVLLDEEEIDAEEEVANEGQGAAEQGDDACV

SEQ ID NO: 170630 - protein, 190 aa, Glycine max
  Coding DNA Sequence Number=SeqID_78945
  Homolog annotation: Hit_ID=A7UQU7; Match level="QueryCoverage=50%, HitCoverage=16%, E-value=3e-11, Identity=41%"; Hit description=IMP dehydrogenase/GMP reductase, putative
MARTRGLGRAIGRLVGRDRHDDHDAADVPERRRPTASARRQRVHQMTTIACDMAEDVANMTDDVPDLAAEAPEMRANVHGADGAEGSDADDAAEGFPGGPRDPSVLASFADHVAHAVWSGQERPDLKLVSHGRKVTLIGRPVPEIEGLVAATRLSPLIDCSVITGDLGLISALVERWHGETNTFHLPVGE

SEQ ID NO: 170631 - protein, 372 aa, Glycine max
  Coding DNA Sequence Number=SeqID_78946
  Gene Ontology: Biological process=response to stress
  Homolog annotation: Hit_ID=Q9M670; Match level="QueryCoverage=95%, HitCoverage=93%, E-value=3e-29, Identity=28%"; Hit description=Small heat shock-like protein
  Pfam annotation: Domain name=HSP20; Domain location=31-124; Score =10.4; E_value=0.00029; Accession=PF00011.12; Description=Hsp20alpha crystallin family
MAASGPRTPKTRTSRGPSIRPVYETFEPMSEMKEKEEAYFLHIYLPGFVKEKIKINFVRSSRVVRVVGERPLGGNRISNFEQTYPVPENCEVEKLQGKYELGTLIITMPKKPIISRVPPKAQVETTPRIGPTPLISPSKKPVPDQLPKPKEVVAKEAMPPKSPITRMEQGEKSNGHKTRPQHVQEESMLKSAAIASTPRKETGKSQKGHEEIVPKIEEYRNEESNKQNDITTYIEKVKEKQNKDREYEKLHETRKQDQKYIVHNVVLKEREIKTTRPKETVSSSTPKAPQKGKETSTTIIDKGKSKEEDEIYTIGKGIKEVVASASEVVTKIGEGKLNDEEKPLVANMGAAILVIVALGAYVTYKFTSCSRA

SEQ ID NO: 170632 - protein, 150 aa, Glycine max
  Coding DNA Sequence Number=SeqID_78947
  Gene Ontology: Mol. function=structural constituent of ribosome; Cellular component=ribonucleoprotein complex; Biological process =translation
  Homolog annotation: Hit_ID=Q676Z7; Match level="QueryCoverage=98%, HitCoverage=88%, E-value=7e-70, Identity=80%"; Hit description=60S ribosomal protein L11
  Pfam annotation: Domain name=Ribosomal_L5; Domain location=1-31; Score=4.4; E_value=0.0091; Accession=PF00281.10; Description =Ribosomal protein L5
  Pfam annotation: Domain name=Ribosomal_L5_C; Domain location=35-134; Score=208.6; E_value=1.5e-59; Accession=PF00673.12; Description =ribosomal L5P family C-terminus
  Pfam module annotation: Pfam domain module=Ribosomal_L5::Ribosomal_L5_ C; Domain location=1-31::35-134
MREIKVQKLVLNISVGESGDRLTRAAKARIRKNEKIACHVTVRGDKAMQLLESGLKVKEYELLRRNFSDTGCFGFGIQEHIDLGIKYDPSTGIYGMDFFVVLERPGYRVGRRCRCKARVRIQHRVTKEDAMKWFQVKYEGVILNKSQALV

SEQ ID NO: 170633 - protein, 118 aa, Glycine max
  Coding DNA Sequence Number=SeqID_78948
MNPKGRYSFVSSDYTKKQISLLAMNLKGRYSFMFSESTKSFDDNKDDDKKLKSQDHFMITKMMTFKNEFKIESRTLQGSRGNLISRIKIQDSRFKNNQDQDSRLKDSRIKKRLNQDKY

SEQ ID NO: 170634 - protein, 52 aa, Glycine max
  Coding DNA Sequence Number=SeqID_78949
MKDHVHTPLRHYDAILPRKGPVTRAMSKRLQEDWARAANEGPRVLMNLRVDF

SEQ ID NO: 170635 - protein, 103 aa, Glycine max
  Coding DNA Sequence Number=SeqID_78950
  Subcellular localization annotation: CTP_CleavageSite=82; ConfidenceScore=5.61e-01
MLPRSLILPLLRMSLSPPCQTAQQSASTVTVTTQSGNPIAFVSQSSSLGPWILDSSASDHMTDNNLFSLNCHYQILCLLLLSQMALRLNFVALVKPTPFLTSL

SEQ ID NO: 170636 - protein, 704 aa, Glycine max
  Coding DNA Sequence Number=SeqID_78951
  Gene Ontology: Mol. function=protein binding; Cellular component =histone methyltransferase complex; Biological process=histone H3-K4 methylation
  Homolog annotation: Hit_ID=Q1S5M0; Match level="QueryCoverage=75%, HitCoverage=96%, E-value=0.0, Identity=77%"; Hit description =Putative uncharacterized protein
  Pfam annotation: Domain name=WD40; Domain location=115-152; Score =22.3; E_value=0.0019; Accession=PF00400.23; Description=WD domain, G- beta repeat
  Pfam annotation: Domain name=WD40; Domain location=266-303; Score =14.9; E_value=0.3; Accession=PF00400.23; Description=WD domain, G -beta repeat
  Pfam annotation: Domain name=WD40; Domain location=385-423; Score =22.5; E_value=0.0015; Accession=PF00400.23; Description=WD domain, G- beta repeat
  Pfam annotation: Domain name=WD40; Domain location=71-108; Score =16.4; E_value=0.11; Accession=PF00400.23; Description=WD domain, G -beta repeat
  Pfam module annotation: Pfam domain module=WD40::WD40::WD40::WD40; Domain location=115-152::266-303::385-423::71-108
MEMYMCVEVVRRLVTVLEVWGAAVVLGPLRGAAVMTVLSVGSVEVWGAERRCFAAVRCRVAVLCGGAGDFPEVIEEYLEYGCMKCIAFNRRGTLLAAGCNNGSCVIWDFETRGIAKILRDDECSSPITSICWSKYGHQILVSAADKSLILWDVMSSKKITRIVLQQTPLQARLHPGSSTPSLCLACPLSCAPMIVDLNTGNTTLLKVSVLETCNGPTPTPPSRNKCSDGITSFTPTAACFNKYGTLVYVGNSKGEILAIDYKNGDVRAVVPISGGSVVKNIVFSRNGQYLLTNSNDRIIRIYENRLPLKDEVRALDDLSENHNVLNNIENLKAVGSKCLTLFREFQDSITKVHWKAPCFSGDGEWVVGGSASKGEHKIYIWDRAGHLVKILEGPKEALIDLAWHPVHPIVVSVSLNGLVYIWAKDYTENWSAFAPDFKELEENEEYVEREDEFDLIPETEKVKGPDVNEDEEVDIITVEKDAAFSDSDMSQEELCYLPSTPSRDVPEQQEKCVESSSKLLDSNNTGSPLSEEAGPNGHMMNHASSPLEDDAGRMKRKRKPSEKVLELQAEKVKKPSKSSKLAKPKSKSLADQDNGNGFHVLLKSGHGGMASRNFGKTPPNSSGVAGVGLTRANHTRVSPLQRYDQQQSPARRMAVWAPATQTTTADDVLEHDGSRPADDACERQTTDDQCTNARRRRRQCFGAF

SEQ ID NO: 170637 - protein, 181 aa, Glycine max
  Coding DNA Sequence Number=SeqID_78952
  Gene Ontology: Mol. function=metal ion binding; Cellular component =integral to membrane; Biological process=ubiquitin cycle
  Homolog annotation: Hit_ID=A3BU82; Match level="QueryCoverage=39%, HitCoverage=25%, E-value=5e-12, Identity=48%"; Hit description =Putative uncharacterized protein
  Pfam annotation: Domain name=zf-C3HC4; Domain location=129-170; Score= 13.8; E_value=0.0024; Accession=PF00097.16; Description=Zinc finger, C3HC4 type (RING finger)
MAVRASLLENPQMFVEIAYQALLMFFMDLVLKSPFISSSQNGNNSNNNLKNTGSGSCPFHQSNASHVTHDLPLHLIRLHLHSLLLPRRTTPGASTSHARRVDPCMLAMCPFMSYFVVKMRTPQNPAFQCAVCLAEFDNTDDALHLLSKCGHVFHAHCIDAWLSSVLSKKIEHRKKGKKIVE

SEQ ID NO: 170638 - protein, 64 aa, Glycine max
  Coding DNA Sequence Number=SeqID_78953
MKFEYRVRNPISSILTVGNCKNMEKKESHEDSTSGGFNLFSVSLTFENSIGAVGGKTGGIPGNR

SEQ ID NO: 170639 - protein, 145 aa, Glycine max
  Coding DNA Sequence Number=SeqID_78954
MKSVTKTVEGKPPQHGPQWIEAKSHVQTGNYECGYYVMHWIWCIVSGGLKDDWIHWFSDRSAVTSSQGGGDKDYKEVPPAPLFKPVGGHINQVVTFNRSYYKKKRFQDGSIDKTVVEPAHFYNGHRDVTVVELSLSYNGHGTRPS

SEQ ID NO: 170640 - protein, 378 aa, Glycine max
  Coding DNA Sequence Number=SeqID_78955
  Homolog annotation: Hit_ID=Q9M197; Match level="QueryCoverage=17%, HitCoverage=5%, E-value=2e-07, Identity=41%"; Hit description=Copia -type reverse transcriptase-like protein
MAACLRQVAANVVVLMPLITNMPPLHLLRRFCETVEKMIETKENLQEEKEDLRGRIPQSKPKESKEKKGKEDKLGLEIPMRGKVKKPQKHLEAIIGLQPQGQSERRELKMGWEGKGKRRFRKGLEGNYKSWEEEGSGFVCKGREEKEGRRGSEEEFELEGRDFSSSDGISGKSDDTARRRDQLVLSKIQQGVDYSIFSKIVNAKTDKEVWDILKLSYKGAEKAHKSKFQSLRREYERHPRQQGGGQNSTHHVDEESIESNVSRLLEKISKVEAKEIIEVEEWGNINQGRNNNLGSFGRGRGGDTFGSANQGRGRGNNYQDEIVKSIVRFENNANIPIMGKGQITIRLKYGSQNFIFDVFDVPGLHHNLLSMRQPSKKG

SEQ ID NO: 170641 - protein, 141 aa, Glycine max
  Coding DNA Sequence Number=SeqID_78956
DAQVAWPRAHPSPSRGGGASATQEPAPEEPVAEGEDELTPPEPFYFDVDAHMAQEEETSINQIPESSLAPVPEETQPSTPVMEPEQPIQDSSAAVALDLNEDQPQDEQDPLEENEHVIGSMTKNVSQFVRLIVKECVNRIP

SEQ ID NO: 170642 - protein, 147 aa, Glycine max
  Coding DNA Sequence Number=SeqID_78957
  Pfam annotation: Domain name=Retrotrans_gag; Domain location=57-142; Score=8.1; E_value=0.0088; Accession=PF03732.8; Description =Retrotransposon gag protein
MKGIPVVGASEKGNLANMASPSHQELDDHSLIIDLQREINPLKQRNTQEMENAILREYVPTTLKGASLHRYTRLPRNSIDSFVTLVACFGAQYVSRRPHHLTAMAFTNIRQVEDESLHEISWKAYVRSLLQHWMSLEQGLSGSSKWK

SEQ ID NO: 170643 - protein, 694 aa, Glycine max
  Coding DNA Sequence Number=SeqID_78958
  Gene Ontology: Mol. function=nucleic acid binding; Cellular component= intracellular
  Homolog annotation: Hit_ID=A5ALP0; Match level="QueryCoverage=79%, HitCoverage=49%, E-value=0.0, Identity=67%"; Hit description =Putative uncharacterized protein
MAEVINNMPPESLDHDQSPSASAPPPPAASSSAADDLPPPPLPLPPRRRDRRDDRDFDRHPNRSRDYYDRDRDFKRRRSPSPGYRDRRYSPPPPSRRSPPPYKRSRRGSPRGGAYVPDDRFGYDYSGGYERGAGGRTGFADEKSYGRLAHRSAGGYHNGISDVDNSRGYADLPSGGAQREGLMSYKQFIQELEDDVLPAEAERRYQEYKSEYISTQKRAYFNAHKDEEWRNENARRLAKDFLLDLQSGTLDLNPGLNSTSSGKSGQASEPNSEEETDGKRRRHGRGPNKDNDFSAAPKAHTISSEPRRIQTDIQQAQAVVRKLDREKGIDDNILCTSDHNKNDDKAHSGSVGPIVIVRGLTSVKGLEGVELLDTLITYLWRIHGVDYYGMIETNEAKGFRYVRPEGTGHEETRKSGSDWEKKLDSFWQGRLNGQDPLEVMTAKEKIDAAATDVLDPHVRKIRDEKYGWKYGCGAKGCTKLFHAAEFVHKHLKLKHPELVMELTSKLREDLYFQNYMNDPDAPGGTPVMQQPQDRPLKRRLGGLEGRLKDDRGNRRDQDRSDRINGDRPDGSPSHERQMGNHDEAMYDAYGGLGVPQFTSDMAPPPVLMPVPGAGPLGPFVPAPPEVAMQMFREQGGPSSYDASGRKIRSGPHMGGPAPIIAVPPSFRPDPRQMRSYQDLDAPEDEVTVIDYRSL

SEQ ID NO: 170644 - protein, 160 aa, Glycine max
  Coding DNA Sequence Number=SeqID_78959
  Subcellular localization annotation: CTP_CleavageSite=38; ConfidenceScore=5.03e-01
MTSSLLFHLPTSPNESLHSHCYSSSCTTQHFFGERNCCCRVRWRGWWKWFEALLEFKDLIIVWTVDDDKDYNKGGVLGLGFFPFVSEKFRNRMIERGCGVRVLAGVVMWETLLLKLCLAFEKGIGRVEQEKKLMAFAVQTTTHSPTGPTSPWMEALVLGT

SEQ ID NO: 170645 - protein, 52 aa, Glycine max
  Coding DNA Sequence Number=SeqID_78960
MASYGVASPIIFLLLHSPAIKLQEAKESIDEEDPRPTSSIGATSCGIKSIFI

SEQ ID NO: 170646 - protein, 170 aa, Glycine max
  Coding DNA Sequence Number=SeqID_78961
EEFEAKLSQARSDAASSVGESQLTPLDPAEEQRLRSRCWVAVAGPKCKGRLYGTGDLAHTYNCGKINRLREELRQSKEDMHIFQSVLLQFLPPEARNIINQHQQPHQQHQDQHQDQADDQQNFRRKGSLVMQSYPTRALDRRLQVDWARDAREGPRVLMSLRVDFEPMGV

SEQ ID NO: 170647 - protein, 93 aa, Glycine max
  Coding DNA Sequence Number=SeqID_78962
MAVSPAPWARPYQLGVSPEGLAVPAGCVVVPIGDTLLSPSYVAYIATGSDNTPFSPALPPLAMAGSAMPPVAMAVSSTKQTPSVISFGTDPIP

SEQ ID NO: 170648 - protein, 60 aa, Glycine max
  Coding DNA Sequence Number=SeqID_78963
  Subcellular localization annotation: CTP_CleavageSite=39; ConfidenceScore=5.07e-01
MELSKAPNSQNGRSPTWPLFCAQPLGTLSDNIQTFFTYVAQMQMPQRIIRRAIGRMVSRL

SEQ ID NO: 170649 - protein, 62 aa, Glycine max
  Coding DNA Sequence Number=SeqID_78964
MIGMEKEKDDWRHHFKEKMSLEEAHHHRRPWIRAWRKKKMNEGRGREEHEILCFKRTLKYEV

SEQ ID NO: 170650 - protein, 236 aa, Glycine max
  Coding DNA Sequence Number=SeqID_78965
  Pfam annotation: Domain name=Transposase_23; Domain location=51-121; Score=-12.6; E_value=0.028; Accession=PF03017.5; Description =TNP1ENSPM transposase
MLSFSQMQSQFQSHKQSQGLILPPELEVGPLASRINTKESCVNPSWNDPDTGDSKKCGLYVKENPPDLVALRRLYEGSTTVHNIPLRHDQVKVGVEEVRDADALISIPTQEVQLVGQTLNTFVAWPTHLVKRLLEQVMWDATVFGVFNDNFPFYIKYEDLSKTTHGGQCLIISVIQLWILHMTETSMRAGNVDVYRFLEPQSIQRSGQSQFESESYIMNWMHNSKRDVYLGAYLNG

SEQ ID NO: 170651 - protein, 81 aa, Glycine max
  Coding DNA Sequence Number=SeqID_78966
MSNYKSTKSSIKNLEIQVGQLAKQMAERPTSSFGANTEKNPKEECRAMLTRSQRKAQGEGEEAEGDHFEEGRADKEGEKEE

SEQ ID NO: 170652 - protein, 99 aa, Glycine max
  Coding DNA Sequence Number=SeqID_78967
MGFGYDDSKDTYKEVAMVVNKEALETKVIVHCMGDSYSKKIASWWSGFPRLGLIFQKKIDLLQHQELAAQNRTRLYNHGGCTSSVPSPGLKSYFVSFGT

SEQ ID NO: 170653 - protein, 177 aa, Glycine max
  Coding DNA Sequence Number=SeqID_78968
MKEFGMVDSWTMLLKVNCEGLQFFNYYYYQQFPLWMTENGDFLLLDNRLEQIESRTNVVKLKTQPLVFSPRLSKSLSPLVSLSSLRSRRKPKPLKFSIVVIGVRQLTVVSAIISIVRGTVQPKVCSLVSCFIGFRHSLSSWSGFKVILDAIKAAIVLALGKELEAADRASCSKFLHL

SEQ ID NO: 170654 - protein, 76 aa, Glycine max
  Coding DNA Sequence Number=SeqID_78969
MPKESYNPNVTSSRGKNDVAPCGACRSWIFFINEVFCFLKIMAAEWRRKKDDWRRHFKEKMSLEEACHHRKPWIRA

SEQ ID NO: 170655 - protein, 59 aa, Glycine max
  Coding DNA Sequence Number=SeqID_78970
MKLHVELVGLGSSSSMESFAYWRSMTVERRRKKDDWRRHFKEKMSQAQAHHHRKPWIRA

SEQ ID NO: 170656 - protein, 204 aa, Glycine max
  Coding DNA Sequence Number=SeqID_78971
MESRRDPLFHLTIRTDNGYWAHHPGTDHDTFYVNVTLLFLPIGASLNVPPIEVPLPLIVIDAHATRYTYITPTSLTPSCDSLTSFDSSSFLNFVHLGTNVEEMLSDTVVPMEAFPTLNLILLVAQAPSMIVIEDSAENSMEEDPEKDPKEGEGSIDIVSVLRFSILPYDILVLYIPSLNEVTKRSIAHATLVASATPKVWALLE

SEQ ID NO: 170657 - protein, 158 aa, Glycine max
  Coding DNA Sequence Number=SeqID_78972
  Homolog annotation: Hit_ID=Q6WAY4; Match level="QueryCoverage=89%, HitCoverage=26%, E-value=3e-14, Identity=33%"; Hit description =Putative uncharacterized protein
MGQLQRQAFNKAYGKIWDLTMVDVSTEAIPSLAQYYDQPLRCFTFGDFQLTSTVEEFEEILGCPLRGRKPYLFLGFYPSLARIAKIVKISTQKLDHGKQVENEVVGVPRKCLEAKARVLASQDEWAPFIDILALLIFGVRLMLFMPFTTARKLGCGIL

SEQ ID NO: 170658 - protein, 128 aa, Glycine max
  Coding DNA Sequence Number=SeqID_78973
MKADMEALKDQMTSMMEVMLSMKRMMKDQMTSMMAATSAATKVDPTHPSAINQANQPIPDVVGQGREVLGSTDSPHMGHNRNAYLYGLPPLNYMPPTMHMPNENINHVVPLTVVGQQPQPVGGAREEP

SEQ ID NO: 170659 - protein, 158 aa, Glycine max
  Coding DNA Sequence Number=SeqID_78974
  Homolog annotation: Hit_ID=Q6WAY6; Match level="QueryCoverage=54%, HitCoverage=15%, E-value=1e-07, Identity=34%"; Hit description =Putative uncharacterized protein
MGTSGCINYNPILAVRQLGYSMRGAPSEESIMPFIARGFSDPNARIFQRIRKAWSVVQRKDKELRGSSNGIVGGYHKWLKARMQEITWLPKLKISTKEEAEIPEESEEVQALKVELERAQAIKEKFKTTTIKVQKECDELRDINVATTEALEWETKRA

SEQ ID NO: 170660 - protein, 641 aa, Glycine max
  Coding DNA Sequence Number=SeqID_78975
  Subcellular localization annotation: CTP_CleavageSite=22; ConfidenceScore=5.05e-01
MVMSLSSPHVWMSVVRFRLSVMDMSLACQERRARHTRSTLAYVSHVKWTRNGVKAVPRLRILLEVPQIVSPPLHRWQGPHAELGARRASGDGDVRSSPHARPNVRARSLSSTPAVAGYEWVRDDVLKYNVSKNLFEFDTNVFNHFKDHFFKVLVIDVVADGMPLMFNRDGEPLFPFYWQFDPIRFKSYDEDLLTIVERVDKEILEQLPASLEARAILSLPSASDHFTSLDDNVMGDFAWRPLVKQVGPTGGDVPPSVDASSTGEEGQHASEVGPIIVVVEVVASAPSSILVKRKRDDATGPSSHKKLKAPMSLYALRQAAGLGSIAGRLMIAQDEVFPIVVKVVVPATQADSVVVSSSTIVALLLSVGVVTTSAPRVLPLSSSAPMVLSAAVLAAMGSPSSFSHPHVSLDHLSISSDANSLWAIDKNLIRLAGVQNATNSAKVFLQRSLEILEENGLRHQEAVQKVVFLEAEALRVNCQLSSKVGDALAKLLHTRLDGDELFNCCKCLQAEKIDLGGKVESMAAKKDGFAKRIAELEARLRESESTLEGSELRASKEREASMKLEEELILYKKKVVEQHEKGFQKAVKKVGFFAKDLDLGLFDPFKDVKEGVWLDEEQIDAEEKVVDEGQGVVKQGDDVCV

SEQ ID NO: 170661 - protein, 85 aa, Glycine max
  Coding DNA Sequence Number=SeqID_78976
MRGLGCSAARPGELLLQLEVSKDKDTNFILAILLSNRQLEEIKAVKPVKKKKCMKYQGHQTKDFEVLKCKEDVEVSTKEIEAFER

SEQ ID NO: 170662 - protein, 114 aa, Glycine max
  Coding DNA Sequence Number=SeqID_78977
MTPTVKYDRMAVHSCQAPLLAAMLLFRFRSIGCMQSSKTCSDLELVLYSEFIDIELAVEYQNKALIVKVDTDDEYEFARDMQLTRISILLIGVSTFKTRLHPQKGPLPTDLDTG

SEQ ID NO: 170663 - protein, 114 aa, Glycine max
  Coding DNA Sequence Number=SeqID_78978
MHHAPRQLYIPSNAILPLFHALVEVKLRFYPSSGGAGEEHVRRKIIIDMARCFGLGSVLVLAALAASMVVLPLMLPPLPPPPLVLLFFPVGIMAALMLLVFSPSDQNGVVYATT

SEQ ID NO: 170664 - protein, 132 aa, Glycine max
  Coding DNA Sequence Number=SeqID_78979
MAVGWRRKRERRCHFKEKMSLEEAHHHRKSWIRTWRKKKMNEGRGREEHEILYSKRALKYELWFSPLIQDQVQDSPLSMLRWHEASHGLEIYPKAHENPRAFSCIFGPIFLECSIQCPWGVGLHQLGISSMG

SEQ ID NO: 170665 - protein, 191 aa, Glycine max
  Coding DNA Sequence Number=SeqID_78980
MCHFQGFFKGSVKTSNNGSQWWWRRSLGVLREGLGEEKEEEDGSFTLLDVFVACNTRPGEPNLPRRADPQLKFFASGVTTSPSSSASEEEKGKESSEEIYSQEEGQPLMVKGECKETLVSTATPLGLEVIPQVKKLLDGGLIASTNKVALEIPPLRSSRLKTKCFQDMQGSGNRLPDSVIDYQKTSLKNSY

SEQ ID NO: 170666 - protein, 163 aa, Glycine max
  Coding DNA Sequence Number=SeqID_78981
MDLKKLSAKRSRRDAAAEGTSATPEDDEYTNFQEEIARRHWTSLVTPMAKFDPDIVLEFYANAWPTEEGVRDMRSWVRGQWIPFDADALSQFLGDPLVLEEGQECKFSQRRNKADGFDEEAIAQLLCIPGQDFARTAAGRRVWIMHTSMTHIDPDVDDVDGSP

SEQ ID NO: 170667 - protein, 143 aa, Glycine max
  Coding DNA Sequence Number=SeqID_78982
MEIERKQIEVQRLKESRVKQVPKNQESKSLKNQVSKNQDSRIIKFQELRFKNNQDQDSKLKIQESREDSIKIRYILCGTSRGYIYLGCYTENKRGYISCGSAQVEGTSTWLFKENKEGYIPCGSLACKGFYSLKNHWLLGDWM

SEQ ID NO: 170668 - protein, 131 aa, Glycine max
  Coding DNA Sequence Number=SeqID_78983
MVEALAMHTIADDRNVVQQRKGWEKLKERVIKPNIDALVKQNQVSAKVIFCNSREEAISAASLILPYVFEAHVAKVSALRWAMETTLQLSFSFVHFKLDCQKMEAYWIEECPPQIQPFLLDDVRPMVSLSQ

SEQ ID NO: 170669 - protein, 54 aa, Glycine max
  Coding DNA Sequence Number=SeqID_78984
MDQSLKAGEDEWRERERRGTKFCASNELWFSSLVQDQVQDFPLSVLRCHETCKA

SEQ ID NO: 170670 - protein, 345 aa, Glycine max
  Coding DNA Sequence Number=SeqID_78985
MLTENTPLIEDPSSPIEEHVKWKIALTKRYGQMTSQTAQEISNRIDSLQEQTTQGSFVPNSCDNILNTTIGRLEHPGCVHVAGSGMTISQYYGRASRGSSSSSTTITQQQLTEIIGSLKEEWSNEIIGNLKEEIWNEIEEENKRSLEKMKQELKDVIKIEFSQMGSQYSPLIDADIQALGARISTKGSNVETVVNPSGKEHDDHVILTMGLYVQRNVAYANDVVRVSAEKFLDGDAREALHRFIAWLTNLVKLVAQEDSHISPKKLVEPLPRSNNVSAKDPLRQLTKSLYDIYDKSVELMWDANIKDHCGWKNDQGTPKWIEVKSHVQSGGYECGYYMMHWMWNI

SEQ ID NO: 170671 - protein, 60 aa, Glycine max
  Coding DNA Sequence Number=SeqID_78986
MASSLRNAHMAGKPPFVMASWCQVELATSAGEFGHGFGNRYFDWRFGFAWGAGLVQLRCR

SEQ ID NO: 170672 - protein, 132 aa, Glycine max
  Coding DNA Sequence Number=SeqID_78987
  Homolog annotation: Hit_ID=Q2HTA0; Match level="QueryCoverage=62%, HitCoverage=13%, E-value=7e-14, Identity=46%"; Hit description=IMP dehydrogenase/GMP reductase, related
  Pfam annotation: Domain name=DUF1723; Domain location=46-95; Score =53.1; E_value=9.6e-13; Accession=PF08330.1; Description=Protein of unknown function (DUF1723)
MERKRPELKLSSHGKKMAKFGRLAPEIEGLVAASGLSPLIACSLDTGDRGLMSTFVEHWYKETSSFHFPVGEETITLDDIASLLHFPVVGAFHSFELLHVDDAVEMLVELLEVSTAEARAKTIQCHGSYVRL

SEQ ID NO: 170673 - protein, 57 aa, Glycine max
  Coding DNA Sequence Number=SeqID_78988
MKEIRNQRLGGIFFCQEGDAILPPRALDRRLQEDEAKATEEGPRVLISLRVDFWLMG

SEQ ID NO: 170674 - protein, 65 aa, Glycine max
  Coding DNA Sequence Number=SeqID_78989
MASKTVNRVDSVDDIEFMEDEEEVRLNLNQIQKRKEVTMMKKRVKKLRFARNACGQQHVIGGSKV

SEQ ID NO: 170675 - protein, 115 aa, Glycine max
  Coding DNA Sequence Number=SeqID_78990
  Homolog annotation: Hit_ID=A5BP71; Match level="QueryCoverage=44%, HitCoverage=13%, E-value=6e-11, Identity=58%"; Hit description =Putative uncharacterized protein
  Pfam annotation: Domain name=zf-CCHC; Domain location=88-105; Score =18.7; E_value=0.0022; Accession=PF00098.14; Description=Zinc knuckle
MVIIVNAEACGYVSMNYYQYIDVVYTNEHILKAYSAQSWPLGNKAAIPPSDDAWTLIPDPTTIRAKGRPKSTRIRNEMDWVEPSEHQPKCSRCGAEGHNRRRCPMQSERGSCSNH

SEQ ID NO: 170676 - protein, 74 aa, Glycine max
  Coding DNA Sequence Number=SeqID_78991
MASSNGNFPASMLVLKGKNYDDWCAQMKVIFRFQDVTEMVQKGVQELDRNPTDAQKVAHRDLMKRDAKHCSLFI

SEQ ID NO: 170677 - protein, 65 aa, Glycine max
  Coding DNA Sequence Number=SeqID_78992
MLVATPRIFPPLESAPVSLALARPRRARCDSWRLHWGLFFGPYTRVHGNLRSGGESIIMLGLRLA

SEQ ID NO: 170678 - protein, 66 aa, Glycine max
  Coding DNA Sequence Number=SeqID_78993
  Subcellular localization annotation: CTP_CleavageSite=29; ConfidenceScore=5.13e-01
MEKDALHVGSWSGGFNPFSFSLTFRNLNRATKGGTLESTRNVTIDNREHLSDYIECDSKNYSSVGV

SEQ ID NO: 170679 - protein, 208 aa, Glycine max
  Coding DNA Sequence Number=SeqID_78994
MAILVVEFQQELAQMVQMMMSKIPEPLQHPYEVLVKAELKKLYLVQAAIIDLGLREKGKLEPEIACGLLEMGGTIAFISGPEMVSDGKLAANMAAEVETMGASFVTDTGKISEASVAEGAGDKAEDEGDRADGAGGKADGAGAKAEGAGGKLDGGKEADVILGILALAGSKDDGNSGKLEDTVGKEGVMLGYCIGCCIDEGIDKPGGG

SEQ ID NO: 170680 - protein, 123 aa, Glycine max
  Coding DNA Sequence Number=SeqID_78995
MVGLQPSQGDPTQLSANFPRWGPFKNYFPKWGSFERIYQTAIANGEFAVQRPCGSETAIRVGELMQVELVTSVGESGHGFVNRQFDWQFCFAGGVAGDAGFLCSAGLLFSGVGTFFSRDRVAF

SEQ ID NO: 170681 - protein, 18 aa, Glycine max
  Coding DNA Sequence Number=SeqID_78996
DGYLKILGGYLEKSNMLQ

SEQ ID NO: 170682 - protein, 191 aa, Glycine max
  Coding DNA Sequence Number=SeqID_78997
MTNKKMIEISVGRYLYSLILGPCNSGSELLGSRPRVRLGVLALLVQCILVEVVAQLHLASMVCRLLVNQMLHWWCICCRLLLLVLPRLLCLPWHAILLNEGPVNGEVDELCRRDRYLVELAKACDQCWKSQCPVGLLWVHWMSRRCNTYKLVGGIRDKLCYMNIDLSQDRIDQLAFRQWEIRIMVTGEDVA

SEQ ID NO: 170683 - protein, 140 aa, Glycine max
  Coding DNA Sequence Number=SeqID_78998
  Homolog annotation: Hit_ID=Q2V3V7; Match level="QueryCoverage=37%, HitCoverage=39%, E-value=3e-14, Identity=67%"; Hit description =Uncharacterized protein At3g15351.2
MKGVAGTSSRPLVQEVCTTCGKHDSSEQMWMMFPGTDLFARISFHASRTILETVSNVLAITHKSYYIFFSAMGSGKPIALDEMKSWVSCISLESGLSTLFLFDAISLCNCKYYYTVMNVILPKCGLVYYTVEVFKCHLIE

SEQ ID NO: 170684 - protein, 134 aa, Glycine max
  Coding DNA Sequence Number=SeqID_78999
MAPKKLPAKRARKVTAGEGSSAALQAEIEFDGHRFRSEEHQRRFEAIKDWRQWTQLTEPMPKYDPEIVMEIYANVWSIEERVMDKRSWVRVQWIPYDEDAINQFLGHPLILGEGQHCEYAERRSQVSGFDGMTT

SEQ ID NO: 170685 - protein, 153 aa, Glycine max
  Coding DNA Sequence Number=SeqID_79000
MHLSRWCPGALYQAVCSPQVQEDSPNMRTNMLANHGGSTMNAVEEWESRGLKHIRDVSTSRWFILEALREANVIDLDSDKGDPCLMHPGASHDVETCPVTEELLQGMINRGQIEIRSSKKKEGEVCMQSGDRNPSKPKLSAIHFTRDITTKRP

SEQ ID NO: 170686 - protein, 113 aa, Glycine max
  Coding DNA Sequence Number=SeqID_79001
MKWMNIFALTLNESQELPRLLARAKAVADTYSASDEVHVTIVTKKNVCALRHPYRTCAKAKIMSKIEEVQEQLKADMDAMKEQTTTMMETIMSMRKMMEVNTDAVAATVLPLR

SEQ ID NO: 170687 - protein, 183 aa, Glycine max
  Coding DNA Sequence Number=SeqID_79002
  Homolog annotation: Hit_ID=Q6WAY6; Match level="QueryCoverage=91%, HitCoverage=31%, E-value=4e-16, Identity=33%"; Hit description =Putative uncharacterized protein
MGNIRRCISSASVWEVLFLNVDGLVDLATINAFLAYHHSKESLVIAVLADTYDMFDLRCEKSNARIVYCTLALYVRLVSHVFNHEGMTGASISWFSWWKEGGAGVLCSCEGFPNVPLMGTRGCINYNPMLAIRQLGYPMRGAPSEEIITSFIARGLNEANAKILQKIRKAWNRVGRKDKELRG

SEQ ID NO: 170688 - protein, 79 aa, Glycine max
  Coding DNA Sequence Number=SeqID_79003
MAFGTMATRPKHKKKLVKDARLVDLADKTSEEIHEDVVLESLKTLSTEEVQRQSSEKDTMMHIDGELVLEVVIVESILA

SEQ ID NO: 170689 - protein, 223 aa, Glycine max
  Coding DNA Sequence Number=SeqID_79004
MAGASDGGGEYHQLDGSQQGLENHLNQNAKRPYSGNREGNDGPRQNRMEMALVRVNIEEKTGDTMARFLNGLNPNIRVQVEQQLEEKCIKKELIQYFQLELDQQIEEEGRQLIQSISSVPSWKVSSRRHIAFECPTRRTIIMKADGEITSESEINEEVKEELEKEATQGDMLLVRKLLEMSKLNLETKPHPRPYRLQWLSKDEEVKVTQQVELCLTIGRYNDK

SEQ ID NO: 170690 - protein, 950 aa, Glycine max
  Coding DNA Sequence Number=SeqID_79005
  Gene Ontology: Mol. function=protein kinase activity; Cellular component=intracellular; Biological process=protein amino acid phosphorylation
  Homolog annotation: Hit_ID=A7Q5D4; Match level="QueryCoverage=100%, HitCoverage=57%, E-value=0.0, Identity=74%"; Hit description =Chromosome undetermined scaffold_53, whole genome shotgun sequence
  Pfam annotation: Domain name=Ank; Domain location=529-562; Score =35.4; E_value=2.1e-07; Accession=PF00023.21; Description=Ankyrin repeat
  Pfam annotation: Domain name=Ank; Domain location=563-595; Score =19.2; E_value=0.015; Accession=PF00023.21; Description=Ankyrin repeat
  Pfam annotation: Domain name=Ank; Domain location=598-630; Score =23.9; E_value=0.00061; Accession=PF00023.21; Description=Ankyrin repeat
  Pfam annotation: Domain name=Ank; Domain location=631-663; Score=7.4; E_value=2.8; Accession=PF00023.21; Description=Ankyrin repeat
  Pfam annotation: Domain name=Ank; Domain location=666-698; Score=2.0; E_value=17; Accession=PF00023.21; Description=Ankyrin repeat
  Pfam annotation: Domain name=Ank; Domain location=733-765; Score =38.7; E_value=2.1e-08; Accession=PF00023.21; Description=Ankyrin repeat
  Pfam annotation: Domain name=Ank; Domain location=766-798; Score =28.1; E_value=3.3e-05; Accession=PF00023.21; Description=Ankyrin repeat
  Pfam annotation: Domain name=Ank; Domain location=799-837; Score=4.2; E_value=8.1; Accession=PF00023.21; Description=Ankyrin repeat
  Pfam annotation: Domain name=Pkinase; Domain location=150-445; Score =89.7; E_value=9.3e-24; Accession=PF00069.16; Description=Protein kinase domain
  Pfam annotation: Domain name=Pkinase_Tyr; Domain location=150-445; Score=21.8; E_value=9.9e-14; Accession=PF07714.8; Description =Protein tyrosine kinase
  Pfam annotation: Domain name=zf-C3HC4; Domain location=6-51; Score =41.9; E_value=2.3e-09; Accession=PF00097.16; Description=Zinc finger, C3HC4 type (RING finger)
  Pfam module annotation: Pfam domain module=Ank::Ank::Ank::Ank::Ank::An k::Ank::Ank::Pkinase::Pkinase_Tyr::zf-C3HC4; Domain location=529 -562::563-595::598-630::631-663::666-698::733-765::766-798::799 -837::150-445::150-445::6-51
MKIPCCSVCQTRYNEEERVPLLLQCGHGFCRECLSRMFSASSDATLACPRCRHVSTVGNSVQALRKNYAVLALLQSAAAAANGGGGGRSNFDCDYTDDEEDGDGGREDEDEEDDEKRRRNSRESQASSSGGGCAPVIELGGGGGGAHNDLKLVRRIGEGRRAGVEMWMAVIGGGGGGEGGGRQRCRHNVAVKKVAVAEGIDLDWVQGKLEDLRRASMWCRNVCTFHGTMRVEDSLCLVMDKCYGSVQSEMQRNEGRLTLEQVLRYGADIARGVVELHAAGVVCMNLKPSNLLLDANGHAVVSDYGLATILKKPSCWKARPECDSAKIHSCMECIMLSPHYTAPEAWEPVKKSLNLFWDDGIGISSESDAWSFGCTLVEMCTGAIPWAGLSAEEIYRAVVKAKKLPPQYASVVGGGIPRELWKMIGECLQFKPSKRPTFSAMLAVFLRHLQEIPRSPPASPDNGLDKGSVSNVMEPSPVPEMEVPQQNPNHLHRLVSEGDTAGVRDLLAKAASENGSNYLSSLLEAQNADGQTALHLACRRGSAELVETILECSEANVDVLDKDGDPPLVFALAAGSPECVRILINRNANVRSRLRDGFGPSVAHVCAYHGQPDCMRELLLAGADPNAVDDEGESVLHRAIAKKYTDCALVILENGGCRSMAILNSKNLTPLHHCVAIWNVAVVKRWVEVATSDEIAEAIDIPSPIGTALCMAAASKKDHENAGADPSAQDSQNGRTALHTAAMTNDVDLVKVILGAGVDVNIRNVHNSIPLHLALARGAKACVGLLLDAGADYNLKDDDGDNAFHIAAETAKMIRENLDWLIVMLMKPDADIEVRNHSGKTLRDILEALPREWLSEDLMEALVNKGVHLFPTIFKVGDWVKFKRSVTTPTHGWQGAKPKSVGFVQSVLDRDNLIVSFCSGEVHVLANEVIKVVPLDRGQHVHLKEDVKEP

SEQ ID NO: 170691 - protein, 213 aa, Glycine max
  Coding DNA Sequence Number=SeqID_79006
MGGAVTLLDIPGGGNRVGDLDTYCLVFLSESVMWTRLGYFLGDGTTLHLRVEVSGDIIATRRVVTDVLVHFVGMKHEPCEIHNMDPDKFGVYYVIDDINSFVENLGLPHCHPFIIDEFWHEPRLAAPFSLVVNELVNEGINELVPIVEDDVGSNGNCPIQVDEVYVSDGDLTSKGLSEGSSSDSEYSPFDKYAELTNGDALSDFDESVDVIGA

SEQ ID NO: 170692 - protein, 203 aa, Glycine max
  Coding DNA Sequence Number=SeqID_79007
  Gene Ontology: Mol. function=structural constituent of ribosome; Cellular component=ribonucleoprotein complex; Biological process =translation
  Homolog annotation: Hit_ID=P30707; Match level="QueryCoverage=28%, HitCoverage=29%, E-value=4e-22, Identity=89%"; Hit description=60S ribosomal protein L9
  Pfam annotation: Domain name=Pescadillo_N; Domain location=15-198; Score=-112.2; E_value=1e-07; Accession=PF06732.2; Description =Pescadillo N-terminus
MKHLNLDFQLITNENGKRKLKIDAWFGSRKTSVAIRTALSHVENLITDVTKGYRYKMRPLVEIHRAIRMHERKIKKFVAKKNLECANRLREKTPKPKINRIIRQRYLRIVDALRELDDCLTMAEVEDQTITWLTPHSLQQVVSDDFDITTMLNFLQLYELVGLGSSSSMAVEWRRKKDDWRCHFKEKMGQEQAHHHRKPWIRA

SEQ ID NO: 170693 - protein, 113 aa, Glycine max
  Coding DNA Sequence Number=SeqID_79008
  Subcellular localization annotation: CTP_CleavageSite=60; ConfidenceScore=5.09e-01
MHNIGVNNPLEQPPSSYLLKKRGGACRPARPGKLCSPQNFTEALGKPRKPFFNKTGEEVAAQLTQNFTNSTAMGVKHFEVVKRRSHADKRWSPNEIRATSANPSSKTVKAWRH

SEQ ID NO: 170694 - protein, 171 aa, Glycine max
  Coding DNA Sequence Number=SeqID_79009
MSSTVCKDHARKTPSGPEEFQQGPGVLALITGLYRFYGVSFTPNKVIRPPINRAFITKYCAPRQAQGEAPRQPGDSQQLAADSSPPPLESTSTHLQGLEHCLRYMVDQQAPNHRDRSSPQRSPGRAPLKRIAMWPHKPTQVLTNIDSRAWNIDSVSRPSKDGHSSDRDRRN

SEQ ID NO: 170695 - protein, 164 aa, Glycine max
  Coding DNA Sequence Number=SeqID_79010
MQGYRMVIRTFCHPEAASPMTYGGTVWLSASFVNQEANEPIDAQRLMSSPAPFFNQEGSELVNAQRITSSSAPFVILRKQPDDMRGYRMVIRTFCHPETVNPMIYGGTVWLSASFINQEANEPVDAQRLMSPPAPFVNQEGSELVDTQRLTSSSTPFVILRQQV

SEQ ID NO: 170696 - protein, 117 aa, Glycine max
  Coding DNA Sequence Number=SeqID_79011
MTSPLNESILCFLIWVDPWVLEPIAFRGLHVLAIRGLHALTFRGLHVLTFRGLHALTFKGLHVLTFRGLHALAFKGLHVLAIIGLHALTFRGLHVLAFRGLHASPSEDCTPSPSENY

SEQ ID NO: 170697 - protein, 70 aa, Glycine max
  Coding DNA Sequence Number=SeqID_79012
MKMKDNKTRNELKLSDSKTYRLKNEERTKNGEERWKIFTKLLMEMSQKRYGRTSAWIFFTETRFFTQKPA

SEQ ID NO: 170698 - protein, 48 aa, Glycine max
  Coding DNA Sequence Number=SeqID_79013
RESPLSPHYKLFEGTHVPDIVSTSGKAAEEEEDAAEDTESDDDSEATP

SEQ ID NO: 170699 - protein, 179 aa, Glycine max
  Coding DNA Sequence Number=SeqID_79014
MDAKITLILHHGGRFTPRANDGKVEYIGGEFDIWEDISTNYMNIFILCDLVSYTIDGDILYLVKDALENENEINVYFHHEVDPIPEEVPLMLDLKCHPILEASNEDDLDDVPVAGHEEDVGGGEKVARYKLNIRRPKQKNISNTSTVDTPIVDVPPTTPLLFMPTPRFTRRKAADKDPV

SEQ ID NO: 170700 - protein, 133 aa, Glycine max
  Coding DNA Sequence Number=SeqID_79015
MDEHQQNWKEMANTMIKINKKAKEMFNIVHVMDRSYGEVSRSFVVRWKDELEPTWHLLHFSGNMHSVTYNQDLDVSSTKYSFMKATRFTHLNLEGTMECMIVYNHHRKIAKIGNGWRNFAQSKNCFLELKLYI

SEQ ID NO: 170701 - protein, 185 aa, Glycine max
  Coding DNA Sequence Number=SeqID_79016
MNLQTRLSESLLEWRRREKALVDVYVVRRFVVAGFGLGDVEGEENGFEPHEGRWLQEVDAGEVEADEDYKVELGSKERQAFTSKTVFENHCQMTVLDEDTNKGKDHEALEGPLTRGRLKHAQHVIETRNFWHLIKFGESFSLGSLLNQSQTYQGNPCGVYPDLSSFTGSGVIQISIACIKRSAPS

SEQ ID NO: 170702 - protein, 95 aa, Glycine max
  Coding DNA Sequence Number=SeqID_79017
MMQLVEAYKSLTLKKSIQETTTGNHWKLVIKVCHMVVVVQRILTLKASSNHYTSKKYPSFSKSAGYYISYLNACLVLTHPFHVQSPWLVSPSALK

SEQ ID NO: 170703 - protein, 56 aa, Glycine max
  Coding DNA Sequence Number=SeqID_79018
MTTTIKVTEVVTIDNDGGVIDDSDGGDDNNYDGRCDSGHGRDNDNRDNDDGDKEKL

SEQ ID NO: 170704 - protein, 409 aa, Glycine max
  Coding DNA Sequence Number=SeqID_79019
MMSLKGSFTDIVLMHEDLTETILDRYGIQCMVAHTEASCVVMLLNQQNRGGERAGTRADKSFLQHEVYLGFNLLFLKMGVPLQPHINGFRIGDKKNLGRGRLGQRKLCRGNGNVKICIDVLCVDDVMKLWWSKHLKCRVNFAFELHEMMNVNKEYDALDLNGNHLAKKVALKVMSDRRVGWVYMMGVLLSVVIIINDDKENPRGAFVVAVELLIVIEAKVALVPLEGVGNNGGGSVEEVGKGGEQGTGFNGCKAWTSGRISDVSPEMKQLKRNDEGRPIMRLAKSSNSESESCLKGLQEDWPGRELTIIGHPLKPGQSATIHVERSNGQALVFWSGVVLKKLVDLEDPTEGCTEVAEEGGAVEEEGEEVAESLVAKLWISSSSLSVWDNESTKMLGSSLTTLDFEGQYL

SEQ ID NO: 170705 - protein, 426 aa, Glycine max
  Coding DNA Sequence Number=SeqID_79020
  Gene Ontology: Mol. function=nucleotide binding; Cellular component =intrinsic to membrane; Biological process=defense response
  Homolog annotation: Hit_ID=Q7XA40; Match level="QueryCoverage=63%, HitCoverage=34%, E-value=1e-44, Identity=33%"; Hit description =Putative disease resistance protein RGA3
  Pfam annotation: Domain name=NB-ARC; Domain location=168-400; Score =0.1; E_value=2.8e-10; Accession=PF00931.13; Description=NB-ARC domain
MTAVAEDGSWSVVKPKLQNSIELTVAAHDTTGGMKTKIAEAAMIAKLGIDVYIVKAATSHSLRALNGDLRSSIPDDWLGTLAKSAFNNIRKDTLKINKRYWIDLKDAAYELDDIMDECAYEELGMEYGGVKCCLSEMEMERISERLNKIAEEREKFHLTETTPERRNAVTDQRQTNPFINEPQVYGRNAETEKIVDFLLGDASHSADLSVYPILGLGGLGKTTLAQLIYNHERVVNHFKLRIWICVSEDFSLKTMIKAIMEAASERTYNWQKLKSALVCGAKGASILVTTRLSKVAGIMGTMPPHELSELSKNYCWEFVGSAAFSKREKKEWLYVKESNLWSLSGDANSIMPMLRLSYLNLPIKHLRYLNLSEALQELSLIECSTLSSLPPQIGKLARRESSQFLISRYSLSFNLPNSAKRGQYVK

SEQ ID NO: 170706 - protein, 192 aa, Glycine max
  Coding DNA Sequence Number=SeqID_79021
  Gene Ontology: Mol. function=helicase activity; Biological process =viral genome replication
  Homolog annotation: Hit_ID=Q2HUT8; Match level="QueryCoverage=98%, HitCoverage=48%, E-value=3e-45, Identity=47%"; Hit description =Putative uncharacterized protein
  Pfam annotation: Domain name=DUF889; Domain location=1-191; Score =191.4; E_value=2.3e-54; Accession=PF05970.5; Description=Eukaryotic protein of unknown function (DUF889)
MKLQCVTDIDDAKLGEPNDGYDEITIPDEFLIKDFQDPIQAIVEATYPDLLQNYSNGNFLQKRVVLASTKDVIDKINDYVLSLIPSEEKEYCSADSVDKSYELLSPAFGVLTPEFLNSLKTSGIPNHKLKIKVGTPIILLRNLDQADGLCNGTRLIVTRLGSNVVEAEIITGPNICHRTYIPRMNLSPSDSP

SEQ ID NO: 170707 - protein, 160 aa, Glycine max
  Coding DNA Sequence Number=SeqID_79022
  Gene Ontology: Mol. function=chorismate mutase activity; Cellular component=chloroplast; Biological process=aromatic amino acid family biosynthetic process
  Homolog annotation: Hit_ID=Q30CZ6; Match level="QueryCoverage=69%, HitCoverage=34%, E-value=4e-32, Identity=60%"; Hit description =Putative chorismate mutase
MKLAKIFYILALLCKVDQKTSANTLHKKFQITGHCTQWNSINVRASPPLLQTISKRIHYGKFVAEAKFQDAPHEYEAAIKARDRKLLLELLTYETVDKFVKKRVEIMAQQYAAVEKIGETGYIPNSVYRINPSLIADLYGDWVMPLAKEVQVEYLLRRLD

SEQ ID NO: 170708 - protein, 243 aa, Glycine max
  Coding DNA Sequence Number=SeqID_79023
  Homolog annotation: Hit_ID=A5BH48; Match level="QueryCoverage=46%, HitCoverage=13%, E-value=2e-08, Identity=37%"; Hit description =Putative uncharacterized protein
MGGISMGKKLDRVIVDTFEHIIFPDAYAIEPMWGALGSLPYVGCTRNKLDKLKDTSKILNPSDVDGSCLYPLNLIGSGGVLHNHNSQWLLGFSSFAGTRDAEKAKLMAILNGLRTKKRNPILVGESELKAAIKEVIKKIENKELGDGAFANVNVIHLDKAGLGIRVWTVEWRVFIDLGVFKWLVEQPVGFGVAGGLGNMQQLTLTKANKVAVAVAVAVAAAEMRKMVSKFGEGGIGGLLGHAT

SEQ ID NO: 170709 - protein, 123 aa, Glycine max
  Coding DNA Sequence Number=SeqID_79024
  Subcellular localization annotation: CTP_CleavageSite=76; ConfidenceScore=5.15e-01
MRGYCMVIRTFRYPEVASSMTCGNTVWLSASFVNQGQTSPLTCAATCPFAGERRRGSRVRFPKEERCAESPPTFICGKRRKNRRKPVKMKILSSGVVFTFEEGRQKRGFCSYVPSIEEEIRPT

SEQ ID NO: 170710 - protein, 103 aa, Glycine max
  Coding DNA Sequence Number=SeqID_79025
MARIAKVVKISVQELDRVKQNRNGIVRIPRRHLEEKVKALVDQVLLVFGFVLFPNVDGLMDLATINAFLAYHHSKESSVVVVLADAYDTFDRRYKKSGARIAC

SEQ ID NO: 170711 - protein, 103 aa, Glycine max
  Coding DNA Sequence Number=SeqID_79026
MAPTLCTHIEILGLILGSISAEVDVSLSELNALSECHPLRKASTRLADRRNLEGNLPCRHALNASSAHLASRLSPSRLSASLALRKNSLTRAKRENGAKHDVE

SEQ ID NO: 170712 - protein, 41 aa, Glycine max
  Coding DNA Sequence Number=SeqID_79027
MENWRTALRNNFGGAPDSKRYAITSRGSRLEGGGHMKTARQ

SEQ ID NO: 170713 - protein, 98 aa, Glycine max
  Coding DNA Sequence Number=SeqID_79028
MYEYPRRTRALTHKHSFQNSYGYSCFVGKREMAPKKLSTKRSRRDAIGEGSSAAPEFDSHHFRSAEHQQHFEAIRGWSFHRERRVQLREDEYTDFQRR

SEQ ID NO: 170714 - protein, 72 aa, Glycine max
  Coding DNA Sequence Number=SeqID_79029
MSALKEQMVSMMDAMLGMKQLMESNTATATAVSSAAKADPNLPTTTHFPIANMVERERSTPGHISNPHPGYN

SEQ ID NO: 170715 - protein, 110 aa, Glycine max
  Coding DNA Sequence Number=SeqID_79030
MKSGDMRRYPSGYPHKRFLLILTREVRWQAEIPKWKSGGRWGYRMVIHTFLQPGANEPVDAQRLTSSSKPFVIQGQRVRWQAEIPYGRPHLSSTKVNEFDGIRMMLVVRF

SEQ ID NO: 170716 - protein, 82 aa, Glycine max
  Coding DNA Sequence Number=SeqID_79031
  Gene Ontology: Mol. function=nucleoside-triphosphatase activity; Cellular component=cellulose and pectin-containing cell wall
  Homolog annotation: Hit_ID=Q9M9M5; Match level="QueryCoverage=58%, HitCoverage=7%, E-value=9e-17, Identity=85%"; Hit description =Putative 26S proteosome regulatory subunit
MTNVGWGCMEVATVTEGAMMVCGVEARMNVEKALAEVEGRAHEAKLAEDVNMRILVDRANAEQEKWVAAINTTFEHIGGTFC

SEQ ID NO: 170717 - protein, 412 aa, Glycine max
  Coding DNA Sequence Number=SeqID_79032
  Homolog annotation: Hit_ID=Q84VI1; Match level="QueryCoverage=100%, HitCoverage=63%, E-value=0.0, Identity=86%"; Hit description =Envelope-like protein
MATSPKETAASGSPSVPSSPHQEQPEFNIQPIQIIPGQASVPEKLVPRRPQGVKIAENPSPATSPREVDTEMDKKIRSIVSSILKDASVPEADEDVPTSSNPNVSVPDVKKDVPTSSAPNAEALPSPGEEGSTEEDDQAAEETPAPRAPEPAPGDLIDLEEVESDEEPIANRLAPGIAERLQSRKGKTPIKRSGRIKTMAQKKSTPITPATSRRSKDVELDVSTSKKAKTSGKKVPGNVPDAPLDNISFHSIGNVEKWKYVYQRRLAVERELGRDALDCKEIMDLIKAAGLLKTVSKLGDCYEGLVREFIVNIPSDISNRKSDEYQKVFVRGKCVKFSPAVINKYLGRPTDGVIDIDVSEHQIAKEITAKRVQHWPKKGKLSAGKLSVKYAILHRIGAANWVPTNHTSTVAT

SEQ ID NO: 170718 - protein, 63 aa, Glycine max
  Coding DNA Sequence Number=SeqID_79033
MAPRKLYAKRSRKDAAVEGTSAAPKFDNHRFRSVEHQQRFEAIRDDEYTDFQEEIACRRWTSL

SEQ ID NO: 170719 - protein, 134 aa, Glycine max
  Coding DNA Sequence Number=SeqID_79034
  Gene Ontology: Mol. function=homoserine O-succinyltransferase activity; Cellular component=cytoplasm; Biological process =methionine biosynthetic process from homoserine via O-succinyl-L -homoserine and cystathionine
  Homolog annotation: Hit_ID=A8GKF8; Match level="QueryCoverage=100%, HitCoverage=43%, E-value=7e-70, Identity=96%"; Hit description =Homoserine O-succinyltransferase
  Pfam annotation: Domain name=HTS; Domain location=2-134; Score=69.0; E_value=1.3e-20; Accession=PF04204.7; Description=Homoserine O -succinyltransferase
MPIRVPDELPAVNFLRGENVFVMTSSRAKTQEIRPLKVLILNLMPKKIETENQFLRLLSNSPLQIDIQLLRIDSRESKNTPAEHLNNFYCDFEDIQNENFDGLIVTGAPLGLVDFCDVAYWPQIERVIDWAKHH

SEQ ID NO: 170720 - protein, 299 aa, Glycine max
  Coding DNA Sequence Number=SeqID_79035
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=95%, HitCoverage=43%, E-value=1e-139, Identity=76%"; Hit description =Photosystem I P700 chlorophyll a apoprotein A1
  Pfam annotation: Domain name=PsaA_PsaB; Domain location=44-299; Score= -67.8; E_value=2.1e-05; Accession=PF00223.10; Description=Photosystem I psaApsaB protein
LFVCVVWKEEDSMIIRSPEPEVKILVDRDPIKTSFEEWAKPGHFSRTIAKGPDTTTWIWNLHADAHDFDSHTNDLEEISRKVFSAHFGQLSIIFLWAEWHGEGSEEIQITSGFFQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHK

SEQ ID NO: 170721 - protein, 165 aa, Glycine max
  Coding DNA Sequence Number=SeqID_79036
MENNVATAAAVSSAIEADPTLPATAHHPLPNAVGRERSILGHTSNPYLGYNWVAYPYGLPPNYTPPVMHDDAGLIPSPILEGEPPRQADEHNLTAQPIFLSTEGPPPAVEERRKLDLIEERLRDVEGFGDYPFADMADLSLVPDVVIPPKFKVPDFYKYKGTTCP

SEQ ID NO: 170722 - protein, 126 aa, Glycine max
  Coding DNA Sequence Number=SeqID_79037
MSFKVVMGPRTRYGKIWNKRLNPKGIEEQWGITFEKQHLIQHVQHLTNIQFKACSELQNKERETRLKRAIKGINSRKHQQESSQGYCASNQWGKTHQMIMMMDGSNSNKEEKQGFQIAKCQEAFFK

SEQ ID NO: 170723 - protein, 276 aa, Glycine max
  Coding DNA Sequence Number=SeqID_79038
  Homolog annotation: Hit_ID=Q6WAY6; Match level="QueryCoverage=98%, HitCoverage=46%, E-value=2e-18, Identity=28%"; Hit description =Putative uncharacterized protein
MDGLVDLAAIDAFLAYHNHKESPVIAMLADLYDTFDRRCEKNNTRIVCCTPALYVWLVSHLFRQEVRHACPLESHCSCTEKGRANWDQLLASKEGASVNCFPRWKEGRTEVLISCGGFQNVPLMGTRGCISYNPVLAIRQLGYPMRGAPLEEEIVPKVRKAWEVLQKKDKELKGSNNGPIGGYRERLKAHVQGLDWLPSLRATKREEDEAPEEDEGVQALRTELKQAQTAKERFKSAALKIRKENAELRDVNIATTKALEQETKWARREEHSRNKF

SEQ ID NO: 170724 - protein, 34 aa, Glycine max
  Coding DNA Sequence Number=SeqID_79039
MVILRLVSAKRNKFDSIGMMFRWQEGSLAERCFA

SEQ ID NO: 170725 - protein, 84 aa, Glycine max
  Coding DNA Sequence Number=SeqID_79040
MAKIQCPKEGKTYSNIYKEEWIQPWPMGSAIYPEVHENPRDVSLVIRRVLVVKTLAYQRSLMRKLLRILPEIHRRFLQVGFTFD

SEQ ID NO: 170726 - protein, 121 aa, Glycine max
  Coding DNA Sequence Number=SeqID_79041
GLSSMERSMIDAASGGALGDMTPAEARNLIEKMASNSQQFSARNDAIVLRGANDHPKYAISARDKSLYSESDKLDGNPKNMSVITLRSGKQIEVPPPVAPPVPEPVKLHSTPEKEDELAAQ

SEQ ID NO: 170727 - protein, 518 aa, Glycine max
  Coding DNA Sequence Number=SeqID_79042
  Gene Ontology: Mol. function=transketolase activity; Cellular component=chloroplast; Biological process=metabolic process
  Homolog annotation: Hit_ID=A7QGQ5; Match level="QueryCoverage=51%, HitCoverage=63%, E-value=9e-66, Identity=70%"; Hit description =Chromosome chr16 scaffold_94, whole genome shotgun sequence
  Pfam annotation: Domain name=Transket_pyr; Domain location=275-410; Score=-49.3; E_value=0.0077; Accession=PF02779.15; Description =Transketolase, pyrimidine binding dom
  Pfam annotation: Domain name=Transketolase_N; Domain location=78-345; Score=-110.8; E_value=4.1e-08; Accession=PF00456.12; Description =Transketolase, thiamine diphosphate b
  Pfam module annotation: Pfam domain module=Transket_pyr::Transketolase _N; Domain location=275-410::78-345
MAMLETSSGSEVDKDAPVEVDTGSGSHSGTKDIIECNDEHVGKSVSNDLVDDSQQTSTLEDSCKKSELTESQTTTCNEDDQSHSALSKRLKANNWFETSLCGHELKAGMGLAAAAKVFEAHRISAEEFRSFALSIIKNENLILKFRERYLLWEKDAPLVLGMTVFGLDLPVEPKDTNLVGLDDAVKAKCDAPGPASFGRRWRLWPMNFQRFKTIDHTNSVSSEEVFVDSKSDCQTSVVEPSPTSAMPISKFISISQVTTTIEFGSPNKANSNSVHGSALGAKEVDASRKNLGWPYNPFHVPEDVKKHGWGGAKLEAEWNDKFVEYEKKYSEEAAKLKAIIAGKLPAGWEKALPDGPTHQPIENLASFKAMPNTLMLRPADGNETAGSYKVAMVNRKRPSIVALCRQKFTQILGTPIEGVEKGGYTISDNSSGNKPDVIFIRIGFELEIVVAAAKDLRKEGKTVIVVSFVSWELFDEQTDEYDENVLPASVIARVSIEAGSTFGWHNIAGRKGKAIGID

SEQ ID NO: 170728 - protein, 151 aa, Glycine max
  Coding DNA Sequence Number=SeqID_79043
MTIIIYVFGVEKISNIVEALHRLDECMTRGNPSDLQPFDPEIDRAFDRLVRHSVHPTFPEHFVPFEHPEHFVIGQSEHFVVGNFEHPDFEHYIFEHSENMAQPPPHERTLREMATPDFTYESLCIQYPDEDVPYVLKTGLIHLLLKFHGFA

SEQ ID NO: 170729 - protein, 136 aa, Glycine max
  Coding DNA Sequence Number=SeqID_79044
  Subcellular localization annotation: CTP_CleavageSite=78; ConfidenceScore=5.34e-01
MDLGSLILGQISLIAQHDSSRLDDPLVTFWGTRKSRARGFEAPSTSAPPTSAPSTSPLSPAPAAPVLLDPSSQSFEPSLSMLQSLHQGQLLIMWPGQESSLHLWEEVRPLQPRSLSRISRRTFQRLQSLHLLSHSL

SEQ ID NO: 170730 - protein, 136 aa, Glycine max
  Coding DNA Sequence Number=SeqID_79045
MRGKFLVDKSSFDPEITKTERKNKKKKKQATIITPENIMAERGEGSRPPRRTLGDYAYQQGPKHYNSIVIPPFSNKQNREGRERGDATSKEKMSLEEAHHHRRPWIRAWRKKEMNEGRGREEHDILCSKRALKSEI

SEQ ID NO: 170731 - protein, 279 aa, Glycine max
  Coding DNA Sequence Number=SeqID_79046
  Homolog annotation: Hit_ID=A5AZ88; Match level="QueryCoverage=100%, HitCoverage=26%, E-value=3e-11, Identity=25%"; Hit description =Putative uncharacterized protein
MQISLFMKGITNDCRRMINASTGGNYLNKTTTQVKTIIKDLATSERTIDTNWSNLPKGMYELNAQDNLLALQQKIEMVIEAMTKAIQQIPQQLQGAISKKPQQVFTCEECKGCHQISKCTKVQTEEVNYMGGQQQPYNNFQQIGFQNIHGNYNQLEEALTKLTEVVVTNHKNTEVTNKSMETQKGKLSIHKQGDDERMAKFEKYMEMLQRKKEEPPIKKLKWDVLHQVRPTRHLEDKGCFTIPVTLKNFPIDHALLDLGASSNLMPIGCLNLKLTNMTL

SEQ ID NO: 170732 - protein, 107 aa, Glycine max
  Coding DNA Sequence Number=SeqID_79047
MGSSQTPWLKKRFYQVKIKSLGVTSLKELGQLIGQLQRQAFRKAYGIGPGKASRKWGGWSTKEMFGSKGENLGKSRRMGLIHGRPGAFDLQSGPLSKCGWVGGPGSD

SEQ ID NO: 170733 - protein, 146 aa, Glycine max
  Coding DNA Sequence Number=SeqID_79048
  Homolog annotation: Hit_ID=A5AY05; Match level="QueryCoverage=78%, HitCoverage=29%, E-value=9e-09, Identity=29%"; Hit description =Putative uncharacterized protein
  Pfam annotation: Domain name=zf-CCHC; Domain location=94-111; Score =21.9; E_value=0.00073; Accession=PF00098.14; Description=Zinc knuckle
MSHHSSSVNGKGTSHKDPLSRILDELSPLKREIRVEQQLKRKSTSKSYGSHSYPKKDQGQGILGVTPSKPKYDKGKTIEKQPLKASMQEKTSSMKCFKCLGIGHITSQCPTKKTMTMRGQDIYSSQDEATTPPSSSESEEAKAEES

SEQ ID NO: 170734 - protein, 76 aa, Glycine max
  Coding DNA Sequence Number=SeqID_79049
MAAEWRRKRERRCHFKEKMSLEEAHHHRKPWIRALRKNEMNEGRGREEHEILCSKRALKSEPTNPRSIPRFSTKCA

SEQ ID NO: 170735 - protein, 122 aa, Glycine max
  Coding DNA Sequence Number=SeqID_79050
  Gene Ontology: Mol. function=oxidoreductase activity; Cellular component=cytoplasm; Biological process=metabolic process
  Homolog annotation: Hit_ID=A7R0V8; Match level="QueryCoverage=81%, HitCoverage=27%, E-value=1e-38, Identity=80%"; Hit description =Chromosome undetermined scaffold_324, whole genome shotgun sequence
  Pfam annotation: Domain name=ADH_zinc_N; Domain location=12-112; Score=-2.3; E_value=0.0012; Accession=PF00107.17; Description=Zinc -binding dehydrogenase
MKQYNILELFFWTAKVARQHLGADSFLLSCDQHQMQAAIGAFDGIIDTVSTVHPLLPLIGLLKSHGKIVMVGAPDKPLELPIFPLLAGRKIVDGSLIGGLKETQEMIDFAVKHKKDSSCQLT

SEQ ID NO: 170736 - protein, 183 aa, Glycine max
  Coding DNA Sequence Number=SeqID_79051
  Pfam annotation: Domain name=DUF1905; Domain location=2-76; Score= -13.6; E_value=0.053; Accession=PF08922.2; Description=Domain of unknown function (DUF1905)
GTSFVVQVEGTSTWVVVTENKRGYISFGSVQVEGTSSWLFKENKGGYIPCGSLLVKVLTRLKEISKTTGHPVEAMLSKIMLMMPKTQFKNQESSKFQESKSRSIKIQDSRYILCGTSRAYIYLGCNTKNMRGYISCGSVQVECTSTWLFKENKGGYIPCGSLLVKDFTRLLEISRTGDCLGTG

SEQ ID NO: 170737 - protein, 74 aa, Glycine max
  Coding DNA Sequence Number=SeqID_79052
MCVKGVIPLSTLMHSVGTVSITLGKSHMSLQLVVVGLQLSEFLLMTPPNLHNAGLELLESIGVYHSCWGRIGAF

SEQ ID NO: 170738 - protein, 153 aa, Glycine max
  Coding DNA Sequence Number=SeqID_79053
MSGFTRDSPQISASPHQLDLAPYASGSYNAQWDTPGLLHDKHMLRSSRILGEMEVDEPWLGLWLPLNYQVDMGASQQRTPELGVMCFLLEFSTSNPKALTIQRLQKCKKTNCFLENAMNSLTEHAALSEFISTHYLHAKSCFPGPSTICCGIH

SEQ ID NO: 170739 - protein, 113 aa, Glycine max
  Coding DNA Sequence Number=SeqID_79054
MIKHHPQILLTLESDQFPLLNDPNKACIYVIKGRSNKGFSFPPGSLLYNKEKKKMKDCKNTSGEDVSFTSMISQSLANSSQALKLAPTSSSGLCRSSHSKISQNSPELGPFSL

SEQ ID NO: 170740 - protein, 80 aa, Glycine max
  Coding DNA Sequence Number=SeqID_79055
MEDDEKKKVQEDQKAKSILTSDDDKKLKRIEEHPSQENLEQVKEFKNQEEFKAQEESLQTRIKIQDLKNQDQDSRLKIQE

SEQ ID NO: 170741 - protein, 242 aa, Glycine max
  Coding DNA Sequence Number=SeqID_79056
AQNQYMDNVLGRNILLERKVEFYANLYNFEGPSPKQARVRGHLVKINTKSLNTFLETPVVLAEGETLPTYCRLPSDPREIEVALCITVWNVLSYSNLALTSHTSDLTVDRARLIFGLVSRMGMNIGALISGQMTFIAQSNSSRLGFLTLITALCRGRGVVSNNLTFERLSLIINLAYIRKNYWNPDDLTVAIRGARRARARLANLPSTSVAPTLASTSAAPSDPAQMDSQCFEAMLQSIHQG

SEQ ID NO: 170742 - protein, 202 aa, Glycine max
  Coding DNA Sequence Number=SeqID_79057
  Subcellular localization annotation: CTP_CleavageSite=29; ConfidenceScore=5.26e-01
MALKKLPTKRSRKDAVGGGSSAAPQDFARSITGRQVRIMDTSMTTLKQIWMTLLLSNVLPSDNTSELPLPKCQLVYAILTQVSVHVAQLISDAMYHFVEVAPPRHPVDLEKSNKALGFLALITGLCQFYGVSVNPTKLIRPPISRAFIEKYCMPSRVRTPILSLGLPPSSSGPQLHGSEMRPILRHGQDLQGPWEGRRSLGG

SEQ ID NO: 170743 - protein, 187 aa, Glycine max
  Coding DNA Sequence Number=SeqID_79058
  Homolog annotation: Hit_ID=Q6WAY4; Match level="QueryCoverage=82%, HitCoverage=28%, E-value=5e-17, Identity=33%"; Hit description =Putative uncharacterized protein
MNLAQCQVFRKAYGKIWDLAMIEVSVESIASLTQYYDQLLRCFTFGDFQLAPTIEEFEGILGCLLGGRKPYLFSGLYPSMAREAKVVKISAQELDQVKQNRNRVVGMPRKHLEEKEKALADQGEWTSFIDVLALLLFGIVLFPNVDGLVDLAVIDTFLAYHRNLSAPYKVITCVPRKEKQIGRNSWQ

SEQ ID NO: 170744 - protein, 82 aa, Glycine max
  Coding DNA Sequence Number=SeqID_79059
MYKANWTQPWPMGSKIYPEVYENLRAFFSSSSPILLKPLAHGSSDWSLPREDCIKGSHTCWRTTRSMVLPMKIICRTQGSLF

SEQ ID NO: 170745 - protein, 162 aa, Glycine max
  Coding DNA Sequence Number=SeqID_79060
MAGWGLWRVFLDGGDDQDGWVMEVLASFKLWDGGGMFLYERNLYMWRISGSSIKGLLARWMLGTMVSSEGGATSLFLNTNPSSSLSVSLSAFRHSTVDDGCWFFLNQAPPSPIHLDRLHHQGTPAIGPNLKQSYPPRALDRRLQEDWVRDAREGPRVLMSLM

SEQ ID NO: 170746 - protein, 72 aa, Glycine max
  Coding DNA Sequence Number=SeqID_79061
MSQEQAHHHRKLMEACFGRQRRRGERRHHPLGNKPWKKELHHQDEPWIRSLKRMLQWRKRKRERKREGGTRN

SEQ ID NO: 170747 - protein, 288 aa, Glycine max
  Coding DNA Sequence Number=SeqID_79062
MEAFGYQTCLEASDCTIGVPFYSINPLVPSDVGVFLLWDESPCASSNEGIELFRHGRFPLLVFESLREARWLTRFRGQEYERVNLLAFNNSIFGPCYHGMSGSGNQNFCEERGVQVARFVGGLDMLFLFVSAIVLDKEVGWGAVSDGEEFGFVENGKIFSTKISLDVYGLYRIVDHNKDRHFGFCYNRRSRVLENLALPLLFVILLPEIAPFSPPALNLSETAPSTPTLSSVEATEPPTLPENPHCPRWNPQNPLQCRKTHIVVAGTPQNPHCPGSKKTLHTLLLLGC

SEQ ID NO: 170748 - protein, 135 aa, Glycine max
  Coding DNA Sequence Number=SeqID_79063
MWMHFAEHVLPVGELCLVPGQVSADYMEWFFRISHPFMISTQAGDQSRDAPAADPEEYIQPPSLQVPVAFDPHPHVDDYDGYEVIAQRLERVLNLRMVIASTELYEIMQDCLTIARGGASADGSVRACQRRRTEH

SEQ ID NO: 170749 - protein, 46 aa, Glycine max
  Coding DNA Sequence Number=SeqID_79064
MSRNFTNCLTMGFKFLEVVKRRLHAIKQWSPDEIRYDSENYSSVGV

SEQ ID NO: 170750 - protein, 451 aa, Glycine max
  Coding DNA Sequence Number=SeqID_79065
  Gene Ontology: Mol. function=motor activity; Cellular component=cell projection
  Homolog annotation: Hit_ID=UPI00016621D1; Match level="QueryCoverage =97%, HitCoverage=40%, E-value=1e-25, Identity=35%"; Hit description =UPI00016621D1 related cluster
YGPHFRGLHVVTLRGLPALTFRGLHVLTFSGLRALTIRRLHVLTLRRLHALTFKVLHVLTVRGLHALTFRGLHVLTFRVLRTLTFRGLHVLTFRGLHGLTFRGLHVLAFRRMHALTLRGLGLHILTFRGLQALTYKGLHILTFRGLHALTFRGLHVLTLRGLRSLTLRRLHVLTLRGLHALTFRVIHILTFRGLHAITFKGLHVLAFKRLHVFTFKGLHVLTFRGLRTLTFRGLHMLTFRMLHALTFRGLHFLTFRVLHALTFRGLHVLTFRALRALTFRGLHVLTLRGLHALTFKGLHVLAFRGLHALGFRGLHVLTFRALRALTIRGLHFLIFRGLNALTFGGLHVLTFSGLHAFTFRGVHVLAFRGLHALTFRGLHVFTFRGLRTPTFRGLHILTFIGLHALNFRGLHVLAFRDLHAFTLRGLHVLTFRGLRALTFRGLPVLALRGLH

SEQ ID NO: 170751 - protein, 140 aa, Glycine max
  Coding DNA Sequence Number=SeqID_79066
MGVPLPSRKPRNTALPHLHSPVHLWPIGGGVMMLDLEIPAHFLHLRVNEAAKYMDENVGARAPQPTLLRASETRLTDASSKGGKCAESPPTFICGKRRKNRRKPVMKNIPDSGVVFTFEEGISTSHVCPCRNMPFCGRAR

SEQ ID NO: 170752 - protein, 115 aa, Glycine max
  Coding DNA Sequence Number=SeqID_79067
  Homolog annotation: Hit_ID=UPI00006A2D9E; Match level="QueryCoverage =81%, HitCoverage=49%, E-value=8e-07, Identity=18%"; Hit description =UPI00006A2D9E related cluster
MRGPLDESISCFLIGVDPWVLEPIAFRGLHVLAYRGLHILTSRGLHVLAFRGLHALAIRGLHILAFRGLHAFTFRGLHVLAFRGLHAFAIRGLYALAFKGLHVLAFRGLHALAFR

SEQ ID NO: 170753 - protein, 141 aa, Glycine max
  Coding DNA Sequence Number=SeqID_79068
LSEELAKCTYYAKQVHPLRMNIHPLAELTVSKILSERNVELYHSEFDEFKVELERRNFHKRLTNLQEGSIDVAVVKEFYANFYSPADQAPKCVRIRGHLIKIDTDSLNKFLQTPVLLEEGESLPTYSRFCRLRSDPREMEA

SEQ ID NO: 170754 - protein, 119 aa, Glycine max
  Coding DNA Sequence Number=SeqID_79069
  Subcellular localization annotation: CTP_CleavageSite=60; ConfidenceScore=5.03e-01
MPISPYGSISWGHSHKTPSGLGEVQQGLGDSSSGYEPLSVLQGARTPRQVKLISDVSSTECSSPPARSSGLLLTELSSRSIAPPGRQRARHHNSLLMASNMQQMHRRHLQSPSAHPQKG

SEQ ID NO: 170755 - protein, 139 aa, Glycine max
  Coding DNA Sequence Number=SeqID_79070
MVTVQHLVMDNKKRRPIINGTKLDLNKTFKEATKAIEVAQVLLTTLVEVFQIEDPRQQQAQPDRMSYMEDTLTHFMWWTGVGLKDNDEKKNKEGVEKKNKKNDEVVTSEKVEEKGGIRADANICKIDEGFSYEEEKNYG

SEQ ID NO: 170756 - protein, 249 aa, Glycine max
  Coding DNA Sequence Number=SeqID_79071
  Homolog annotation: Hit_ID=Q84VH5; Match level="QueryCoverage=83%, HitCoverage=39%, E-value=2e-67, Identity=97%"; Hit description =Envelope-like protein
MDLIKAAGLLKTVTKLGDCYESLVREFIVNIPSDITNRKSDEYQKVFVRGKCVRFSPAVINKYLGRPTEGVVDIAVSEHRIAKEITAKQVQHWPKKGKLSAGKLSVKYAILHRIGAANWVPTNHTSTVATENLLYPCITNCLKGHMSPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 170757 - protein, 84 aa, Glycine max
  Coding DNA Sequence Number=SeqID_79072
  Homolog annotation: Hit_ID=A5BMX7; Match level="QueryCoverage=80%, HitCoverage=8%, E-value=6e-11, Identity=44%"; Hit description =Putative uncharacterized protein
MDSSRGSKNEVVNLSLMAKNYESEEEDSLKKSWYIDSGCSKYMTGDASKFTHISPKNNGHVTYGDNNKDKTSNHVQCFLSKVKF

SEQ ID NO: 170758 - protein, 52 aa, Glycine max
  Coding DNA Sequence Number=SeqID_79073
MGTNQNGKRFHQVKIKSLDVTSLKELGRLMGPLQRQAFRKVYGKILDLTAVE

SEQ ID NO: 170759 - protein, 79 aa, Glycine max
  Coding DNA Sequence Number=SeqID_79074
DFGQIEKAACHSFVIELGSARWPSAPSDLLNSELRARPSEIRVIPSSEIVSVAGEIAAQKGKGLYGGRQRNINHRVLRQ

SEQ ID NO: 170760 - protein, 57 aa, Glycine max
  Coding DNA Sequence Number=SeqID_79075
MRGVATNVYLWKTSEKPKESVMKNIPDSGVVFTFEEGRQKRGSCSYVPSIEEEIRPT

SEQ ID NO: 170761 - protein, 107 aa, Glycine max
  Coding DNA Sequence Number=SeqID_79076
  Subcellular localization annotation: CTP_CleavageSite=60; ConfidenceScore=5.57e-01
MHTQSFTIPQFPKIGLTHKNSPQGSRQLSQPTILRASEARLTGASSKGGKCAESPPTFICGKRRKNRRKPVIKNIPDSGVVFMFEEGRQKRGSCSYVPSIEEEIRPT

SEQ ID NO: 170762 - protein, 215 aa, Glycine max
  Coding DNA Sequence Number=SeqID_79077
  Gene Ontology: Mol. function=[formate-C-acetyltransferase]-activating enzyme activity; Cellular component=cytoplasm; Biological process =oxygen and reactive oxygen species metabolic process
  Homolog annotation: Hit_ID=P0A9N6; Match level="QueryCoverage=100%, HitCoverage=87%, E-value=1e-122, Identity=95%"; Hit description =Pyruvate formate-lyase 1-activating enzyme
  Pfam annotation: Domain name=Radical_SAM; Domain location=1-154; Score=35.6; E_value=1.8e-07; Accession=PF04055.12; Description =Radical SAM superfamily
MRCLYCHNRDTWDTHGGKEVTVDDLMKEVVTYRHFMNASGGGVTASGGEAILQAEFVRDWFRACHKEGIHTCLDTNGFVRRYDPVIDELLEVTDLVMLDLKQMNDEIHQNLVGVSNHRTLEFAKYISAKGIKTWIRYVVVPGWSDDDDSAHRLGEFTRDMGNVEKIELLPYHELGKHKWVAMGEEYKLDGVKPPKKETMERVKGILEQYGHKVMY

SEQ ID NO: 170763 - protein, 85 aa, Glycine max
  Coding DNA Sequence Number=SeqID_79078
MPSKIVLMMPKNQDQDSRFKNNQDQDSSKESRLKIQESREDSIKLSIKEFFKTLNSTRIFQKEKSFTKVFYSLVIDYQKAVIDYQ

SEQ ID NO: 170764 - protein, 116 aa, Glycine max
  Coding DNA Sequence Number=SeqID_79079
  Subcellular localization annotation: CTP_CleavageSite=46; ConfidenceScore=5.10e-01
ICTDDRSARARALGFAATAAPSYSSGLGPCPDGRVCSHSNPSQKIRVGRAVQPTGGIPPISFLAPLRVYSPVDSHTCQTPWSVFQDGPNGEPHRPDARRSQVPRHAKGSLCYPQSR

SEQ ID NO: 170765 - protein, 85 aa, Glycine max
  Coding DNA Sequence Number=SeqID_79080
MSLDSKKGADDHNLSPRAIGLDCLGIAKRVRMTIWLLTSAPDRTSSIKRLVLIKPRPQIPLVRLNSTRTALRHTYSTDLSHPDFL

SEQ ID NO: 170766 - protein, 189 aa, Glycine max
  Coding DNA Sequence Number=SeqID_79081
VVVSPSKPPSKLDPEVDDPLYLMTLTISELFLRPYQVRWDATVFGVFNPDFPLYIKHKDLFKIAHGCGFCKHLTETCIRVGNSDIYGFLEPQSIHRSRQSQFESESYIKSWMQSSQRNVYLGAYLNGFHCSGHWQMVVILPKEHLVVWFCSLHNRPDNYLKGIINSALKGLDDASQPKSKASARWIVVK

SEQ ID NO: 170767 - protein, 131 aa, Glycine max
  Coding DNA Sequence Number=SeqID_79082
MGLFLNYFQEGTVFIREKHVCRTQTARIGGEFGVLEQIASVNGDTSETCTPFGNRQFDWRVPWIKLFGTALVPIHIHGTRQCDWRFPKAAHVAISSGDLVTGIAINVGDLFKDTKLATGSGDLGSACMFFT

SEQ ID NO: 170768 - protein, 106 aa, Glycine max
  Coding DNA Sequence Number=SeqID_79083
MVEKAKREEETNLEEEAKTRRRSRPIVLITTTMRRRNAKNNEEAETRRTMKKMESRRRRRRLKKQTNEEAADSEEEEAESWHGRERGERVVFLKKKILKGLKDFSQ

SEQ ID NO: 170769 - protein, 140 aa, Glycine max
  Coding DNA Sequence Number=SeqID_79084
  Homolog annotation: Hit_ID=Q2HUU9; Match level="QueryCoverage=84%, HitCoverage=70%, E-value=2e-09, Identity=29%"; Hit description=Helix- turn-helix, Fis-type
MKIIKQSTLKIVCQQGQTYGLEEDAAHLFFPCTKTLPLWWETQSWINSLGAFPHNPKDHFLQHDNSSADGVRARRWKCWWVALTWVIWKHRNGVVFHNHSFDGSKVMDDAIFLFWSWLKVMEKGFTVPFSSWSSQLKAAF

SEQ ID NO: 170770 - protein, 334 aa, Glycine max
  Coding DNA Sequence Number=SeqID_79085
  Homolog annotation: Hit_ID=Q2HSY2; Match level="QueryCoverage=100%, HitCoverage=97%, E-value=1e-108, Identity=58%"; Hit description =Cyclin-like F-box
  Pfam annotation: Domain name=F-box; Domain location=20-67; Score =44.4; E_value=4e-10; Accession=PF00646.24; Description=F-box domain
MSSEKNYASKLDKQKDCKVSSLLDLPEWTLDCILECLPPQDLCRVAQVCTSLRDRIRSDALWEKKIKHKWGRLLGDVAHQEWQLHTTKINTQSFLLLQQNQSGSYGSFSGVWPFLIFHSYLENFIDLISLFKNCSKMALYISLESGLFWFPVQVFKITNLFCYDAIVSYDSRTDTFKSRSPTGGWRMIEGNIQRDRLRLAPAETSPMTFYMSNSMNDLKPGDHIEIQIRRRKESPYNWWYAVIGHLETCNQNVNHCHCQYSDGSNMKCYCCIVEDSLVVEFKQYQPENRMRRAMLNRNVNVEQGSTFRLRWFGGIRKLYKEEEIEKWNNLLASR

SEQ ID NO: 170771 - protein, 125 aa, Glycine max
  Coding DNA Sequence Number=SeqID_79086
  Homolog annotation: Hit_ID=Q2HSX6; Match level="QueryCoverage=98%, HitCoverage=39%, E-value=7e-38, Identity=58%"; Hit description =Cyclin-like F-box
MELVSMSEVCTCLRDRCRSDPLWEVHIKKKWGGVIGDVAYKEWHWHITTTKEKGINQLHQQHNIQNGSLGPFSGTWPMLYLRSYLEDCSHLNTSLANSFMMALYFSLENGKFWFPAQIYRVKYPF

SEQ ID NO: 170772 - protein, 437 aa, Glycine max
  Coding DNA Sequence Number=SeqID_79087
  Gene Ontology: Mol. function=microtubule binding; Cellular component =cortical microtubule, transverse to long axis; Biological process =cytoskeleton organization and biogenesis
  Homolog annotation: Hit_ID=A5AJJ7; Match level="QueryCoverage=96%, HitCoverage=69%, E-value=1e-138, Identity=61%"; Hit description =Putative uncharacterized protein
  Pfam annotation: Domain name=Myosin_HC-like; Domain location=63-398; Score=592.5; E_value=4.1e-175; Accession=PF07058.2; Description =Myosin II heavy chain-like
KDDEMPPIEAIIAPLEAELKLARMEVAKLQDDNRALDRLTKSKEAALLEAERTVQIALAKASLVDDLQNKNQELMKQIEICQEENKILDKILRQKVAEVEKLTQTVRELEEAVLAGGAAANAVRDYQRKVQEMNREVARAKVTANRVATVVANEWKDANDKVMPGEMQQLRDKLAIAERTAKAEAQMKEKYQLRFKVLEERVKTSNGNSKFTVSDGRNIGTGPSRRQSFGEAESLSASSSNGYQSRKNSISRSGSLRSNSANVLLKHAKLSSRSFDGGSRNLERERPTSDANGLDNMPTNYNNQTITRETITTHEESANGTPVEKSKSENEDYVSGMLYDMLQKEVISLRKACHEKDQTLKDKDDAIEMLAKKVDTLSKAMEVEARKMRREVASMEKEVAAMRISKEHDHRAWQASAPRGAVNSQSISSSMVITVKI

SEQ ID NO: 170773 - protein, 193 aa, Glycine max
  Coding DNA Sequence Number=SeqID_79088
MEGLVDLAVIDAFLAFHHGKESPVVAILAMHDTFDQRCEKSGARIVCCTPALYVWLVSHLFLQEGRLVYPLKCSLDGTRGCINYNPVLAIRQLGYPMRGVPSDESITPFITRGFSDPNARDRELRGSSNGSIGGYHKWLRVRTQGLDWLPNLKTMRDDEVKASEESDEVQALLAELERARVVEEKFKSIAIKV

SEQ ID NO: 170774 - protein, 190 aa, Glycine max
  Coding DNA Sequence Number=SeqID_79089
MVFFLRRAGNADAADAAEAGQGEREGAAVHRIVAHVQPVAFLQRRLPLLQAQADGVRAFVKMVHQITLAPHPVGDVRRGARHGVIKQRLPGQLDLDGDAQAAPLGGGFQRRAQFPGGGGIKMGKGQRRFLFAERLQAQSSLKRLGRDRRLGDKIEPPGRSRGWERAPRRAGRVASGRQRVFAEGVQQLFR

SEQ ID NO: 170775 - protein, 89 aa, Glycine max
  Coding DNA Sequence Number=SeqID_79090
MGSTPLEAVYVKLHYLVGVQNGSNQVDLRKARFYWENSSMAVKRSTLADYLAQQPINDYQPMHPEFPDEDIMALFEEEGEDEDKEKWIV

SEQ ID NO: 170776 - protein, 100 aa, Glycine max
  Coding DNA Sequence Number=SeqID_79091
MKVQVEKDEETFGILIKFGESFSPGSLLNQLSDLSSGVYPDLSSFTGSGVYPDLSSFTGSGVYPDLSSFTGSGVIQTFVACIKQSAPTQVHIIWYQSFGS

SEQ ID NO: 170777 - protein, 504 aa, Glycine max
  Coding DNA Sequence Number=SeqID_79092
  Subcellular localization annotation: CTP_CleavageSite=61; ConfidenceScore=5.75e-01
MKVRSPFGSTSARHQPLSIWPWRNSTSSPSSPMAASTAAPHSPLPTGMPLITGVSRRTSARATLNAQPPICRACGWASISSPLVGRRGSVITRSPTAPPITRTGVQTVSDQTHRERHKQPQAGIGEQAFGQRAVDKTGFGDQQAAQGAEEPAEQRGFAHAAVLAMQAVQSVAIIPVAAAQAQVIEQENRLPGRQEDAAEHQEGDERPHEITGDEQHIQGDTQHHHRVDRYRQPLLDLHADGQQVKAGGIQAEHRDGDDAGGSGQQIRNGHPGGQHRAYQRDGVGGAGQIGQLHGKQDAGQHQQHQRQTGAAHHRGENAFARRARALIAAVIGAGDRPTDAGAGGDHRYRRQEAGQPAAGRQRQHLAPLGVEQDIEHHDQRHGAEDAAEPALHPDHGILPQQADDDSEPAEQQQAERGQQVAATQPEGLEQRRQRQGAGDHVDCFPAHQVDPTEQGGRHVALQAENHPRERQRRGAPALAGEAGEADQHEAGDADQRGEYRLQEG

SEQ ID NO: 170778 - protein, 213 aa, Glycine max
  Coding DNA Sequence Number=SeqID_79093
  Gene Ontology: Biological process=transposition, DNA-mediated
  Homolog annotation: Hit_ID=Q6UUU1; Match level="QueryCoverage=28%, HitCoverage=40%, E-value=2e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLVKLLPHEVRDTLNVKASKGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 170779 - protein, 201 aa, Glycine max
  Coding DNA Sequence Number=SeqID_79094
  Homolog annotation: Hit_ID=UPI00016621D1; Match level="QueryCoverage =83%, HitCoverage=39%, E-value=2e-08, Identity=27%"; Hit description =UPI00016621D1 related cluster
MSKSCGFGMTGPLDESISCFLIRVDPWVLVPIAFRGLHILAFRGLHVLTLRGLPALALGTSTLTFRGLHILTFRGLHALAIRGLHVLTFVGLHALTFRGLHVLANRGLYALTLRGLHALTSRGLHILALRGLHAITLRGLHVLANRGLYALTLRGLHALTSRGLHILALRGLHALTFKGLCVLIFSVLHIRTLREFKVLYP

SEQ ID NO: 170780 - protein, 64 aa, Glycine max
  Coding DNA Sequence Number=SeqID_79095
MRDKTAGLKDKGTKIVITPMWGMEVLMSERPDDVTPLPDDAQVPGEEPLDDDDDTGEDDGQKPI

SEQ ID NO: 170781 - protein, 139 aa, Glycine max
  Coding DNA Sequence Number=SeqID_79096
MIGTLTILSIFIGAIVGQAKTPRTGLLTFAAAPLPTAAVANMAPARGDILLQLIYQRQNQVEVIAARGAVTLPARADDRPEHRAYLSHHRFPHTGPNLACIVTEKKLRYCSNNVSDVVADTKVERGTAAFRRAENVTSE

SEQ ID NO: 170782 - protein, 189 aa, Glycine max
  Coding DNA Sequence Number=SeqID_79097
MGEVEEVQEQMATMMEAMMSMKKIMEANAVTVAATSTVAKVNPMPSSGLNQMNHPTLNMVGKDLGSRDGPHDVQIQNKYTFPPYGSPPKEDANNFAPILIESQQPQTNHAHVSQTVEETHEIAHHNPANSEPCLGYATEGQAVGDIPLQNTLEGPQPHPLDSTMRKNPHAMAEMGKLDHLEERLRAIEG

SEQ ID NO: 170783 - protein, 124 aa, Glycine max
  Coding DNA Sequence Number=SeqID_79098
  Homolog annotation: Hit_ID=Q84VH5; Match level="QueryCoverage=62%, HitCoverage=11%, E-value=2e-23, Identity=76%"; Hit description =Envelope-like protein
MKIESPLSRHYKLFEGTHVPDIVSTSGKAAASGAVSKDALIAELKDTCKVLEATIKATTEKKMELERLIKRLIDSGIDDGEAAEEDGEAAEEEEEAAEEEEEAAEEEEDAAEDTESDDDSEATP

SEQ ID NO: 170784 - protein, 282 aa, Glycine max
  Coding DNA Sequence Number=SeqID_79099
  Gene Ontology: Mol. function=sequence-specific DNA binding; Cellular component=intracellular; Biological process=regulation of transcription, DNA-dependent
  Homolog annotation: Hit_ID=Q9I0Z4; Match level="QueryCoverage=78%, HitCoverage=87%, E-value=2e-37, Identity=40%"; Hit description =Probable transcriptional regulator
  Pfam annotation: Domain name=HTH_AraC; Domain location=176-221; Score= 12.5; E_value=0.1; Accession=PF00165.14; Description=Bacterial regulatory helix-turn-helix proteins, araC family
  Pfam annotation: Domain name=HTH_AraC; Domain location=224-270; Score= 17.9; E_value=0.021; Accession=PF00165.14; Description=Bacterial regulatory helix-turn-helix proteins, araC family
  Pfam module annotation: Pfam domain module=HTH_AraC::HTH_AraC; Domain location=176-221::224-270
MLIHPSDNLPFSGDPRKEELRQRLMRPDAPKVIAVSLSKELDRERRTHRHAAGQLFCLRQGLMTVNTSSGIFANPPRLVGWIPPWFDHALVGPGRVLGWTVLIDEALAAPLPDRPVLLSCPTVLEPLAERLAVLEPELWSSARYARLGQVFLDELYESTPQELTLPLPEEPRLRQIARLLMDDPADTRTGPELAQWAGLSARSLSRHWSSAVGMSLSKYRQVSRLLKSLEGLAAGHSVQQVAWQVGFDSVSSYISAFRAAFGSTPGKYFTTPADSANAASAG

SEQ ID NO: 170785 - protein, 63 aa, Glycine max
  Coding DNA Sequence Number=SeqID_79100
MARRTHDRRSPKITMNYIKRRSSVRHRIRKRDLRTTSPGWPRRVCQRSDEITVNTELLTGGAA

SEQ ID NO: 170786 - protein, 100 aa, Glycine max
  Coding DNA Sequence Number=SeqID_79101
MARTKKTGQMMSEAAKEIAEKIILWRSRRHRVRLSPMDGLAVPPETEVGPSATRVSTKGICVDPSSIDPDMGDSDKCGQVKVGVEEVKDVEALVPVPTDE

SEQ ID NO: 170787 - protein, 58 aa, Glycine max
  Coding DNA Sequence Number=SeqID_79102
DGYVAIADKLERLLNLRILTEGTEAYTVAKECPSIARSYIGQPTIGHRSRRRRRMDGH

SEQ ID NO: 170788 - protein, 58 aa, Glycine max
  Coding DNA Sequence Number=SeqID_79103
MGVQIATRPTWALQKIPPEGCCFWRKQPCSPGRAGNLAKFRPFFDVLHSFFIVLRSST

SEQ ID NO: 170789 - protein, 322 aa, Glycine max
  Coding DNA Sequence Number=SeqID_79104
  Homolog annotation: Hit_ID=Q2QQW5; Match level="QueryCoverage=47%, HitCoverage=13%, E-value=5e-07, Identity=26%"; Hit description =Transposon protein, putative, CACTA, En/Spm sub-class
MSTVASRWRQFKCNLTTRFVYGNSEGQHEHNPPVKYDVDKETWEQFAASRKTPNWQGIRKKMQEIQKYNDCPHVLSRGGYDLLEKKMMEEKMNKRQHDAMTTENTPNSADPPSPIQRHASLEEQTRQGTFVPHGREDILNTAIGRPDHGGRVRAAGFGVTISQYFGRAARGSSCSSGSISQVQMAEIIGGLQEQWKNEIQVLKDELKEQIILEMSQRGSLIPTHIQPDIHGLGARVSTKGSNAESVLNPCLPNDVAPVEPLMGLYVQHQDSIELVALGKTYDGGSTIHNVPYADDVVRVSVEQVIDGDAEVPFPTSEIKCVR

SEQ ID NO: 170790 - protein, 120 aa, Glycine max
  Coding DNA Sequence Number=SeqID_79105
  Gene Ontology: Mol. function=peptidase activity
  Homolog annotation: Hit_ID=Q8H6W2; Match level="QueryCoverage=51%, HitCoverage=68%, E-value=2e-10, Identity=47%"; Hit description=Gag -protease polyprotein-like protein
GLRFRGSLVVKQSEHKGRVVLVWFRTCKGFLQDSGTLKRVAWGLDVGTRGYHYWKTRMQIFIEALDLNIWEAIEVGPYVPTMVAGNATIEKPREEWTEDGRRLVQYNLKAKNHYFCPRNG

SEQ ID NO: 170791 - protein, 141 aa, Glycine max
  Coding DNA Sequence Number=SeqID_79106
MGKAEEVQEKMKADMEAMKEQTAPIMEAMMSMRKIMEANAVAVAATSAVAKVNSMPPSGLKQMNRPTSDMVGKDLGSMDDPTMCKFKTSTPSYHMACLPTIRHPMWHTLPMRMSITPLLYPLRANNPKLSCTCLLKRGGVT

SEQ ID NO: 170792 - protein, 72 aa, Glycine max
  Coding DNA Sequence Number=SeqID_79107
MMITKDDDKGDDKKLKDQSKNNSSESGTIQEFKIRIKKNSRLKKKVKSQESGLQCFGNRLPVPLNVEIQIQM

SEQ ID NO: 170793 - protein, 122 aa, Glycine max
  Coding DNA Sequence Number=SeqID_79108
MMITKDDDKGDDKKLKGQSKDEFKMFKKESRQFKIKAQEEKLKNTSRFKKKDEFKIQIQGSSFKNQDQDSRFKIQESREDLIKITHGVSQNMFTKEFLLSGNRLPDCCNRLPDCCNRLPVGK

SEQ ID NO: 170794 - protein, 100 aa, Glycine max
  Coding DNA Sequence Number=SeqID_79109
MEQYGELVMAVFFPLPYSNSLNIWSDKWFPNSLDNVIHWDQNPDIDVSQTVSDIIIPDSNQWGVEKMRGMFSESTCLKVCSIPLRRTRMCGNLLMMESTQ

SEQ ID NO: 170795 - protein, 139 aa, Glycine max
  Coding DNA Sequence Number=SeqID_79110
  Homolog annotation: Hit_ID=Q6UUU1; Match level="QueryCoverage=61%, HitCoverage=55%, E-value=7e-19, Identity=61%"; Hit description =Putative uncharacterized protein
MNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVWPRLSHSTPDTQFR

SEQ ID NO: 170796 - protein, 72 aa, Glycine max
  Coding DNA Sequence Number=SeqID_79111
  Subcellular localization annotation: CTP_CleavageSite=38; ConfidenceScore=5.23e-01
MGEIIVKYGVPQKAVAGLPSQPIPSLLLAVPPLSSACPANANSGTPYPAIVTGGSSFPSVSMTVPTSRNDPP

SEQ ID NO: 170797 - protein, 114 aa, Glycine max
  Coding DNA Sequence Number=SeqID_79112
MARGSVFVGKENSGCHFITECKKVAEKVWFSVLIQRKQEIEGYSKVCEINDGPSDARGTTEDGEYEDPRKEKDEDVCGPNARVREPLRVPVQIRRWHRLHVQVCHQSVPKIIPF

SEQ ID NO: 170798 - protein, 399 aa, Glycine max
  Coding DNA Sequence Number=SeqID_79113
  Gene Ontology: Mol. function=nucleic acid binding; Cellular component= nucleus
  Homolog annotation: Hit_ID=P92964; Match level="QueryCoverage=83%, HitCoverage=94%, E-value=4e-63, Identity=63%"; Hit description =Arginine/serine-rich-splicing factor RSP31
  Pfam annotation: Domain name=RRM_1; Domain location=217-281; Score =57.4; E_value=4.8e-14; Accession=PF00076.13; Description=RNA recognition motif. (a.k.a. RRM, RB
TLGFLSKEIVFVGIVIKGVDKGFGHCGFYAPFSVSCLLGKKKMRPIFAGNLEYDTRQSELERLFSKYGRIDRVDMKSGTSTKGKYAELLSWFANLSANFFWEGKLPACLLSFYSQICIFTSDHWSLTSSSPNIDISIRMLNNMPMSFIIISASNTSYVTGFAFVYYEDERDAEEAIRALDNVPFGHEKRRLSVEWARGERGRHRDGSKANQKPTKTLFVINFDPIRTRVRDIEKHFEPYGNVLHVRIRRNFAFVQFETQEDATKAIECTNMSKILDRVVSVEYALRDDGERGDNYDSPRRGGYERSPSPYHRRPSPDYGRPRSPVYDRYNGGGPDRRRSPDYGRHRSPDYGRRRSPDYGRRKSPDYGKPRSPEYAVRRCEVSANGSIGPEYETGNPVYC

SEQ ID NO: 170799 - protein, 61 aa, Glycine max
  Coding DNA Sequence Number=SeqID_79114
MDLVTTICSNKGKSQSQHIPEGAMRIEKPRFSKDNYNITFPEKLDPISQRLRLQYLKELKN

SEQ ID NO: 170800 - protein, 414 aa, Glycine max
  Coding DNA Sequence Number=SeqID_79115
DTSMIKHIRILPGGLAVLAAVFLCLLTACRDHSRDGMSGADINVYNHGPDAIVSMQVDGYGGPRANPYGGGGGFCCVMVPNDWRPGLTAKITWTSDPNSWMKSSEMPDDYETHYQKHGPITVPIERWEKGPGLADSAFLHPAWAAGLPESTLNALKALIAAFQTGATPVAVKTSTAEAASLPPKFPGPDDKNGEKSADNSVQQKAEYNERGRLPASRTQAEGNYARQYLEGYVGESEHQSDKKTEPGCPASLHISLFFDGTCCNEKGADEDTSMIKHIRILPGGLAALVAVFLCLLTACRDHSRDGMSGADIAVLNHGPDAIVSMQVNGYGGPGANPYGGGGGFCCVMVPDVWRPGLTAKITWTSDPNSWMKSSNMPDNYSQYYQRHGPITVPIERWEKGQGCGFDVHIFPCDK

SEQ ID NO: 170801 - protein, 38 aa, Glycine max
  Coding DNA Sequence Number=SeqID_79116
MARGLQEDWARDAGEGPRILMSLRVLSFFSHILLVLKL

SEQ ID NO: 170802 - protein, 79 aa, Glycine max
  Coding DNA Sequence Number=SeqID_79117
MAKMKGQKEEKPILIFTKKNGPNLGPWAQKSALRFIRTLGPSLVALAQSSWSLLVNTLGGRIASSHPPWKGFDLKSRGS

SEQ ID NO: 170803 - protein, 724 aa, Glycine max
  Coding DNA Sequence Number=SeqID_79118
VALAVEGAEADLARFGPLPGFGELDAGHLPQQFPAVRDVAVFDLVRAQHIHRGQHLVRAQLPLAVLVHIDLAEGANGAAASAATSVEVFMGGEGRAWLDAAKAGVERCLHRVAGGFPGLLPGAFEFARGDFVVLVEIQERHRLVGQQEAVVAVGMLVGPDHLGAVDFHLAHDLLAACFHQHVALAQARFGPVLVVLLCSGFRAGSCVVLCVGHCGGPGRRRGRKVRNGAIIARPCSTQVSASLGRRRQRHALRPQHPDVALLLHVTGQLAGGIAAAPVQVGAHFTGDGTAGVLRGHRAHHRAAVRARGGQPQQAAQRHHGAVHCHAVTGGERHVRMASIGDVFLLQLALVHQPATDGAVRVAILFCIGQPHLRAIAQSHPAGSLDLQQLQVHRISQPGQHRRLGALGRDGTGVVIGLEHLTLDAPAQALALQFRVEALQLHHHQIIRRAVHRHRSSGRAGEAAGIDRFVVAGNEPVGLVAAGTQCIDIQIALQELADRGRVLVRHRRGGGAGSGPDRIVLQAGAAAAPGNEAGLQIAVGDRRQCAPCDLGVGGRRRCDGRRHFGSGAGGGGGAAGEHGRCQQDAVLALEEGGGIDHAAMVECRPLGGNPARGQAFMRGVTASAATANAGCGRPRHPASSASRRGHGNGGGRRRRWLRGCPADSRSGPVHSTHRSLPAQHHPQRAARPRTRPRPAAARGRSGSDPACASVPGRRGRSPGAAGCST

SEQ ID NO: 170804 - protein, 251 aa, Glycine max
  Coding DNA Sequence Number=SeqID_79119
  Gene Ontology: Mol. function=kinase activity; Cellular component =cytoplasm
  Homolog annotation: Hit_ID=A1FU52; Match level="QueryCoverage=78%, HitCoverage=96%, E-value=1e-103, Identity=91%"; Hit description=YbhB and YbcL
  Pfam annotation: Domain name=PBP; Domain location=54-247; Score=33.4; E_value=2.7e-08; Accession=PF01161.11; Description=Phosphatidylethanol amine-binding protein
MAELLGRLFERQMPPAAQLGAPRFPPGHWRNYRDVMSAAFAKLTPIAVRLGYPEDLTNGAPIDREFAAGDAAGFAPDRNPHLAWNGAPEGTRSFLLVCVDPDVPTVPEMVGRSDMTVPRDQPRCDFVHWVMADIPASVQEIAAGSCSDAFVVKGKTAPAGPAGSRQGLNDFTGWFAGNPDMAGDYLGYDGPYPPFNDERVHRYFFRVFALDVASLELPARFTAADAYRAMHGHVLAEAALHGTYTLNPALG

SEQ ID NO: 170805 - protein, 108 aa, Glycine max
  Coding DNA Sequence Number=SeqID_79120
MRSDCLVQFSILYPFSKPHELRFCSCVLVATYPSAGGRRETHGMRVPRKEYARSRHQRLFEENVGKTGKDEIYELFSERFRSCIYARGRVFPFAPTYSSIWDEKIRPT

SEQ ID NO: 170806 - protein, 87 aa, Glycine max
  Coding DNA Sequence Number=SeqID_79121
MTTGSTMGKRQLWQSLSTRKLQSQLGRGIKWASISNLVGKHKIDLLCLQETKRDSIDRALCQALWGHSDFDWEWFPADNTAGGLLCV

SEQ ID NO: 170807 - protein, 146 aa, Glycine max
  Coding DNA Sequence Number=SeqID_79122
MQLPQEPLNKKPRGLARKSMVETNFMELCGAAIRLCEIETNMLTIVSKYQEELNLATTHKHKVADEYAQVYAEKEARGRVIDSLHQEATMWMDRFALTLNGSQEIPRLLAKAKAMMNTYSAPEEIHALLSYCQHMIDLMAHIIRNR

SEQ ID NO: 170808 - protein, 265 aa, Glycine max
  Coding DNA Sequence Number=SeqID_79123
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLTGLEPATSGFEVQRAIHCATRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 170809 - protein, 130 aa, Glycine max
  Coding DNA Sequence Number=SeqID_79124
MSWSSFVQCIEGLIRLTYFKVGGCDSEHYIYMILIFQCNAFKKLNTTADGKVPKTAPQWLELKTHVQRGGYECGYYVMHWMWNIIGAKLKSDWNVWFGDGSALDPEAITTLHKKWAAYFLKLRTIQCTKL

SEQ ID NO: 170810 - protein, 90 aa, Glycine max
  Coding DNA Sequence Number=SeqID_79125
MHVEDESSEATIPKPFVIREEAEETQVRQVATATPKRSLEATSEPSVEGEDIPSPQLAVDPSTLLLEMPEDRLHQSWLWTLLLQPLQYYI

SEQ ID NO: 170811 - protein, 56 aa, Glycine max
  Coding DNA Sequence Number=SeqID_79126
MGLKSTLRLMRTLGPSLASLAQTSWSLLSIVPGGVRSENPFPGHLPMREHGSSPTQ

SEQ ID NO: 170812 - protein, 82 aa, Glycine max
  Coding DNA Sequence Number=SeqID_79127
MVGSQPSSWYPTHRKMQGSCMSEHITRTMKIKCMQLQLSDTMHHQKGKTLDEASLLSNESETHHDHRLTSTPYGSHRLNYRA

SEQ ID NO: 170813 - protein, 102 aa, Glycine max
  Coding DNA Sequence Number=SeqID_79128
  Gene Ontology: Mol. function=transferase activity, transferring acyl groups; Biological process=metabolic process
  Homolog annotation: Hit_ID=Q798S0; Match level="QueryCoverage=58%, HitCoverage=33%, E-value=1e-15, Identity=67%"; Hit description =Streptothricin acetyltransferase
MAAAHVWARSVNAPGLRLETQNVNVSACLFYRNYGFTLGGYDRYLYNALPEKDEVALFWYYMLASAETPQHVVKQPAGGYRVQVGDVIVTSFTDGNCRAGSA

SEQ ID NO: 170814 - protein, 117 aa, Glycine max
  Coding DNA Sequence Number=SeqID_79129
  Gene Ontology: Biological process=transposition, DNA-mediated
  Homolog annotation: Hit_ID=Q1J7G7; Match level="QueryCoverage=28%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGCATVGEGAIGAGLLRYYAQLAKGGMCCKAIKLGNARVFPVTTL

SEQ ID NO: 170815 - protein, 99 aa, Glycine max
  Coding DNA Sequence Number=SeqID_79130
  Gene Ontology: Mol. function=tetracycline:hydrogen antiporter activity; Cellular component=integral to membrane; Biological process=response to antibiotic
  Homolog annotation: Hit_ID=Q47336; Match level="QueryCoverage=42%, HitCoverage=45%, E-value=4e-10, Identity=78%"; Hit description=LacZ -alpha peptide
MLPFDFRCVTETYGLCIKSFSCSPGDPLVLERPPPRWSSNSPYSESYYNSLAVVLQRRDWENPGVTQLNRLAAHPPFRQLGVIAKKARTDRPFPNSCAA

SEQ ID NO: 170816 - protein, 74 aa, Glycine max
  Coding DNA Sequence Number=SeqID_79131
MKGNQQRVESPTVATYPSAGGRRETRGMRVPRKEYARSRHQRLFEENVGKTGKDAIYELFSERFGSCIYARGRY

SEQ ID NO: 170817 - protein, 137 aa, Glycine max
  Coding DNA Sequence Number=SeqID_79132
  Homolog annotation: Hit_ID=Q6L477; Match level="QueryCoverage=45%, HitCoverage=10%, E-value=3e-08, Identity=33%"; Hit description =Putative uncharacterized protein OSJNBa0009L15.8
  Subcellular localization annotation: CTP_CleavageSite=55; ConfidenceScore=5.71e-01
MATPPASPPPPVPLPPPPADASVSLFTLKRTRKATQLRSLATRPPGAKRPMVNVDSATGKVDGPHKKKLRTYLVIVARDKVDVTYDTWKEVPTGQKDLIWKDIQAEFEIPEASDSKTKKKILQTVDEHWRQFKSDLT

SEQ ID NO: 170818 - protein, 61 aa, Glycine max
  Coding DNA Sequence Number=SeqID_79133
  Pfam annotation: Domain name=G-patch; Domain location=2-43; Score =19.3; E_value=0.00089; Accession=PF01585.14; Description=G-patch domain
MMVARVMLGYGYEPEMGFGMNNDGRTSLVSTRGNRGKFGLGYKPTQADIRKSIAERKSRGQ

SEQ ID NO: 170819 - protein, 194 aa, Glycine max
  Coding DNA Sequence Number=SeqID_79134
  Homolog annotation: Hit_ID=A9R5L4; Match level="QueryCoverage=45%, HitCoverage=90%, E-value=1e-08, Identity=38%"; Hit description =Conserved domain protein
MANLTLSLAPSLRDKPMKTSELDNLIVVYFGQDYDLINAEGDITALIAEYIRLATHQQREALVNEIDELLAQDNVESLFNQRFGFTFSPELWGTTVPAFLQQARSAADYDLFTDAETAEGVIDGFLEQNGSQVIRDILEEAKKFQATYAGRINEGMAEHFSDEFVPESWGTTAVGVFAILQRKTEQKLEQLKRI

SEQ ID NO: 170820 - protein, 709 aa, Glycine max
  Coding DNA Sequence Number=SeqID_79135
  Gene Ontology: Cellular component=membrane
  Homolog annotation: Hit_ID=A7P771; Match level="QueryCoverage=96%, HitCoverage=98%, E-value=0.0, Identity=56%"; Hit description =Chromosome chr9 scaffold_7, whole genome shotgun sequence
MESSRRAVESYWRWRLIDSATSDEDKVTPVYKLEEICQLLLSSHATIVKELSEFILKRLDHKNPIVKHKALRLIKYAVGKCGVEFRREMQRHSVAIRQLLHYKGPSDPLKGDALNKAVRDTAQEAISAIFSADDNKNPPPSAPPAASDLNRRIEGFGNTNFQAPSHDKKSFLSEVVDIGSATIKQGLSAFTQGHSSLIKNEAGTGTYKGPNNLHASFTAETERGDRYEPVAYRGGMQGASGLSRNHSGGPLNRDTSVTRIEMSIAKSDASYAESKTQEDRLLETVASSGGVRLQPTRDAIQVFLREAAKLDAMALCHAIERKLQSPMWQASVCVLESIVRKKDDDDHFSRMASYFAENNDLVLRCSESPQASLREKANKVRGLLGGNQLNSAINSEKAVKTDSAAVAELPDLIDTGDLNDYHGTDDTTKSKNDQNIAHLTPSTPPALADDLFGNFMNSGVASNELKNDDDPFADVSFHSNDNKEPADIFSSMTAGDDKLGHHVSHGLGNRTEPENDDLLAGLSIDENTSSTKQKVTSPAMQSESSFSGLNNHVSHLGPENGLGGMLGTQAVGFDVNSIFPSGHPPCTVQPGIMLNQSYSSQPLNYGAMGNLLAQQQLLATMANFQHLNNVNKNDGGTAQNAGSNGKTPLPDIFQSKFSTQAPSSMINSSKKEETKAFDFISVSLGVNHLFTIQRFTLSIVMICNDLSAL

SEQ ID NO: 170821 - protein, 1422 aa, Glycine max
  Coding DNA Sequence Number=SeqID_79136
  Gene Ontology: Mol. function=cadmium ion transmembrane transporter activity; Cellular component=integral to membrane; Biological process=defense response to fungus, incompatible interaction
  Homolog annotation: Hit_ID=Q9XIE2; Match level="QueryCoverage=100%, HitCoverage=97%, E-value=0.0, Identity=65%"; Hit description =Pleiotropic drug resistance protein 8
  Pfam annotation: Domain name=ABC2_membrane; Domain location=1146 -1360; Score=254.9; E_value=1.7e-73; Accession=PF01061.15; Description=ABC-2 type transporter
  Pfam annotation: Domain name=ABC2_membrane; Domain location=498-716; Score=151.9; E_value=1.8e-42; Accession=PF01061.15; Description=ABC -2 type transporter
  Pfam annotation: Domain name=ABC_tran; Domain location=173-396; Score= 44.9; E_value=1.5e-10; Accession=PF00005.18; Description=ABC transporter
  Pfam annotation: Domain name=ABC_tran; Domain location=866-1049; Score=106.1; E_value=1.1e-28; Accession=PF00005.18; Description=ABC transporter
  Pfam annotation: Domain name=PDR_assoc; Domain location=680-742; Score=95.0; E_value=2.4e-25; Accession=PF08370.2; Description=Plant PDR ABC transporter associated
  Pfam module annotation: Pfam domain module=ABC2_membrane::ABC2 _membrane::ABC_tran::ABC_tran::PDR_assoc; Domain location=1146 -1360::498-716::173-396::866-1049::680-742
MEGVFASGRYSRRTSNVDEDEEALKWAAIERLPTYDRLRTSILQTFVEAGHDHADARPSTLQHREVDVRKLDVNERQEFIDRIFKVAEEDNEKYLRKFRNRLDKVGIRLPTVEVRYQNLTVEADCYIGSRALPTLPNVALNIAESALGLCGISTAKRTKLTILKNVSGIIKPSRMALLLGPPSSGKTTLLLALAGKLDNDLRVNGEISYNGHKPNEFVPRKTSAYISQNDVHIGEMTVKETLDFSARCQGVGTRYDLLAELARREKEAGIFPEAELDLFMKATAMEGTESSLITAYTLKILGLDICKDTIVGDEMQRGVSGGQKKRVTTGEMIVGPTKTLFMDEISTGLDSSTTYQIVKCFQQIVHLTEATIFMSLLQPAPETFDLFDDIILISEGQIVYQGPRDHIVEFFESCGFKCPERKGTADFLQEVTSRKDQEQYWANRSLSYRYVTVSEFANRFKQFHVGIKLENELSVPFDKSRGHRAALVFKKYTVPTMGLLKACWDKEWLLIKRNAFVYVFKTGQIVIIGIIAATVFFRANMHQRNEADAAVYIGSILFTMIMNMFNGFAELPLTIARLPIFYKHRDHLFHPPWTYTLPNFILRIPITMFEAIVWVLITYYTIGLAPEASRFFKHLLLVFLVQQMAAGMFRFISGVSRTMIIANTGGSLMLLLVFLLGGFILPKNGRTPIGIATLNNFDVFTEKRWYWIGAATLLGFIILYNVLFTFALMYLNPIGKKQAIVSEEEASEMEAEGDFRKDPRLLKPEPNREIALQSLSSTDGNNTREVAMQQMSNRGNPSGIRSVDSMHESATGVAPKRGMVLPFQPLAMSFDSVNYYVDMPAEMKGQGVTDDRLQLLREVTGAFRPGVLTALMGVSGAGKTTLMDVLAGRKTGGYIEGDVRISGFPKNQETFARISGYCEQTDIHSPQVTVRESLIYSAFLRLPIEKFVDEVMELVELNNLKDAIVGLPGVTGLSTEQRKRLTIAVELVANPSIIFMDEPTSGLDARAAAIVMRTVRNTVDTGRTVVCTIHQPSIDIFEAFDELLLMKRGGQVIYSGPLGRNSLRIIEYFEAIPGVPKIKDKYNPATWMLEVSSIAAEVRLRMDFAEHYKSSSLYQRNKALIRELSTSPPGVKDLYFPTQYSQSTWEQFKSCLWKQRLTYWRSPDYNLVRFFFTLAAAFLVGTVFWRVGKNRGNSGDLTTIIGALYGSVFFVGVNNCQTVQPVVAVERTVFYRERAAGMYSALPYAIAQVISEIPYLFVQTICFSFIVYAMVSFEWKVAKVLWFFFVSFFSFMYFTYYGMMTVSITPNHQVASILGAAFYGIFNLFSGFFIPRPKIPKWWVWYYWICPVAWTVYGLIVSQYGDVEIEISVPSANNQTIKHYIEEHYGFKPDFMGPVAAVLVAFPVFFAFVFAFAIKTLNFQTR

SEQ ID NO: 170822 - protein, 288 aa, Glycine max
  Coding DNA Sequence Number=SeqID_79137
  Homolog annotation: Hit_ID=Q9LU25; Match level="QueryCoverage=100%, HitCoverage=63%, E-value=1e-154, Identity=84%"; Hit description =Arabidopsis thaliana genomic DNA, chromosome 3, P1 clone: MYA6
MYGMGFDHSFGLWFIARWLEPDLMIESGAFKGHSTWVLRQAMPDTPIISLSPRHPEKYLKKGPAYVDGNCTYYAGKDFVDFGSVDWPNVMKKHGISDLNRVLIFFDDHQNELKRIEQALKAGFRHLVFEDNYDTGTGDHYSLRQICDQSYIRGGGHSCFKDSDEARIRSRRKKFWEKAVDIEELCGPNEAWWGVRGYMRDNFNHSNEPISYAQHFQNSRYIESILDVYWELPPVAGPSLTHQTRYDPARAPSPIVEDGRYGLFRRLGLANLDNSVFNGYTQMAYLQIS

SEQ ID NO: 170823 - protein, 376 aa, Glycine max
  Coding DNA Sequence Number=SeqID_79138
  Gene Ontology: Mol. function=ATP-dependent peptidase activity; Cellular component=integral to membrane; Biological process=ATP -dependent proteolysis
  Homolog annotation: Hit_ID=A5BLD5; Match level="QueryCoverage=58%, HitCoverage=60%, E-value=3e-55, Identity=49%"; Hit description =Putative uncharacterized protein
  Pfam annotation: Domain name=DUF81; Domain location=80-368; Score =24.7; E_value=4.8e-07; Accession=PF01925.10; Description=Domain of unknown function DUF81
  Pfam annotation: Domain name=Voltage_CLC; Domain location=46-342; Score=-165.3; E_value=0.0089; Accession=PF00654.11; Description =Voltage gated chloride channel
  Pfam module annotation: Pfam domain module=DUF81::Voltage_CLC; Domain location=80-368::46-342
MAVKGSPQRWDMRLVLTITLLLISVSVSALQHVSHKNINPTTVETTQTSFLGKVVNFLWSSSGSGYQHTWPDIEFGWRIITGTIIGFLGSAFGTVGGVGGGGIFVTMLSLIIGFDAKSATAISKCMITGGAAATVFYNLKQKHPTLDMPVIDYDLALLFQPVLVLGISIGVAFNGSVLENVRWKALGVLFTVWVLILASEIAKSHTTTCSVEYWILNLLQVPVALGATSYQAVLLYTGKRVIASKGDQRTQWRAHQLVLYCSCGICAGIVGGLLGLGGGFILGPLFLELGIPPQVSSATATFAMTFSASMSVVEYYLLKRFPIPYTLYFVAVSTFAAFVGQVLVRKLVAILGRASLIIFILSGTIFVSAISLGKCH

SEQ ID NO: 170824 - protein, 116 aa, Glycine max
  Coding DNA Sequence Number=SeqID_79139
MGVATCTQHYCWGTQQTVKWPNCPSTILLPEEVFPETFRKSLFRKVYGNTSSGKRIWEFRKYSRTSSGRSSGNCCRKTHPEDRLPEVSAAYSGSTSGTTSSGIGRSNFRKKVFRKC

SEQ ID NO: 170825 - protein, 270 aa, Glycine max
  Coding DNA Sequence Number=SeqID_79140
  Homolog annotation: Hit_ID=Q6WAY6; Match level="QueryCoverage=94%, HitCoverage=42%, E-value=9e-17, Identity=30%"; Hit description =Putative uncharacterized protein
AIDTFLAYHDRKESPVVAILADLYDTFDRRCEKSSARIVCCTPAFYVWLVSHLCRQEVRHPCPLESHRSCTEKRGANWDQLLASKEGASVNWFPHWKEGRIGVFIPCAGFPNVPLIGTRGCISYNPVLVISQLGYPMRGAPLEEELMPIIARGFNKTNVEALQKVHKAWEMVQKKDKELRGSNNGPIGNYRDEEVQALRAELEQAQSVKERFKSTTLKIQKENAELRDVNKATTKALERKTKRARRRNTEGLYGAVTASLSSGERKRTIT

SEQ ID NO: 170826 - protein, 94 aa, Glycine max
  Coding DNA Sequence Number=SeqID_79141
MDGEELPSPVNSDVAACSLSLCVFWISPRDFPSAVSLVTIFQRNERGFEALVLTLVSNLALICDHLSPSAQFIGCPKRLIKIEPKPTFANICCV

SEQ ID NO: 170827 - protein, 137 aa, Glycine max
  Coding DNA Sequence Number=SeqID_79142
ALGFPALITGLCQSFGVPVVPSKAADAPPPHQAGPAGSFDTEQYLRHLVRQQAANHRAHVQTHDCLYQLSLSLQSQGFTSFPCPTPDQFRAEVAWPGDWPKAWAGEAPAEAPDEADEAREDEEMTDLLDFLGGSGAT

SEQ ID NO: 170828 - protein, 51 aa, Glycine max
  Coding DNA Sequence Number=SeqID_79143
MERNLKCINKLILMPSILLMSINMIFLLLKCYLPVMMFYIGFDLLLMILVL

SEQ ID NO: 170829 - protein, 127 aa, Glycine max
  Coding DNA Sequence Number=SeqID_79144
LCQSFGVPVAPSKATDALPPHQDGPVGSFDTKQYLRHLVRQQAANHRAHVQTHDCLYQLSLSLQSQGFTSFPCPTPDQFRAEVAWPGDWPEARVGEAPVEAPDEADEAREDEEMTDLLDFLGGSGAT

SEQ ID NO: 170830 - protein, 392 aa, Glycine max
  Coding DNA Sequence Number=SeqID_79145
MAPRKLASKRSRKDKAAEGTSSAPEYDSHRFRSAVHQQRFEAIKGWSFLRERRVQLRDDEYTDFQEEIGRRRWASLVTPMAKFDPEIILEFYANAWPTEEGVRDMRSWVRGQWIPFDADAIGQLLGYPLVLEEGQECEYDQRRNRSDGFDEEAIAQLLCIPGQDFARTAAGRRVRIMRTNMTTLTQIWMTLLLSNILPTDHNSDLPMPKCQLVWRPLGTLWTQISPTRALGFPALITGLCQSFGVPVAPTKVIRPPNHPGFIEKYCTQRQGQGDAPQAAGAPPPPHQAGQAGAFGIEQYLRHLVRQQAANHRAHVRTHDCLYQMSLSMQSQGFASFSCPTPDQFRAEVAWPGDWPEAQAGEAPPEAPGDGEEAHEDEEMADLLDFLGGSGDT

SEQ ID NO: 170831 - protein, 113 aa, Glycine max
  Coding DNA Sequence Number=SeqID_79146
MHAKARVMSEIEEVQEQMKAYMKVMKEQITTMMEAMMSMRKIMEVNMATVVAASTANNDKKLKSQDHFMITKMMTFKNEFKIEFKIESRTLQGSRGNLISRFKIQDSRFKIHE

SEQ ID NO: 170832 - protein, 315 aa, Glycine max
  Coding DNA Sequence Number=SeqID_79147
  Homolog annotation: Hit_ID=UPI00016621D1; Match level="QueryCoverage =95%, HitCoverage=40%, E-value=1e-22, Identity=34%"; Hit description =UPI00016621D1 related cluster
  Pfam annotation: Domain name=Leu_leader; Domain location=114-137; Score=4.9; E_value=3.4; Accession=PF08054.2; Description=Leucine operon leader peptide
  Pfam annotation: Domain name=Leu_leader; Domain location=234-257; Score=2.5; E_value=8.7; Accession=PF08054.2; Description=Leucine operon leader peptide
  Pfam annotation: Domain name=Leu_leader; Domain location=81-105; Score=7.5; E_value=1.2; Accession=PF08054.2; Description=Leucine operon leader peptide
  Pfam module annotation: Pfam domain module=Leu_leader::Leu _leader::Leu_leader; Domain location=114-137::234-257::81-105
GLHALTFRGLDVLDFRGLDVLAFRGLHVLTFRGLHVPTFRELDVLTFRGLHVLAFRGRHAPTIRGPHALTFRGLYVLTFRVLHALAFRGLLVLAFRGLLVLAIRGLHVLTFRGLHVLTFRGLDAFTFRGLEVLAFRGMHALGFRGLDVLAFRGLHAFAFRGLDVLVFRGLDVLAFKGLHVFTFRVLYVLTFRGLDVLAFRGLHALAFKGLRAPTFRGLRALTFRGLHVLTFRGLHVLTFRGLHALAFRGLHVLAIRGQHVLAFRGLHILTFIGLHVLTFRELLVLTFRGLRALTFKGLHVLALRGLHAFTFKGRY

SEQ ID NO: 170833 - protein, 70 aa, Glycine max
  Coding DNA Sequence Number=SeqID_79148
MGIHKGVTSFGVHCKKWNLLLGIITEHKGERSFGVHCNRWDCLLVLSLNTKDEGVGSSGLGIIKKGGGVN

SEQ ID NO: 170834 - protein, 71 aa, Glycine max
  Coding DNA Sequence Number=SeqID_79149
  Homolog annotation: Hit_ID=Q53JE1; Match level="QueryCoverage=59%, HitCoverage=4%, E-value=2e-07, Identity=59%"; Hit description =Transposon protein, putative, CACTA, En/Spm sub-class
MEKEKLVGILESHHDEKVGDIIFDDHNASETLRKLVGGPKRNFITWQGYDINKYSFYTKSKDDKSTMQNNC

SEQ ID NO: 170835 - protein, 68 aa, Glycine max
  Coding DNA Sequence Number=SeqID_79150
MMQSYPARALDERLQVCWARDPREGPRVLMSLKEGWSLSIPSLDRENNLAIRELPKEVISRNLLKEAT

SEQ ID NO: 170836 - protein, 89 aa, Glycine max
  Coding DNA Sequence Number=SeqID_79151
MKMKANKTRKELKVSDSNTYRLKNEEGTKNDEEHRKSFTDLLMETSRKRYESTSTRFFFTKTNFTEAMKAPKTIFQQNVEELAAQLLPP

SEQ ID NO: 170837 - protein, 41 aa, Glycine max
  Coding DNA Sequence Number=SeqID_79152
MDKSLKVGEMSGRGREGGHKIYASNEPTNLRSSIRFSTECA

SEQ ID NO: 170838 - protein, 271 aa, Glycine max
  Coding DNA Sequence Number=SeqID_79153
  Homolog annotation: Hit_ID=UPI00006A2D9E; Match level="QueryCoverage =70%, HitCoverage=93%, E-value=7e-11, Identity=14%"; Hit description =UPI00006A2D9E related cluster
  Subcellular localization annotation: CTP_CleavageSite=6; ConfidenceScore=5.46e-01
RAPCPRLQRARRPRHQRTTCPHLQRATRPHLQKTTRPRLQRATRPHKQRTTRPSLQRTTRPFLQRVARPRLQRTTCPPLRGLYVLTFQGLHVLAFRGLHALFFKGLYAFAFRGLHALHFRGLQVLVLRGLHALAFRGQHSLAFRGLHVLTFRGLLALPFRGLHVLASIGLHALTIRGPHGLVFRGLHVLTLRGLPFLSFRGLHALALRGLHVLTFNGLHALPFGGQHVLTFRGPHALPFTGLHVLASIGLHTLTIRGLHVLTIQRTTHPRL

SEQ ID NO: 170839 - protein, 256 aa, Glycine max
  Coding DNA Sequence Number=SeqID_79154
MIYAIKNLRIPKYLDLEWFSQQGSNFPNLLEAQGMSKLVQMKGTFYPELVKVFYTCARADLEGNLFSTVNGVEMVIDAEVWKEVVGLDMGGVCKFDETTNGYSKMQASRGVLLDPARNLRNCQGVGVLTVEDRMLVYLITYILTLRSSIKMNWVLLIEDIKLKSHRLVDYEFSYVVLASRFIDYFNVSNEIVDFTKASGQITERHLKKLVMRFVDHEWIVAGDPAVGNLEQMEEDAKAEAPQESAHQWSPFESPMI

SEQ ID NO: 170840 - protein, 70 aa, Glycine max
  Coding DNA Sequence Number=SeqID_79155
YALSMGWRSLTRTLSLRILGFLPAALPAFPELGMGRRSIDHRPSLYSPKAGRVQFQLSAWGIPWTERKGS

SEQ ID NO: 170841 - protein, 430 aa, Glycine max
  Coding DNA Sequence Number=SeqID_79156
  Gene Ontology: Mol. function=glycerophosphodiester phosphodiesterase activity; Biological process=glycerol metabolic process
  Homolog annotation: Hit_ID=A7Q7U8; Match level="QueryCoverage=43%, HitCoverage=57%, E-value=2e-53, Identity=56%"; Hit description =Chromosome chr18 scaffold_61, whole genome shotgun sequence
  Pfam annotation: Domain name=GDPD; Domain location=64-294; Score= -29.2; E_value=0.0011; Accession=PF03009.8; Description =Glycerophosphoryl diester phosphodiesterase family
MQQSSRSRKAALRVRVPSRKLMILSLAIFAILPPIFFHFRLRRLQQLQLTKCRWLNDPPLVCAHGGDSSKASPNTMASYFHALQSRVDCIEIDVSRSSDGVLFALHDRDLQRLNGNTSSKVGYMNSEEIRKLSASHQSTSKFTDESILTIQDALMLTANSVRQIVLDVKVGPPFYEKKLAKDVLSIVSIILPFLTVHLLPSERAINTPGLRNVFVLKDSCESRLSGVGRSGSALPPLGVHSRSATWRVINGWVMEDSGPCIYEGGSHGKLDESWLSLVKQACKQLCQFTFLLDTVHGNIEIAWNLIGNEQRTDDSVGVSTMPIHLRRKKWQCDGGHLAEWCCEHHNPQWREGCVHTKPARIGAENLEGMWLGLHILGLLTNEALSYKSLNILGYSRPKKDEANLAKVALVPECPPSTELWKAFMRVSLMD

SEQ ID NO: 170842 - protein, 89 aa, Glycine max
  Coding DNA Sequence Number=SeqID_79157
  Homolog annotation: Hit_ID=A5AKI3; Match level="QueryCoverage=39%, HitCoverage=13%, E-value=2e-07, Identity=74%"; Hit description =Putative uncharacterized protein
MKIEIPSFNSLAEIALCQGKNVQKVFDPVTKNVRCTRDKSVIKEGHKSFPSGHTSRKYLEQTLRFMNVMSQGCGRSCSLRRGSKLIKEG

SEQ ID NO: 170843 - protein, 43 aa, Glycine max
  Coding DNA Sequence Number=SeqID_79158
MIMSKFDYRSISKAQVEKVKKAKAKKIHAEKDKGSKKKIPKMT

SEQ ID NO: 170844 - protein, 101 aa, Glycine max
  Coding DNA Sequence Number=SeqID_79159
  Gene Ontology: Mol. function=transcription regulator activity; Cellular component=nucleus; Biological process=regulation of transcription
  Homolog annotation: Hit_ID=A7QWE9; Match level="QueryCoverage=48%, HitCoverage=9%, E-value=1e-14, Identity=70%"; Hit description =Chromosome undetermined scaffold_203, whole genome shotgun sequence
MVECPNISNFSWNYFIFWQLSQSKSSDWVLGWGDGCCKEPSEEEGALSRTERGRKERSKEVKSYFSPLSRKSKYTGKKSSYGKRYKPSYGERFQDPVVSYN

SEQ ID NO: 170845 - protein, 78 aa, Glycine max
  Coding DNA Sequence Number=SeqID_79160
MAPPKEIATVIYHNGHIVDDLVQRSGQTRYISAQLLDNDDLRAKCYAIMDLIPQPRPSPPQPSCPQLQLLPPQQITVP

SEQ ID NO: 170846 - protein, 127 aa, Glycine max
  Coding DNA Sequence Number=SeqID_79161
  Gene Ontology: Mol. function=phosphoprotein phosphatase activity
  Homolog annotation: Hit_ID=A5B3Q0; Match level="QueryCoverage=42%, HitCoverage=3%, E-value=3e-09, Identity=51%"; Hit description =Putative uncharacterized protein
  Pfam annotation: Domain name=DUF1723; Domain location=2-36; Score =25.3; E_value=0.00023; Accession=PF08330.1; Description=Protein of unknown function (DUF1723)
MPEIHTFHLPWGKCTIILEDVALHLGIRVDGRVVTEPNFLHWDKLCDKLLGEVPPKNARKKAALKNQQYTNNNAENYVGHHMRLVKLWVIVPYYCSHELGTACLLLHQESHDLKQLIHWLKDEVVVD

SEQ ID NO: 170847 - protein, 103 aa, Glycine max
  Coding DNA Sequence Number=SeqID_79162
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=A7PQ72; Match level="QueryCoverage=90%, HitCoverage=23%, E-value=2e-41, Identity=83%"; Hit description =Chromosome chr18 scaffold_24, whole genome shotgun sequence
  Pfam annotation: Domain name=2-Hacid_dh_C; Domain location=1-69; Score=-52.7; E_value=8.2e-06; Accession=PF02826.10; Description=D -isomer specific 2-hydroxyacid dehydr
MAMDPDIFAHGGLLVNVARGGLVDYEAVINHLESGHLGGLGTDVAWTEPFNPDDQIFKFKNVIMTPHVAGVTEHSYRSMAKAVGDVVLQLHAGLPLTGIELVN

SEQ ID NO: 170848 - protein, 194 aa, Glycine max
  Coding DNA Sequence Number=SeqID_79163
  Gene Ontology: Mol. function=intramolecular transferase activity, phosphotransferases; Biological process=glycolysis
  Homolog annotation: Hit_ID=Q2QPB6; Match level="QueryCoverage=47%, HitCoverage=21%, E-value=5e-35, Identity=79%"; Hit description =Metalloenzyme superfamily protein, expressed
MWKELQIKVAELPKAKPQKRKLHQGRGGNYYQAAPTSRYATEHRCGVVVKGPNLSGNISGTEPLKDNHILLKAEALDDSHEPSNIAVVVNELSKEITKNLVSHPVNAKCTAEGKSIANVVLLRGCGIQIERITEGQNKVTLNKFSCIALAGMSTEYLIYGFFKGGLDDIRKVATIPRERKNQEKEIGEEDNKLQ

SEQ ID NO: 170849 - protein, 367 aa, Glycine max
  Coding DNA Sequence Number=SeqID_79164
  Gene Ontology: Biological process=ubiquitin cycle
  Homolog annotation: Hit_ID=A7NV34; Match level="QueryCoverage=100%, HitCoverage=93%, E-value=1e-142, Identity=58%"; Hit description =Chromosome chr18 scaffold_1, whole genome shotgun sequence
  Pfam annotation: Domain name=F-box; Domain location=11-58; Score =44.7; E_value=3.3e-10; Accession=PF00646.24; Description=F-box domain
  Pfam annotation: Domain name=Kelch_1; Domain location=100-158; Score =55.5; E_value=1.8e-13; Accession=PF01344.16; Description=Kelch motif
  Pfam annotation: Domain name=Kelch_2; Domain location=100-158; Score =21.7; E_value=0.0028; Accession=PF07646.6; Description=Kelch motif
  Pfam annotation: Domain name=Kelch_2; Domain location=186-221; Score =0.2; E_value=43; Accession=PF07646.6; Description=Kelch motif
  Pfam module annotation: Pfam domain module=F-box::Kelch_1::Kelch _2::Kelch_2; Domain location=11-58::100-158::100-158::186-221
MSPTVDEESPTLIPNLPDELSLQIIARLPRICYFNVRLVSKRWKSTIMSSELYKLRKELGTTEEWLYLLIKVGENNLLWHALDPHSKTWQRVPNAFDEMPFCGCAIGAVDGCLYVLGGFSKTSTMRWVSQGQAGLVPLQSAEVFDPSTDTWSHVPSMPFSGAPVLPSAFLADMPKPVATGLSSYMGRLCVPQSLFSWIFVNVGGQIYDPETNSWIEMPAGMGEGWHVRQAGTKLSVVVDGELYAFDPSNFVDGGRIKVYDQGEDAWKVVIGKVPIYDSSDSESPYLLAGFHGKLHVITKDANHDIAVLQAGLRDNLDSSPSLSTLSPSTSQESPEVAAESEAATVWRIVANRDFGQAELVSCQVIDI

SEQ ID NO: 170850 - protein, 1800 aa, Glycine max
  Coding DNA Sequence Number=SeqID_79165
  Gene Ontology: Mol. function=protein transporter activity; Cellular component=Golgi membrane; Biological process=vesicle fusion with Golgi apparatus
  Homolog annotation: Hit_ID=A7NV36; Match level="QueryCoverage=99%, HitCoverage=89%, E-value=0.0, Identity=40%"; Hit description =Chromosome chr18 scaffold_1, whole genome shotgun sequence
  Pfam annotation: Domain name=Filament; Domain location=887-1148; Score=-189.8; E_value=0.048; Accession=PF00038.12; Description =Intermediate filament protein
  Pfam annotation: Domain name=KID; Domain location=1013-1023; Score =4.9; E_value=46; Accession=PF00038.12; Description=KID repeat
  Pfam annotation: Domain name=KID; Domain location=1079-1089; Score =0.4; E_value=4e+02; Accession=PF00038.12; Description=KID repeat
  Pfam annotation: Domain name=KID; Domain location=1222-1232; Score =3.0; E_value=1.2e+02; Accession=PF00038.12; Description=KID repeat
  Pfam annotation: Domain name=KID; Domain location=1478-1488; Score =4.7; E_value=50; Accession=PF00038.12; Description=KID repeat
  Pfam annotation: Domain name=KID; Domain location=1632-1642; Score =1.5; E_value=2.4e+02; Accession=PF00038.12; Description=KID repeat
  Pfam annotation: Domain name=KID; Domain location=947-957; Score=4.7; E_value=50; Accession=PF00038.12; Description=KID repeat
  Pfam annotation: Domain name=M; Domain location=1033-1053; Score=8.5; E_value=9.8; Accession=PF02370.7; Description=M protein repeat
  Pfam annotation: Domain name=M; Domain location=1057-1077; Score=4.8; E_value=31; Accession=PF02370.7; Description=M protein repeat
  Pfam annotation: Domain name=M; Domain location=1099-1119; Score=4.4; E_value=34; Accession=PF02370.7; Description=M protein repeat
  Pfam annotation: Domain name=M; Domain location=1519-1539; Score=8.7; E_value=9.2; Accession=PF02370.7; Description=M protein repeat
  Pfam annotation: Domain name=M; Domain location=643-663; Score=8.1; E_ value=11; Accession=PF02370.7; Description=M protein repeat
  Pfam annotation: Domain name=M; Domain location=887-907; Score=3.0; E_ value=52; Accession=PF02370.7; Description=M protein repeat
  Pfam annotation: Domain name=M; Domain location=925-945; Score=6.0; E_ value=21; Accession=PF02370.7; Description=M protein repeat
  Pfam annotation: Domain name=M; Domain location=967-987; Score=8.7; E_ value=9.3; Accession=PF02370.7; Description=M protein repeat
  Pfam annotation: Domain name=M; Domain location=991-1011; Score=0.0; E_value=1.3e+02; Accession=PF02370.7; Description=M protein repeat
  Pfam annotation: Domain name=Myosin_tail_1; Domain location=700-1568; Score=-522.4; E_value=0.077; Accession=PF01576.10; Description=Myosin tail
  Pfam annotation: Domain name=Pox_A_type_inc; Domain location=1012 -1034; Score=4.9; E_value=17; Accession=PF04508.3; Description=Viral A-type inclusion protein repeat
  Pfam annotation: Domain name=Pox_A_type_inc; Domain location=1047 -1072; Score=0.1; E_value=82; Accession=PF04508.3; Description=Viral A-type inclusion protein repeat
  Pfam annotation: Domain name=Pox_A_type_inc; Domain location=1140 -1166; Score=0.5; E_value=71; Accession=PF04508.3; Description=Viral A-type inclusion protein repeat
  Pfam annotation: Domain name=Pox_A_type_inc; Domain location=1353 -1375; Score=2.7; E_value=35; Accession=PF04508.3; Description=Viral A-type inclusion protein repeat
  Pfam annotation: Domain name=Pox_A_type_inc; Domain location=1473 -1492; Score=0.2; E_value=79; Accession=PF04508.3; Description=Viral A-type inclusion protein repeat
  Pfam annotation: Domain name=Pox_A_type_inc; Domain location=1624 -1646; Score=4.3; E_value=20; Accession=PF04508.3; Description=Viral A-type inclusion protein repeat
  Pfam annotation: Domain name=Pox_A_type_inc; Domain location=350-372; Score=1.1; E_value=58; Accession=PF04508.3; Description=Viral A-type inclusion protein repeat
  Pfam annotation: Domain name=Pox_A_type_inc; Domain location=587-609; Score=1.1; E_value=58; Accession=PF04508.3; Description=Viral A-type inclusion protein repeat
  Pfam annotation: Domain name=Pox_A_type_inc; Domain location=946-968; Score=5.9; E_value=12; Accession=PF04508.3; Description=Viral A-type inclusion protein repeat
  Pfam module annotation: Pfam domain module=Filament::KID::KID::KID::KI D::KID::KID::M::M::M::M::M::M::M::M::M::Myosin_tail_1::Pox_A_type _inc::Pox_A_type_inc::Pox_A_type_inc::Pox_A_type_inc::Pox_A_type _inc::Pox_A_type_inc:...
  Pfam module annotation: Pfam domain module=:Pox_A_type_inc::Pox_A _type_inc::Pox_A_type_inc; Domain location=887-1148::1013-1023::1079 -1089::1222-1232::1478-1488::1632-1642::947-957::1033-1053::1057 -1077::1099-1119::...
  Pfam module annotation: Domain location=1519-1539::643-663::887 -907::925-945::967-987::991-1011::700-1568::1012-1034::1047 -1072::1140-1166::1353-1375::1473-1492::1624-1646::350-372::587 -609::946-968
MENHVHSRVKLKRESKDLPRISSLEGESGVNEDYADSAAGFDGSSSTSESIYTEKHDISSTHEVDSLKSTISGDLGGLSLSQSPQPEKGEAPDNQFPAQGSERVHDWSIDYSAANSLAAASEDRSSNRLMGNLDAVESSILDLKLKVSSLQNHADEIGVETHKFSEQLAAEISSGEELVKEVAVLKSECSKFRDEFEQLKSSKLSLALPHKEPTGTDRDKLFQNLQHKWHKGLLLMEGKIRDIQKVSLGFPERDFRFLNLELEALAEILQNLKQESGEPISGAKVVNERENKKMDMHKSEQFLTDIGSDTGLFQPESMTHYLTIPGLVSHEFDSVDPALAMKEKVFELLRELDESKTERESLVRKMDQMECYYEALIQELEQNQRQMMAELQNLRNEHSTCMYTISAGKSEMEKMHQNMNEQIMKFAEDKHILESLNSDFERRAISAEAALKRARLNYSIAVGQLQKDLELLSCQVLSMHETNENLIKQTLSDSSLPNADGSPEPVTYPKISEGRTFNRSLCQNHSSSLQRQHLGEDILLSDLKRSLQLQEGLYRQVEEEISQMHFVNIYSDVFSKALQETLLEASLDIQLMKEKIVQLSQQLELTNESNELLVLRLQNAMNDILSLNEYKEICTAKSNDIALQNQILEANLKDLAHENNLLTEKINELEVLLTEYRSYEGKYMACSTENSELRSLLKKESLGKKHLHDEISILQEELKSIRTKFDEQVSMKDNLQNNAIFLSKKLQKLLASYEERHSELSLCSRSACLDSECEDVEGLLLQLEELQQSAFHRILLLIEEKEILVHEKLMAQVSLNTAESDVLVMKQKVEHDLQEMVQKITVSGALLQKLQLNFEVIINRINAGFEAEELYSQHHKEFLSGLDHLEAELQQLNSRNQDLAQEIIKLDTSSSDLEMCKLTLATIKEEKKDLESSLQEKTEESTKISSELDFLKKNLDSLHNELHAEKTVREKLEKTVSDLTTELNEKQRQLQGKKDLESSLHERAEEAAKISSEVDFLKKNLHSLHSELHAEKTVREKLEKTISDLTTELNEKQTQLQGKKDLESSLQERAEESAKISSELNFLEKNLYSLHTELHAEKIVREKLEKTVSDLTTELNEKQCQLQDSDLKRQELVHLKQMVTDLEFENSRISDLLQKSEKHLTDALKESSSISCLETQLSEMHEFCIATDVVMTFTRAQFEDHMEELAQKLHSTCWQLDVVHKKNLDVESELDGYLSRERTCIEENTRLLTSLDFVKSEIDVLTTQNRALIDQNSANMLELKEHKSRTEKISDTYVRERQSVPEVARLEQLLASCCRNAEELFLSKEAAEFKCIVLLGKLDELETAFTSLKQSDNELIRLQNQCNELTKRLAEQVLKTEEFKNLSIHLKELKDKAEAECANAHDRRGPEGPPVAMQESLRIAFIKEQYESKLQELRQQLSLSKKHSEEMLWKLQDAVDETEKRKKSEASQIKINEELGMKILELEAELQAVLSDKRNLLNAYDLLKAEKECSVISLECCKQEKQELEASLVKCNEEKSKIEVELTLAKELVETSGSHVNSLNEGNGTFSSLNPQENSTHAACSHEPESASINMQSKDPLAFSVMNGCQTLGTEKDLQLEEVMKHVASTQSLKSSIDHLNKELERMKNENMLPSVDGQSHESSFPGLQRELMQLHEANQELGNIFPVFDKFSISGNALERVLALEIELAEVLRTKRSSNIQFQSSFLKQHSDEEAVFRSFRDINELIKDMLELKARHSAVETELKEMHDRYSQLSLQFAEVEGERQKLMMTIKNTRASKKASN

SEQ ID NO: 170851 - protein, 168 aa, Glycine max
  Coding DNA Sequence Number=SeqID_79166
MGLSNFRKKCFWKLLRRIPEEVLPEVLLQEWALVTSGRCASGRYLPEEASSGNILDDVLLERVSEYFRNHEFFFRKKVLSEKESSGMIPEEGSFGNGFRGRAFSPLHCLLGAPAIMLSARRNSQVVRMPPPPLGSHNHSQIHLKLSNQLLLRALVSADLHMAKSLKSL

SEQ ID NO: 170852 - protein, 145 aa, Glycine max
  Coding DNA Sequence Number=SeqID_79167
KYAHGSTDFWCHLLFAGITPTRHPVDPKKSNKVLGFPALITGLCHFYGVPISPSKRATDAPPPPPEPLSSSTKAGALPTTRGRPAVITCPAQDVKEVLLGGNLELATKKLPTKQSRKGTIKKGSSAAPHANTGFDKHRFQSAEHQ

SEQ ID NO: 170853 - protein, 90 aa, Glycine max
  Coding DNA Sequence Number=SeqID_79168
MLNNGHPCLSHPLTNTSVLIQLPSECECKPLVCLLKRPALLSVDFQDRSIRDYSSCTLVRVVKTKMDTSEPYTGAMRGIVHEPQVNLGVD

SEQ ID NO: 170854 - protein, 226 aa, Glycine max
  Coding DNA Sequence Number=SeqID_79169
MPLSPVILVTLADNELMSVASSFLSLGGAYLHGTAWLFWYENGIGLTTEGYWGAWGAASLGLVDKPSGGRRVLQRFGPMQPTRLDGINRSPSMIGKRARHYSVEWPGVFPWDGKRSSYVIGIGVNPGVGLEENFLVALEPMPKWALLAGRIRVGAGAWGGSLWMGAGALVCTSAELEESPVRAEKLGCSDPPSIGTFGGDIIELPSLQAHFDSFPSEYQVCKVGGH

SEQ ID NO: 170855 - protein, 157 aa, Glycine max
  Coding DNA Sequence Number=SeqID_79170
MESEYWEKNPFKAIAKWWDFFGPIPKIFPEQYSKIENNKQFPSLQRHGFVKWWDQFDTSKAQPDKVKIWFKAHLEFLKAPDPETSLFLNQKSQLAAFLARSNSKEHLTEKLKEVLQLLQSQEEGSSSSKKEDTNSSNHDNDFYQNEDDCFGICLNEH

SEQ ID NO: 170856 - protein, 73 aa, Glycine max
  Coding DNA Sequence Number=SeqID_79171
  Gene Ontology: Mol. function=nucleic acid binding
  Homolog annotation: Hit_ID=A5AYU6; Match level="QueryCoverage=95%, HitCoverage=12%, E-value=9e-14, Identity=54%"; Hit description =Putative uncharacterized protein
MDSFEDSENEVVNVSLMAKNYESDEEVSLKKSWYIDSGCSKHMTGDASKFTHISPEKSGHVTYGDNNKGRILE

SEQ ID NO: 170857 - protein, 151 aa, Glycine max
  Coding DNA Sequence Number=SeqID_79172
  Subcellular localization annotation: CTP_CleavageSite=37; ConfidenceScore=5.02e-01
MINDGTYGFGDPTVRWLRMPSNSWDTVTKSGVVDKSRAFAPTYPQFVMRNSDLRSSCLLISFLNDHLEETLGPTKIGENHSKCINLTQCGARKSLAHRILVGNQRETTTLGRGKGLTFSPRVKVYDKLGFLLKASRTASHDICQVWPAVRG

SEQ ID NO: 170858 - protein, 166 aa, Glycine max
  Coding DNA Sequence Number=SeqID_79173
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=78%, HitCoverage=45%, E-value=7e-69, Identity=99%"; Hit description=Beta -lactamase TEM precursor
  Pfam annotation: Domain name=Beta-lactamase; Domain location=21-165; Score=-38.7; E_value=0.0023; Accession=PF00144.15; Description=Beta -lactamase
GERGSHGIIAALGPDETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHDHFCARPFRLAGLIADKSGA

SEQ ID NO: 170859 - protein, 244 aa, Glycine max
  Coding DNA Sequence Number=SeqID_79174
  Gene Ontology: Mol. function=nucleic acid binding
  Homolog annotation: Hit_ID=A2Q4S5; Match level="QueryCoverage=90%, HitCoverage=47%, E-value=5e-17, Identity=28%"; Hit description=IMP dehydrogenase/GMP reductase, putative
  Pfam annotation: Domain name=DUF1723; Domain location=2-51; Score =60.6; E_value=5.3e-15; Accession=PF08330.1; Description=Protein of unknown function (DUF1723)
VTDDPGLISAFVERWHRETSTFHLPVGELTITLYDVSSLLHLPISGALHNFEALSVDETIFLLIELLEVSGEEARAETAFRDMGQSGGYAWGAAALVHMYDQLDEVSRTMTWQIGGCWIYEHFSSVHQCIINDAYEETSSRASRWLTMKAHMKGITGALYRARCDALTVTDVCWLPYSDHRGLRWGPMVLTVRPERVLRQFGYIQSIPPPADSASLSYDDIDDRWMPFSDHVVVVSDLCVVLGQ

SEQ ID NO: 170860 - protein, 169 aa, Glycine max
  Coding DNA Sequence Number=SeqID_79175
MKESHFAIKTNIKETSPLRQPPHLLLCKKTPVGTAMPLGLEIIPKVKELLDEGLVRKSLNPCALLVPKIGIMRHQIPMIVGMMNVFSGATLFCKITHVSNIFMIHIHRDSLGRSNQHENIKKVIPEWPTPPSIREFWGFYDLSNFYKRIVPYFSILVAPLIELVSRKEA

SEQ ID NO: 170861 - protein, 206 aa, Glycine max
  Coding DNA Sequence Number=SeqID_79176
  Subcellular localization annotation: CTP_CleavageSite=58; ConfidenceScore=5.02e-01
MLHLVEKHRDFSVSQVIQNYVGLSTSWRIRRSKSLAFVDHTAFVAMTQELVARGDTLRLSAPFCHPEAAGPMTSRDQVWSFCTLVSSRGGGPDDTQRYLTVIRTLLSSRGGGPDDKQRPKTKFGHSAPLYHPEAAGPMIRGDTLRLSTPFCHPEAAGPMTSRDQVWSFCTLVSSRGGGPDDTRRYLTVIRTLLSSRGGGPDDKQRP

SEQ ID NO: 170862 - protein, 251 aa, Glycine max
  Coding DNA Sequence Number=SeqID_79177
MPAITGTLPSAASLATSITASFSCTVIEAGDAVAHQVFDHRMSGVEIQREIVAELGRHRREYAAPAYGFMAHRGGLTLFADCRDEIGTMPAERGREKSGRRRTLKRGGALSGKRQAEIARRGAGHRFELTAEGAVIGVAALQRDVGDRQIAGQQFRGLFQPHFMDHLARGEVEDTFAVAFDLRHRQPGQRRQLLKRDRPGIVAADVYVDRRQPLVGRVIGPGLLQIVRNTRHTDDFSLRIIQRQLLRQAPA

SEQ ID NO: 170863 - protein, 90 aa, Glycine max
  Coding DNA Sequence Number=SeqID_79178
  Subcellular localization annotation: CTP_CleavageSite=29; ConfidenceScore=5.23e-01
MWRKLKRGVFAQSQSGPLRPSRSFLQKAVASGGSKLARLGELGGKLLPYFAINRGRSEEEKGSAFLALLSLSKLLRKIISVKKIQAEALP

SEQ ID NO: 170864 - protein, 74 aa, Glycine max
  Coding DNA Sequence Number=SeqID_79179
MIIVATYPSAGGRRGAHGCVFQERKMHGVATNIYLRKMSEKPKKVWSMKFKCERFGSFFTHREAISTPRIRHKG

SEQ ID NO: 170865 - protein, 169 aa, Glycine max
  Coding DNA Sequence Number=SeqID_79180
  Homolog annotation: Hit_ID=UPI00006A2D9E; Match level="QueryCoverage =72%, HitCoverage=67%, E-value=7e-08, Identity=17%"; Hit description =UPI00006A2D9E related cluster
MVAITPARVPQPPFFRGYDSNATCEYYGGVLGHSIEHFMTLKRLHVLAFSGLHVLTLRGLHTLPFRGLHVLAFKGLHVLTFRGLHTLAIRRLHILAIRRLHVLTFRGLHALTFKGLHVLGFRGLHVLTFRGLHALTFRGLHVLAITRAARPHLQRAICPHLQRATRPHL

SEQ ID NO: 170866 - protein, 75 aa, Glycine max
  Coding DNA Sequence Number=SeqID_79181
MESPTVATYPSVGGRRGAHGCIFQRRIMRGVATNVYSRKTSEKSERRKEGGGCRLARPGKLGCFHQKAPPSVGTP

SEQ ID NO: 170867 - protein, 199 aa, Glycine max
  Coding DNA Sequence Number=SeqID_79182
  Subcellular localization annotation: CTP_CleavageSite=35; ConfidenceScore=5.11e-01
MDMNIGALISGQISSIAQSNSARLGSLALITALCRARGVTSNSLTYESLSPAINLAYIKKNCWNMDDLTVNFRGARKARVRPADVPSSSTLPAPSTSATPTPAPLGSSTQDSQRFEAMLQSIHQGQILLLQSLQVIAPLGSILSIEQFIEKVSWPGTLPSVVREGEGPSAQVPQQGTGKAGGCYSREIDRTQQVHQIAQ

SEQ ID NO: 170868 - protein, 183 aa, Glycine max
  Coding DNA Sequence Number=SeqID_79183
MASKKRKAPSTPTQAKFDRSRFTSQEAWERYTDIVVPRKLLLERNVVVYYTKFDEFKEELERRHWDEKLIDFDDSSIDIAIVKEFYANLYDPKDKSPKQELAAKLCIPGRGFELNADGQPLKILRKNMTTLAQTWSVLSFSNLIPTSHTSDVTLDRAKLIYGIMMKMDMNVGYLISHKISLIA

SEQ ID NO: 170869 - protein, 147 aa, Glycine max
  Coding DNA Sequence Number=SeqID_79184
  Pfam annotation: Domain name=zf-CCHC; Domain location=20-37; Score =34.2; E_value=4.8e-07; Accession=PF00098.14; Description=Zinc knuckle
MERSHNFNNGKRSQEVSPTLKCYKCNQPGHIKANCPSNESWSEKNEKKNYKERRSKKAYIAWDDNDSSDGSEKEINLLSKDYESDENISQEFYRGYISCGSVQVEGTSTWLFKENKGRYISCGSLACKGFYKVERNLKNRWLLGDWM

SEQ ID NO: 170870 - protein, 180 aa, Glycine max
  Coding DNA Sequence Number=SeqID_79185
  Homolog annotation: Hit_ID=A5C922; Match level="QueryCoverage=53%, HitCoverage=35%, E-value=2e-09, Identity=36%"; Hit description =Putative uncharacterized protein
MTRGNPSDLQPFDSEIDRTFHRLVRHHFIPFDYPEHSITGESVHSVIGDFHHPDFEHYNFEHSDSEHSDFEHSENMAQPPPHERTLREMAAPDFTYESLCIQYPDEDVPYVLKTGLIHLLPKFHGLAEGVAKDWLYYLAPRSITSWDDLKRVFLEKNFPASRTTAITNDISRIRQLSGES

SEQ ID NO: 170871 - protein, 102 aa, Glycine max
  Coding DNA Sequence Number=SeqID_79186
MAKIQGPKEEKTYSNIYKEERTQPWSMGSEIYPGVHENPKAFFSSSSPILLESSIQYPWGVGLHHPLHLGMDLTSNPESKVRSENPFHGHLPMREHCSSPTQ

SEQ ID NO: 170872 - protein, 60 aa, Glycine max
  Coding DNA Sequence Number=SeqID_79187
MSPPLWLSFTRLGGPMTRARARKAKEPLQQVLSILFEYKPKFQGEKSKVVSCIMAQMEED

SEQ ID NO: 170873 - protein, 133 aa, Glycine max
  Coding DNA Sequence Number=SeqID_79188
  Subcellular localization annotation: CTP_CleavageSite=36; ConfidenceScore=5.24e-01
MPKFHGNISVLRSVLSFSMTYLVGKSWLSSNFSALRLGVFPSLIWECLSSWVPIGQLSDKWHVTLLLPHQFFTEEVFEVSGLLAAKLCVGGCFVSFWNDCWCLQQLIAKAPSLPLSICQQLSSMVKNFWQDNS

SEQ ID NO: 170874 - protein, 177 aa, Glycine max
  Coding DNA Sequence Number=SeqID_79189
MSKTWEKTCSTKGKTSYSCPDVSPRTKEGAEEEATKEFEGPSAGEFAERNLQWLSARKNPEEDELSSSLSAPLQICKGEFGTFLEKLCIHEGSREIKVQVPESSERFCCVKICRDASSKQKPFGELEMSLRFPDYRKLNPLLDLPYRYLIGNWSDSKVLDSTGLSCCAITRNRGTRT

SEQ ID NO: 170875 - protein, 365 aa, Glycine max
  Coding DNA Sequence Number=SeqID_79190
MDDFAYRPFVKQVGPGGRDVPPSTVVAVVEKEGQPASEVGHIVVDVEVTPNGSSSVLAKRKRAPSAVEATATATSAPAPSPSSIIVVQEVTIVAIEVFIPATLASSLAALPSTVISFGVVTTSAPTVLPYSSNPSVASASTILAAVASPSSFSHPRVSLDHFYKSKQKTSVGFVSAFDKNLIRSAGVENATDSAKVFLQRSLAILEKSEQRHQEAVQKVASLEAEVAKWRTTTRTLWRVERPKVANATVAFAKAVEKKDLCGKVESVAAERERLVKIFFDLEAQLKESESRLEESELQAAKEREARFLEAVKQADFFVKDLNLGLFNPFKDVKDGIMLDEEGIIADDEAIDEGQGVVKQGDDACV

SEQ ID NO: 170876 - protein, 54 aa, Glycine max
  Coding DNA Sequence Number=SeqID_79191
MGSTTTLRLGQRRKFRLMEGEKGREKKKEEGSWKVGGEEEAGVVDAILPCKGIG

SEQ ID NO: 170877 - protein, 133 aa, Glycine max
  Coding DNA Sequence Number=SeqID_79192
  Homolog annotation: Hit_ID=A5BSR3; Match level="QueryCoverage=48%, HitCoverage=20%, E-value=2e-07, Identity=45%"; Hit description =Putative uncharacterized protein
MARTKKTSQMTSEAAKEIADKIDSMKEQASQGSFVAHGRQDVLIAAIGRPEHPGHVCVAGASVTIKQYFGLAPRTSCTSSSMALEDLEQLTQKIREAGGVDHKKSDLTTNVVLQLDAIPVSIANKITWTRTAS

SEQ ID NO: 170878 - protein, 109 aa, Glycine max
  Coding DNA Sequence Number=SeqID_79193
MKLKPYKNDVFLQANPVLRHDWFKLKQTAIVNGEFAVRSHVAWKTPLVVASCLQVEVATMTSELGQASAGFWKPLVKLAGWLVQAFAVFAGCFCRRCRPKGELQLPLAI

SEQ ID NO: 170879 - protein, 112 aa, Glycine max
  Coding DNA Sequence Number=SeqID_79194
  Gene Ontology: Mol. function=aspartic-type endopeptidase activity; Biological process=RNA-dependent DNA replication
  Homolog annotation: Hit_ID=Q6VPE8; Match level="QueryCoverage=50%, HitCoverage=7%, E-value=1e-08, Identity=47%"; Hit description =Putative gag-pol polyprotein
MVGDGDGGGEYHQLDGTQRLLLDIMTTQMQRLLNRNNEELYGQIEGPENQLNQNTGRHFGGNRVGNVGPRQNKMEGVKLNVPPFEGKSDPDAYLDWEMKIEHVFSYNDYTEE

SEQ ID NO: 170880 - protein, 225 aa, Glycine max
  Coding DNA Sequence Number=SeqID_79195
MVWQSPNQKSIFSKLEFDSLVTIYIKAFKTVETDASDIGYGGILKQRVHGQDHKTSRAPQIHYLTTLPVNSYRKVVMPPKASGISLRGGRSTGKGARLALPEPTIKKSSTSSGSPTQAGSSTQKTNLEGSSTQITSIKPEPSTQESPKSATAKQTSADYAWPIETLQALQDMGITKFPKIIKKSWADIASESDDESESNLQTVIQNASMTKTATNPKGKLPLAKA

SEQ ID NO: 170881 - protein, 360 aa, Glycine max
  Coding DNA Sequence Number=SeqID_79196
  Gene Ontology: Mol. function=chlorophyll binding; Cellular component =integral to membrane; Biological process=photosynthetic electron transport
  Homolog annotation: Hit_ID=Q2MI75; Match level="QueryCoverage=99%, HitCoverage=70%, E-value=0.0, Identity=92%"; Hit description =Photosystem II P680 chlorophyll A apoprotein
  Pfam annotation: Domain name=PSII; Domain location=1-352; Score =562.4; E_value=4.6e-166; Accession=PF00421.10; Description =Photosystem II protein
VACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVGWLGHPVFRDKEGHELFVRRMPTFLNISGCLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKKQVV

SEQ ID NO: 170882 - protein, 210 aa, Glycine max
  Coding DNA Sequence Number=SeqID_79197
  Gene Ontology: Mol. function=motor activity; Cellular component=cell projection
  Homolog annotation: Hit_ID=UPI00006A2D9E; Match level="QueryCoverage =98%, HitCoverage=97%, E-value=3e-18, Identity=17%"; Hit description =UPI00006A2D9E related cluster
GLHALAFRGLHILTFRGLHALAFRGLHVLASKGLHALTFRGLHILAFRGLHAFAFRELHALTIKGLHALTFRGLHVLTFRGLHDLTFRGLHALTFRGLHVLAFRGLHDLTFRVLHVLAFRGLHALAFRRLHVLGFRGLHVLTFRGLHALAFRGLHTLAFRGLHILAIRGLHNFAFKGRHVLDFKGLHTLTIGWLRVLTFSGLHIHTLREF

SEQ ID NO: 170883 - protein, 33 aa, Glycine max
  Coding DNA Sequence Number=SeqID_79198
KWVYDPNMGKMQGLHMSKHENKKYVERIYVMMQ

SEQ ID NO: 170884 - protein, 352 aa, Glycine max
  Coding DNA Sequence Number=SeqID_79199
  Gene Ontology: Mol. function=protein-N(PI)-phosphohistidine-sugar phosphotransferase activity; Cellular component=integral to membrane; Biological process=phosphoenolpyruvate-dependent sugar phosphotransferase system
  Homolog annotation: Hit_ID=A4W4S7; Match level="QueryCoverage=100%, HitCoverage=65%, E-value=1e-174, Identity=87%"; Hit description=PTS system, alpha-glucoside-specific IIBC subunit
  Pfam annotation: Domain name=PTS_EIIC; Domain location=9-347; Score =301.3; E_value=1.9e-87; Accession=PF02378.9; Description =Phosphotransferase system, EIIC
MLSQIQRFGGAMFTPVLLFPFAGIVVGIAIMLRNPLFVGEALTAPDNLFAQIVHIIEEGGWAVFRNMPLIFAVGLPIGLAKQAQGRACLAVLISFLTWNYFINAMGMTWGHFFGVDFSAEPTAGSGLAMIAGIKTLDTSIIGAIVISGIVTAIHNRYFDKPLPVFLGIFQGSSFVVILAFFVMIPCAWLTLLGWPKVQMGIESLQAFLRSAGALGVWVYTFLERILIPTGLHHFVYGPFIFGPAAVEGGIQVYWAQHLQEFSQSTLPLKTLFPEGGFALHGNSKVFGSVGIALAIWYTASAENRVKVAGLLVPATLTAVLVGITEPLEFTFLFISPLLFAVHAVLAATMATV

SEQ ID NO: 170885 - protein, 65 aa, Glycine max
  Coding DNA Sequence Number=SeqID_79200
MCFSETVARAFAKCNLQWLSARKNPKEDELSSSLSAPLQVIKHTASAHPLSETSALSQNPLMRTK

SEQ ID NO: 170886 - protein, 116 aa, Glycine max
  Coding DNA Sequence Number=SeqID_79201
MPTKLIMQKQNFLQHPLSGPTCCYAVGRNILSERKVELYHTEFDDFKTELERRNLHKRLTNLVDGSINVALVKEFYANLYNSEGPSPKQARARGHLVKIDADNLNTFLETPVVLAE

SEQ ID NO: 170887 - protein, 122 aa, Glycine max
  Coding DNA Sequence Number=SeqID_79202
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLQASYLGSRVGSSETSKTALQG

SEQ ID NO: 170888 - protein, 313 aa, Glycine max
  Coding DNA Sequence Number=SeqID_79203
  Homolog annotation: Hit_ID=Q6WAY6; Match level="QueryCoverage=29%, HitCoverage=16%, E-value=2e-11, Identity=39%"; Hit description =Putative uncharacterized protein
EGKEGVLFSCGDYPNVPLIGTRGCINYNPALAIRQLGYPMRGAPTEESLSPFLMRDLGAQGLKVIQRIHKAWRSPLRKDKELRGIRNGVIGGYHGWLRIHTRGLDWLSKLKVINEENFEAPEEDEEVRALKLELGKARLAKEKFKSAATHIRKSAPSYKRKTQPLQNPLNKKPKGPARRNMAERNSEEHCGVATMSSSSEEKREIGHGSKRNLAQHLEATEQSMLAIIGQYKEELNQSTAHEQKLVEDYAQVYAEKEARGRVIDALHQEATMWMDRFAFTLNGSQDLPRLLAKAKAMAEVCTAPEEIHGLINY

SEQ ID NO: 170889 - protein, 254 aa, Glycine max
  Coding DNA Sequence Number=SeqID_79204
MRARARVMGEIEEVQERIKADMEAMEEQMATMMEAMMSMKNIMEVNAVAVAVTNTLAEGDKELGSTGGPHFVQVQNKHAFPLYGLPPNYTPPNVAHTSDENINNSTHILIESQQPQSDNAHVSQPMGETHEVPHHNLADFEPHLGYATEGQAVGGVPLPDTLGGPQFRQQPQPSHFAVGRVPPAMVERGKLDHIEERLRAIKWAGNYAFADMAELCLVLENHLKKYCRKMGAYAKDEKLLMHFFQESLTGVVVT

SEQ ID NO: 170890 - protein, 97 aa, Glycine max
  Coding DNA Sequence Number=SeqID_79205
MEKSGGKQNNFGSMKEREWKIFRPDKFSARLPFSTGDIPPHMNKEEKTETPSFLSKNTTLEKILLVRDRINETLGLIRILVVDLKRANKAALTLVNF

SEQ ID NO: 170891 - protein, 135 aa, Glycine max
  Coding DNA Sequence Number=SeqID_79206
MGRAEEVQEKAKAYMEAMKEKMATMMEAMMSMKKIMEANVVTIAATSIVAKVNPMPPSGLNQMNHPTLDMVGKDLGSRDDPHDVQNQNKHAFPPYGLPPNYTPPNVAYTPNEDVNNSTLIPIESQQPQTDHAHVS

SEQ ID NO: 170892 - protein, 59 aa, Glycine max
  Coding DNA Sequence Number=SeqID_79207
  Homolog annotation: Hit_ID=A7R3V4; Match level="QueryCoverage=57%, HitCoverage=13%, E-value=1e-07, Identity=73%"; Hit description =Chromosome undetermined scaffold_574, whole genome shotgun sequence
MMLMSAGIKMNWVLSAAKVAKKMKLKFTKEWIAYLRLPLPIDVYKELKHYILKHGANAM

SEQ ID NO: 170893 - protein, 82 aa, Glycine max
  Coding DNA Sequence Number=SeqID_79208
MKRLQRAGLRSSRGVGLGHNIKCRSLGGECGIWVEVTLSMLSRFFTGAPYRLGLLTHNSKGNDMINVLIGHVHGGRHIIEGW

SEQ ID NO: 170894 - protein, 39 aa, Glycine max
  Coding DNA Sequence Number=SeqID_79209
MDRSWITAPRISEAYQHGQHVHLIPVELQSGDLMGRHDT

SEQ ID NO: 170895 - protein, 243 aa, Glycine max
  Coding DNA Sequence Number=SeqID_79210
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=44%, HitCoverage=12%, E-value=4e-10, Identity=36%"; Hit description =Gag/pol polyprotein, 3'-partial, putative
  Pfam annotation: Domain name=G-patch; Domain location=161-202; Score =15.8; E_value=0.0023; Accession=PF01585.14; Description=G-patch domain
MPEVEREHCRAIHKVLQHSRGQKRDYCIIRKGCANSNQAHLGLLGGSNRRRCLLVEATQLAWNSTKPRLESLVSVKCMDHVMAKVLIDNGSSLNVMPKSTLEKFPYLPSEEDVLVSCPSSMPYVEAAEESLEMAFQSFEVVSIASVDCLSGQPCLSDMAMMVAPVILGYGYEPGMGLGKNNGGRTSLVSTRGNRGKFGLGYRPTQANIRKSISERKNKGQSPRLGQQAEGAPPCHISRSFISA

SEQ ID NO: 170896 - protein, 286 aa, Glycine max
  Coding DNA Sequence Number=SeqID_79211
MGCSKIASEWLSQQVFNFPSLLKAEGLSKLVQKKITFYPELVKEVADLDIGGVHKFDEAPDGYNKMQTYMGMLLDPVRNLRNRLGVGGLTEKEKMLVYLITYILTPRSSNHAQATDDDLQIVYGLKSGIKMNWVLLIEDIMLKCHLLLDYEFPYVVLASRFIDYFKVDISYEIVNFTKAFSEITERHLKKLGMRFIDHEWIMVGEPEAGNIDEMEEDVEVKAPQKHVHQWSPFEFLMIPKMDAMLPLHQEHSAKFHSSADNIITRLENFETRLTLSNLLNPNKDET

SEQ ID NO: 170897 - protein, 319 aa, Glycine max
  Coding DNA Sequence Number=SeqID_79212
MDDEELPSPVNSDIVKRAAMDGSRPILDFIAMSPKKLLTKRARKDTAGEGSSSAPHAEVELDGHRVRSEEHQRRFEAIKGWSFLKERRVQLRAREYTEFQEEESWISAPGCEANGSPMMKRLSTSSWGGHRPATVLPRTGICVKRDGKAARLISDAIYQFAGITPLRHPVDPEKSNKALGFPALITGHCQFYGVPVTPTKLICPPINRSFIEKYYMPRQAQQPRQDQQQQSALDAPPQPLQQPPSLESISAHMQRMELYMQHLANQQAANHRGQDPNPYPWPTPEQFEATVAWTRDRHNFQAGAGLTKAQGMRTKLRKR

SEQ ID NO: 170898 - protein, 189 aa, Glycine max
  Coding DNA Sequence Number=SeqID_79213
MGTRGCINYNPILAIRQLDYPMRGASSEESTMPFIAWGFSDPNARIFQRVRKAWSVVQRKDKELRGSNNGILDWLSKFKVSSEEEVETLEESEEVQALKVELEKAQVVKERFKTMTIKVRKECDELRDVNMATTEALEGETKRARKEEWVQNKFRGALWGSNDELKLRRAKRDQSRVEGMILEGKLKAC

SEQ ID NO: 170899 - protein, 166 aa, Glycine max
  Coding DNA Sequence Number=SeqID_79214
MESRRKRLDCGLEGIFVPIPWVFKSISDSSSDSKAMSAHVFSGSFVRPISWRAKNFEGEIFFEHGSGRANLNPFPELLPPRKEVMDALGGMTTFLLIRQIGKSVVFTFSLSQSTGLNSEEDELSSSLSAPPQVIKRAASAHPLSKTSALSQNPLMRAKRSRSALSA

SEQ ID NO: 170900 - protein, 248 aa, Glycine max
  Coding DNA Sequence Number=SeqID_79215
MEFMQISMFMKGITNNCRRMVNASTGGNYLNKTTTQVKTIIKDLVASERTIEMRRRPSNIKMYRGTNRGGFQNIHRSYNQVGDNKPQQRPNLWDRILKLEEDLTKLIEVVITNHKNIQAAIKSMETQIGKLAKQLQTSSIGFSATIKDNPKVHCKAIISIIECDVGGKEEEEIEESTMLEEEMKAQANPSTQGMQSSLNPPLFNFSKLSIHKQENNERIAKFKKYIEMLQGRRRNHLLKKSHGTCYIK

SEQ ID NO: 170901 - protein, 132 aa, Glycine max
  Coding DNA Sequence Number=SeqID_79216
  Subcellular localization annotation: CTP_CleavageSite=53; ConfidenceScore=5.14e-01
MALGSKRALNPLMKKATSQMKIIPLFFKGLWTSLDFRLLLVTSLMPWNCKSTCGSMPWNQGSPKLKKMSPSSVLALIHHHRLHHHLSLRIVIIKGGDCRQRIKPRRCFDDAKRSHASQRFIQDKAMKDIQDK

SEQ ID NO: 170902 - protein, 308 aa, Glycine max
  Coding DNA Sequence Number=SeqID_79217
  Gene Ontology: Mol. function=kinase activity
  Homolog annotation: Hit_ID=A5BRQ5; Match level="QueryCoverage=52%, HitCoverage=33%, E-value=4e-61, Identity=74%"; Hit description =Putative uncharacterized protein
MAVAAVVHLYVFPAEPYKMGERCIRNVAVMDDYASLGSPLDPEEVQDSQRSTRTWLGAHNNQREKNPMKFTQSVRDVVVGSGEIIVDDMKFTVSHVVEPVERGIAKINKTFHQISENVKRHEQRTRNTKDDCYLVPLRTQMSEFSDVHDTMGEGSVSDSGMSRVPNISKILSEVPAVSPNPLSTYVVVNWALRASHSPEKSTTSMGASCSSFGSAFVRCWCNKATIQLTSQTKKHPDKIFWRCAKWNVLQVLWRLSNPNFVREPSVVGMRPSFDHFEDVPPEGGCFWRKQPSSPGRAGWQASPSFSYK

SEQ ID NO: 170903 - protein, 42 aa, Glycine max
  Coding DNA Sequence Number=SeqID_79218
MGRDTHLHLRGLELSTIEEENKRKTMGSPFSLLAGRNRKGEF

SEQ ID NO: 170904 - protein, 59 aa, Glycine max
  Coding DNA Sequence Number=SeqID_79219
MGRGDDHRLIVATYPSAGGRRETRGMRVPRKEYARSRHQRLFEENVGKTGKDAIYELLS

SEQ ID NO: 170905 - protein, 179 aa, Glycine max
  Coding DNA Sequence Number=SeqID_79220
MRASGNRLPRGCNRLPGLERGLEHCGGLWNGSLVIDYQIMMAAQLIHDRVEMECLEGAWETLEGNTRCRFRGTIRFTATSLVHPDEPARTLQRMVEWILPTPTPYHLVEPIQVIEVTSSEEDPEDALDFLEGDEDPLPEVDSPEEVMSASEADSTEDSGPGGGDGDQRRLFIIVGSSMD

SEQ ID NO: 170906 - protein, 119 aa, Glycine max
  Coding DNA Sequence Number=SeqID_79221
  Subcellular localization annotation: CTP_CleavageSite=73; ConfidenceScore=5.25e-01
MGNQQRQGYTQGGFSGFQQGPYNQQGQWRTHPGNQFNKDQSGPSNRPIQQGPNIFQRTTKLEETLTQFMQVTMSNHKSTESALKNLEVQVGQLAKQIADKSSNSFVANTEVKGTDCKKK

SEQ ID NO: 170907 - protein, 128 aa, Glycine max
  Coding DNA Sequence Number=SeqID_79222
  Gene Ontology: Cellular component=integral to membrane
  Homolog annotation: Hit_ID=A7NSI8; Match level="QueryCoverage=82%, HitCoverage=30%, E-value=2e-45, Identity=78%"; Hit description =Chromosome chr18 scaffold_1, whole genome shotgun sequence
MELSSMILYMHTAYAGSDTACEVVSYDFKEKRFAHLHRSAIGFPESRFFYTGTPATSNAKATALKGEELVRTQFQRDPFGCRGSLYHKKLKRDPFHRSIPYPNGCPEIEGLFKYCGPTPYPGALPWAQ

SEQ ID NO: 170908 - protein, 66 aa, Glycine max
  Coding DNA Sequence Number=SeqID_79223
  Homolog annotation: Hit_ID=A7NSI8; Match level="QueryCoverage=74%, HitCoverage=14%, E-value=1e-15, Identity=77%"; Hit description =Chromosome chr18 scaffold_1, whole genome shotgun sequence
MGKFLLIGKERKAQTGKEESVKWRALTEEHARDSFENLLFSVCRFRELTGTYPQNITVCKPYLSEL

SEQ ID NO: 170909 - protein, 138 aa, Glycine max
  Coding DNA Sequence Number=SeqID_79224
  Gene Ontology: Mol. function=nucleoside-triphosphatase activity; Cellular component=endoplasmic reticulum; Biological process =response to abscisic acid stimulus
  Homolog annotation: Hit_ID=Q9ZPX7; Match level="QueryCoverage=55%, HitCoverage=16%, E-value=1e-18, Identity=59%"; Hit description =Putative uncharacterized protein At2g46620
MAVPDSKSNSVFGYAGKDLGAWDPKGTLRGKVLGVTRWRAFDSKGNMRPKWKIQPPKIPGFVPFTHPSTFDTITMELDYTSKIKFDLESFLRVKQYYHCLSCIRKRCLLLYSPFDIEKSSFATAMTNFLYYDIYDIDL

SEQ ID NO: 170910 - protein, 172 aa, Glycine max
  Coding DNA Sequence Number=SeqID_79225
  Gene Ontology: Mol. function=amino acid transmembrane transporter activity; Cellular component=integral to membrane; Biological process=amino acid transport
  Homolog annotation: Hit_ID=Q9C6S5; Match level="QueryCoverage=51%, HitCoverage=20%, E-value=4e-29, Identity=64%"; Hit description=Amino acid permease, putative
MLPRYSLTVQGFVLRDPTVQGFLLLVVPVVICLFVCLFLLLFFFFVTACYPCGHCKEVRACKLQGAQGGDFQSVGVRKVLRAPKAIFFPLLVATGDVPLNRELWTDGYFSIIVEIVGGVWLRWWLQVAAAMSNMEMFVAEMSSDSFQLLGMAERGMLLEFFGKRSCYETPYT

SEQ ID NO: 170911 - protein, 132 aa, Glycine max
  Coding DNA Sequence Number=SeqID_79226
MEAMKEQMTTMMEAMMSMRKMMEVNMATVIAASTATEVDPTHPSGLNQVNCPVSNMVGQKGGRALGSMGDENMASHHMACLPTIHHPILHMLPTRMSITLLPYPLRANNPNLVMHRSLNPWGRHMKYPETTL

SEQ ID NO: 170912 - protein, 83 aa, Glycine max
  Coding DNA Sequence Number=SeqID_79227
MLGFTRSSPQISASPHQLDFAPYASRSYIAQWNAPGLLHDKHTLRSSCILGEMEVDELWLGFWLPLNYQVDIGASQHRTPELG

SEQ ID NO: 170913 - protein, 152 aa, Glycine max
  Coding DNA Sequence Number=SeqID_79228
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=100%, HitCoverage=26%, E-value=1e-68, Identity=75%"; Hit description=DNA -directed RNA polymerase subunit beta'
  Pfam annotation: Domain name=RNA_pol_Rpb1_1; Domain location=1-144; Score=-149.0; E_value=0.0045; Accession=PF04997.3; Description=RNA polymerase Rpb1, domain 1
GAIREQLADLDLRILMDSSLIEWKELGEEGSPDNENEWEDRKVGRRKNFLVRRIELAKHFLRTNIEPEWMVLCLLPVLPPELRPIIQIDGGELVMCQEKLVQEAVDTLLDNGIRGQPMRDGHNKVYKSFSDIIEGKEGRFRETLLGKRVDYS

SEQ ID NO: 170914 - protein, 266 aa, Glycine max
  Coding DNA Sequence Number=SeqID_79229
  Gene Ontology: Mol. function=lysine decarboxylase activity; Cellular component=cytoplasm; Biological process=amino acid metabolic process
  Homolog annotation: Hit_ID=A7MEM5; Match level="QueryCoverage=96%, HitCoverage=35%, E-value=1e-127, Identity=83%"; Hit description =Putative uncharacterized protein
  Pfam annotation: Domain name=OKR_DC_1; Domain location=124-266; Score= -92.0; E_value=2.6e-06; Accession=PF01276.11; Description=OrnLysArg decarboxylase, major domain
  Pfam annotation: Domain name=OKR_DC_1_N; Domain location=8-118; Score= 137.1; E_value=4.9e-38; Accession=PF03709.6; Description=OrnLysArg decarboxylase, N-terminal domain
  Pfam module annotation: Pfam domain module=OKR_DC_1::OKR_DC_1_N; Domain location=124-266::8-118
MGPHGAFYKDEPIRELDAALKLQGFQTVYPNNASDLLKLIEHNPRVCGVIFDWDDYSLALCSDINQLNESLPLYAFINTHSQMDVSINEMRMALHFFEYALNAADDIALHIRQYTDEYIDKIMPPLTKALFTYVKEGKYTFCTPGHMGGTAFQKSPVGSLFYDFFGANTLKADVSISVTELGSLLDHTGPHLEAEEYVARTFGAEQSYMVTNGTSTSNKIVGMYAAPAGSTVLIDRNCHKSLTHLLMMSDIIPIWLNQRATRWAFW

SEQ ID NO: 170915 - protein, 34 aa, Glycine max
  Coding DNA Sequence Number=SeqID_79230
MVQPKQKYMNKKVKWWQDRNIEMAITEATGLQMR

SEQ ID NO: 170916 - protein, 177 aa, Glycine max
  Coding DNA Sequence Number=SeqID_79231
  Homolog annotation: Hit_ID=A0ST23; Match level="QueryCoverage=14%, HitCoverage=51%, E-value=4e-07, Identity=100%"; Hit description =Putative reverse transcriptase
AIGAGLFAITPAGERGMCCKAIKANWSSTAVAAALELVDPPGCRNSIARADPVDRAIAVRAKRSRSCGTHQAYRYRRPRGGARYQLLFPLVRVNFELGVIMVIAVSFGKPVVPAALMNRPTRGERRFAYWALAECILAYYVGTDEGVSEVLHVAEKKGCTGASAEYVIQDIFRFLAH

SEQ ID NO: 170917 - protein, 30 aa, Glycine max
  Coding DNA Sequence Number=SeqID_79232
MPCKCEIAPRKLPAKRTRKDTAGEGSSAAP

SEQ ID NO: 170918 - protein, 294 aa, Glycine max
  Coding DNA Sequence Number=SeqID_79233
  Homolog annotation: Hit_ID=Q6WAY6; Match level="QueryCoverage=88%, HitCoverage=52%, E-value=1e-16, Identity=24%"; Hit description =Putative uncharacterized protein
MFTFGDFTLVPYVEEFEEILGCLLGGRKPYLFSRFYPSLARIAKVVKISAQELDRVKQNRNGVVRIPRKHLEEKAKALADQGEWASFIDVLALLQRKPGRCTPALYVWLVLHFFGHESRPVCPLQGHRTCTKKVKANWEQLLASMVRTSVNWFPRWKKGRAGVLSSCEGFSNIPLMGTRGSINYNVVLAIRQLGYPMRGAPSEESTTPFIARGFSDPNAMIFQSVQKAWSVVQRKDNELRGSSNGIISGYHKWLKARTQELDWLSKLKASSEEEAETLEKSDEVQALKTKLEKA

SEQ ID NO: 170919 - protein, 206 aa, Glycine max
  Coding DNA Sequence Number=SeqID_79234
MVLKEELVACSRSKRSLSQRLCETETNMLAIIAKYREELGLATAHEHRIADEYAQVYAEKEARGRVIDSLHQEATMWMDRFALTLNGSQELPRLLAKAKAMTDTYSAPEEIHGFLGYWKNTITKRAARYPYRTRSKSRTMGDQEETQEQMKADMSAMKEQMASMMEAMLSMKQLIENYAASAAAVSSAAEADPTLLATVKPPPSNI

SEQ ID NO: 170920 - protein, 154 aa, Glycine max
  Coding DNA Sequence Number=SeqID_79235
  Homolog annotation: Hit_ID=A7P032; Match level="QueryCoverage=68%, HitCoverage=52%, E-value=3e-25, Identity=50%"; Hit description =Chromosome chr6 scaffold_3, whole genome shotgun sequence
  Pfam annotation: Domain name=Dirigent; Domain location=25-153; Score =4.5; E_value=1.9e-06; Accession=PF03018.5; Description=Dirigent-like protein
MSTKLLLTLILISYTLSNVIGEETGFVGTLHPKSLGLHKKQTLSHFKFYWHDIVSSGANSTSATIIPPLPKYNTTTSFGMVNVMDNPLTLGPELGSKLVGRAEGFYALTSQSQINLLMVMNFGYRARIRNHGHSCFLCEIVIRSQFHTTYEPEA

SEQ ID NO: 170921 - protein, 177 aa, Glycine max
  Coding DNA Sequence Number=SeqID_79236
MASRKRKSIGSRPTTQYDTRRFHSLDAWNWVRGHLVKIDANSLNTFLETPVVLAEGDTLPRYSRYCRLPTDYREIEAALCIPGRGFILNAEGHPWRILRKDLTTLAQVWSFVSYSNLAPTSHTSDLIVDRARLIFGLVSRMDMNIGALISGQMTSIAQSNISRLGYRRLIDKEKFEP

SEQ ID NO: 170922 - protein, 310 aa, Glycine max
  Coding DNA Sequence Number=SeqID_79237
MAKFDLDIVLEFYANAWPTEEGVRDLRSWECEYGQRRNRADGFDEEVIAQLLCIPGQDFARTAAGRRVQIMRTNMTTLTQTWMTLLLSNILPSDHNSDLPLPKCQLVYAILTRMSIHVAQMITDAIYLFASIPPTRHPLDLDKSNRVLGFLALMTGLCQSFGVPITPSKVIRLSITWAFIEKYCTPRQAQCGDLQAPDAPPPPHQADPAGSFDTERYLRHLVRQQAANHRAHVQTHDCLYQLSLSLQSQGFAFFPCPTPDQFRAEVAWPGDWPEAQAGEAPAEALGDADKARMDEEMIDLLDFLGGSGAT

SEQ ID NO: 170923 - protein, 56 aa, Glycine max
  Coding DNA Sequence Number=SeqID_79238
MSPLSTCEDGALRGLAFAQRLYAAHPYSGMVHALSLQVGRLADDALSQKISGLASS

SEQ ID NO: 170924 - protein, 16 aa, Glycine max
  Coding DNA Sequence Number=SeqID_79239
MENCTKQSLHMAPNSK

SEQ ID NO: 170925 - protein, 58 aa, Glycine max
  Coding DNA Sequence Number=SeqID_79240
MWYHGDQLGSQCFARMLQPYGINIGLKEHSNRVTPKAYTPKSPSGPLPPDSGPTQKIF

SEQ ID NO: 170926 - protein, 41 aa, Glycine max
  Coding DNA Sequence Number=SeqID_79241
MEVEEPWLGLWLPLNYGVDMGASHHRRPELGWWVVRRADNG

SEQ ID NO: 170927 - protein, 62 aa, Glycine max
  Coding DNA Sequence Number=SeqID_79242
MGGVARGRAQLAQGKHNHGPLSLQDTGLPCSDVLCLFSTGKGRRSVSHDPILHLRPFLSTYK

SEQ ID NO: 170928 - protein, 255 aa, Glycine max
  Coding DNA Sequence Number=SeqID_79243
  Homolog annotation: Hit_ID=A4PP05; Match level="QueryCoverage=65%, HitCoverage=46%, E-value=1e-10, Identity=30%"; Hit description=IMP dehydrogenase/GMP reductase, putative
MYDQLNDASMSHSRQLGSYITLLQIYEHFPSVAESTADQDYDEASSRACRWIATKKTVKSIRTPAYKEHLDRLWIPDVCWIPYGEHREFGYTQTIPAPPVDSWVSYDDIHDRWMHYEDHIVPAGEVCVVLGVCSSDYMDWFFCISHPLMTPGHASDPLPHGHAPQPRVVHQAPQTDIPHVPEPGASSTSVEEPRHAVEICDDIAKRLERHLSLGVVTPGSSTHEVIEECLRLARSVTQDHLVYVRSRRRRRTNQA

SEQ ID NO: 170929 - protein, 76 aa, Glycine max
  Coding DNA Sequence Number=SeqID_79244
DCHHQKGGDCGSNAFQDYFDDAKESRVKQIPKFQDTRFKNQVSRIKIEDQDSRLKIQESREDSIKISTKKVFQNIE

SEQ ID NO: 170930 - protein, 287 aa, Glycine max
  Coding DNA Sequence Number=SeqID_79245
VVRTYMPHAEVPIPTSEVHYLEQAVGTFVAWPTHLVREVTNEVVVGPDKPPSRSVGEPNRLTSVATDDPLGELVKKSYVVYTKPMELAWDGAKFGLPNASNVYGFLEPQSIRCIKDTREECQKYIETWVKESHREIYLGPYFNQAHWQLLVLCPRENIIVWFCSVRRKPDVHIKFAVNNAMKKICSNLQGKDNAPPPPPQWIEAKSHVQQGAYECGYYVMHWMWCIVSADGTTLDTDTMTTIRKKWAAYFLEVGKWMSAFDMFLLGSFSPPQPSHTLVQEIIGKAPQ

SEQ ID NO: 170931 - protein, 70 aa, Glycine max
  Coding DNA Sequence Number=SeqID_79246
MKQLRRNGGDNPMIRFVRSSNSESLSELILDLEDSAMKQDNESTNLLRPRDEKLALRARDLLRKRKETCR

SEQ ID NO: 170932 - protein, 74 aa, Glycine max
  Coding DNA Sequence Number=SeqID_79247
MEEEGPSGLNEMPDLALSHPILLRTSKSSKGNIINPCIPRGYEYPQISNASDVKHPLFQPDGNFSACRKKKDLG

SEQ ID NO: 170933 - protein, 179 aa, Glycine max
  Coding DNA Sequence Number=SeqID_79248
  Homolog annotation: Hit_ID=A5AUG5; Match level="QueryCoverage=84%, HitCoverage=44%, E-value=6e-14, Identity=34%"; Hit description =Putative uncharacterized protein
MSPYEITFGKKPFNILQYLAKTSAVAAVDDMLTNREVVLAEVRRKLMKAQAIMKQHADKKRRDVHFKEGYIYLGLTENKRGYISCGSVLVEGTSTRFKENKGGYIPCGSLLATRSNKWKGLSPDDTTWEDWDQLKSAYNLEDKVLFDAGGNDRKIAEQPALREKSTRKMTTPRYLMDYI

SEQ ID NO: 170934 - protein, 114 aa, Glycine max
  Coding DNA Sequence Number=SeqID_79249
MCTDNPWVSPHVIELDHLWLAETSLARIELECLWMTKEGCERPYVVFVRHRTCRLWMMKGADNHKVCPRATRPLGHDSKIETFLRSQPEDAGIFGKGADDHIGLCVPTDSLASS

SEQ ID NO: 170935 - protein, 48 aa, Glycine max
  Coding DNA Sequence Number=SeqID_79250
MSRLKRALTGLGGPNPQRMMSMARGRALNGLGWPHFALPTPGKLRIQA

SEQ ID NO: 170936 - protein, 48 aa, Glycine max
  Coding DNA Sequence Number=SeqID_79251
MTHSQIRVMITRKNITQEEGHPDLSKSCHTCAHYSQLLPCHAIYKITP

SEQ ID NO: 170937 - protein, 224 aa, Glycine max
  Coding DNA Sequence Number=SeqID_79252
MAPRKLPTKRFRKDTTREGSSAAPQADVDFNRHRDEEFAKFQEEIARRHWAPLVSPMAKFDPEIVMLFYANAWPTEEGVRDMRSWASGFDEEVIGQLLCVPRQDFARTAARRRVSVHVAQLISDAIYPEKSNRALGFPALITGLCQFYGVPITPRPGTTAARGGPIAGSYRRTTATSRVHLYSPAEVETLYTTWLAGTSGDGDRAQEDDDMVDVMDFFLGRGEV

SEQ ID NO: 170938 - protein, 100 aa, Glycine max
  Coding DNA Sequence Number=SeqID_79253
  Subcellular localization annotation: CTP_CleavageSite=62; ConfidenceScore=5.04e-01
MSPPPLRISQSLKNSQIFLKDQNLAPFALFFAYVDFTLQALTAIQRSLPDLSSFFAKETTISLSELHTRWARIEDKPEESSSALSSVAKPLPSRLAVWSR

SEQ ID NO: 170939 - protein, 44 aa, Glycine max
  Coding DNA Sequence Number=SeqID_79254
MTTEWRRRKGDWRCHFNEKMSQEQAHHHRKPWVRAWRLNMQKKK

SEQ ID NO: 170940 - protein, 110 aa, Glycine max
  Coding DNA Sequence Number=SeqID_79255
MVAWPGTQPFLYGEDEGPTSQVPQHVEDESSEATIPKPFVVGEEVGETQVRQVVAATPERSLEATSESPAPVVDLPSSQHKADPSTPILEIPEDPTTPVLTLDTSPPTTP

SEQ ID NO: 170941 - protein, 64 aa, Glycine max
  Coding DNA Sequence Number=SeqID_79256
MVGAGRGGDDYHQLDGAQRLLLDAMNAQMQHLLDRNNEEVFGRLEFLENQANQNARRNIGGEQK

SEQ ID NO: 170942 - protein, 76 aa, Glycine max
  Coding DNA Sequence Number=SeqID_79257
MSEEVDMNVENEEDVGVKVEHVDCSHTLYFSVLHWARSVAHDIGFVVVIMRSYTNTGVATYPSAGRQGEIKKCIFS

SEQ ID NO: 170943 - protein, 158 aa, Glycine max
  Coding DNA Sequence Number=SeqID_79258
  Gene Ontology: Mol. function=oxidoreductase activity; Biological process=metabolic process
  Homolog annotation: Hit_ID=A0AXN7; Match level="QueryCoverage=89%, HitCoverage=39%, E-value=5e-53, Identity=66%"; Hit description =Alcohol dehydrogenase GroES domain protein
  Pfam annotation: Domain name=ADH_N; Domain location=27-140; Score =10.9; E_value=0.00013; Accession=PF08240.3; Description=Alcohol dehydrogenase GroES-like domai
MTMKAAVLTAFGRPLDVKNVPAPVMGTGEVIVDVVAAPVLSYTNEVLSGERKYLLPVPVIPGCGAIGKVRQTGPDSAWLKPGDWVFCDPTVRSRDNALSPEIVLQGWSARGEGGQKIQQYHLNGSLAEQIRIPTENAVPIGDISLQMRGDGVPSIRCL

SEQ ID NO: 170944 - protein, 226 aa, Glycine max
  Coding DNA Sequence Number=SeqID_79259
  Gene Ontology: Mol. function=hydrolase activity
  Homolog annotation: Hit_ID=A0GP63; Match level="QueryCoverage=91%, HitCoverage=97%, E-value=1e-39, Identity=39%"; Hit description=Metal dependent phosphohydrolase
  Pfam annotation: Domain name=HD; Domain location=47-155; Score=38.0; E_value=3.4e-08; Accession=PF01966.13; Description=HD domain
MGKTTQAIPLSRFNGELPATLAGVTIPHTRFTDGATELVASCSSAPLFNHVVRTYLFAASIGKKLGKAFDEEMLYLGCIMHDLGLTEKFIKDARFELDGADAARQYLVDNKFPEEKAEVIWDAIALHATMELPERKRPEIALVHLGAFMDGGMNANIFPLSFFEEVFEEFPQNGNKTHFIELVANVLRKKPHTAYLSFEKDIGVKMVEGFPTVNYCDIKPNYPFNR

SEQ ID NO: 170945 - protein, 63 aa, Glycine max
  Coding DNA Sequence Number=SeqID_79260
SQGFTPFACPTPDQFRAEVAWPGDWPKAQAREAPAEAPGDGEEARMDEEMTDLLDFLRGSGAT

SEQ ID NO: 170946 - protein, 181 aa, Glycine max
  Coding DNA Sequence Number=SeqID_79261
  Subcellular localization annotation: CTP_CleavageSite=75; ConfidenceScore=5.08e-01
MISYISCPILLDDRPSRWADLLFSHKGGPLGTSTYLLQRATCPRHQRTTRPRLQRVARPRLQRTTRLQLQRLQVLVVKGSCTFTFVGLHALTFRGLHILAFRGLHVLAIRDYMSPIFKGRHALTFRGLHILAIIGLHSLAFKRRHVLNFRGLHALAFRGSRVLIFSVLHTHTLEEYKVLCP

SEQ ID NO: 170947 - protein, 37 aa, Glycine max
  Coding DNA Sequence Number=SeqID_79262
HLYSKPWDWYFNWMGWTKRRGKQLPSIEFQLLFLLIQ

SEQ ID NO: 170948 - protein, 212 aa, Glycine max
  Coding DNA Sequence Number=SeqID_79263
  Homolog annotation: Hit_ID=Q6WAY6; Match level="QueryCoverage=38%, HitCoverage=14%, E-value=1e-07, Identity=39%"; Hit description =Putative uncharacterized protein
MGMRGCINYNPVLAIRHLGYPMRGAPSEEIIMPFITRGFNKANTKILQKIHKAWNKVGRKDKELRGRSNGVIGGYHKWLKPRRQGIAWLKKLKGLNGEEAEVLEESEEVQALKIELEKTKVAKEKLKVVVTRVRKKCDWLKDINMSLVEGLEQETKKARKEEWSRNKFQGALLGSSNELKLRKVERDKSRMENVMLKDKLRNCQWSKGSLKE

SEQ ID NO: 170949 - protein, 156 aa, Glycine max
  Coding DNA Sequence Number=SeqID_79264
MALRKLPTKRSRRTPPERAPTLPCKLTWTSTSTGSGAQNISSILRPSRDDALSQFLGHPLILAEDQQCEYSQRRRQVSGFDEEAIAQLLCIPGQDFARTATGRRVRIMHTSMTTLTQIWMTLQLSNILPSNHNSDLPLPTCQLVYAILTRVCMWLS

SEQ ID NO: 170950 - protein, 98 aa, Glycine max
  Coding DNA Sequence Number=SeqID_79265
  Gene Ontology: Mol. function=catalytic activity; Cellular component =chromatin; Biological process=auxin mediated signaling pathway
  Homolog annotation: Hit_ID=P33081; Match level="QueryCoverage=63%, HitCoverage=75%, E-value=6e-27, Identity=90%"; Hit description=Auxin- induced protein 15A
  Pfam annotation: Domain name=Auxin_inducible; Domain location=1-72; Score=106.8; E_value=6.5e-29; Accession=PF02519.5; Description=Auxin responsive protein
ASNAVDAPKGYLAVYVGEKMKRFVIPVSYMNQPSFQDLLTQAEEEFGYDHPMGGLTIPCSEEEGGRTIRMTDSYFMEHVSVCLSNTLYHCSDYQYIFL

SEQ ID NO: 170951 - protein, 114 aa, Glycine max
  Coding DNA Sequence Number=SeqID_79266
MYRVTSLLRLLPNTFRIVDVLVTSSFTLTKMSLTRKEHALRHPYRTRARARVMGEAEEVQEQMKADMEAMKEQMATMREAMKEQMVTMREAMMSMKKIMEANAVAVAATSVVAK

SEQ ID NO: 170952 - protein, 62 aa, Glycine max
  Coding DNA Sequence Number=SeqID_79267
MSFRTCGKAWAEQMRKMSDKENACALLVMGKVVHIGVWSLASGNRLPRVCNRLQGLKMKTES

SEQ ID NO: 170953 - protein, 314 aa, Glycine max
  Coding DNA Sequence Number=SeqID_79268
  Gene Ontology: Mol. function=catalytic activity; Cellular component =integral to membrane; Biological process=metabolic process
  Homolog annotation: Hit_ID=A7ZRL0; Match level="QueryCoverage=99%, HitCoverage=54%, E-value=1e-128, Identity=74%"; Hit description=AMP -binding enzyme
  Pfam annotation: Domain name=AMP-binding; Domain location=48-314; Score=-117.9; E_value=0.018; Accession=PF00501.19; Description=AMP -binding enzyme
MSETSSVHSLPMRYADFPTLVDALDYAALGNTGMNFYDRRNQLVTVLEYRTLQQKAISGARRLLSLKLKKGDRVALIAETSAGFGEAFFACQDAGLVAVPLAIPMGVGQRDSYTAKLKGLIASCNPAAIVSSEEWTPLIASATENTSALHILSDADFNALPEPEIALPAPSPDDIAYLQYTSGSTRFPRGVIITQRAAMANLNAISRDGIKLRAGDRCVSWLPFYHDMGLVGFLLTPVATQLSVDYLRTQDFAMRPMQWLKLIAKNRGTVSVAPPFGYDLYLRRSNAKELADLDLSSWRVAGVGAEPIPAELLG

SEQ ID NO: 170954 - protein, 213 aa, Glycine max
  Coding DNA Sequence Number=SeqID_79269
  Homolog annotation: Hit_ID=A9MTE2; Match level="QueryCoverage=49%, HitCoverage=100%, E-value=5e-39, Identity=70%"; Hit description =Putative uncharacterized protein
MAPMGRIRKPAPDPAKVIISEANSLLAGEKGVCDVGGVKAEQKEVELFQKVAGGDAQNRAGFGPGGHGGGGETPRASDRLSVTARKKVNVSHCVCKMSGCTFSLAGGPVWEIKTTDAFDNWFSSLHDADRAGVLAALMVLREKGPGLPRPYADTVKGSRYSNMKELRIQSRGEPLRAFFAFDPYRIALCFARAIKPAADREFTNWLNTLNEKE

SEQ ID NO: 170955 - protein, 203 aa, Glycine max
  Coding DNA Sequence Number=SeqID_79270
  Gene Ontology: Cellular component=flagellin-based flagellum basal body; Biological process=ciliary or flagellar motility
  Homolog annotation: Hit_ID=Q7WA82; Match level="QueryCoverage=100%, HitCoverage=100%, E-value=3e-47, Identity=54%"; Hit description =Flagellar protein FliL
  Pfam annotation: Domain name=FliL; Domain location=26-203; Score =82.8; E_value=1.1e-21; Accession=PF03748.5; Description=Flagellar basal body-associated protein FliL
MATSKPTTMPPRGPLPTRSGGIGRILRPLLMILVLLLVAAASAGATWFIAQRMQPQGGGAPVQLGVGQTGNQPGQPGAAGPQATPTTFVAPPTTPAAVPAPIFVPIEAFTVTLQNADTERIMHVGLTLRVSDEQTRIRLEKYMPEVRSRILMVLSSQSPIAVQTQQGKTDMANAIKQAVNRPFAPLPDGQYVTDVLYTAFVVQ

SEQ ID NO: 170956 - protein, 93 aa, Glycine max
  Coding DNA Sequence Number=SeqID_79271
MGKLNSSKHGKNLAKLPIISPKTQYPRKSSEKEVYPNLKFRGPTRRDALHDFENAFLSRFGAEMGTKGWSFNGVSMEDEEEENGNVRERKELF

SEQ ID NO: 170957 - protein, 289 aa, Glycine max
  Coding DNA Sequence Number=SeqID_79272
  Homolog annotation: Hit_ID=Q84VH5; Match level="QueryCoverage=100%, HitCoverage=42%, E-value=1e-118, Identity=78%"; Hit description =Envelope-like protein
MIPGSAPVPEKLVPKRQQGMKISENPSLATSPREVDTDMDKKIRSIVSSILKNASVPDADTDVPTSSTPNVSVPDADKDVPTSSTPNVSVPDADKDESTEEEDQVTEETPAPRAPEPAPGDLIDLEEVESDEEPIANKLAPGIAERLQSRKGKTPITRSGRIKTMAQKKSTPITPTTSRWSKVAIPSKKRKEISSSDSDDDVELDVLDIKRAKKSGKKVPGNVPDAPLDNISFHSIGNVERWKFVYQRRLAVERELGRDALDCKEIMDLIKAAGLLKTVTKLGDCYESL

SEQ ID NO: 170958 - protein, 117 aa, Glycine max
  Coding DNA Sequence Number=SeqID_79273
DSPQISASPHQLDFAPYASGPYNAQWNAPGLLHDKHTLHSSRILGEMEVEEPWLELWLPLNYRVDIGASQHRTPEWGWCLALVVWKVGFVVDLGMAFVDNWVVGKEKGCYWLSNDIV

SEQ ID NO: 170959 - protein, 55 aa, Glycine max
  Coding DNA Sequence Number=SeqID_79274
MEKWRTARGNLILRAPDSKGLQSRRWRTHEPALGNEFMGLRIKVENVELANFARQ

SEQ ID NO: 170960 - protein, 102 aa, Glycine max
  Coding DNA Sequence Number=SeqID_79275
MEKSDKMNFKEKKEKKGYITWEDNVINYSSDSEKKIISLGILMKDYENGEEQNNKQSSHFSPRKVNLKKSKYVIYGDKEQRPLDQQAQQVILNDTNRSLVFD

SEQ ID NO: 170961 - protein, 141 aa, Glycine max
  Coding DNA Sequence Number=SeqID_79276
MSTSSSQESFGLTTSADPDTCIRWHADIPKWQAEIPKVVIRTNTIMLPRPVRGPVACGDTLWLNVYRPRPPKGLALVIRGHSKSDSARRQHTVVRIPQLETSEPVDKQRPMWSSAPFPEMSVSSSRDREKVSLLLSRLEGL

SEQ ID NO: 170962 - protein, 121 aa, Glycine max
  Coding DNA Sequence Number=SeqID_79277
MRHQIPMIGGMMNVLSGAALFCKISHAPNIFMICVHRDSLGRNNQHENKEKGMFYSITFLDFLNSDQGLPMDPKRIKVIPEWPTPPFVEERIPEFQETMDLRLNPFQGGGNDAIPPPKGIG

SEQ ID NO: 170963 - protein, 309 aa, Glycine max
  Coding DNA Sequence Number=SeqID_79278
MKNLRRAVAAIGDVIESDDDTEDRRRLDRARVLVRTPLPPLIRSEVIVRVGELEYRVWIVEETGFEGGSNRKGSSSSDGWSEMITSDDGGEVGDVLDDTNTNFSFSSELPNQKLSPSRTQRAEGGTDVRCCDLRPLGNIQADVTPKEKSKGTVEGMLGSSFGKLNLGYSFAGTEEEAANTKEVTCYNTLQDDQRHRNHIEGKYLNGGAKVAADQTFIGEEEGHVTQSLSPSLSGQIQQGIWPGCIKGPISTPGGCNKEDIHPVELLGVQAVQNQKEGGLSNDLGPILKTDGCHKEESLPLIQSIKENPD

SEQ ID NO: 170964 - protein, 132 aa, Glycine max
  Coding DNA Sequence Number=SeqID_79279
FAKRDTQWLSARKKPEDDELSGSLSAPLQVIKHTASAHSLSERKAKLHDESRLIQRCFDDNKDDDKGDDKKGKGQSKNEFKMFKIESRTLQDSRGKLKNTSRFKRKVDFKNQDSRIKLSRIKIKIQDSRFKN

SEQ ID NO: 170965 - protein, 68 aa, Glycine max
  Coding DNA Sequence Number=SeqID_79280
MSRNFTDYATIPSSASGMLRNFMDCPIIFPFDSRHVAELHGLLNDGCQVPRSGQAKVACHQTMVPGRN

SEQ ID NO: 170966 - protein, 104 aa, Glycine max
  Coding DNA Sequence Number=SeqID_79281
  Homolog annotation: Hit_ID=Q2QSQ2; Match level="QueryCoverage=68%, HitCoverage=5%, E-value=3e-08, Identity=39%"; Hit description =Retrotransposon protein, putative, Ty1-copia subclass
MKVEGIGCVRMKLHDGINQTFSNVRFVPFVVVNIISMGEMTSQGYKYGGSKWKCKKNKSNLGYLDGQALKRNHDNKVKKKVKFSNVVEVLGDTSVGGRVCSLSN

SEQ ID NO: 170967 - protein, 71 aa, Glycine max
  Coding DNA Sequence Number=SeqID_79282
MQNAKVVIMGDIEVPPKCLAGVCHQMLAPQWHIQGEARSQLECGLGVLHVPPPWVEGPMHDQIGVVGSQWV

SEQ ID NO: 170968 - protein, 128 aa, Glycine max
  Coding DNA Sequence Number=SeqID_79283
MYKVSDGTYLCEMKEMRKNESKSAQLKLGAVAKGGSYKLVRDPNFVWGGSFAKVLILASRIELLNSSSRAIRKVKGAEGMGLDFQTLKDLVKLRRRRKNEAEALLNRIRDRFLHCSSFVNRLVFILKF

SEQ ID NO: 170969 - protein, 192 aa, Glycine max
  Coding DNA Sequence Number=SeqID_79284
MGSCAEVAAKASIEEPSVVDVATMGLYIVGDQFYDTYAPVPFPTSKIQYVREAINTFVGWPTHFVKPISDEESHNHLPKPVGVVQRCNTIEIEKPLRELIKSLFDVYQKPVELPWDGPKFGIPNVHVSLFITHVDVTEIISADCQLENFACPVDNDNEKDKYEVGENVRFQWEGQTQEQGSVDQDDTLNEYC

SEQ ID NO: 170970 - protein, 312 aa, Glycine max
  Coding DNA Sequence Number=SeqID_79285
PVCPLQGHRMCAEKGKANWEQLLAGMVGASVNWFPRWKEGGTRVLFSCKGFQNIPLMGMRGFSDPNARMLQRVRKAWIVVQRKDKDLRGSNNSVIGGYHQWLKAQTQGITWLPKLKSSSGEEAEVPKESEEVQALKAELERMRVVKEKFKTKAIRVRKECDKLRDVNGSNSELKLRRDERDESRVEIMILEDKLKACQRSKRSLTEQLSRMEENMWAIIDQYKEKLNLAANHDQRLEGEHAKVSALQAKREARERVINSLHGEVMTWMDRFAFTLNGSQELPRLLAKAKAMADVYSAPEEVHGLFDYCQHMI

SEQ ID NO: 170971 - protein, 231 aa, Glycine max
  Coding DNA Sequence Number=SeqID_79286
MAPKKLSAKRERKDAAGNGSRVAPQVDVEFYELRFWSEEHQCRFEAIKGWLFLKERRVQLREGEYAEFQEQIARRQWTQLEAPMAKYDPEIVMEFYANAWPTEEGDFARSVAGKRVQIMRTSMTTLTQNLDDPLPILWGAGHSRQAYLGPHQQGFHREILHVQVGTVAGGRPAVASRRYTATTSTAAAIPGVYLCSPAKDRASDAHDSQAPRDKDGAQEDDDMADVLDYFL

SEQ ID NO: 170972 - protein, 75 aa, Glycine max
  Coding DNA Sequence Number=SeqID_79287
  Gene Ontology: Mol. function=sequence-specific DNA binding; Cellular component=nucleus; Biological process=regulation of transcription, DNA-dependent
  Homolog annotation: Hit_ID=Q8LLR1; Match level="QueryCoverage=85%, HitCoverage=26%, E-value=2e-20, Identity=76%"; Hit description=MADS -box protein 3
  Pfam annotation: Domain name=K-box; Domain location=3-71; Score=45.4; E_value=2.1e-10; Accession=PF01486.8; Description=K-box region
MQKDSLVYNNISWYQEVSKLKAKYDSLQRTQRHLLGEDLGPLNIKELQNLKKQLERALTQARQRKVVKHVPIYKN

SEQ ID NO: 170973 - protein, 169 aa, Glycine max
  Coding DNA Sequence Number=SeqID_79288
MDGHIDVALVKEFYSNLYDTEDKSPKQMDMDVGFLISHQISQMAQSNSSRLGFPALITALCVTRGVISYSLTFESLNPAINLAYIKKNCWNLDDPTIVFLGTRKAQAQGSEGPSSSAPAPASTSAPASSDPAPSTSLPPPSVPAPFGTSTQSLDLTVQMLQSLHHGLAW

SEQ ID NO: 170974 - protein, 140 aa, Glycine max
  Coding DNA Sequence Number=SeqID_79289
MAEPLKKRKGSSSQSQRHSETQEMQIPSSISSSSLFSSEEQRIRYTNLFSFGSIIDPKFIDMDFFSNEIFECIQAFENSNLIPFMSLKLPVYTELVKAFYSNLEIQEGTLISEVYGIKMVIDQSLFYDLTQLSSEGVPFE

SEQ ID NO: 170975 - protein, 30 aa, Glycine max
  Coding DNA Sequence Number=SeqID_79290
DSMSFALSFIGLKVLAFIFHRTQSPHLYLS

SEQ ID NO: 170976 - protein, 74 aa, Glycine max
  Coding DNA Sequence Number=SeqID_79291
MGKFACCCFVKITNLKGRVESCLPISKFSKCINIGNRYMSCITASLFQVQLVVGKVLPELNRKLTGMAFCVPME

SEQ ID NO: 170977 - protein, 61 aa, Glycine max
  Coding DNA Sequence Number=SeqID_79292
MVRDGGGNAVLARHVVCEWTSMAIASQSLKPWQFTVHATNNSSHVPHASLWCCCCWWFFSM

SEQ ID NO: 170978 - protein, 199 aa, Glycine max
  Coding DNA Sequence Number=SeqID_79293
MEEKKKKLEEATQFGSTNTVIDPHLPSDGTPLGSFVAHGRQDVLTVAIGQPEHPGCVRAVGADLEQLTQQIRDQLKESITEKVTQQLMLSFNQMQSQFQSQMQSQGLILPSKPEVGPSIAHVSTKESYVDPSGNDRDTGDSDKCGLYVEESPPRLVALGRLCEGSTTVHNIPLLHDQVKVGVEEVRDVDAPIPVPNEEA

SEQ ID NO: 170979 - protein, 61 aa, Glycine max
  Coding DNA Sequence Number=SeqID_79294
MGSWIGTEEAMEQWWFVVDYSNLVAAPAMENNNTTTNNHPHHQFSSVFDGSRLQLYYGHSN

SEQ ID NO: 170980 - protein, 266 aa, Glycine max
  Coding DNA Sequence Number=SeqID_79295
MGRNMGLNLIGYSTVAMVFIIVFSWSGEHSLGLRTDAIYYKNCSTGLEGGLTYIFDYRRTMALLSIDWLVVVVVIVLIVSPSLSHGLVIIFTVVFLCPRPHPHHCVWESLATIFKPEHECLRVLISLNLKQEPCLDLCASGGKDGVTLLWDLAQEWEGNDWKHPYNVLEMQILIIKARCIRFARHPTRLVDWETLEDDKSEMCLSSVKPACPTSMLSLLALSAPTLAKRKFTNSRLASHARSASFRKLKSPRAFKTLRLAEFQGER

SEQ ID NO: 170981 - protein, 91 aa, Glycine max
  Coding DNA Sequence Number=SeqID_79296
MQSQFQSQMQSQGLALPPQPEVGPSAARVSTKETCVDPSGNDLDTGDSDRCRLYIEENPPHLVALGRLYEGSITVHNIPLLHDQVKVGVEE

SEQ ID NO: 170982 - protein, 128 aa, Glycine max
  Coding DNA Sequence Number=SeqID_79297
MRSHECPVATYPFAGERDEAWLTGALSKGGKCAELPPTFICGKRRKNRRKPVIKNIPSSGVLFTFEEGISTSHVNKSGALAPTYPPSKRKSDLRSSFLRVNQAILSTWKVIILRRWTLKMIHLLGKKN

SEQ ID NO: 170983 - protein, 160 aa, Glycine max
  Coding DNA Sequence Number=SeqID_79298
  Homolog annotation: Hit_ID=Q6WAY4; Match level="QueryCoverage=86%, HitCoverage=25%, E-value=1e-13, Identity=34%"; Hit description =Putative uncharacterized protein
MGTNQNGKRFYQVKVKSLDVTSLKELGRLMGPLQRQAFRKVYGKILDLAAAEVFMEVVVSLAQYYNQPLRCFTFGDFQMVPTIEEFEEILGCPLGGRKPYLFSGFLPSLSKIAAVIGDSAKELDRMKQTRNGIVGLPRKYLEGKARDMASQEKWSPFAIF

SEQ ID NO: 170984 - protein, 162 aa, Glycine max
  Coding DNA Sequence Number=SeqID_79299
MKGLYDCRNVPFAGERGRGSRVRFPKEERCAESPPTFIYGKRRKNRRKPVKMRILSSGVVFTFEEGISTSYVDKSGAFAPTYPPSKRKSDLREELATQLAQASSARPGEQGCFLQKQQPSGGRIWKAQSSNQMIQEYQIQHAFLVFFDADGEEGVAGSGEGG

SEQ ID NO: 170985 - protein, 123 aa, Glycine max
  Coding DNA Sequence Number=SeqID_79300
RQAQGDAPQAADVPPPHQAGPAGSFDTKQYLWHLVCQQAANHRAHVQTHDCLYQMSLSLQSQGFTSFPSPTPDQFRAEVAWPGDWPEARPGEAPAEALDEADEAREDEEMTDLLDFLGGSGAT

SEQ ID NO: 170986 - protein, 197 aa, Glycine max
  Coding DNA Sequence Number=SeqID_79301
LCSEFRASWIYYGTQSDNRVKSYCHLNLLRASVFNYERLDKLRDTIGHPKIQFSISSVSIYYGTQSDIRVKIFCRLNLLRAFVFNYERLEILLDSIGHPRTSYCRLIFLRASVFNFERLDILRDTIRHPRQKLLSFEFAQSFCFQFRASRYTTGLRIRHPSQKLLSFEFAQSFCFQFRASRYTTGHNRTSELKVIVV

SEQ ID NO: 170987 - protein, 73 aa, Glycine max
  Coding DNA Sequence Number=SeqID_79302
MTGPLNESISCFLIRVDPWVQVPSPSEGYTPSPSLGYMSSPSEGCTPLPSEGYTSSPSEDYMSSPSEGCTPWP

SEQ ID NO: 170988 - protein, 146 aa, Glycine max
  Coding DNA Sequence Number=SeqID_79303
  Gene Ontology: Biological process=transposition, DNA-mediated
  Homolog annotation: Hit_ID=Q1J7G7; Match level="QueryCoverage=22%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDQDALFNLGLPSLQKCEPINL

SEQ ID NO: 170989 - protein, 227 aa, Glycine max
  Coding DNA Sequence Number=SeqID_79304
  Homolog annotation: Hit_ID=UPI00016621D1; Match level="QueryCoverage =86%, HitCoverage=46%, E-value=1e-12, Identity=31%"; Hit description =UPI00016621D1 related cluster
MAKDNNWYLKGLHWAMRGIVHEPQVNIGADQKFPTSNVQSCEFGITGNLDESISCFPKRVDPWVLVPISFRGLHALTFRGLHVLIIRGWHALTFRGLHVLAIRGLHALTFRRLHVLTIKGLHTLTFRGLHILTFKGLHALTFKGLHALTFRGLHVLILRGLHTLALRGMLALAFRGLHVIAFKVLDVLTFRGLHILTFRGLHILRHQRAAHPHLLEDYTSLAIRGLH

SEQ ID NO: 170990 - protein, 164 aa, Glycine max
  Coding DNA Sequence Number=SeqID_79305
  Homolog annotation: Hit_ID=Q6WAY3; Match level="QueryCoverage=67%, HitCoverage=4%, E-value=2e-08, Identity=36%"; Hit description =Gag/pol polyprotein
  Subcellular localization annotation: CTP_CleavageSite=37; ConfidenceScore=5.04e-01
MAAIPTWPNFPPAQQCHRSANIDLSHYPPPSHPQSLLAAHPMSSANQNTNQEMNFAAKKPVEFTPIPVSYADLLPYLLDNSMVAITSAKVHLPPFLREYDSNATCACHGEAPGRSIEHCRALKLKVQCLIDAGWLKFEENCVLVLTLTRDATHGAILKAVVRCL

SEQ ID NO: 170991 - protein, 125 aa, Glycine max
  Coding DNA Sequence Number=SeqID_79306
MAGTNSEGLCGADELRICLRSKRSLSQQLSETETNMLAIISKYQKELNLAMTHEHKVADEYARVYAEKEARGRVIDSLHQEATMWMDRFALTLNGSQELPRLLAKVKAMVDAYSTPEEIHKLLSY

SEQ ID NO: 170992 - protein, 71 aa, Glycine max
  Coding DNA Sequence Number=SeqID_79307
IFQPTDFVGFLSNITKKTCGIKMLHNLVIQCFGKFGHICPTCIQFYHQASCLKVALPPLRGTKSNKVQINM

SEQ ID NO: 170993 - protein, 101 aa, Glycine max
  Coding DNA Sequence Number=SeqID_79308
MVLGASSPLVLVKVQHLELGNDHGLFPPQNAMVMVVGETEGSPKCFQRVYHQLLALQWHIRAKARSQLDCGGEFHVSPPWFERYVPDELGGKPYDGKACSF

SEQ ID NO: 170994 - protein, 157 aa, Glycine max
  Coding DNA Sequence Number=SeqID_79309
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=73%, E-value=2e-24, Identity=66%"; Hit description=LacZ protein
MAAPDFTYESLCIQYPDEDVPYVLKTGLIHLLPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 170995 - protein, 111 aa, Glycine max
  Coding DNA Sequence Number=SeqID_79310
MELDLRWEALNGNFSKVLLGITFRLELLSMSTLAITCSRHLTDTCKARLCPLPSVGISSSAKRNSPASLSDTSLLPQPSLPSKYPRLARGCEHATPVGYAAQPDDIGHFGR

SEQ ID NO: 170996 - protein, 92 aa, Glycine max
  Coding DNA Sequence Number=SeqID_79311
  Homolog annotation: Hit_ID=A0ST23; Match level="QueryCoverage=27%, HitCoverage=51%, E-value=3e-07, Identity=100%"; Hit description =Putative reverse transcriptase
MGDPEAQYALGCHLRVELLFPLVRVNFELGVIMVIAVSFGKPVVPAALMNRPTRGERRFAYWALAECILAYYVGTDEGVSEVLHVAREKRLH

SEQ ID NO: 170997 - protein, 56 aa, Glycine max
  Coding DNA Sequence Number=SeqID_79312
MEVEEPWLGLWLPLNYQVDMGASFLAAKFTSWLVFLVCAKGGVRHWKCGRQTLWLI

SEQ ID NO: 170998 - protein, 68 aa, Glycine max
  Coding DNA Sequence Number=SeqID_79313
MGVRGNLAGVMATIALSSRYGSKLAYDTGIWGESYRLFAAKFISWLVGFVVDLGMAFVDNWAVGKEKG

SEQ ID NO: 170999 - protein, 169 aa, Glycine max
  Coding DNA Sequence Number=SeqID_79314
MASNSQQFSARSDAIVIRGVHEVATNSSSSTETKKLEGKLDALVNLETQLAMNKKSAPVARLCGLCSSADHHTDLCPSVQQSEAIEQSKAYAANIYNRPPQPQQQNQPQQNNYDLSSSRYNPRWRNHPNLRWSNPSQQQQQQQQPYFQNAAGPSRPYVPPPIQQQQQQP

SEQ ID NO: 171000 - protein, 59 aa, Glycine max
  Coding DNA Sequence Number=SeqID_79315
MMQSYPAKALDRRLQVDWARDPTEGPRTKDQAECFDDAKGSHVSQSFIQDKEIKDIQDG

SEQ ID NO: 171001 - protein, 45 aa, Glycine max
  Coding DNA Sequence Number=SeqID_79316
MESFASQVLQGKVAEEPQLFAVSGAVAVVIVAAGLVEERMVCLGQ

SEQ ID NO: 171002 - protein, 71 aa, Glycine max
  Coding DNA Sequence Number=SeqID_79317
EAIEICPYIPTMVAENATIEKPREQWEAEERKMEYEMELMRLNQHEENDKKKKGIALKASSSIQEGSDKKI

SEQ ID NO: 171003 - protein, 260 aa, Glycine max
  Coding DNA Sequence Number=SeqID_79318
  Gene Ontology: Mol. function=DNA binding; Cellular component=nucleus; Biological process=regulation of transcription, DNA-dependent
  Homolog annotation: Hit_ID=A7PT68; Match level="QueryCoverage=30%, HitCoverage=10%, E-value=7e-29, Identity=72%"; Hit description =Chromosome chr8 scaffold_29, whole genome shotgun sequence
MVEFRNEVRLAKAAKEEHARDLPLMNGIKEVIKSVGVLDSSNLDYHEALYNLSSQVKSLQDKHNPHLELTLSTRKKISSILEHLNRKWGNSSIAAAEVMFFPYGIQRENLVNCPRWTQESTLSAADIYAMIGSPPIFCLRVTSNPDDIVIIIGNVKNRISSLFPFKFSCISHFVVWQISHKNWMMQFLGVRRQKSQIALLQCSYKDRNPVTAGRLWETSQSHVVLQECSNHVGWHRLKGELKPGDPQGLHSKESVRASPS

SEQ ID NO: 171004 - protein, 234 aa, Glycine max
  Coding DNA Sequence Number=SeqID_79319
MDQQDFRETVFGGKFGFGMKETGHKDLVGNQERELHVFQIMGKGKNSYPGSRFMVEGLRFWLKKARGRQDMTYVREEVQHVGHVLILLGAVSLSGGQSPEVLWSPGPADVECIDKNYRSVAPDPCGWPPAGQPHVIYNVPTSAGEQRWTPKVAVVRPHLPAAGRPQAVVVPGLVAPAGGVQYFSMKSLRAKRTLWAQLASIAKRSFSPLSMTRASGRAQESRPCAKHEISSLSE

SEQ ID NO: 171005 - protein, 89 aa, Glycine max
  Coding DNA Sequence Number=SeqID_79320
MAPRKLLAKRSRKDTTGEGSSTAPQADMDFDRHRFRSVEHQQRFETIKGWSFLRERRVQLRDDEFPDFQGEIARRHWAPLPKVLNLDPS

SEQ ID NO: 171006 - protein, 123 aa, Glycine max
  Coding DNA Sequence Number=SeqID_79321
MEENIMFTSAQFIEVIEMLKQQKTMLEEHQKLIADLQTEKDDAQKEHSNAMEALKWLHSLLSISIDSWLDLREKFKSTFAMKEQRWRSIKNLFDKDLRNCLHDTSHNSTRKQGLWTINSQESC

SEQ ID NO: 171007 - protein, 293 aa, Glycine max
  Coding DNA Sequence Number=SeqID_79322
MAPRRMRRKAIKKEDPRRRILPGMTMTHPMVRRRRSNFYPRTMKMMRTSLKKFNLWNMKPRNIEGADISNSSLHIISYVVFLRRTTHPVQFSFLFLVPIIDPNLSPMKLPFYPELVKAFYSKLGDFKKIPLISEVYGIKMVIDQSLFFDLTQLSSDGVPFEGSLDDEWKFDFFVFDARRMVGTNQADMAGRLLASSLAFECCIMHYLIVPSYSLDLPTLQRDGSWVKKDALVQVVEDRSPSPHSQRDDSSSLMHNILERFDGLQTYVDERITKVEEDVTIIRDCLDLPPPPSV

SEQ ID NO: 171008 - protein, 149 aa, Glycine max
  Coding DNA Sequence Number=SeqID_79323
MEGYDFGVKEGIFETFLDPTVFRVVGKGKLAEESLMTSFSDIVGDVKRGGCDRVEEEDPHVFLPHVLGLVAVVVELLVVLGLERNSVVGDGCFSSSPEEERVVVKRVLEDGVELGWDWKERGDKVVIVVVGGALELEGVGERSRFWRKE

SEQ ID NO: 171009 - protein, 320 aa, Glycine max
  Coding DNA Sequence Number=SeqID_79324
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=A9PBF4; Match level="QueryCoverage=100%, HitCoverage=100%, E-value=1e-137, Identity=79%"; Hit description =Putative uncharacterized protein
  Pfam annotation: Domain name=ATP-synt; Domain location=44-318; Score =424.7; E_value=1.3e-124; Accession=PF00231.10; Description=ATP synthase
MAMAAALRREGRRLTQPINALHSSLNSSLISQSHYVIEIEGWLSVRNRMKSVRNIQKITKAMKMVAASKLRAVQTRTENSRGLWQPFTALLGDDPSVDVKKNVVVTISSDKGLCGGINSTSVKISRVLNKLNSGPDKETKYVILGEKAKAQLLRDSKKQIALSLTELQKNPLNYTQVSVLADDILKNVEYDALRIVFNKFHSVVQFLPTVATVLSPEVIEREAESGGKLGELDSYEIEGGETKAEILQNLAEFQFSCVMYNAVLENACSEQGARMSAMDSSSRNAGDMLDRLTLTYNRTRQASITTELIEIISGASALEG

SEQ ID NO: 171010 - protein, 80 aa, Glycine max
  Coding DNA Sequence Number=SeqID_79325
MAARGGHRWLWVMEKKLGGVGEGLGEEKKEEVAVFSCCTLSVYPLNSSIVVYESQEWLDVKQYLDVLRFRGSLRGMPKVA

SEQ ID NO: 171011 - protein, 268 aa, Glycine max
  Coding DNA Sequence Number=SeqID_79326
DESRMESMVLEDKLKAFQRAKRGLTEQLSITKENMLTIIDQYKEKVNLVASHGQRLEDEHAKVSALQIEREAREKVIESLHGEAMKWMDRFAFTLNGSQELPRLLARAKAMAVTYSAPDEVHGLFNYYQHMEQMKADMEAMKDQMAAMMEAILSMKKIMEVHTAAVATTSAATEIDPSRPSSMNQNSFPPYSLPPNYAPPNVVHVPDENTDHSAPNLETTLWLTSSLTPYMPLRDHHLVACPNLTPQRSLIIARYNLYISWWEDCHLP

SEQ ID NO: 171012 - protein, 47 aa, Glycine max
  Coding DNA Sequence Number=SeqID_79327
MTTNRHPLPMSHTDPGVLSGVSIYRNLPFSGRARRNAKGASSKKESA

SEQ ID NO: 171013 - protein, 262 aa, Glycine max
  Coding DNA Sequence Number=SeqID_79328
  Gene Ontology: Mol. function=hydrolase activity
  Homolog annotation: Hit_ID=A7PGJ7; Match level="QueryCoverage=87%, HitCoverage=83%, E-value=8e-76, Identity=62%"; Hit description =Chromosome chr17 scaffold_16, whole genome shotgun sequence
  Pfam annotation: Domain name=DUF1637; Domain location=18-252; Score =326.0; E_value=6.6e-95; Accession=PF07847.3; Description=Protein of unknown function (DUF1637)
  Subcellular localization annotation: CTP_CleavageSite=41; ConfidenceScore=5.04e-01
MVFSSLRGYFSMRQQSSKVQALYDHCKTILSPSGSGTAPPSSQALMKLSSILDTIQPADVGLKEETADDDRGLGFFGANALSRVTRWAQPITYVDIHECDSFTTASALHCTAAGFHVYVSMCIFCFPTSSVIPLHDHPGMTVFSKLLYGSLHVKGYDWVEPPCIIESKGPGYGQVRLAKLAVDKVLNALCDTSVLYPKHGNLHCFAAVTPCAMLDILTPPYREEEGRSCTYYHDYPYSAFLGRDCALHHPKLACNNNNLVEL

SEQ ID NO: 171014 - protein, 488 aa, Glycine max
  Coding DNA Sequence Number=SeqID_79329
  Gene Ontology: Mol. function=phosphopyruvate hydratase activity; Cellular component=phosphopyruvate hydratase complex; Biological process=glycolysis
  Homolog annotation: Hit_ID=A9P745; Match level="QueryCoverage=94%, HitCoverage=93%, E-value=0.0, Identity=88%"; Hit description=Plastid enolase
  Pfam annotation: Domain name=Enolase_C; Domain location=198-488; Score=674.0; E_value=1.2e-199; Accession=PF00113.13; Description =Enolase, C-terminal TIM barrel domain
  Pfam annotation: Domain name=Enolase_N; Domain location=61-190; Score= 240.2; E_value=4.5e-69; Accession=PF03952.7; Description=Enolase, N -terminal domain
  Pfam module annotation: Pfam domain module=Enolase_C::Enolase_N; Domain location=198-488::61-190
  Subcellular localization annotation: CTP_CleavageSite=43; ConfidenceScore=5.81e-01
MALNLTHQPAIKAPSSSSFAASRPLRAPQSVPLRSPQRSLAVRAAATESPAPAVTAVRECKVKSVKARQIVDSRGNPTVEVDLVANGLFRSAVPSGASTGIYEALELRDGDKSVYGGKGVLNAVRNINEVLAPKLVGVDVRNQADVDAIMLEIDGTPNKSKLGANAILGVSLSVCRAGAGAKGVPLYKHIQEISGTKELVMPVPAFNVINGGSHAGNNLAMQEFMILPVGATSFAEAFRMGSEVYHVLKGIIKAKYGQDACNVGDEGGFAPNVQDNREGLVLLMDAIEKAGYTGKIKIGMDVAASEFYTKDGKYDLNFKKQPNDGAHVHSAQSLGQLYKDFVKEFPIVSIEDPFDQDDWGSWASLLSSVDIQLVGDDLLVTNPKRIAEAIQKKACNGLLLKVNQIGTVTESIQAALDSKAAGWGVMVSHRSGETEDNFIADLSVGLASGQIKTGAPCRSERLAKYNQLLRIEEELGSVQYAGEAFRSP

SEQ ID NO: 171015 - protein, 143 aa, Glycine max
  Coding DNA Sequence Number=SeqID_79330
MSEEVDMNVKNEKDAVAQEIGFVVVIIRSDINAGVRGRVSFLLIACKRSGRMTKDEKIVVADMTKGSNTEMQQLMMLLDRDQYIHWHRMKDVNVVCDLFWSNPDAGMTFFAAFAYLEGERLNNVVWALRRFRGLFMKVDALPK

SEQ ID NO: 171016 - protein, 70 aa, Glycine max
  Coding DNA Sequence Number=SeqID_79331
MAFWGETSSQTIVNSSRMHNTLQLTDDQYLDEIYYRQPFADAGHFEYSEKVIKFEIIELKTDDDVLKVLV

SEQ ID NO: 171017 - protein, 353 aa, Glycine max
  Coding DNA Sequence Number=SeqID_79332
  Gene Ontology: Mol. function=endonuclease activity; Cellular component=cytoplasm; Biological process=tRNA aminoacylation for protein translation
  Homolog annotation: Hit_ID=Q2HUP4; Match level="QueryCoverage=34%, HitCoverage=41%, E-value=7e-37, Identity=61%"; Hit description =Endonuclease/exonuclease/phosphatase
  Pfam annotation: Domain name=tRNA-synt_1c; Domain location=155-337; Score=-127.4; E_value=1e-06; Accession=PF00749.12; Description=tRNA synthetases class I (E and Q), catalytic domain
MRRRCRPPASLRRSPSTILETHDSCDGDDWRPVVAGSPSKTLPARGTTLKGKLLRSGYGSTDVVYNNQCLKGKVYYVVDRQRLPLNGWSTTSLLLKATTSKGTLLRRFQGRNVVECMALTSCLGEERRGMHGYYAVSRRRPPLTAWEKLRRCCHIIRFNRYDDTNPEAEKKEYIDHIEESVQWMGWKPFKITYTSDYFQELYELAVELIKKGHAYVDHQVSTIKSLIKDVMVRRKINFMCLQETKWTGENAKELDNSGFKLWYTGKIRSRNGVGIIVDKEWKKDVVDVRRVGDRIIVLKLVVGQDTFNVISGYAPQVGLAEHFKVKFWEDLEGVLQDIPQGEKVFLRGISMDM

SEQ ID NO: 171018 - protein, 102 aa, Glycine max
  Coding DNA Sequence Number=SeqID_79333
MEARPRPCKPPPPPQRRSDPENGPWTGIKKKYPEDPFWKEKRMAEILGWNHPSLKIPEAPIPCKMFSSTSYDQEFPSLNRKTDPVTISTKPYIIPTEVGPEG

SEQ ID NO: 171019 - protein, 172 aa, Glycine max
  Coding DNA Sequence Number=SeqID_79334
MVRTRGLGRTLGQAIGKVLGRREANDDDNDVPSDEGLPHLPERPELKLYLPMEGRWLSSGGLLQRLRALWLSANKSFDHMFPRYGRSRTNFPIPVREVTITFDEVASLLHFLIVGVFHSFEQLHVDDVVDMLVELLEVSFVEARAETIQCHGSYVRLSCLRDVYQTKIEACH

SEQ ID NO: 171020 - protein, 218 aa, Glycine max
  Coding DNA Sequence Number=SeqID_79335
  Pfam annotation: Domain name=Transposase_23; Domain location=112-166; Score=-10.2; E_value=0.015; Accession=PF03017.5; Description =TNP1ENSPM transposase
MEEKQKKRLKEAAQSGSTDTIVDPPSPIRQHDVLTTAIGRLEHPGPIHAAGACITIKNYFGPTSRGSSTSLSMSQMQSQGLALSPEVKVGPFATRVSTKESCANPSGQDPETGDSDKCGLYGSMTVNNIPLGNDQVKVGVEQVRDADAHVPIPTQEVQLVRQTLNIFLTLSTHLVKPFLEHDKQVAKGSAKPVHMPDPDEDPLYLMTLTILYLFLKLL

SEQ ID NO: 171021 - protein, 151 aa, Glycine max
  Coding DNA Sequence Number=SeqID_79336
MMNKKLKRIKEHPSQENLEQVKELKNQEEFKTQEESLQTRIKIQDLKNQDQDSRMKKRLNQDKGYIYLGLTENKRGYISCGSVLVEDTSTRFKENKGGYIPCGSLLVKGLGSSSSMDSFTSWKMNGSGMEKEERKETPLQGEDESRRSSPP

SEQ ID NO: 171022 - protein, 73 aa, Glycine max
  Coding DNA Sequence Number=SeqID_79337
  Gene Ontology: Mol. function=unfolded protein binding; Cellular component=endoplasmic reticulum lumen; Biological process=protein folding
  Homolog annotation: Hit_ID=P35016; Match level="QueryCoverage=45%, HitCoverage=4%, E-value=1e-10, Identity=90%"; Hit description =Endoplasmin homolog precursor
MNRRLEEDHRQCLKEIGVSSILVQMFEEEFLNFQNLKEYASSDNDEKKGQYSKFWNEFGKSIKLGIIEDATNR

SEQ ID NO: 171023 - protein, 225 aa, Glycine max
  Coding DNA Sequence Number=SeqID_79338
  Gene Ontology: Mol. function=hydrolase activity; Cellular component =extracellular region; Biological process=metabolic process
  Homolog annotation: Hit_ID=A7QTL4; Match level="QueryCoverage=44%, HitCoverage=23%, E-value=3e-30, Identity=55%"; Hit description =Chromosome chr11 scaffold_170, whole genome shotgun sequence
MDTWVYLDLKIPMALLPRVIYFVHLLEKYYCLSFLISVSKLISLSGSDEHLERKILDPERLSREKLEGSYNSGGNHVSNRFLNNFWYLDQLGIASCYNTKVYCRQTLIGGNYGLLNATTFAPNPDYYSAVLWHRLMGKKVLAVSSDVHIKDFYLQLENLKRNNSLLPGGSKTVEAFESLCREAQIFLPVSHSTHFLGKFSSPLLKVLVGLRCITPPAIAPKFKLT

SEQ ID NO: 171024 - protein, 140 aa, Glycine max
  Coding DNA Sequence Number=SeqID_79339
  Subcellular localization annotation: CTP_CleavageSite=29; ConfidenceScore=5.46e-01
MSINGRPKIKGTSGSSSISMMTKSTGNVKCQNFTKTSLSYPNFVWGLLLDDMQPLIGRFKILGTLCCTISKSRDTPEIKGKQVKGVHLVKRGVQIEIRPTWAFQILPPEGRCFGRKQPCSPGRAELAWVSWVASSSPNLL

SEQ ID NO: 171025 - protein, 105 aa, Glycine max
  Coding DNA Sequence Number=SeqID_79340
MIGERIRPYIRAVLLKCQPPRINPTLDLVFEGHALLYWMPWDTPVIGASCIEVVPSREGRLVDLLGFHHHHLVDDQGWILCWKIPSRIGACVRVGVAGGTRLGGK

SEQ ID NO: 171026 - protein, 112 aa, Glycine max
  Coding DNA Sequence Number=SeqID_79341
MDAVYGWLECKYYGQILCAIAEISNIHNLTFKTQPCYDNSEKGYSLACAVPPQDETSDEVTGVRANATGHSEFTARSQYTEISDKQGSGSSSASVHELARTTLYTSMLTMVA

SEQ ID NO: 171027 - protein, 115 aa, Glycine max
  Coding DNA Sequence Number=SeqID_79342
MGAKDSSFLNRDHPEVWRGHPGLAKMYLVLEWARDPRSSVLLPCLQHNLYLQCRLPPQVPEMVWQQGHKPWWRLYSIGTIWSELCMEVSKGAGVGVGGGGAGAERAEEEVSGPQS

SEQ ID NO: 171028 - protein, 87 aa, Glycine max
  Coding DNA Sequence Number=SeqID_79343
  Subcellular localization annotation: CTP_CleavageSite=76; ConfidenceScore=5.32e-01
MPLMLNKLGLSESILLSLRWPLGRGNQPPPDPRSPMIRTDSSLRVLGRDTSRTFTPGTSFRRGMLTYSLWSTTSSVGSLKGGSGIKP

SEQ ID NO: 171029 - protein, 129 aa, Glycine max
  Coding DNA Sequence Number=SeqID_79344
  Homolog annotation: Hit_ID=A7PLG7; Match level="QueryCoverage=80%, HitCoverage=27%, E-value=7e-11, Identity=39%"; Hit description =Chromosome chr7 scaffold_20, whole genome shotgun sequence
MALGDDAQHHSPSFLDALLCEERETFEEDFDENGYERETENNEPSVIKLQSLPLVLHNNDLFWEGKELVSLTAKEGEIHLCFHGVVANGALEGPRVEAVNWISKVCGHYGVVAESNRHGYHIPRVMGLG

SEQ ID NO: 171030 - protein, 247 aa, Glycine max
  Coding DNA Sequence Number=SeqID_79345
MRSDTNTGVRGKTSFMLIACERSGEYRPKKKDLLICGTHNHEMTKSFVGHPYVSRLTKDEKIVVADMTKFMALQRFPNLFMKVDAFLGVIVTDRDLALMNAMETVFPDATNMLCRFQIDKNVKAKCKTLSYFDEYLKNFEMACSCGLCLSIMCAKHGYTLNEIAAECEYVAYTGKNPSRCGCVMRTTHGLPCAYQGLCEVEVTIIGEMKTISKRFEQLDVCGKVHLKIKLWEITYLDLNYMGLPLEK

SEQ ID NO: 171031 - protein, 148 aa, Glycine max
  Coding DNA Sequence Number=SeqID_79346
MEILILILQHPLRFATQSSLWECRMMLSIGSFHSKEIACILGMRPRTNQILDDFAGIKIELKTPEEATKLIENMAASDHVIIQNRTHGWVTKWKVLWYPQQGKFGKGWYGFCRWLGLKEGDEVIFHKFHGVSMVFMLVKPIDMLSTME

SEQ ID NO: 171032 - protein, 186 aa, Glycine max
  Coding DNA Sequence Number=SeqID_79347
MEEVETRTNLKGLKNGKKERLRANWMLQHAKLWDFEWTLGLRTLALRKVFVKRIGGETCKTKDSDTQVYELGNKACICISVSSSERLRDNQCAGVFAHMFVCVGCIEGLIELGICRREVELQEGDKFVKPSSIDKCLSDVGCGNLGRLSLMCQVREVFRFDNSALFWPLEGALKIDFMFSCIGVTR

SEQ ID NO: 171033 - protein, 908 aa, Glycine max
  Coding DNA Sequence Number=SeqID_79348
MSSFLSDSAIDLGDSDSEGSIQQPLMDQEIISISGSSLENTRHGASNNESSSSEKVVEMKMSGHLPTCDVAGSPLFLLVVAGYELLASPEDSCKIVLQACKSDNFPFLKAMSGSLPFFFMHKCLFEDRFFKVLDTSVVVDGLPLMLNKDREPSFPFYWQADPTKFKSLDEDLLTLMERALFSFHLVSDPLAALDSIMNDFAWRPFMKQVRPTSGTMPPSVATFAEGGQPVVEVGLVVVGIAEIVPSAPSSILAKRKRDDSVGLFGRKKSMAPSSLRPLRQPTGLRPGVGRLSVVQDMPPTPPVVEAPTANVVVVVVALIASKVSAPTALAGSTMAPSSTVVALLLSVDVVTTSSPVAPPPSSSALIVPSSTSSQPRVSLDHIYTSNDVDFLLGMGVTACTVWRVERPKVVGATIAFVKAVRSNHQLSFKVGSVLAKLLHTRLDELFKRCKDLQEEKNNLAGRVEDVVAEKGKLAKKVADLEARAKESESMLKETELQATAEREAIKKLEDELLIFKREAMEHHEKGFNKVDLDLGLFDPFKDVKDGVLLDEYDIAAEKEADKEEQGIMGQGHIEDKCGIFNSVGSLVTHLVGLPSALRSFSPDACEEYVLSLNLMMGGFDLQSLSSDGNEDLGMGTYPPLRFEMPVELCRGLPRVGLGFCELVRITKCRAWDRPSVNLGFYEPFGGSTRELSNLGFRRRALAYMSLIVDGMYWRLNGVLLHTCHSLWVACIGDLVACCDPEWAFPVGLSHSEIFSDFTSDSPYKQSPCGWFLDFNRDHGIYVVSESGPEDDSITCLFLTVGLRMFNRGVWEAVPAYKVFLGPLAVVLVCPFPTWKGAQTVEFVRRGAWNVCKLLALPASLCEVKGVCPKCWPVLASAHHLCCKGASSCVETTNSFMEFSHDIIYLLVV

SEQ ID NO: 171034 - protein, 77 aa, Glycine max
  Coding DNA Sequence Number=SeqID_79349
MPAGLHHLDPGITPPRHPVDPEKSNRALGFQTLITGLCYGSKAFQVYFDDAKDLSQESRVKQVSRIKESFKQESRFK

SEQ ID NO: 171035 - protein, 63 aa, Glycine max
  Coding DNA Sequence Number=SeqID_79350
MELYPQHVANQQAANHRGHLGATIAWPGDRPSFQAGARPTWVPGDEDGAQEDDDMADVMDFFL

SEQ ID NO: 171036 - protein, 143 aa, Glycine max
  Coding DNA Sequence Number=SeqID_79351
  Gene Ontology: Biological process=response to stress
  Homolog annotation: Hit_ID=A7PGM8; Match level="QueryCoverage=79%, HitCoverage=53%, E-value=4e-41, Identity=70%"; Hit description =Chromosome chr17 scaffold_16, whole genome shotgun sequence
  Pfam annotation: Domain name=Usp; Domain location=2-121; Score=39.6; E_value=1.1e-08; Accession=PF00582.17; Description=Universal stress protein family
MDVKKIVVAVEDVDAARTALQWALRNIIRYGDIITLLHVYHHSTRSKSKARLLRLNGFKLALSFQDMCNNYPNTKVEIIVTEGDQEGAKIAATVREIGASMLVVGLHDSSFLYNTYYIVVSCDGWMMTYLNNVIWVLPLSPSP

SEQ ID NO: 171037 - protein, 639 aa, Glycine max
  Coding DNA Sequence Number=SeqID_79352
  Gene Ontology: Mol. function=translation initiation factor activity; Cellular component=eukaryotic translation initiation factor 2B complex; Biological process=cellular metabolic process
  Homolog annotation: Hit_ID=A7PGN1; Match level="QueryCoverage=65%, HitCoverage=99%, E-value=1e-177, Identity=75%"; Hit description =Chromosome chr17 scaffold_16, whole genome shotgun sequence
  Pfam annotation: Domain name=IF-2B; Domain location=330-623; Score =310.6; E_value=2.9e-90; Accession=PF01008.8; Description=Initiation factor 2 subunit family
  Subcellular localization annotation: CTP_CleavageSite=63; ConfidenceScore=5.19e-01
QHFHTVITAIPTRLPPMDGRRASRASAADPKVRRIGFFAPQSEPDPTPPPPNFVSVPPLRHLSAAVPVPDTGIRRQLSGDLVPIGSYNPAESLLGTSPAASSLSSSIVGVGDKEFSEDSSAAGWYRRGDSDFTGVGFDLPVVKPPGNSPAVNAKNVAGVWNYACSRDIVVSRVSAHCDLVNHCCDAMMRILSVFMLLVVLHPADGNTTVAETRRAAPSKRMWQSSQKKDGPLVMSPVATDKKSGDRPLEKERKKDAPPPRMQFDDKNRVEKAKRRAVVDQNEARNRVELFRHLPQYERWTQLPKLESKFFQLDSVHPAVFKVGMRYLAGDISGSNARCIEMLRAFQEAIIDYSTPPGKVLVRDLTAKISSYVSFFSECRPLSISMGNAIRFVKSCVAKLPLSHTESEAKAALCSDINQFINEKIILADKVIVGHAASKVRDGDVLLTYGSSCVVEMILLYAHDLGKQFRVVVVDSRPKFESRALLRRLVARGLSCTYTHINAVSYVMHEVTRVFLGASSILCNGTAYAKVGTACVAMVAHTFRVPVLICCEAYKFHERVQLDSICSNELGDPDAVAVVPGRMDVNYLDNWTNQDNLQLLNLFYDATPSDYVSAIVTDHGMIPPTSVAVIVREYGREHLI

SEQ ID NO: 171038 - protein, 683 aa, Glycine max
  Coding DNA Sequence Number=SeqID_79353
  Homolog annotation: Hit_ID=Q9LI74; Match level="QueryCoverage=73%, HitCoverage=50%, E-value=2e-30, Identity=23%"; Hit description =Similarity to pherophorin
MASASFSRQHCEIFLFFLESNIKSRSQNHMIIKVSFIVAASIAALKISQTKTSSSTKRNGSDGSHLEQEFEERENSTVNANHVIQVNEEKEIKFEMPQNLPTGEFKDLELLIDSEKMHNATKKEVLQNLVQNYKQREVNLERKLLKLNSLREEQSAIAQMQKQLEEKTETVEILKKTIGSLQSESEVFREKIREDLMLKKQLDIAKKMMNEMHRKKDVNASPVREQILMLQQQVAEFRKFNSSGGNAMGNKKLKDVQDMMVKVLELKRRNKELELEKRELVIKLATAQARIRTELNGSLRASPGTTVKLCLGNRLVVGSNSETASLHMQGKAAYNDLSPYLCIEEIGPRIKQEITGLRHVHEELSEQVERLQRNRFDMVQEVVYQRWLYTLLKFEVHDHQKQSRKASRRDSIRSQNSSKELCGKKHASISDLELESVSSNSTSNENDEIETNTFESSSSSQSSSGSTKLKRWRTTKDYSNKIWSKGRNFFIQPGPIQRFSMSMVESDVSKLESPITPKIKRVSFSDSVKLSTYEDMPETTTEDAIDDKGTKSEQIMELTSSVVNSINIDCIEKNEGAKNKIGHLGEVYSSVVSSTNIDSIEKNEGSKNKIGHSGEVYSSGVSSTNIDSIEKNEGAKNKIGHSDEVYSRNGTISRKDDRIKTILVQLHFTPQFSVWIIFRNSAI

SEQ ID NO: 171039 - protein, 118 aa, Glycine max
  Coding DNA Sequence Number=SeqID_79354
MGLHVQDGVVRVSVEKVYDGDAQVLLLASKDSQIHPKKLVEPVERSNIIVGDDPLGDLIMNLFMDEWSTRLGHGSVYGFLKPQSIHNAKDRHVECQHYIETWVKESQQEVYLGAYLNQ

SEQ ID NO: 171040 - protein, 509 aa, Glycine max
  Coding DNA Sequence Number=SeqID_79355
  Gene Ontology: Mol. function=RNA polymerase II transcription factor activity; Cellular component=transcription factor TFIIE complex; Biological process=transcription initiation from RNA polymerase II promoter
  Homolog annotation: Hit_ID=A5BBD1; Match level="QueryCoverage=38%, HitCoverage=18%, E-value=8e-48, Identity=56%"; Hit description =Putative uncharacterized protein
MYSAATAATVDVQLTGKEGEEKIYDVVRYRIHRMKKLLKDELDNKNTIEEYICTKCGKRYNALDALRLVSFEDDDFHCESCNGKLEVENDKFVAQEGGDGDENARRRRHEKLKDMLQKMESWLSLPFARTEKFVSLLIWAYRGPRYYGMLDGVFKYLGNLRKILTDGGAVLCLGPRYYGMPKSLVELGCLMEYYGVPKSHIELGCSMEYLSAWPLVFIMIQASSLEHEGGECWKATLIAAQLKPLMDQLSRVKDLPVPEFGSLLAWEARASAMGRAANGDMSGDSKMSQLGYNGAPMPYSGDTKVVVDFNGTEDIKDVKSETGSASLKVLPPWMIKSGMVLTKEQRGEAKEEIKMDGTSTSSSAQYLDDKKSTDEYIKAYYAALLKQQHELEAASKQELPNTLTANDPSSSASNRQVGMKSKLEEDDDGTEWEEAPVAVIKVTLPVATLAWCNGNDGYGGKTVVVVATDDDCSRVDNNCIGNENYKVDLNVEADDTPADDDEEVDWEEG

SEQ ID NO: 171041 - protein, 151 aa, Glycine max
  Coding DNA Sequence Number=SeqID_79356
DLLHQWIPLFLGRCMAAEWRRKRERRCHFKEKMSLEEVHHHMRPWIRAWRKKEMNEGRGREEHKILCSKRALKSEVNIQMIKVLLSNALGGTNRLRILCPNTFEGTSFVGTSTWFFKENKGGYIPCGSLACKGFYKVERNLKNRRLLGDWM

SEQ ID NO: 171042 - protein, 248 aa, Glycine max
  Coding DNA Sequence Number=SeqID_79357
MEKDEGPEAETLPRLLITYQGNSCGVYPDLSSFTGSGVIQISIACIKRSAPTQVHITLGCDMFNSVPEFGHFFHLDAAFGSFAQLVHATGGVLYRLFVNLSGHRARSMECNATSGGHAMRPAGYVLCTEAFDEGFEAVYGSWWEFIVLGQCLPLMGIGKTRHMIPSSLPKDMIASMMWLTKRSRRVVRPAMCEHIARCPGDVWHEPSTDHGEPLAFSAPPHDVASSPQWLKPLKWGFASEARPSANHG

SEQ ID NO: 171043 - protein, 140 aa, Glycine max
  Coding DNA Sequence Number=SeqID_79358
MEVLIRLAPTKPPRLGLAKTKYFQYRHGIGHNIENYWTLKDKIEELIQDGYLAQFVKRLNSHQAEARPEGQQEKKTLNELGAIVSIPYLKMKFPNLIREIVTVKGDQKQARQSYVKSLNVAPYPFTRELAKHHPTVIEGT

SEQ ID NO: 171044 - protein, 114 aa, Glycine max
  Coding DNA Sequence Number=SeqID_79359
AEFDILEASDSRTKRKLLQTVGERWRQFKSGLTRKWALAADQDGVEDIVCEKYDISKEKWAQFCQTRRDPSWEHEGTSHPEVEYCPHVLSRGGYDYLEQKLLAGKTKNKLEEAA

SEQ ID NO: 171045 - protein, 389 aa, Glycine max
  Coding DNA Sequence Number=SeqID_79360
  Gene Ontology: Mol. function=transcription factor activity; Cellular component=nucleus; Biological process=regulation of shoot development
  Homolog annotation: Hit_ID=Q1WK55; Match level="QueryCoverage=94%, HitCoverage=96%, E-value=7e-44, Identity=39%"; Hit description=CYC5
  Pfam annotation: Domain name=TCP; Domain location=106-366; Score =121.0; E_value=3.6e-33; Accession=PF03634.4; Description=TCP family transcription factor
  Pfam annotation: Domain name=Vicilin_N; Domain location=189-291; Score=-72.7; E_value=0.078; Accession=PF04702.3; Description=Vicilin N terminal region
  Pfam module annotation: Pfam domain module=TCP::Vicilin_N; Domain location=106-366::189-291
MMMMLLFNSRWRVKGRSAFYYYNSRPFFIDSESNPTSKQENNNNNCDLVPSPPPPLSFFHFPSPTFEDTQNQIFLEQRHDFLLQFYHQPLPQDPEPQPVITTMDLSVKKSDQIQRKRVPGKRDRHSKINTARGLRDRRMRLSLEVAKRFFGLQDMLNFDKASKTVEWLLNQAKVEINRLVKEKQKQQQQKKKEENDHHYYQSCSSASSECDQEGVSCLDEVVVSGDQEQQQERVEKVVKRKVKNSRKISAFDPLAKECRERARERARERTREKMRNRGVLAEESKQCGEETNQDLIQLGSWNPFETGDQESAGAKRTTTHSVAEHPSSLDVITIEAKEQSYHAAKEHDDDDDDSLVVLSKWSPSLIFNNYGFSQDKFNGVRYLPVLRIW

SEQ ID NO: 171046 - protein, 499 aa, Glycine max
  Coding DNA Sequence Number=SeqID_79361
  Gene Ontology: Mol. function=phosphoprotein phosphatase activity
  Homolog annotation: Hit_ID=Q2HTA0; Match level="QueryCoverage=97%, HitCoverage=84%, E-value=2e-27, Identity=25%"; Hit description=IMP dehydrogenase/GMP reductase, related
  Pfam annotation: Domain name=DUF1723; Domain location=159-208; Score =50.8; E_value=4.7e-12; Accession=PF08330.1; Description=Protein of unknown function (DUF1723)
MVRTRGLGHALGRVIGRALGRHDDHHADDVPQRRRPTASARRQQVVAPVAEDVPEMTEDVPEMSTDVPAPGAEGLASDGVEGSADDDAEGFPGGPRDPSMLTSFAEHVAYSIWSREEFPELKLVSHGRKVEKFGRPVPEIEGSVAAIGLTTLIASSVVISDPGVIYAFVERWHKETSSFHLPVGEQTITLDDVASLLNLPITSAFHSFEPLLVDEAVIMLVELLEVSGEEARAKNVWCHGAYVRLSWLQDIHQTRCETQQWIFVARAYLLHLCWIYEHFPSVHNCVTDDGFDEMSPRACRWLTTKAYMKGLIASPYRTRIDALSITDMCLMPYGDHRGVRAFNLISCFQGQLRWGPIVTIPPLPISATLSYDDIDDRWMHYSDHLAVSGQICLVPEQVSGDYMEWFFRISHPFMTPTQVGDQPRHPPVPQHEAYVELDIPEDACEGITERLECVLNLRIVTEGTELHEIMKDCLRIIRGVTSDGNVYVRARQRRCIDHS

SEQ ID NO: 171047 - protein, 88 aa, Glycine max
  Coding DNA Sequence Number=SeqID_79362
MALGLLIRKNFFRMKIDSRCFGDNKDDDKKPMRMISRLSQEQFKNQEKDSREVSSFQESRIKNNQDQDSRIKKRLNQDKYKKVFQNIE

SEQ ID NO: 171048 - protein, 594 aa, Glycine max
  Coding DNA Sequence Number=SeqID_79363
  Gene Ontology: Mol. function=protein binding
  Homolog annotation: Hit_ID=A7PGP2; Match level="QueryCoverage=97%, HitCoverage=88%, E-value=0.0, Identity=73%"; Hit description =Chromosome chr17 scaffold_16, whole genome shotgun sequence
  Pfam annotation: Domain name=DUF1630; Domain location=12-594; Score =919.9; E_value=1.1e-273; Accession=PF07792.3; Description=Protein of unknown function (DUF1630)
MSRSPSFSVRTEVSPSVDSESLQQWVVAFCAIRFDLEQGQLVEECYPHGCFSHDEELEIAYSSFPDSVSQHQNQNRSSIHDCIFFFRILRHLKKSLDEKGVADSSNASKFLYGYVFNRQRHDERLKRGGEQKSVVILSYSPYSSVFRPLLQIVGPLFFDIGKKALEHIAAYVSKWPAPVPGKVMDLPIGNATLKVNLPPAHSFPVEGGVSFEEGASSVAPFLPNSQPVPQGLFHDSDIFGSFRGILLQLWLLWELLLIGEPMLIIAPTPPQCCEAVASLVSLVAPLLCSVDFRPYFTIHDPVFARLNSVQEGEAFPPMILGVTNVFFLKALRNIPHIVSVGSPSPNSNRLALTTRSSTGRVSGRPEGIGFQQLKKFSPSSLLSAVRMRRDGPLCLMTEHKEAIWSTYSATTKPDTSILNRLIDAGVSPRVEESMSVVNNEILRRHFLELMTNFLAPFSPYFRTSTPSEGSSPYVDPPSLPPFNADEFLSSLSARGPGKFILKRMKSNWLDLYRRFLNGPNFMPWFQRRRAVAEQEQDRLWRLARMKTDIQQLISRLPELEIVDSFSVIERLLLREIQTVPFAERNCNIIVSVEP

SEQ ID NO: 171049 - protein, 281 aa, Glycine max
  Coding DNA Sequence Number=SeqID_79364
  Gene Ontology: Mol. function=helicase activity; Biological process =viral genome replication
  Homolog annotation: Hit_ID=Q2A9E0; Match level="QueryCoverage=86%, HitCoverage=17%, E-value=3e-56, Identity=43%"; Hit description =Putative uncharacterized protein
  Pfam annotation: Domain name=DUF889; Domain location=34-255; Score =232.3; E_value=1.1e-66; Accession=PF05970.5; Description=Eukaryotic protein of unknown function (DUF889)
MVHKYCFEALDKTLNDIMRMSNSDNAPFGGKVVVFGGNLRKILPIIPRGSRSDIMHATKNASYLWDYCTVLKLTKNVGDGKQGKGHDGCYGIELPSDFLITNFTDSIKAIVSHTYPDIQKKYKDEKFLKSKAILAATNEFIDHINDYILNIIPGEEKEYFNCDSIDITDVAATECYEAVTPEFLHSLKISRIPNHIIRLKTNTHIMLIQNLDQAEGLCNETRLIISRMTNHVIEARIIFEKKYRKFGLYSTNAIITISISLAFQDDEKTIPIYSVICHDNQ

SEQ ID NO: 171050 - protein, 121 aa, Glycine max
  Coding DNA Sequence Number=SeqID_79365
MGNEDLAMLENLSWDATQKTQKDHDGIVIPISDENPWKNRLLVKVLGAWVNFRIIEAKLQRSWTKNDTIQIIDVQDGYYQVIFTSADDYKFAFPKMEAVLLNASGGDKEGSCMDSYTQATN

SEQ ID NO: 171051 - protein, 112 aa, Glycine max
  Coding DNA Sequence Number=SeqID_79366
MVAPGIKVGHSTFMQYVWRRKKMIKVVQYVVKENVHWKSKSARKQKKKDNSSKDQKESQDQSDSMDVGSRTFETVGIEKAEDVSAIDVKEQLKKVASMKKKGDGCCCTSSYE

SEQ ID NO: 171052 - protein, 461 aa, Glycine max
  Coding DNA Sequence Number=SeqID_79367
  Gene Ontology: Mol. function=transferase activity; Cellular component= cytoplasm; Biological process=paclitaxel biosynthetic process
  Homolog annotation: Hit_ID=A7PEV2; Match level="QueryCoverage=98%, HitCoverage=97%, E-value=0.0, Identity=68%"; Hit description =Chromosome chr11 scaffold_13, whole genome shotgun sequence
  Pfam annotation: Domain name=Transferase; Domain location=16-457; Score=240.9; E_value=2.8e-69; Accession=PF02458.6; Description =Transferase family
MAPPWVQELHLNHLSIPITIAKMISVMPSRPIPVKPGDTLYLSNLDDMIGARVFTPTVYFYQSDNTSFSEKPVTKTLQCALADVLVPYYPLSGRLRETKNGKLEVFFGPDQGALIVEARSDIALAELGDLTAPNPDWEPLIFKFPDEEQYKVLEMPLVIAQVTLFRCGGFSLGLRLCHCICDGMGAMQFLGAWAATARTGTLVTDPEPCWDREIFKPRDPPEVKFPHMEFMTIEEGSNLTMSLWQTKPVQKCYRIKREFQNRVKDLAQPYDAAGCTTFDAMAAHIWRSWVKALDVRPLDYQLRLTFSVNARQKLQNPPLREGFYGNVVCVACTASSVSELVHGKLPQTTLLVRKARQSVSEEYLRSTVDFVEVDRPRQLEFGGKLTITQWTRFSIYKCADFGWGKPLYAGPIDLTPTPQVCVFLPEGEADCTCGSMIVCICLPESAAQKFTQALQLLDSVS

SEQ ID NO: 171053 - protein, 306 aa, Glycine max
  Coding DNA Sequence Number=SeqID_79368
MCAQREKSNLEEHMPNIWSFLKPFEPPCALNAHMQALVLIIGKCFNAKNLKELLSNPYLGMKWCWSALFMHFSKGLGVKSSELGSFTRGIMLKTRFLLNNLNPHGHTQQASTTIAFLSANSIFHYAYEWFKMRHLWRSITWQTKTVKTIIKEAIIKVVTFLKIKGQGCKSLSRNKFNKDQGVPSYRPPNQGLNLYERTTKLEDTLTQFMQVSISNHKSTESAIKKLEMQVGQLSKQPAEKSNGKFVANTEQNPKEQCKEVLTRSKRMKGLVSDELVEGIVEDVSDDDEVEERERKRAENKEKKNKS

SEQ ID NO: 171054 - protein, 111 aa, Glycine max
  Coding DNA Sequence Number=SeqID_79369
MAPKKLLSKRARKDAAGEGSSAAPQVDMKFDGHRFQSEEHQHHFEAIKGLSFLKERRVQLREEEFVEFQEEIDKRQWTQLAVPMAKYDPEIFMEFYVNTWPMEEGVRDKCY

SEQ ID NO: 171055 - protein, 111 aa, Glycine max
  Coding DNA Sequence Number=SeqID_79370
MWYIVRDFNDVKCEDERKGGLEHSRQEEIQAFEELMEEAKAMNSSIVGMRFTCYRDDGSTRGRDIHDSSVSALATLALEGLWIVLPHREANLVHKDRQEKDARSDITLRAT

SEQ ID NO: 171056 - protein, 124 aa, Glycine max
  Coding DNA Sequence Number=SeqID_79371
MVQNRNSFPYGLPPNYTPPNVVHVPNENANHSVLIPLDGQQPQLGHAPFAQPVGEAREEPRDHALGEFEPYPTYAAEGPTFSEMEKLDLIKEMLRAIEGIGDYPFTNMAELCLVPDVIIPPKFK

SEQ ID NO: 171057 - protein, 79 aa, Glycine max
  Coding DNA Sequence Number=SeqID_79372
MNETLDVSISFLNDHLEETLGPTKIEENHSKCINLTQVYGKLGFWLKACRTAGHDICQGLASGLGIKGMFHIISMIHMQ

SEQ ID NO: 171058 - protein, 153 aa, Glycine max
  Coding DNA Sequence Number=SeqID_79373
MVLDVQQRRHHGVVFMVIANHQRKNNKRKGRRERNLLESRWWGHNIETVVVEILRRGAMQILLITHRSFIGTPLADAKQPANENTKSELVGVASFLVHFIKQFKCVVEGVRFAKGIDEEGLVDVTLLGEDLDMKVMEFMVHVGAGEHAGCDGD

SEQ ID NO: 171059 - protein, 132 aa, Glycine max
  Coding DNA Sequence Number=SeqID_79374
MENLRKENATFKEQYLKLQEDQNANLDYEGTTPTWMKDVNHALIVTMDSWTQTNTVLVYSFAEKLNRLIGDAYRAFWSLVLVSLSPNLRLELKGRAYYNDYGSKVRMLLEQPIMYVEQQEIGVIVGYLRLNI

SEQ ID NO: 171060 - protein, 176 aa, Glycine max
  Coding DNA Sequence Number=SeqID_79375
MVFSKATNLLCRFHIDKNVKAKCKTLVAQKNAWDYVMEAWGSLVECPCESSFDEVESAHWSLKRLLQNSDDDICSVWEEMNNMMTLQHTQIKASLRQARTWLGMCLNFSDQGLCETQETITEEMETILKCFKQLDVCGKVHLKSKLQEITYPDMNSMCPPPEKVKTKGAPKKPLTK

SEQ ID NO: 171061 - protein, 96 aa, Glycine max
  Coding DNA Sequence Number=SeqID_79376
MKKWGALSKLGQILVIAQMGAVFYVAAVEYFMQIASMNNATLRHATRGCVASTTGDNSDVATCNGALAMQGGVAGQTSASLRVATAFAGAAVKVQH

SEQ ID NO: 171062 - protein, 140 aa, Glycine max
  Coding DNA Sequence Number=SeqID_79377
MYIKVEGVTSSAFVRVDFYSPMCDHKSQELASANPKSTFFRVEAHVIFTELFEDLFLSAMCWAMLRLDDYVVDIDLDVSSDLLLENLVHQSLIATPEACQGNDDIGSIPFTSNALDNDQGLSLDRNDLVRPIVDGKPVVP

SEQ ID NO: 171063 - protein, 70 aa, Glycine max
  Coding DNA Sequence Number=SeqID_79378
  Subcellular localization annotation: CTP_CleavageSite=43; ConfidenceScore=5.02e-01
MQRKPTESSSGPCARDSISLRAYGKKNSLTKSKKWTNQGKSCHASSNKEIQHKGSTMSLSTRQPRMASLR

SEQ ID NO: 171064 - protein, 182 aa, Glycine max
  Coding DNA Sequence Number=SeqID_79379
  Homolog annotation: Hit_ID=Q9SB56; Match level="QueryCoverage=17%, HitCoverage=2%, E-value=5e-07, Identity=84%"; Hit description =Putative uncharacterized protein F22K18.190
MSCLMINDIDVGLGRFELLYTIVCLYSHYNNRYNNHYNNRYNNHYNNRYNNRYNNRTSTTITATRMITTPMTGGVDRKELFHLYLVWIQDKCLSLLESCKLDKDFIIFPLMHSMVNFLEFGYDPCFMVLCIGYLHVHREKTSKMELFIISGAACLPHPSNVPSILQYHDSFGSVNRNENEAC

SEQ ID NO: 171065 - protein, 92 aa, Glycine max
  Coding DNA Sequence Number=SeqID_79380
MEGVKVKALLHREMQMYSLHIDGIILLPTSFLRHRRERREYRQGKIFFPNPLGCRKLDFLFLFLIILPFLNESTRAYLSNELRNMLMQQLKT

SEQ ID NO: 171066 - protein, 313 aa, Glycine max
  Coding DNA Sequence Number=SeqID_79381
  Gene Ontology: Mol. function=nucleic acid binding; Cellular component= intracellular; Biological process=transport
  Homolog annotation: Hit_ID=A7P2E8; Match level="QueryCoverage=47%, HitCoverage=41%, E-value=2e-23, Identity=41%"; Hit description =Chromosome chr1 scaffold_5, whole genome shotgun sequence
  Pfam annotation: Domain name=DUF1675; Domain location=71-307; Score =71.9; E_value=2.2e-18; Accession=PF07897.2; Description=Protein of unknown function (DUF1675)
MAKERCRRRVVPAKCRETKHKCTVTVDDVNQPLSPLITTETFKGVVVLKDSFFDPWFQWRCYNEKEYKSKKIDLTLKLSPCGENAEEKERGLRRSSSSSLVVVGVANGAQWGTSLGRSCSLPAERQRRVAALSPQVLAWVAASSAVNVNNTSSSLHKPNPLPSSSQDSGLQGNQFLSLMSSSSAKGVALNIQTSTKEENDSKASHKTIAKAISPRPADSKPENPAKKHKLGNYCSLKGDVMEILRQMPSVTTTGDGPNGKRIEGFLYKYRSGQVCIVCVCHGNFLTPAEFVMHAGGKEVANPMKHITVLSNSF

SEQ ID NO: 171067 - protein, 515 aa, Glycine max
  Coding DNA Sequence Number=SeqID_79382
  Gene Ontology: Mol. function=transferase activity, transferring glycosyl groups; Cellular component=integral to membrane; Biological process=cell wall organization and biogenesis
  Homolog annotation: Hit_ID=O48946; Match level="QueryCoverage=11%, HitCoverage=6%, E-value=6e-17, Identity=64%"; Hit description =Cellulose synthase A catalytic subunit 1 [UDP-forming]
  Pfam annotation: Domain name=Transposase_23; Domain location=156-221; Score=-7.5; E_value=0.0078; Accession=PF03017.5; Description =TNP1ENSPM transposase
MARTKQYGQMTSKAAKEISDKISTHGSFVPSRRDDIFNIAIRRPEHSGQVHVAGTSVTISQYFGPASHGSTTSSNSITPHQLAEIIGKKCTMDTIKEELKQEIKLELSQIASQHSPSLQAHDIQVLAASVSSKGSCAAPKTNAIGKKASDMHGDSVGLHVIAEKSTKLVALGKLYDTFGTIHNVPYADDVVRVSVVKVYDGDAQVPFPTSEIKFVRVAVGTFVGWPTHLVKPISNEDLEKPVTTPFKIVAEDKALVPVDPLGELVKNLFEIYQKPIELSWDGAKFGIDNVKDGFFITHANVSEIILGDKCLNISLLQLWLTAHWQLLVMCPRDNLVVWFCSLRKKPDAAIKAAVNSVMKTLSKSTEGNPYQPVPQWIEPKTENEAFKVRMNALIAKAQKMPEEGWTMQAGTRVFLGHIGGLDTDGNELPRLVYVSRARLRIQCILGQSHSHDHRRLRCILRWVCPGGHVHMPDVKFCAFYDGPFQPSLIWSQLFTTSETTTIVNQRKMPSITDVE

SEQ ID NO: 171068 - protein, 75 aa, Glycine max
  Coding DNA Sequence Number=SeqID_79383
MSLRICNSAPRAEFHATRPTMGNAVKVQPPSVVIQQRFKLLFANEQDAKNLRWHVDERRIGTGQTSCKLYTMEDI

SEQ ID NO: 171069 - protein, 140 aa, Glycine max
  Coding DNA Sequence Number=SeqID_79384
MTITLDDVASLLHLPIIGAFHSFKPLHISEVVLLLVELLKVNKAEARAKTIYEHFPSIASCIVAEDFDERKSRAYRWKSGKALPVSMYCQICVALIQYAADYIKWFYMISHPFMSPAQPRDPPRHPPIMRDDTFIEPDIP

SEQ ID NO: 171070 - protein, 744 aa, Glycine max
  Coding DNA Sequence Number=SeqID_79385
  Homolog annotation: Hit_ID=A7QHZ7; Match level="QueryCoverage=18%, HitCoverage=21%, E-value=6e-43, Identity=60%"; Hit description =Chromosome chr17 scaffold_101, whole genome shotgun sequence
MDVVNDLHMGPPATTNLGGSTSTDDVNSSQKQKIVRKKTQGKSVECEGPDFSLDKSSPKTDATIKHPLHESPALPNFLSCQIIVEYSTENEKSKRQKTTHNAIEGNVNGCGTPEGIFSPKASTPALDMPSEHPIQCFSNDLITSQSCVEVGICQGHNEEKKQNMINTTAENSNSQQGIPEESCNHISFAASHEPFAKECVSEVVKLNTEHGINDNIPNREDKNDFEKNTSLVKKNVDDSLDYGLCDKNLCVKTYARRKMVNSSCWRNSGSPSPENCNKEPTIQDHQKDDSHKFSDGPLRVCLMDGETKLSIDQVTSQSGAAAEEIKLSTDNINEQRFMTTSSAVDIPSEHLKTDGRPLDHTEITRNDLCCADEEIELSTDNIKEQRFMATSSAVDIPVEQLKTSCRKLDNTEITRNDLCCAGDVSDLSLDTVRDGHLKISQFSLDRNFAGNQKNKLLILDLNGLLADFVSISDTDTPFRRYRREPEPDFVLRGKKGDMVKCLVSSFQISYLALAQIWLICYSFLLQSTRGPFVTIFYSFALTHFMWEYGRLDPRAMLMHQSNFLWGNLQPNCSFVGYKVGLVVGKGGLKGEGREGRGRSRNQSHCTKTKFSTVENIDKPLVLKEIRKLWEKAEPDLPWEKGEFNESNTLLLDDSPYKALMNPRHSAIFPYSYRYYHTRDSELGREGDLRVYLKGLAKAENVQNYVSENPFGQRPIREANPSWGYYRRVIESLQRSQNDGPSLPR

SEQ ID NO: 171071 - protein, 380 aa, Glycine max
  Coding DNA Sequence Number=SeqID_79386
  Gene Ontology: Mol. function=phosphoprotein phosphatase activity
  Homolog annotation: Hit_ID=A5C0F5; Match level="QueryCoverage=32%, HitCoverage=19%, E-value=4e-18, Identity=36%"; Hit description =Putative uncharacterized protein
MQHVCMGTCRACLFIQRDVQRHRLQNKINRRWLRRGNQHIDNDDLIVFRHKLGIMKRHEFLWEPYTTTVMSMLSPICLVGSVVWCAVVPLICFHVVEWHQPDRVLRQFGMQQPIPESPSQPQNIHGLMLKGKQDENWFQLLAAMISQWNNRAEFRGEVAETLQYMVSPKGRNTWTVNDPMPYVEKITILSEEQERITEPMAHGPTSERRFPPQQFHMLQSSVETRGFDRRREIVQAEDFSQQMQQRGHGMYYTPLTFSQYPSQMYQYPFEGHDTDMSASEHSFGGVAETHPHFSWPTMTPSQQHDAPMATPNAPLAPQWDVLGAIPDMGDLLGVDLRHEFSAEAEQQGRRQCARRNPNRQARRWDRPYGTSSHHHGHHND

SEQ ID NO: 171072 - protein, 30 aa, Glycine max
  Coding DNA Sequence Number=SeqID_79387
MAHKFCFEALDQSLRDIIKAKSSPGKIFGD

SEQ ID NO: 171073 - protein, 369 aa, Glycine max
  Coding DNA Sequence Number=SeqID_79388
  Homolog annotation: Hit_ID=Q9C6A4; Match level="QueryCoverage=45%, HitCoverage=26%, E-value=2e-25, Identity=42%"; Hit description =Putative uncharacterized protein F9E11.8
VATTPNGPSARFSVAGDCLDPYMSGVLVFVGGCNRNLEALDDMYYLYTGIARENEQRPEKLSLKKQLKRKCLEQNPNLVRNPVMCGYGVGAASNQPMEILNCSQPSRLNIPVNQSLLPGKKMFQAQVKEKNSAGYTIETVIDGKPLHGVLFKNQPNTLIPVPNTSSSPASNGIHSQNVTAYKVLGQDRMQDKRELRGESSESHECHKDADTIVVSSNPTTVAESFKDICTKVFPLFPEMVGVNKRSPPVALHESNPKFELLSPSWCLVSVNPEPEAVSLNRNGDEKNDTPKSLIESLKNDGSNDVTSSKGEIQIGVQINVPVSNYEIPTQMSDAPNCNADVLKPAAAEIIVCLPNEAYCNISSCDFLDG

SEQ ID NO: 171074 - protein, 199 aa, Glycine max
  Coding DNA Sequence Number=SeqID_79389
  Gene Ontology: Mol. function=metal ion binding; Cellular component =intracellular; Biological process=signal transduction
  Homolog annotation: Hit_ID=Q9C6A4; Match level="QueryCoverage=100%, HitCoverage=57%, E-value=2e-80, Identity=47%"; Hit description =Putative uncharacterized protein F9E11.8
  Pfam annotation: Domain name=Kelch_1; Domain location=109-160; Score =21.1; E_value=0.004; Accession=PF01344.16; Description=Kelch motif
  Pfam annotation: Domain name=Kelch_1; Domain location=59-104; Score =32.3; E_value=1.8e-06; Accession=PF01344.16; Description=Kelch motif
  Pfam annotation: Domain name=Kelch_2; Domain location=109-160; Score =22.0; E_value=0.0023; Accession=PF07646.6; Description=Kelch motif
  Pfam annotation: Domain name=Kelch_2; Domain location=165-198; Score =10.2; E_value=2.6; Accession=PF07646.6; Description=Kelch motif
  Pfam annotation: Domain name=Kelch_2; Domain location=59-104; Score =31.5; E_value=3.1e-06; Accession=PF07646.6; Description=Kelch motif
  Pfam module annotation: Pfam domain module=Kelch_1::Kelch_1::Kelch _2::Kelch_2::Kelch_2; Domain location=109-160::59-104::109-160::165 -198::59-104
MRWEKVEGIGREEGPGKRWGHTCNAVKDGRLLYLFGGYGKFNLKQSWSEPAIKGPPPTPRDSHSCTVIGDNLFVFGGTDGTKLLNDLQILDTSSNTWVFPTVRGEAPDAREGHDAALVGKRLFVFGGCGKSADNINEVYYNDLYILNTELFVWNRATTSGTPPSPRDGHTCSSWRNKIIVIGGEDENDSYLSDVHILDT

SEQ ID NO: 171075 - protein, 113 aa, Glycine max
  Coding DNA Sequence Number=SeqID_79390
MVTQTPATRTHPGCFGHPVVVQQLQGRLIEAEVEGEAVKATSTVLCKNDLTLVWQDDTAATTGVEIECEVVRADDTDSLDSERLRHREIARGKRLKRGQHSRGFLKWLETMSF

SEQ ID NO: 171076 - protein, 98 aa, Glycine max
  Coding DNA Sequence Number=SeqID_79391
MVRWMTLKNLVLEDIGTQHFDRKCHKGGIVGDSGDNDSGGDTNGGGGGASYGDDNNHDGDGGCGVVVLMMVTMMAVVVEVVVMLVTTKIIIVKCVFLN

SEQ ID NO: 171077 - protein, 246 aa, Glycine max
  Coding DNA Sequence Number=SeqID_79392
  Homolog annotation: Hit_ID=A7UQU7; Match level="QueryCoverage=58%, HitCoverage=25%, E-value=1e-14, Identity=37%"; Hit description=IMP dehydrogenase/GMP reductase, putative
  Pfam annotation: Domain name=DUF1723; Domain location=126-175; Score =45.2; E_value=2.3e-10; Accession=PF08330.1; Description=Protein of unknown function (DUF1723)
MMIPMMFCSVDGLRNPHAGNEYLSLLRTMSQWSCDRGHWADAPADTGAQAAEDEPEGFLGGPRDPSVLIEYADHVAGIVWIGEERPKLKLSSHERKVHSLGRPVPAIEGLVAGTGLSPLIACSIYTGDRGLLSSFIERSHQETSSFHLPVGEVTITLDDVAYLLHFPVVGDFHAFQPVHVDDAVQMLVELLIVPAEAARVETAQCRGPQAGRYAWGVVVLVHMYDHLNDASISTSRQLGGYITLLQ

SEQ ID NO: 171078 - protein, 128 aa, Glycine max
  Coding DNA Sequence Number=SeqID_79393
  Homolog annotation: Hit_ID=A7QHZ2; Match level="QueryCoverage=41%, HitCoverage=11%, E-value=1e-10, Identity=62%"; Hit description =Chromosome chr17 scaffold_101, whole genome shotgun sequence
MLGAPSNTPSRLRFYNLYVKLYLECEKIYGRLKGCGGEVRRKHPVGLWKLFKSEKFLKESDLNTKEGLSLCGSEIVKGFYKTVEISSGLLEDGMIELESMALLKLSPGQTHEHFGIDVNTLELNIKIL

SEQ ID NO: 171079 - protein, 277 aa, Glycine max
  Coding DNA Sequence Number=SeqID_79394
  Gene Ontology: Mol. function=nucleotide binding; Biological process =defense response
  Homolog annotation: Hit_ID=A7Q3H0; Match level="QueryCoverage=69%, HitCoverage=51%, E-value=2e-40, Identity=46%"; Hit description =Chromosome chr13 scaffold_48, whole genome shotgun sequence
MPQAIVNFVVQSLGDLLIQEGIFLYRLEDKVLQLQTDLRMMRSYVQVADRKQDGNESLRNWISEIKETAYDSNDVIESYALRGASRRNLTGVLSLIKRYALNINKFIETHKVGSHVDNVIARISSLTRSLETYGIRPEEGEASNSMHGKQRSLSSYSHVIEEDIIGVQDDVRILELCLVDPNKGYRVVAICGMRAINNGSNGRRNLTSMKNGRMELAEEEETLAGRQRKKKWLAGEHQQQPREGEEEPAAARAEEGRRTVLAEEGNEEGSGMHPLWI
